United States Patent 8,067,671 (METHODS FOR GENETIC CONTROL OF PLANT PEST INFESTATION AND COMPOSITIONS THEREOF) - sequence listing, part 29

SEQ ID NO: 45335 - DNA, 991 bp, Heterodera glycines
  misc_feature (49)..(49): n is a, c, g, or t
  misc_feature (60)..(60): n is a, c, g, or t
  misc_feature (96)..(96): n is a, c, g, or t
  misc_feature (156)..(156): n is a, c, g, or t
aattagcaaaaaaatatgagtgatcgaattttcactaaaaagttaagcntaaacttttgncctgttaaaagggaattaaaatttttaaaatttatntcatctccttttttgatagaaaaagcatcagagtgcctaaactagcatgtaaataaaatntggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttgacctgtttaaaaaggaattaaaaatttttaaaaattttattcatctccctttttgatagaaaaagcatcagagtgcctaaactaacatgtaaataaaatttggtgcgtttcagaaccctttctgaaaaaaatatttaagaattaattatgcaaaaaataaataaataacgaaactctcagattttcgaaaatttttttgagccagctagctcggcgcttcatttcagtgtaagttagtcctttaccggggagtatccctgcaaagtttggtacgcttctgctcaattagcaaaaaatatgagtgatcgaattttcactaaaaagttaagcctaaactttttggcctgtttaaaaaggaattaaaaatttttaaaaattttattcatctccctttttgatagaaaaagcatcagagtgcctaaacta

SEQ ID NO: 45336 - DNA, 577 bp, Heterodera glycines
tcccacccttattgttatattttcctcttttagatgaaaataaggcattacccccaaatcggaacatttcttagaaataagaacataaagaaatcctgtattaatcagaaataaaataaattaaaggaaaacgttagccggagtcggtcacgtgggcgggagtctgaatcgcggaggcgggggtgaggccagaaaacctgtcccgcccccggcgggggcggggctcgaaccctagtattttaacgtcctcaccttaacacaaaacacttttagcgcccaaacgccagcgcccaaacggccgcgcccaaacgccagcgcccaaacggccgcgcccaaacgtgtgggtcccctttaaatgagagaaaatgggatcgacaaaagagataaaaagagaaaagttatttgatttgagtcttttatgcattttctaattgcctttgattgttgggcaaatcggtgacccaaaaagacaggcacaaactgctgcaggcgaaagaaagagttgggaaaagggcagaaatgagataaaaatgataactgattatataataaataaaaaaagtacataaaaatatga

SEQ ID NO: 45337 - DNA, 725 bp, Heterodera glycines
cctctcacgctcgagcgcttttgtaacgtataaaatttctcaaaataagagatagtcatttttcttggatataagataaatttaaaaattctctgtgaaattaaatggcgattgcgcgccgcacttcctatcatgctcgagagcatttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgtgaaaattaatggcgattgcgcaccgcacttcctatcatgctcgagagcatttgtaacgtataaaatttctcaaaataagagatagtcatttttcttggatataagataatttaaaaattctctga

SEQ ID NO: 45338 - DNA, 1364 bp, Heterodera glycines
  misc_feature (1277)..(1277): n is a, c, g, or t
  misc_feature (1330)..(1330): n is a, c, g, or t
gtcgtttcctaaaaaccgccaagtgggcgtttcctaaaaaccgccaaatgggcgtttcctaaaaaccgccaaatgggcgtttcctaaaaaccgccaaatgggcgtttcctaaaaaccgccaaatgggcgtttcctaaaaaccgccaagtgggcgtttcctaaaaaccgccaaatgggcgtttcctaaaaaccgtcaagtgggcgtttcctaaaaaccgccaaatgggcgtttcctaaaaaccgccaaatgggcgtttcctaaaaaccgccaaatgggcgtttcctaaaaaccgccaaatgggcgtttcctaaaaaccgccaaatgggcgtttcctaaaaaccgccaaatgggcgtttcctaaaaaccgtcaagtgggcgtttcctaaaaaccgccaaatgggcgtttcctaaaaaccgccaaatgggcgtttcctaaaaaccgccacccgaagtgaattaaagacaataaatataaaaaatagttattgttatacaacatttataataaattaatataaatctctgtattttttaaaagtttcttattctttaaagtgttcaccaaaaacatgaactgtcaagcataacaacgtctaaaaaatatactatttaaaatacaaaataaatacagacttttgttaatgaacattcagcactttcatacaaacatttgcaaaagtttttgtcgcaatcgtatcgttttatagatttgtttatatagcataaagcatggtaataacagcaatcatcgactatattattaaaaaatgtataataaatttaaaatactttattaaaccttttttaaagttgcaaaaccatattactggtgctataaagcatgagtcaaaaaatgaagtgccacaataagtgccacaatatttctttgcaactttcaaagggaaattctaattataataagaaaaaaaataaaaaaataattaatttatcttttgtggttttcttattagttcataatgaccgtcatgaaagtataaaaatattgatgcagtcgattccttttgttggaggttcgaaagctaaaaattatatgaatttgcatattggaaatatttctaaccgatgtttctaaatctggtgagtacacttgccaacggaaaattttttatacgttcacacacaattatatttattcgaaacattttggtgactgctgctagatccaaattattgatccatttttcaatttcatgggcgcctattgcaggagcaatagcattctctatgtgttacttggcgagttttaggaaacgcnccatggtggcggtttttacgaaacgcccacttggcggtttttaggaaacgccncatggtggcggtttttaggaaacgacctagcacc

SEQ ID NO: 45339 - DNA, 1580 bp, Heterodera glycines
ttaggcgaattgagcactgcgagacattgagtttttggcataattttttagataatcagtaaaaataaatttatatttaatagaaaatataaaaataaataacaatatattaagtaccaaggaattattttattatacttatctataaaaacttaatcaaaaaaagaagcacattttaaaaatatataaatacattaacaatttgccaaaaatttttgaatcataacaaaaataaaatggttgtccttgcataaaaacataaattttatgaatttatgtgaatttactaaaaaaggaaaaaaaataatttaaaaaaattaatggctcttgttcgaatggatgacggacatggtcatgaggttatttgtaaaagggtcttaactaatttttattgatttttttatccattaaaattttgcagaattattaaatactcagcaatgagcggtgcagtgccatttttaaaaaataaaatcattaatacaagagttcaattaaaattattcagcctaatgtaatcagaaaagtacacttaattcaaattaaattcattcaccttaaggacttacttaaattttttaattaaaatttaaacgaatattactaaattttagtaatttagcccttttattgatcaacgattaaaaatcacaaaaattagatttaatcctgatcaaaataaaaaaaatgatataataaaaaccaaaagataaaaaatataaattgaatctagaataaaaaacaattttataatttttcaataaaatattaatgaataataattaaaaaataaatgtaacccaatccttacattttgtcttccaatatatgtctttataattaaaaatacgatatataaaaatatattactaattaaaatatatcattttatttgcaaaaataaaagttaaataatcattttgaatttaaacaaataaaaagtaacgattggtacagatgccgaaaaaacaatagatctcatcatttgtattcccgaacaataatttaaagtgaataaatgtgaataaaatagcatgaaaatataaaagattgctcaacttgataaaaaacatttcgaaaactcataatctaagtaaatatattttgaataattgaattttaaaagtatttaacagcaggcaataagtaaatcctaatcaatattgtaattaacgaattttaaaaataaaaaaatcttaatataactaatacacaggcgctcaaaaaagaacccatgcacaattaagaaatcgacaacatatattaacttagcttaaaattattagcatgaaatgtatacatataaatataaattcaataaaaaattatagataataataataaaaatgtctatgaaaataggtaataaaaattgtttaacaaaaaatcaatggccactttttctttatttccccccccccccccgtttttcgtctcagtcgttcttttgcacaaaagtgaacaaattgattttctattttacacattcagatccccattttttggtctttgagaattgaaataattaaaagttaattaaaccaaaattaataatgtattcaaataataatagggtcaat

SEQ ID NO: 45340 - DNA, 987 bp, Heterodera glycines
ggattgtatgggatgaaaaaagatgttagaattttctttaatttttgaaaatttctaaaaaatggtaaaacgaccattttggtaatttgacttatttaggtagttaaaagaatttgcacaattcttatataattttattgaatgtgttttatttagcaaatttcttttcaaattttgaaaaagtttataaaaatgtgtttttatttaggtcgctgattaatttatgctaataccccattctttcaagttcttattttcaatcccgatccaacaagaattgcaaagtcgggatcatgacttgagtttttgaaaaaccaggactggaacctaaaaatcttgattcggggccaatcccggtcggtatctcgatccaatgtggctctttttttaaacaaaaaatggattacagtatttagacttaaaaaggaagcactcagaaacttcatagtgaaaataatgagaggagaagaaaaacacattggaaaaaatataaaagaaattgaacaaaatatcgtaaattatcaagagaagataatgaattttggcgaagaagtaaatctcaatctcaactttaaagaaggtaattatttagataatttttttaatgaaaaaattcttttttttttaaagtttttttcagaaatcctaaaatttattttgccttctttgattgctgaatgtattacatccaacttattatacggaaaaaagatcgaatggaaaatgttggaaatggcacttgagaaaattgggaaaaaagaattatgggaagaaattgaaaagatttacaatgaatggaagacaaaatttgaaaagaagtctaagaatgacgacaatgtaatggaaaagatggaaaaaatgaaagaaaaattggaggaattgaaagatgaaattgaagaagaaaaggaagagaagaaaaagtaaaaaggaagaaaattagtcggaagataaaacagaaaagagaaaaaaagagaaacagaaagaaaa

SEQ ID NO: 45341 - DNA, 928 bp, Heterodera glycines
aaatttggtgcgctttagagcactttctgaaaaaatatttatgaaataaaaaaatcgatttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgatttattcaagtgtccgtttggggtactcaaacaattatggggagcaaaaatccaacgcagaattaaagtacaggctatagggaagctattcccgaaggattcggtctccacataaatctgggcgcatcggttcggggggactgccccgaaaacaaaaaaatcgattttttcaagtgtccgtttggggtactcaaacatttatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcaggttctgaaaaaaaagttaagcctaaactttttggcctgcttaaaaaggaattaaaaattttttaaaattttattcatctccctttttgatagaaaaagcatcagagtgcctaaactaacatgtaaataaaatctggtgcgtttcagaaccctttctgaaaaaatatttaagaattattttgcaaaaataaataaaaacgaaagactcagattttcgaaaatttttttgagccagctagctcggcgctcatttcagtgtaagttagtccttta

SEQ ID NO: 45342 - DNA, 891 bp, Heterodera glycines
cggaaattttgttttaccgggctctagtttttaaccattttttcttttcaatttcttctttttttctcagatgaattacattgaagtacaaatcacggatactctcgagggcattgcagcagcgcatgactgcaccattggagggctggttaagctgaacaaattgacttctcgaatggtaaaatttattttgtacttaccactatggaaattaaggtcttccctggccaaaaacttttggtcccttccgttttttcgtcggaaggcgacacaaaaagtaaaaatggctgtgcaacagatgaaaatcacggaaaaggagagcacaaaaccatcaaaggtgggcttattcttataaaaagaattgtcgtcggttcaaaaaaggcattgaatagtgaaatgaaaatgctggcgctacttaaaaaccatgaaagtttattatccggggttttaaaggtcgctgatcacgaatctgacatttaattcgatgtcatggaccccaagaatcccagggaataaattttggtgtctctccactcctctcttttggctgtcatccgtctttttcctacccgacagattccgtccaaaaaggccccggacaagccgttcgtacactttcttctgctgaaacttccccaatacacaatgggttcggtcacattcaatccatggcaaaatgcacattttcagcaggaaaggacagcgccaatcgaacgccgagttgggaaggatggcatccgaattggacaatgatgaccaagagtgcattcagcggtttctcaagacgagggttagtttttccgtggaaattgtttaaaacttaccaatccttccatttctgaaaataataattctttgcaatactgcggcacttttcgacccctcatcact

SEQ ID NO: 45343 - DNA, 1084 bp, Heterodera glycines
  misc_feature (953)..(953): n is a, c, g, or t
gtagggctcaaccgtatatagtaatgcgttttcggggaaaacctcatgttgaagggtgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgttgaaggctgtagaaaaaagagatagccatttttctgagaatatctattcttagttatggagccattttccaaccgaccatttgtagggctcaaccgtatatagtaatgcgttttcggggaaaacctcatgttgaaggctgtagaaaaaagagatagccatttttctgagaatatctattcttagttatggagccattttccaaccgaccatttgtagggctcaaccgtatatagtaatgcgttttcggggaaaacctcatgttgaaggctgtagaaaaaagagatagccatttttctgagaatatctattcttagttatggagccattttccaaccgaccatttgtagggctcaaccgtatatagtaatgcgttttcggggaaaacctcatgctgaaggctgtaggaaaaagagatagccatttttctgagaatatctattcttagttatggagccattttccaaccgaccatttgtagggctcaaccgtatatagtaatgcgttttcggngaaacctcatgtggaaggctgtagaaaaagagatagccatttttctgagaatatctattctttagtatggagccattttcccaccgaccatttgtagggctcaaccgtatatagtaatgcgttttcgggga

SEQ ID NO: 45344 - DNA, 474 bp, Heterodera glycines
cgcctgaaaatttgaaaatattatgcaatttgttaaaagatttatttaaaaatgactaagatttagaactatatttaaaaatatttaggagtttttgaggcgggcagtgccaataagccccatcgaggaaaatttttcagaatttttaacgaattttgttaaaatagctaaattttttaagcagttcctctttttcccttggctagcaacccgccccctttttatgtatgctaataatacaacaaatcaccaagaataagtcagacgaaatcaaaatatgagtagccttttaataaaaatattaaaaaaaaattcattttataaaaaataatcttgcaagaaatcgtctcgaaaaataatccaaaagtcaaattgcgtaccaaaattgcggataaatcccaaaaatcctcaacccgcaatccgtaactccataaaccccgcaatttccgtaatccgcaattgcgccctgccctg

SEQ ID NO: 45345 - DNA, 1157 bp, Heterodera glycines
  misc_feature (77)..(77): n is a, c, g, or t
ttgataaatatgaccaaaccaatctttggaacttccactcttctagggggacgaggggtaccaatccagccgaaagntttcattcgtcgatgaagaggcaattattatgaataaaaattacaatataaattaaaaatagatttaaaaatcaattttaaaataaaatttagagaccttcggcgataaaaaagggatctgtaaacaattttgtcaattttttacaacaaatagttgcggaaagcgatgcaagaattattaagctttctacaaacaaaattttaccccgtaaaagatcaaaagtctatgttgatttagacgcacagctcttaagaacattggatgaatataatgtacaaaactaaagcactaattcataagtgactaaataaaaaaatttaggctacaattgaaatggaaaattcacaaggcgaattagaacaattttattcaacagccgtaaaagttttggatagactaagttttttcttactaaaacttgactgcaaaggtagaactatgaaagatagcagaattaatatggtagaattttcaactgttgcttagaaatttttaatttttaagaaaagaaaattgaactatcagtcaaatgaaggacaatcacagattaaaaaaaattaaaagtcaggaaacaacattaccattgtcaaattcactaactgaatttgaagaaaatcgacaatgttctattttatttgaagaaactagtgaaattattttttctttactcacattttttgattttagcttctgaaactgatgcatcagcggttttagaaataatttcaaataaaggtttgaaattatttagtcatttaaatcattattaatttaaatccgtgaaagaaaattattttttaatcctatgattgtcacgggatatattataacatataatattcacggacacaatggaagatgtcagttaaataaaaataattaaaaatgggatttatttttaaaatcaaaatttgggagaaatgacaaagtaaaaattctaaaaaatttctaatccccagacgcagagcaactgaaaattttcttcccgcttcggctgtcgattggggactttgatttcagccattgatcagccaaaatttcaacaatgcatacctcttcaaaaagattggggagatttg

SEQ ID NO: 45346 - DNA, 1018 bp, Heterodera glycines
ctgaggacaatgatcagccaggcgtgccgttggacgaagcacccgatgccgaacagagagcgttggatgagaatacgcgagtacagaggccaacggaagccgatggcacggccctagaaatttggaaaaaaatggattaagtcgatcgaaatcggtggcacaattctgtaaattgaggaaatacctacttaaaaaatatgagacgatggcacggccctggttatttggggaaaaaggttgatggaaatcgatggcacaattttgtaaatttgaaaaaaataaaatgctaatttaaaccgatggtacttattccatagaaattcgagaatttatggaagaatatagtgaaatctgaggctatggccctgaaatccgtaatttataacaccaaaaattaattttgccacaagaaagtacccgcaaaatctggtggagtgccatgtccgcgttgaaccatgttggccgcttggagaactctctcttccacttgtcggaaaatgccgtttcgtccggcgcttggccaaccgccaaacaacggtcaacacactgaaaaaaatgagtgagtttaattaatttggaggagtttgaaatttcaaagcgaatcaaaaaagggtttcaaatgcgtaaatcaaaaaaaaaaaaaaaatttttttttgaaatttttcatggccaatttcatatgaaagttgaaatgggatatttggaaatgcccttcaatgttatagattaaaataaacggctctttcggaaatccgtattaaaatttgggattaactttcaaaaattggtgggggatgtagcgaaatttcagtcatcctcccctcaaaaaaaaaagtttaaatgtgtcaaaatggcatttttttgagaaatgccaccatttttagcacatacattcgggttgatgggctccaattcgtcctcctcgtccccactccatccatcgatttcctcctcatccgcgtcctcatcgccccccgaaatttccgttggtctgttgctcattgtcaagggaagcaaa

SEQ ID NO: 45347 - DNA, 1043 bp, Heterodera glycines
tttatcttatatccaagaaattgactatctcttattttgagaaattttatacgttacaaatgctctcgagctgagtaggaaggggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttcacagagaatttttaaatttatcttatatccaagaaaaatgactatctcttattttgagaaattttatacgttacaaaagcgctcgagcgtgagaggaagggcggtgcgcaatcgccatttaatttctcagagaatttttaaatttatcttatatccaagaaattgactatctcttattttgagaaattttatacgttacaaatgctctcgagcatgataggaagggcggtgcgcaatcgccattcaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagggcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttctt

SEQ ID NO: 45348 - DNA, 839 bp, Heterodera glycines
aaactatccttgaatatccggttgccttttcccatccaatttccgcctaattagaagggattttggatctcaaagcggacccaattttaaggggcgttgaaaatgttgtgggaatttccaggagagggcgttaaaagcagtcggtacagcgaaaaaatgaccaaaaatggactatcatggaaaataatggcacaaataaaaacaaaaaacgaagccgctgacaataacgagaaaatgtttgggcatttaccttttgggtcgttcaagagaaagctcaaggtccattttcatgttaatgtgcataaacaataattgatatttcttcaattatagaagacttgttgatccaccttttagcggcattcttgcgacttttgtcgggaaatattgaagcgttcactggcactctttgtgactgtggtaataagggttgcagtttaactgccataagattcgcaaaggccatgttttgttagtagtagagggagggcgaccggttcacggcctcaggtcggacgcgaagcacccgtcttttaattttgtgggagacgttcggccgcttcgcggcctcaggacgggcgcttcgcgcccgttttttaattttgtgggggacattcggccgctttgcggcctcagactggcgcttcgcgcccgttttttaattttttgagaacattcgtccgtttcacggcctcaggacgggcgcgaagcgcccgtcttttaattttgtgggagggatccggccgcttcgcggcactcaggacgggcgcttcgcgcccgttttttaattttgtggggaagattcggccgctttgcggccttaggacgtgcgcttcgcg

SEQ ID NO: 45349 - DNA, 1256 bp, Heterodera glycines
  misc_feature (1170)..(1170): n is a, c, g, or t
  misc_feature (1205)..(1205): n is a, c, g, or t
gtcccagtgattagaatgctgtgggttgagtcccagtgatgaaaatgcaggagaagggagtcccagtgattagaatgctggtgggttgagtgccagtgattgaaatgctggtgagttgagtcccagtgattagaatgctgttgggttgagtcccagtgattgaaatgctggagaattgagtcccagtgattagaatgctgttgggttgagtcccagtgattgaaatgctggtgggttgagtgccagtgattgaaatgcagagaattgagtcccagtgattagaatgctggtgggttgagtgccagtgattgaaatgctggtgagttgagtcccagtgattagaatgctgttgggttgagtcccagtgattgaaatgctggagaattgagtcccagtgattagaatgctgttgggttgagtcccagtgattgaaatgctggagaattgaatcccagtgattagaatgctgttgggttgagtcccagtgattgaaatgctggtgggttgagtgccagtgattgaaatgcagagaattgagtcccagtgataccggtttttttggtaccggtaccggtaccggttttttcaaaaatgaaattaccgttaccggtttgtctagtaccggtaccgccggtaaaaatttgcactggtaagaatgggggtctggtcgagaaaagagtaggaaattggtgaagagggagaaatttttgagaaaaaattaaattttatttcatttagtcacgggattacacacatgcacatgtggtgtagtggttaaactttctacctttcataatttttcgcctgggttcaattccccacttggatagaatattcctcacattttcttggtgtagtggttaaactttctacctttcataatttttcgcttgggttcaattcccctcttggatagaatattcctcacattttctttaccattattttaattaaaattttaattttaaaaaatattccaacttttttctttcatgttaagcatcctaaaaacccaaaacttaatcaattggtcattttttttacaaattctgttaacaaatcgcattaaaaattacaaaatttttcccggcggcgcctatcggcaccgccggccctccttgtcccccaaaagtcttggaaaaaacgtgccgcgtaaaaagcggtgtgaancaaaaaaggtcattgatttacattaatttacatgnccggagaccaggtaacaaaatggaaaattggctgctgaccccttttttgca

SEQ ID NO: 45350 - DNA, 827 bp, Heterodera glycines
tagagtctaattggttattgggtttttaattgatctttcattgtcacattttccactaatttggcaacaagcacagaagaacagcagcaacagatgcacacggaacagcaatttggacagaaatgaggaaaacggagaacaaaagcaaattatggcccatttaaaaatgcccatttcaaatgtattaaacatacgaaaactttaaaagtgaattaaaagcaaaaaggatggaaaataacacatcattagtggtgggaataattccttaaatgaaatccctaaatttaagcaaattgggcaattacgattccgagaaattattgaatttcgaataaatatcatttatttggcctaataatttgtaaaaacattccaatcataaggcaaatgttggcattgaaaaatccgtaaaaaaaagtaagagtttaagtgccaaatgatatttttgagagggcaaaagaagattcattcacttcgcttcctccgtctcaacccgacaacacttccccaattccgacaatcgctttggtcgtccgtcccccgcccgtcttctcattggaatgcctggtgtccggtgattgccttgccgaggatcagtgcgtggatgtcatgggtgcctaagaaatgggcacatttcgccaaagtttgtcacaatttggcaattccatgccatttccttcctcaccttcgtaagtgtttacggactccaagttgaccatgtggcgcatcacctgcatcgtctctctcttagtttatcccttccccctttttttgtccattttcccccttttgcctgataatcgtccacaattccattgcctcccaaa

SEQ ID NO: 45351 - DNA, 1049 bp, Heterodera glycines
gtccgtccattttcacgcgctcgccaaccgactttcgcctgctcaacgaccgtctcctcgcccgtcgccgtgtggactttgataatcccagcagaaacccgcgcggactgatcgccttcagcggatcggagctggtggagatggtcgatgaaaagaatgtccgtgcggtgtttgtgctgttttggcacgaggccatccctttgtcggttcattcattggaattgtggtcgcggacaagcgaattgtggcgacaaacgcaaaggaacggtcggtcgacgctttggccaagtgccctcgtggcgattgaccattgcctttaccgacaacagatgaaggaacagcggacgccgctgctgccgtcgttttgggctccgtggcgtgccacgaggaggacgaattgtgccgtgcttttgcggtggcgcacccggcaattcgccagcagcaacagttatttgcatttcgcaatgggcaacgattggcccaacaaattggcattggcgacgaacattttttggtggaatggtaagggacaatggcaaaggcacttagcaaccgccgatgtaatgcattttcaggatccgaatgattctttccgaccctttggtccgtttggccaatgccggcgaagtccacgccgctcggcacggccttctccccggcagcgaatcgcctcgcgctgccgtcacagtgggcacatttcgctccgagcagcaggaggaatttcgcaaattcgcacgggtggccattttattgcacggccgttactctttggcctattggcttgaagaaaagtgggcactttttgatgagtgaatggcacaatgggtgtttaattggcttccgtcagatcagatgcagtgaaattgagcacttttcggcgtgtcaaatccggcacaaattcgtcagactttgtggaaatgcctttcacgggttcggatttcgacgtcagaccgcttctccatcacatcactcatgccagtttgccagacattgtccgtcttctcttcgaacgttgtctggccaatgactgttccgaaccgaccctttca

SEQ ID NO: 45352 - DNA, 901 bp, Heterodera glycines
aaaaaagactttccaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaaagactttacaaaataatacccctgggagaagggagtgggaaacatgatctttcaaaatttttgttgaaatatttgtcgtgctctgaagggcgtgggagggggggggctgaagacccaccacgaggccgcgaagaaggctctctgagtaccttcggtgcaggaatgaagtgaataaaattttaaaaattttttaattgctttttaaatatgccaaaaaatgtaggcttaacttttttagtgaaaatttgatcactcatattttttgctaattgagcagaagcataccaaactatgcagggatactccccggtaaaggactaacttacactgaaatgagcgccgagctagcttgctcaaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttt

SEQ ID NO: 45353 - DNA, 1062 bp, Heterodera glycines
aaaaaatttggggcgatttgaatgagaatagaaagagccaggttcgatgaagttttggtaagccaaaaaaaaatcccaaacatttaaaaatttataaaaaatttaaaaatgagaattcatgcgagattttctggaaataagcttaatagggcctagttaagctgtaaaaaaaatttggagcgatttgaatgagaatataaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaatttggggcgatttgaatgagaatagaaagagccaggttcgatgaagttttggtaagccaaaaaaaaatccaaacattttttataaaaaatttaaaaatgagaattcatgcgagattttctggaaataagcttaatagggcctagttaagctgtaaaaaaaatttggagcgatttgaatgagaatataaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaatttggggcgatttgaatgagaatagaaagagccaggttcgatgaagttttggtaagccaaaaaaaaatccaaacattttttataaaaaatttaaaaatgagaattcatgcgagattttctggaaataagcttaatagggcctagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatatggcctagttaagctgtaaaaaaaatttggggcgatttgaatgagaatagaaagagccaggttcgatgaagttttggtaagccgaaaaaaaaatcc

SEQ ID NO: 45354 - DNA, 1146 bp, Heterodera glycines
tggggcaattatgccgggatgtgttacttgtttttaaataagctgaagaaattaattatttaattaaattaagaatgagaagaagggaatgttcaaaaaaatggtaaaaatgttcagcaaaaacaaagataaaatgaaagtccaagaagaaaatcaactggaagagaagtaccgaaatttgaacagtttaaaagagacagacccggcaatggcacaaattatggagaaattgcaaatgcacattaaggaggtcaagtcaggtaatgcaacaatgatttatcttctgtaattattgtaatttctctattgtagggaaaatttcggagccgttgaagcaatatttcatttttgtcattcaatttttggcaaaacgacatcacatttcggtcgccgaaattgtgccgattcaaaatatgaaaacaaaaaaagtattaacagagttagtaaagctggttttagaggaaaagcgaaaaaataagcagaaaaatgggaaaaataaggacacaaatggacaaaattgccaatctgagaataaatttaaatcgaacaaagctaaggaagagcgaatgttacgccttttactcacggcattagacaacgtaaacggcacgattaatttatcaatggacggtaagccagaagctgggcattatttgacactaattgtaactatttgcgcagatttaagcgggaccggcgtagcttttctagattttcaggtcccggaaaagcaaaataatgatgtgctaaaataggaaaacagatataaaatcccaggttttgcgggaaaaaaagtattttttgaataaataatattttatttattaattcaggtttatttcattatttttttgtaaactgataattttaagagccctttttcgatttttagagttgtactttttggaaaatcttgaaattttaattcttagagggatgtattttatgttgcattttttattatgacaaaaagatgaaagaaaatattggtttctatcttttatgtattaaaaataaaaaaaaagagaattatattttgttcgtctgagtctcggttagatgaaaatataaaatttaatttttcccttatggcgcatcggctcgagatcaagtcacaaaatccactaagactctagagatcccccg

SEQ ID NO: 45355 - DNA, 1212 bp, Heterodera glycines
aatttggcgagttaattgacttgtgtaaatgtggcctaaggcacaaatgctgtggggaacttagcactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgagacataagcgcccgaaggcctttggcctgaggaagtgtcctaaccgggaaatccggagtgctcgtgtgagtgcctgtgcactgccctcggagctgtgtccagcggcgagatggttcttcccaagtccgggaagctcggatgcctggccagcgctgtgtcattaccacttgctcggtctccttcgctgcccatgcgcacgcttgcgctgaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgctgcggttaaaaagctcgtagttggatctgtgctagccgtccggtgcacactttgtgtgttactggttcggatggcttttctgccgggctctccccggcgttgggc

SEQ ID NO: 45356 - DNA, 1498 bp, Heterodera glycines
acaaaaattcataaaaaatttactagataaaattttgccttttaaggttaaaaaatttcctcagagggtgccaaaaaccttcattttcattaaaaaaatggatcaacatcgcaaaattagatcattttaacgaaaatttttaagaaatcacattaaaatatatgggaaaattttatgaactaagaataaagttgacttctttggtctccgacccccccccccttaattatatttactcacaatggccaattgtgtctctaacatgattgctttgatttaaacattaatttgtaattcgcctctatctgttatgttgctaaatatgtcgttagtgagtgtcaatataatggaaattaatgtttttgaaatgttcaatttgctactgttatgttcttcgtctttgaagactgtctgtgtttattctttagcagttattattgattaattaatgaacacttaaattggcactgctatgggggaggacacatattaaagaaattgctaaaataccaagtaacatggtgacgaattccaacaattttaagccaaaaattccaactgctacaacaacaacaatgcaattttgctacgacaaaacgaaacaaaaacaacagaaattgcgcttttgtattccagccgaactcattaatgagcttctcctttttatggagccactaaaatttttgggcgtaaagcgtttgttgagaataagctcaatttgttaccgtttaattgtctgcagaaaaaatcttaaaaattggcgaatgccatacccaattattgtaagtgaaaaatcgttatctttaacgtcgaatttattttccttaaaagcaataagaaaaataaattttatattatataaaaaacatgtggcattattattcagccaaattcagtattttgatttctttttattcactacgacttttttaaaatattttcagtgacaaaactcacttttttgtctttaagttgactttttaatgctctttttttagtattttgttagaattaatttgataaagaatcgtgtggtaatactattcagccacaatttatttattacttttatttagtgtgactcttttattgttttagtgataataaacatttcgattttttaaattattttttaagaattttttttaatatccatttagaaaaagggtatttttgtttcaataattaagtctgcttagagatttgctaatccatttgggacaaattcacatttatttgcgattttaatatttattatttgtgtgcttttccattataatgaaataataattatacaattaatctggataaaacaaaaaacatttaattcaggagcgcgaagcaattttccaaagcaaattttcccacctccaaaaatggccacttgtgcttcgccttcactcagacaatctcccgtttctttcgattcacacgctggacattgcggccaagtattttgtggtcgccgaaacggactcgccggctgattatctcctca

SEQ ID NO: 45357 - DNA, 551 bp, Heterodera glycines
tctccccataaatctggggcgcatcggttcagggggactccctgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagggggcgtttgggggactcacacaattatggggagcaaaaatcccacgcagaattaaagtacaggctatagggaagctattcccgaaagattcgggctccccataaatctgggggcatcggttcggggggactgccccgaaaacaaaaaaa

SEQ ID NO: 45358 - DNA, 1431 bp, Heterodera glycines
  misc_feature (45)..(45): n is a, c, g, or t
  misc_feature (77)..(77): n is a, c, g, or t
  misc_feature (99)..(99): n is a, c, g, or t
  misc_feature (162)..(162): n is a, c, g, or t
  misc_feature (1274)..(1274): n is a, c, g, or t
  misc_feature (1322)..(1322): n is a, c, g, or t
  misc_feature (1375)..(1375): n is a, c, g, or t
aaaatttgagtttcgtcgtcattttggcattttcaataaatattntcgtcatttttttgcgaacatttctttttttntaatgagaattttttcgaaatntggcaaacttggaggtgtttttgatacaacgaacaacaataaaaaatatgcatttttaagttntaaaccccattttttggttgtttattgtactttttaggtttatttaagcaaatattaaatatgcacaccttttttgggatttttgggggtttacaacatatatttggcattttttatccatattttggtccatatttggccatttttgtcctttttagtccatatttcgggcttttttagtccatatttaatgtccatatttcgcgttttttagtccatataatttacaaccctacttataaccctagtaatatgttaacagaaaataataaactgaagcattcgttttaaaaattaaattttcaaatatattcatttcttcggggtggaaatttcgcatttcgcgccaaaattcgaaacgccaaaaaatgcgaataatgcgaaaggcgaaaagcgaaacctcggtccatccctggtccgtatcactccgggcagtcacagcaccgaggagtccatcaatcgtcagttggccgacaaagaaagggtaaaactaattgattttatttaattattactaatagagcccgccggtcttttacctgacctgtatttttcgggcatactaccaggcccggatcgttcgataaaacgggcttttttgcactgggttgcccgtcccggtcagttgtctaacaataacctggtccagtttctttaaaaatttcggctcgaattattaatatgtttgcaggttgcggctatacaaccattttatgttttatacactttttcatgagatatatttagtaaaacgggatgaaaaaaatttgcatttctttttctctccttttggcgtactattttcatgtctctaacacatgaaaaacattaaattcgctaattgtaataattttggttgtaaggtacaaaatcactttggatatttagaatcaataaaaaaggataaaaattcgcattttggttagaaacagcagcctaggacttggagttatagcgtgataaattaatttgaaagtctcacaactttttctgagatgtcaaattgcttagcattcgcttagaaaaagattctccttttcagaatcttattttagataaaaattttgttcagtttagtcggagatgaagaaagttatggctgatcaaaatanaaaatacaaaaaaggcatttaccagtgtaatttttgaattaacgcgcnaaaatttacgccaaatacgctatttggcgttttgagcaattttgtctgacaanatgtgtataaaaggcgctgttatgatgcgttttctcatatttcactaacgggcgta

SEQ ID NO: 45359 - DNA, 960 bp, Heterodera glycines
gagtctttgctgcatggccaaattcggcggtgagagaactaaggaaaacggaagggaaagggaagaagcgccgggagaagggagagacgcggaggagggaaagtgccgcaagcgaaagaatgccattggggaggggagagaaaggcacgtcattagggggagggggtggacgagaagggcgggaacacttcagccgacggcactccccagaagagagagagagagagagaaagagagagagagagtgtgtgtgagagagagagtgtgagagaggagagttgggcagcagcagaaagacggacagacagacagagggcccccgggggaatgccccgagcaaagtgccgtctctgcccagggaaatgcgcttctctctaccgctgcatttgcttctttacttgcgtaattttagcacagcagtgatgcgagaaacgcgggacggacttcggcggaaagaccgccgaatgtctcttcccttccgccgggaaggccgcggaatgtgtgccgtcgtctgcgggtgttttgggaaaagctttgccacacaaaaagccattcacaaacattggcacaattggccaggtcaatttagcaaaaaccgggcgagaaattagtctttccttggggaaaaaggtctaaaaattcaaatgccttccaaaatttaacaccgccaaatcccaattaaaattgtgttgaagcaaagattccaattttataccgataaataaatgttgtctaaagatgaaaatgaataatgtctattttatttaagtagtgtaaaaagactaattgtaagattaaattagggttttgttagcgaatatcggaagtttcttgcgaagaatgtcacggagacgaacagaagaacataaaaatttgcgaggggttcaaagagtaaaaagggattacatgtgataaacaaaacaaaaacagaagaacacaatatgattgacggagagaagt

SEQ ID NO: 45360 - DNA, 902 bp, Heterodera glycines
ccccataaatctgggcgcatcggtttcggggggactaccccgaaaacaaaaaataaatcgattttttcaagtgtccgttggggtactcaaacaattatggggagcaaaaatccaacgcagaatttaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttgg

SEQ ID NO: 45361 - DNA, 740 bp, Heterodera glycines
attagagcaccgatttctagtgaaaaaacttttttttcgctcaattgatttgaagaaaggagctcaaaaaacgcatttctgcgttaaaattttttcatttggacgtcatttttcgtcactggaaatcactattttggagttttgtcacttaaaatagtgaaaattcacttttttggcttttcgtcactatttatttacttcatttgcaactgcaatcagtgggtccgtatcgttttggcgccgacgttttggcgccagcccaagttttcggactataacttttttaattgttaaccaaatccaataatcttggtatcattcgaaagcttaacatgtttagaagctatttctaaactattgcttcgcgattagacaattaccaaaaaagttataacatgaaattgcaaaaaagtcgaaatttttgatgttttttcttaataacttttttacaggctaaatttttttttgtttttttgtaaggttaatagagcatgtgaggaactttcgaatgatactaagatcgttagatttggtcgacaacgaaaaaaggtataataaaaaaactgaggctggcgccaaaacgacctagtccccaatcagtgaataaaaaaatttgttgcttcatttttggctgaaaattatgtcactattcgtcactattttgtcactattttggcactttgtcgtcactattttagttaaactattttgcgatttttcgtcactaaaagtcggggccc

SEQ ID NO: 45362 - DNA, 969 bp, Heterodera glycines
ttcttggatatgagataaatttataaattctctgatcctttaagggcgattgcgcaccgccctccctctcacgctcgcactcgattttggaacgtatagaatttctcaaaataagagataggcatttttcttggatataagataaatttaaaaattctctgtgaaattaaatggcgattgcgcaccgcacttcctatcatgctcgagagcatttgtaacgtataaaatttctcaaaataagagttagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgaaagcatttgtaacgtataaaatttctcaaaagaagagatagtcatttttcttggatataagataaatttaaaaattctctgtgaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgccctccctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaagaagagatagtcatttttcttggatataagataaatttaaaaattctctgagaaattaatggcgattgcgcaccgccctccctctcacgctcgagcgctttt

SEQ ID NO: 45363 - DNA, 1539 bp, Heterodera glycines
  misc_feature (1009)..(1009): n is a, c, g, or t
tctaatcattaccattagtttaaaatatcaactgaagccctttacaaattacattatttattagctttcttaccaataaaactttaacccatttaaaaaattaatgtacaaataaatatttattatagaacaaacaattaattctataaatactaaatcttccattgatattaataacaattatggcgaaccttagccaataatgatgtgaaaaagtgaaaaatacaatactcattattaatacaaaaaataagtataaaataattataaacaattttttcaaaaatgttaaaaaataggaggaaaagccaaatcaaccacacatcactcgtactactactctacacgacaagaaaaatggaaagttccatttttgtaaaataaatattttaagacatttatacaaagataccaaataattgtcatattacatattttccaaaataccataaccagagttcaccatctatttaaataacaatataaaataaacttatttgatatttcactaaatgaagttttaaaattgttttaataaaaaatttttttaacccaacatttaaaaaaattgactcaataatatatattaataactctataaataaggaaaaggaaactttaatctttttttgtgagaaaatcattaacaaatttacgcaaaactcaaaaaaaaaattatttgattggtactaaaaagcgaccggtatactcaaaaccagtaagttggaggtaaaaaaataaaaaaatttctcaaaaatttaagataatgaattgacattttataattaaaagacctaaaaagtcaactttttaattttagaaatctcttttcaatatgaaaaaaatggtgacaaaaaatagaaaaatgaattaatattaccgtgaacttaattagctctaccataatattaattaaaaagcttaacagaaattagatagactaataacttaaaatattataaaaattaataaaaaaaaagttcgaatggagcatatgttaaagaacagncaaacaatgagaaataataatatttcgagagataaatttttttaattttattgaacagtaatgaaaaaaaattttatttatttattgctaaaattattctcgataatttaaaaacggaattaaaaacaaaaaaaaattcttaaaaatgctttaatcaaaatggataaataatttaattaatatgttacaacaaaaataaaattttaagaaatttggatttttaaatatattttaaatctttccttttaaatcaaaaaggatattttttttatttggaatttttctctaaaaaggattattttttaaaaaaaaaattaaattttaaattttaaaaaaaaatttttgcccgccccaaagggaaaaaaaaattttgggaaaaaaccacaaacaaaccaaaaaatgtttttgggttaaaaaagggggggaatttttttaaaattttgtaaaaatttaaaaaaaaaattttttttttttttttttttaaaaaaggggaaaaaaaaaaagaaaaattttttttttttttttttttt

SEQ ID NO: 45364 - DNA, 1300 bp, Heterodera glycines
  misc_feature (1211)..(1211): n is a, c, g, or t
  misc_feature (1232)..(1232): n is a, c, g, or t
aaaatcgagtttttaacttcagccccctccgaaccaggggtctggctacgcccttgatcattgccttcattacaaaacatctctgacactacttttttcctcattttctcggttttttaaaattgttcggttcacactaaatttttgtacgtcagtaacaaattttttacgcgatatttttctgttatcggacccctattatgtttttctccggcggcgacctttttttactcatcaaatttgaattattcgcacttcaatttggttatgcatatatacagtacaattaacggttcacgattattactgtgatatgacaatacaaaatatttataatatatggaatgcgttatagatagaataaatacatcgcacacagatacatatggcataacaatatatattacttaaaacatcaaacgcttccaagtaagaggaggaagggaaaagcggattctctattcttatgcactttggtgctggtaagtcaggaaattgataaaaggtgtcaaattcccttgctctgatgctatgtcgaggcattcatagtattcatcccttttcgcctcaggcagaataagggtatgaagcccgcggcgcacaaagacacagttcatcaattgacgcccggtccttccgtttccgtcataaaacggatgaataaacacctaaattcactcaaaagttttctagttgaatagattcacaaaaatattatgtttcattcattaagttaaatgtatttatttatttatataattatttttttcgttttcaggttcgaagttgggcgcgtttgcactgcgggatgccttttacgagaccgcattttattggttgtcgagctgcatttgcccgggcaacatttgttttatcatgcaccatcttttgtccgagatggcagttagccgggctttgtccattgtcattttgtcggctgtatttgtccggggcggcattttaccgggttttgtctatttgacattttgcgaattgtgttgttcggattgcggcactttttccaaaaactttttggggacagggtgccggcagatgccgattggcgccgtctggcaaaatttttatactttttaatgcgatttgttaacagattttgtccaaaaaatgacaaaatttgcatatttgttagcagattttcatcaaaaatggctaaggcggcactttgccgtgctttgtccattcgttatttntgtcgactgtatttgtcctgngagtattttgccggactttgtccatttcgagaatttttgtctagctgtatttgtccgggatggcattt

SEQ ID NO: 45365 - DNA, 983 bp, Heterodera glycines
ccgaaaacaaaaaaatcgattttttcaagtgtccgtttgggggtactcaaacatttattggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaaattttttagagcaagctagctcggcgctcatttcagtgtaagttagtcctttaccggggagtatccctgcaaagtttggtatgcttctgctcaattagcaaaaaatatgagtgatcaaactttcactaaaaagttaagcctaaattttttggcatatttaaaaagcaattaaaaaatttttaaaattttattcacctccattattgatagaaaaagcatcagagagccttattaacttgtaaataaaatttggtgcgtttcagaaccctttctgaaaaaatatttatgaattaattttgcaaaaaataaataaaaacgaaagactcagattttcgaaaattttttttgagccagctagctcggcgctcatttcagtgtaagttagtcctttaccggggagtatccctgcatagtttggtacgcttctgctcaattagcaaaaaatatgagtgatcgaattttcactaaaaa

SEQ ID NO: 45366 - DNA, 538 bp, Heterodera glycines
tttttataatttcctcggattcatttgcattttaagcattcgcggagcatcattttcaatccgttgaacccgaccatacgtattctcggcagccgttgtagtttggcatcaattcacccgccccctcaacaacaacaatgaatctcgaagtaacccatcttttctgtattttttacttgtaaacccccaaaaaacttaacaaattttataagtgtctgatcgcccgaccctttccgacttagtttttgaagtcagcagaaacatcgaccgacaagtggacgcagcgaattgagctcggaatttcgtgcactataaaaattttgaagattcgatcatacaattaattctcttttttcgattcattcaatatttaaaaatatcattatttttcgtgaaaattgttatttatttatgcgattctggtaaagtattaatgaatttcgtattttgaagccttaggaatgtaattttaagactttttcgctaatttttatttggcgggatttcgactcattttggctttggcgggatttcgacg

SEQ ID NO: 45367 - DNA, 910 bp, Heterodera glycines
ccccccccccccccccctcgtccgtattcacatatccttttcccgctgagaggcctttcggcgccacagatttttggagatagttaatgttgtgatctcaaaaattccgttgcgtcgcaggcctcgtccggcggtggacaaaatgccacttttttggacaaatatcaccatacctccttatggacaaaatgccatcttttggcaaaatgccactttgttccatttccgcggcaccgttgtctttcagccttaccccgtctacggcaccggcccgggcgttggcgcttaccctccgccagtcggaccggacagcacatattcgccacagcagaaccgacgatttggagacgaacatttgcacagatattacgacaatgaaggcggacggcaccaccgatattgacgaagaaatgccatcagagcacagactgacaaaagtaatagcaaaacaaatttcttaattaccgaaaagctccgatcgttcatttccccaaaatttactgtgagcccttacagtagtcccaacatttccaatttggcacacattttcgatttttatgccaatttaacaaacgcaaatgaatataaatgtttagaagctgttcacatttgcctattaaatcagcaaatttgggcaattaaagaatgccaatgttttctttttgtccattctctgatgaaaaatgactgtcggggagtgccataatcaatttgtgtgccggccaagtggtgggcggggccagtcgataatgaattgcgctgggtaggggggggcaatgcgggaatctgtcaattttagcagcaaaagtgctcaaaggcggaagcacatggaaatctgaaagcagacaaacgcagccttttaaagcagtaataaaatgggagggagagaaaaagacaaaaaaaaaccatt

SEQ ID NO: 45368 - DNA, 1279 bp, Heterodera glycines
  misc_feature (95)..(95): n is a, c, g, or t
  misc_feature (161)..(161): n is a, c, g, or t
  misc_feature (176)..(177): n is a, c, g, or t
  misc_feature (1183)..(1183): n is a, c, g, or t
  misc_feature (1192)..(1192): n is a, c, g, or t
  misc_feature (1194)..(1194): n is a, c, g, or t
aaatcctaaatagacaacgacgcttttcattataaagctttaagggaggaaaaagtaatacgaatatttcatttcttacttatccgaataacaangataggttacacacgaacatttttatagaattccggctgaaactaaaatccctcttttgttcttancctatgattttggcnncattatggatgaattaagtatagaaggcgtcgcagaaatacattcatattttctaaatcggggtttcagaaaattaagatttaaaagaggctaaattacagatgcttttcaaattttgggtgtatcctaatagaaagaagttggaaatcagtacttttcacgcctataaaattcgggccgaaaaatattggtgtttgtgactagaaaaatagcaggtgcatatcaaatgactacagaaaattacagcctccaagaaaataattgctttgcacaagcaatattttgtagagcccatcaaacacattgtgcttataggaaaggcagaattaaacaataggggcctttttattatgattacaacaaatcagcatggcgtctcactgatatggtatgtttcagttaaggtttagccgatctacaaatttcggcactgtctattttgtaaaagcgaatcaaattcctttggattccaaagtggaattacagaattgcgacggcaaatcctaaatagacaacgacgctttcattataaagctttaagggaggaaaagtaatacgaatatttcaatttcttacttatccgaatagacaaagataggttacacacgaacatttttatagaaattccggctgaaactaaaatccctcttttggtcttaacctatgatttttggcccattatggatgaattaagtatagaaggcgtcgcagaaatacattcatattttctaaattcgggtttcagaaaaataagatttaaaagaggctaaattacagatacttttcaaattttgggtgtatccgaatagaaagaagttggaaatcagtacttttcacgcctataaaattcgggccgaaaaatattggtgtttgtgactagaaaaatagcagatgcatatcaaatgactacagaaaattacagcctccaagaaaataattgctttgcacaagcaatattttgtagtgcccatcaaacacattgtgcttataggaaaggcagaattanacaataggngncctttttattatgattacacaaatcagcatggcgtctcgctgatatgggtatgttttcagttaaagttttagccgatctacaaat

SEQ ID NO: 45369 - DNA, 927 bp, Heterodera glycines
gcaattaaaattaattaaaaatgaataagttattatctatgcctttgtaaacttcgcgaatgcaaagaatgattatgatgaacataaaaatagcgaaaaagacgatgccgcccttttctgaatccatttcctgagagaacagctgtaattattacaatttgattttcttttcgcaattcatccacaaatttaccgttttataaatgacttttgcaaaaagcaaaatgccaaacagagacaaaaggaccaattgaaagagttggattggccgcagacgacgacgctggggacgcattgcggcgggcaaccgatcaaaatttatgataggcattgaaacgaatgaattttaaaaagtcaaaatttgttatggattttcataattaggatcggacggactttccggcaaaaggaatttttatgcggcggcgctttgcaaaatcaaacaaatttccattccgaaacaaaaatcccaactctcgccaatggcattttcactgaaattgggatcgaatccggaaaatcttcgaacaaataagaacaaaaatcatttttaagcagagaaaaagaaagtgggaggcaaatggaagcaaatacattccaccaattctcatttcgcttcaacatttgtttattttgtgtgcaaaatctgtttatcatcacagaaaatgagcgaacggacagcgaatgaacaaattccgattaaaaatatttaagaatgaaattaattaagcgaaaaaacatattttttaatttttttctaactttcataactcgcagctaatgattggcgggagggttagtaacggtgtgaaatttatatttactatatgttagacaacgttttgggggtatgtgtccctctcttctaccttttcataatgaaatcttacaagacaataaattacatgtaattttttaaattccttt

SEQ ID NO: 45370 - DNA, 917 bp, Heterodera glycines
agggagaggggggcggggggggaattcgaattgcagcgaaataaccttaattaattgaccattagcaggtggtcttctttagcgacgaattgccgcccaaattagtcgcatatgacgaatcgattttaagacggacagacaaatacgaactgctggcccgagtgaatggaggagacaaagaatggatactgaggataagggacgttcaggtaggaatagtcggacaatcaaagcggggggaattaagaaagtgcaaagcattcgagactcttgctgttgggtgtcgaaaacccgaaaaaagcccgagggaatgaatgatacgaaagatttcaccgaactcggaaaattgtaggaggacgacgccggaatgtacatctgtcagctgaacacgaaccccgtgctcagcaggaggggatttttggagctgcgcattccgccgtccatctcgcgcagtttgacccccgcggcgatcgaagtgcgcgaggggaacaacttgacgatgacatgcacagcgaatggcaatccaaagccagccattgtgtggcgccggtcggaccggcgcatcattcgctgcaacgaagcggacggatacggaggtgggcggggggcgaacgagggggaattgggactgatcggtggcgattccgatcacttcctagccaaattgagcgatccaagaaaagggatgggttgttgtttttggcctcgagttcaattgtttttcgcagaaactatgcacaaaggggctgaattgccattgagccgagtcagccgaaggcatatgggcgaggtgggggagaagatcgcgcagcatttgcctccttcttaagcaatccatttttagtatttttgcgtggcatccaatggcattcccccggacgaaacttgggtcattaaatggcacgttttatgtgagt

SEQ ID NO: 45371 - DNA, 988 bp, Heterodera glycines
ccccaaattgtccttcccccaggcgtttccttgaggcggtgctcgcctacacagcggcgcctaaaattgacgtcatcactcattcggttggcgttgtgttggcacggaaagcgatcaaagggggcgaactgatcgccacggacggaaactgctcacttggcaagtgaatgagaacagaaaagccaccgggagaaggacatttaagctttgaccggaggacccataaacaaagggattaaaaaagataaatggcactaaaaatatttactggtttatttaggcacaacaccgattcatggcctaagcattgtataattttaattttgatgctttaggtcgcccgctgtctgaccgagtcgacacttttcttggcaattttttgctaatatatattaaataattacagctttaaatattgcttatcgtcaaccactttttgttcaggaattgccggtccaaattacggactttgcatgtgccaattggcacagacaatgcccgcctggtgcaatgcgctcgatgtgagtcatgaaagtctttgtctttcaatggttgggggcaatgatttggtggcaaagaaattttaaaattcttacgaatggacaaacgactatgaaaagctccccaaaaatggataaatcacaatatccctgtttgggaatcaaagggcataaatgacttaagggtcaaaaagtctgtgaggccaagcggcggcactaaaacctgccctaatactattatttattttttctacccttgaatagtaaatttattaatcaattaaattttgctctaatccctccccccagggtttgtatccgggctattcttgcgaggatcagttgctctgcggttacacccaaaccccgtgtgaccaggtcaactactcggcctttctggagaagctgaacagagacccgagcagagaagcggactatgtgttcgcattttggtgaaaaacggcagaattttggcaattttaaatttg

SEQ ID NO: 45372 - DNA, 976 bp, Heterodera glycines
tcctaagttcccaaaaagtttttgaaaaaatcgcgctgtaaaaaacgtgtaaataggcactccttttcccaaaaatgttctaaaataatgaaaaatgacaaaaaaagattttgataaaataattgaataattttttcaagcgaatatactaaaaacatttgtgaaataccttttacttggttaagaattaaaaaatttagcctattaaaatatttagaaatctttttattatattgtatattttttgaaaaatttccgatttcttgcaccgcaaaaaagtggttttgaaaagaaaaaaatagtcaatttatgaaccgttaataatttgatttccgatcaactttttaccgtcggatccaatcgaaaaatcttagtcgacccatcaaccccttttaatgcatcccgccagcccttaaaaatttatttttcagcatttttagatttttggaaattttttgaatttaattgaaattttttcgaattttccaaaatcccgcacgggatcccgcaaattttaatgcgggatttgcgggattaatcccgcgggatcccgtcccgcaaaaaattttgagttccagtcccgcagcgggatccgcaaatttgaaatttccggtctctatttaataccacatttcaccatttttgaaattgttattttacatttagcgaattttatgaaattttaagaaattataccctcaatttggaaaccatatttttgcaattcgttaggaccacaattctacttttcgactagggttataagttgtatgcactaaaaaaagccaaatatgcgcataaaatgcactaaaatcccccaaatatgccctaaaacccgaaaaatgcccaaatatgcactaaaatatgccttaaaaattacccaagatggcttctgaccctaaaaaagccaaaattgtgtataataaaaaatttactttaaaatatcaaaacaatggctaagtagcgtttttagata

SEQ ID NO: 45373 - DNA, 1008 bp, Heterodera glycines
cgagtacacgccatggtattcgggccaaacaatttgccagccaaaagggcagcggagggttcatgaaggtaagtaagcggatgagtgtccgtcagggatgtcgggggatcgaggatgcgggaattcgtggtccgaagatgtcggtggatttcgggatttcaagaattgtctctaaaatggcgggaattcggctccgtgcatgtcgaggggtcgggatttcggatattctctaaaatgacgggaatttggggtccaggaaggggcatttgagggtgaagggagatatggtttagactcgaaaaaagaagcgggattctagaccggggaggacacaaaataaaagatttcgggatttgcggaggtaggtccagattattttgttttgttgaagatattagaagtttgaatgcagatcatatggtgcctcgagagcggagccaattaattaaccaatcaaaaataaaactaattgagggataattagtgcctcaactgggcaaactgagagaaatttgagcgactctaatgaccgctttttaaaggtgcgcgacgttttaccgcacagccaagggggcaaggatattccggaagatgacaagctcaaatccgaaggcattgtccgactacaggtgtcccccgagagaatttttaaatacctttaattaccgtaaaattttcattagtcgggcaccaacaaattggcatcccaacggggcatgaccggctttggcacaccgcggaacacgatgagcaagatgggctggaagaaggaatgggtggaggagtacgaggcggcaatgcgcgaatttgaggagcaacgaccgcccgggtcggcatcgtcggataatctgtgagtttggatggggggggggatacggtactttttgaaatatggtagtgggccgattaattaatggggaagagagaaaaaggggtggagtagatagagagattaatgaaagaatcctaaagggtactttttgaaatacggtgctttgaaaaaggtaa

SEQ ID NO: 45374 - DNA, 827 bp, Heterodera glycines
gatgttaaattagccgtacgaaaaagcatttcataaatccgccaagtttcgaaaatattttttctttaaatttaaataaatcgcaaaaaaaaatataacccacttttaattatatgattaataataataattttgaacccacttttgattaatataaattaaaattagttattaattgattaaaaggctgaacgcgctggcagccttatccgatgggatgaactacctccagcatcttcctcactcggtaatgagacgaaaatttcctaaaatataccccgcccccccccccctcaattagaagccccttttgaggggattaaaaaatgaaaccccaccccctcaaatagaaccaacttttgaggaaggttgaaaaccagagcccttgggggctctatttaggaaatacggtaatatatatatatttatatatatatatatatatatatataatatatatatgtatatatatatatatacattagaataatttaattattataaaattaaaacaaaacaaaataggactgccaacctatcgactaccgacagaggtggaaaagttagctcaaaagccgctttcactgatctctgaatggtactcatgcacaagcatttacgattgtttatgccaattgtttggaggtaattaaaaatttattaaatttttataagaatttataattttaatcagtgcgcatttatattttattcatttctaaagtttttcgatcgattttgaaggtccagaaattttagaatataattctcttgccaaattcttaaagaaatccaagtcacactgaaacaattgcaaacatacatgg

SEQ ID NO: 45375 - DNA, 1130 bp, Heterodera glycines
  misc_feature (43)..(43): n is a, c, g, or t
  misc_feature (91)..(91): n is a, c, g, or t
aaatttactcgagatcagaacgatttccattgcgaccaatccngaaacaacagcaaatcaattggcgacacaaataaaaaagaacagtgcncaaaaggacgaggccaatgattgtgaaaaagttggccaaaagagaaagcattgacagatggcttttcgtggggaattcggggtaactcttggagcaatcttcacagtgcaagtccttctgagtcaattggtcgggagaacagcactggcgacagtaacccatcgtatggttggcaaagccctgtgcacattcgtcgcattggagcggacctttttgggttgcgtctttttcatgtccaacgaagctcccttcggcttaccaggcccatggcaagttgcgcacgacttgtcgcactccaaacaaacgctttgcgcactttcgaagtaaccggcggagcacgaattccttctgagcacgcacttggcttggattgtcagtctgtcttaaagacaaagttcagccgacgtcctacccgacgagggactcctctcttacaatccgcgaccaatccttcgggacaagtcgcgacacaacggccatggtccaaatggccgtaatgtttgacgtctatcagcagttttgcatcgtggcacttgtcacatagttccgcttgtgaacacgtctcgcagtcggtggcgcatcgtttgcatttgtcgccgtccgcgtaaaagccctcctcacaatgctcaacacaccttaaaagatttgactgtaaacagtggaaaattcaaacaagaaaacttttggaattacaccatttggacagatgacgccctattcactcattgggaccgggaccatttgtgtccaaggggtctcccagccaatcccgccctcgtcgtaacagccctatgggtcgaaataccccgcctcgtacagtccgtagggaggttgtttttgacgaccccttacagaataatcgggacagtaaaaattttatattttgtgactgcaaattggagacaattgccgatgaaatttcatggtttttaaatttatttgtgtgttttttattgtcagtgtttatgatgagtgtgtgtgatgatatcaatcagctcgagttatcaatacaaaaagttttgactgctaattatgaaaa

SEQ ID NO: 45376 - DNA, 1345 bp, Heterodera glycines
  misc_feature (20)..(20): n is a, c, g, or t
  misc_feature (47)..(47): n is a, c, g, or t
  misc_feature (100)..(100): n is a, c, g, or t
tttgagtttttttttcaaanaaattagcaatttttgtacaattctgnttaataaatgcatttgaaatttaaaattttttttattatattttatgttttgnaaaaattccgacttccgagttctgacttccgacatttctggagtcagaattccgacttccgaaaattttttgggcctcggaattccatccctgctatataccagtgatgatgattcgcccagacttgtgcttggcattccgctcagactggtgctcactgttcggctgaaaaaggcgggcgcttggcccaatcggcgatttgccaccgctgcagccgttaagcaaggcaactccatttgcttgatggggtcggcgtttccttcaaattttagaattccaaattcaaattttttcacatttaaaaagtacgccctccgccgtggtcatcgctcggacttcgcccaatgcgacgcatggcatgcgaacattggcggaccgatgccgaagagttgcattggcgtttaacggcataaaaaataaatgaaatacagtcaccttttttaaattacactgactttggcattttgttgctgcctctgctgctgcggttggcactgcaattgcgtcgtgccgccgcccgctccgcttaacgcatgccgacgcgcactcgtctcggcaaattttcggcagcggaaggaactcgcggcggaccctccggcgaatgtcggaaagccgtgaagagaaaccaaagcacgttgctgaaggaaggagcattaaataatgaataaattaattggttttattaatttttgttaggggaggggcaagaacataaatttcggttttatatttgataaaatcgatcaattaatcaattaaataaaaaatatgggcggcgactcattgatataattgattgattttttttataaccgcataattattttatacaaaatattgtggtgccagaaggaggaagcggagtgtgggagaaagtgggataaaggatatgggagaagccataaaagagtcgcccgtagttcagtcggttcgagcgttccatggatggaaaaaccgttggttcgagtcacaccgggagagttatcctttactttctaattatgcttttgcctgcaaattatgggacaacaaatgaacggccgtgtcaagtggcgtcagtgatgcgattgtcgtgcattggtcaccgccgccagcagtttgggccagcgaacttttcttggaccaatcgccaccaactccagacaatttgcagcgcttaaaggcggaaatatttttttgaatttattattttattcgaaaaaaaattggtagtggtatcaaggcgaggagagggggggggggggg

SEQ ID NO: 45377 - DNA, 886 bp, Heterodera glycines
agttttcttgataaaatagccaattttttcagaaatttagaaatttccctcttttccccttcgctctgaccacccccctttttcatttatggccagcaggagtcctgctaaaacagcagaggacttcattcagtctctgtcttgtcctgctggtccatctaggaaacactgctggcccgggttttttcaaaatttcgctctctactctttcaaaaaaagtgttgatacattgaattgcatttaatttaggccgatgtctccgccagatcaaagcgacgaaaaagtgttctcgactcccgggcccagtgatcagcagaagaaggagtgatcattttgggaaatgaccgataatttgcgttatgattagaattggatgatgttttgtttgggatgaatcattatttgagaaacgactgttttttttttgtgttatgctgaatgggaaaagattttttgaaagtctcgagcttttcggactctggttaagtctagggaaattttcaatctcgagtataaaaataattaacaccgcctacggtcagcagaaatttgttgtgccatggcatttattgaattgtgctgctatgtaacgaaattcgggaaaattattagcaattttatcaacgattatttactcacaatgaatttcacatatatcaggggtggagcgcgcacagaaaaatcctgcgcatcgcgcattcaaattgccgcgaccgcgcaaaaaaaaatgccgcgaatcgcggtcgcgcattttttcctattttttaaagcattttttacacttttaatttttttgaaaaaaaatttgaaaatttgactggactttgttacgaaaattgcatatattcaaaaatgtacccattaaattttttaatttttgtttggg

SEQ ID NO: 45378 - DNA, 1123 bp, Heterodera glycines
cattccagacggcgtttccatttgtgtttaaacgattttcaaatgtgaatcaagtaattccactgcaaaatgtgcctccattacccactacacaatgttaagtgatgtcatccagataatatgactcatcggtatcaatcaaccggccattaattggcgcttaattgatgttgcgtttccttgtctattatttgccattaaatctcacaaattctcgctaattttttgatcattttattaaatgaaaatgagtaatttcatttcaggtgatttgtcggcattattcaaaatgttttcattgccatcattcccattatatataattaaactagcgggtgcgtgaaccgtcggctatttagctggggaaaagcgcttcgcgctttgggagcttcgctacctaggctgtgaagcgatttaaattgatcgaattggttggggaggtttttttgaatttttaaaaaattattaggggtttttagtccacatcgaggctcaagaacgggcgcttcgcgcccgttttttaaatttgttgaactcatacgggcgcttcgcgaccgtcgtttcggctgctgttggccgtggactctcggggccatggcatattcacgaatgcaaaaatagaaacggtcaccgcattaaaaatagattaagaatgactttggaaagggcggctcaattgccacgttcctggaaatcatggcacattcttttgaaattaggggatgggagagaactaaaacatccgtatttggtgtcacaggcagatgactatgctagagaagagaacacgctaatgtccacggacgcccttgacatgtatcaaggatcgtcagaattaagtatagatttgtcgacgcttaaaaatgaattgagagagaactaaactcaaaaattttccccgttaaaattctttgaagcaattctcatcacaaaattttgtgaaaatcaccagaaaaattctcaaaatatttattgacatttttttctaaaagtttttagtgtgaaacttctgctacgcaatatcagaaagatagtgcgcagggggggaggggaacgagctgttttccctcctggcacctgtgcgagactattgcgcaaccagtgcacaacaaaagggatacca

SEQ ID NO: 45379 - DNA, 1140 bp, Heterodera glycines
  misc_feature (160)..(160): n is a, c, g, or t
aaacaaaaaaatctattttttcaagtgtccgtttggggtactcaaacatgtatggggagcaaaaatccaacgcagaattaaagtacagactatagggaagctattcccgaaggattcggtctccccataaatctgggcgcatcggttcggggggactgcnccgaaaacaaaaataaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatcgggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccacgcagaattaagtacaggctataggggagctactcccgagggattcggtctccccataaaatctggcgcatcggttcgggggga

SEQ ID NO: 45380 - DNA, 1524 bp, Heterodera glycines
ccgtcagcggacgggggcatttggtgttgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttccccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaaggccaacgccggggaaagaccggcagaaaagccaaccaaaccagtaacacacaaagtgtgcaccggacggctagcacagatccaactacgagctttttaaccgcagcaataattctatgcattttgagagctggaattaccgcggctgctggcaccagacttgccctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtggccatttatgaggccccttctccggagtcgaacccttatcctccgtta

SEQ ID NO: 45381 - DNA, 778 bp, Heterodera glycines
ttttcaaatgtatttaattttttaaaatcaaaaattattactaggggttataaaaaagggaaatcagcgatacggctgcaaacactgcaatttcaagcatgatcgccctcagtctgtcgctgctcacggtgcgcgagagcacggcgatgagacggcatgcgtggatttgctgtacaactttgagagtcaattgttggcgatgtccaaggattgctttggcgtagagcgcttattcgaaaaagaaatccgtcgccgcaacagattggtgagtgtacttgcacattttttaccaaaattacattcccaatttaaggagcgttttgcccgttcagctgcgaattcaagttcctccttcggaggacgcattggaagcgacgaaaatttgcagaacccaaacaaagaagggcagcacaaattggcacaacagcagcagctgacaatgaaaatttcgcatccgaaaatgttgacgaaaaatgaaaacgccgaggacagagaatggacgccaagggaagaggctaagaaacggcgtagcgaaggcggataccgcttctttggcgtaaggtgagtggaacaaatggaaatgccgaaaataattacgaatgcaattgacatgtctaatcatcatgaaaatttcgttgtttcagaaaaccaatggcacagaaggcgcgtgacgaaatgatcaaactgcgagaggtcagcaagagacttggaggagcccaatacttcagaaaacgcggcaacgaatcgactttttgcgaggcgagtcttattttaatgg

SEQ ID NO: 45382 - DNA, 881 bp, Heterodera glycines
gagaagctttttgagcgtaattacgatttttactttacccatttttttgctaggcttagatcacatgcgattttcggcactctgataattttagcgttcataatgggatgtataaaggcgattgtagaaggaattggatgcgctaaaattgtttgagaagctttttgagcgtaattacgatttttacttacaccatttttttctaggcgtagatcacatgcgattttcggcactctgataattttagcgctcataatgggatgtataaaggcgattgtagaaggaattggaagcgctaaaattgtttgagaagctttttgagcgtaattacgatttttacttagaccattttttctaggcttagatcacatgcgattttcggcactctgataattttagcgttcataatgggatgtataaaggcgattgtagaaggaattggatgcgctaaaattggttgagaagctttttgagcgtagttacgatttttacttacaccatttttttctaggcgtagatcacacgcgattttcggcactctgataattttagcgttcataatgggatgtataaaggcgattgtagaaggaattggaagcgctaaaattgtttgaggagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttaggccattttttctaggcttagatcacatgcgattttctggaagatgataattttagcgctcataatgggatgtataaagg

SEQ ID NO: 45383 - DNA, 1517 bp, Heterodera glycines
ttggctgtggacgaggatttggttgccctggaggcaaatttcaaatcatcatcgccaaagaaaaaactcttcaattgccgcgtcagtatttttggcaattgaagttggcgggtctggcaggctaaaatgcacacagcttaagttaaagcagctgtgcagccgccaatcaatgtcggctagggcttcaagctctgctactttatgctgtgccagagtaataatgccttgcggattgtacatttggtcgttgtacttgttccacaattctatggcattactcggctggccatagaccaggatgctcacaaagagccatctcatctgatctggccagcgcgacagagctgcctccgccagagttttgtcccaaattttgtcgtcttcaagaagaccatgcattattgcagcctcagtgaatgaggtacaaagcaacccattaaccatcttaagatggtctgggtctccaggaaagtgacgcataagtgaatagagcgcgaacctttccgggtccgatgggggtacaggaacaattcgaccgattggtggtctctttgttaggttatatttccttttgttccatttgtcctttgcccatataaaatgctcagggactttttcaaaaagcatgtccttgagcttcggatcatgcttccattcattttgccattgtttccaataggcagaacattgcgtctctggcagttcgccttgctggatttgttgagctttgctcaccagctgaaaagccctgtacacaatcggttgttgattaggcatatggatgctaagtttgacaacctgatgtgaaagtttggcaaatggcagtgaatggacaatggcatatgcttccgttgcaccacggaagttcatcttggcatattgagccggctcatcaattccgattttattgccggactcttgtttgcactcgacataacaatgccctggccctttgaaagggtacttgagtgcgtatttaatatttgctttgttaccatatgcaaacagtacattatggtgtactcggtaacgtagcagaatataaggattatacggcacgacatgtgagttgtcgtatattaggccgtttacctctaattgggcaccaccatcagttggtgaaggccggaaatacatcgcgggcctgtccgggcgcaaaatcgtacattttgagtaaggggctgggaaccccttcttgcaccgcccgtaaattgggtcgctaggaccacaccaactgtcactgcatctgtgcagttgcatatgcattgtttcgcggatttcgcgatgcatttttgcaatgggcgtgtcgtcatctttatcaggcaaagatggaatgtgcgcccatatgtattcctgaatgacatatggaactgcgtccaggtctgtttgcgccacaatgtgggcatgtgggcctcctcggccttggaactccatggattcaccgtaaccaaggattgttccaaagaactttttctaaaaaagttcttctcggaactcagcgattttgctggtccaaa

SEQ ID NO: 45384 - DNA, 1633 bp, Heterodera glycines
aatgttagcataaatgtgtgcaagagacaacgattagagagacagatgagaagagagtcatgatatgggcaattttaatgaattttcacttgaattcaactcaagacttttaaattttcatccttttatttatattttataagttcaattttttcgttaggatattgctaaatttaggccaaaactgttgaataataatcttttgaagttttctcggccgacatggtgtttaaaatttgttaagtttatatgtgttggcgaagtgtttaataaaagcaacagacaaatgagattcagtgccggcattcatttttagttattttgttcacaattaatatttgtagctcataaataaggatcattcgttaaaataattgttttttatgtcataacaatcgaatctgatggacagaatagcgcttagggtattgttttgcataatgtggtgagaatctcggccgacaaggtgtttaaaatagtgccgttatatggcttttagcgaaatgtattttaaaattaaataatataattaagtctcagtaccaagccaattattttgttttagctaattgtccttatttttatttaatttatatttgtaggaactaaaatttatgttattcgcttttgatttaattattacttgctaaatgaggatgaaaaaactatttaaaccatcagttcggctttttctcggccgacatggtgtttgaattagcgcgttattgatattattaatttatggctaaatgtatttaaaagtgatttcaaaaaaacagatgttttgattagtaatatgaaaagtgtgaaattattgtttattaagctaattaagatttaataaggttatttcttctatatttctaatgattattcgtacaaatttcactaatttaatttgtctaattttaaagcttttagataacacattttttttaaattgctttaaatctggagatgagccgacgacctcaacatttcgtccgtcgaaattgcgggcaatttgctgaaatttaccaaaacaggtttaatttcattttcatcattcatttttagggggagaaaaaaaaattattaattcatcaactctctttttttttaaatttgtttccagccctcaggcttgggtttggatttaaagatttaggatagatggggaaaaaaaatttttgaaattagtggttgcctaatgctaaaataaaaaaaaatgtggttgaagttgattaaactaattcccattccccttttagtatggcaaaaatgtttgatttgtcgctggacaattggaccttggcaacaaagagatcaagcgcagtggacattcagttcggcgcttgacgttttgaacccggaacagcaggtggtcaagcagtactaagcgtcaacgacaagaggtaccagtgataggcagccgtttttttttttttaaattttttgttgtcggtcaacgcatagagagcggttggtcgttagcgaacctatttctaatattttcttttgcttttgctttccaagcaacaaaaaaaaaacatcaaaaactaaattgtgagaagaagcagggaaaggaaaaaaaattttgtcatcaagttttgagggtttttattttttgtaaaaccaaaagtcactaagcaaa

SEQ ID NO: 45385 - DNA, 1093 bp, Heterodera glycines
cgtcgccggacaaaacgtcgccgcaaaaaaaaaaaataaaaattttctagatttcaagaaaacttaaaagtattttagctttttgaaaatctaagtgttaataaaaactaaatttgctgaatttccggaaaaacccccaaaaaacttgaaaattttttaaaaatttccttgaattttcttgatagaattttttttgtttagatttttctagaatttttttcgtattaagctagctaactaaatttatgacaatttttctagatttttttctaaaattagaaaaaaattttgcggcgacgttatgtcccggcgcgtttcgggccggcgacgttttgtcctgctccctccaaaattgaagttttggcttgagtatgaattgcaaaattgttattttttggcgctaaatcgttaataattcctgctttttcatccctgtgcggaaaattttttttcaaaacaacactggagaaaaaaaatttttggcacgatgagcaaacaataagagctcttcggatgccctaccgaaacttttttctgatacgggcctgggcctcgttggggaaaaacgcagtgtaaacaccatttctcctcccctcccccgttgtttctttgtttctcctttcaagatctttaacaaaaaccttgaaattttaacgaaaacgttgaacagttgttctttaaaaaatttcttgatgagaccaaaaattgttggatttcatccagaaatgcaccaagccgatcacattgtacaacaaatccacgtggcgacacccccaccgcatggtcatcaacggtcttcagtggttcctcaccaaaaagggcttggctgcgacaagtcatctcgagtctggcggctttgcccggtccagcacagaagtgagcctaagtttttatggtcatggtcttagagtccattttgtttgactttactcaatttttttttggcttattttcaagttgttgtgtctgtgtttgagtcacttccaccaatcccttccccacattcccatttcggattgatcaccccgacttgcaattccatttccttccgtcgacggttcacgaggacggcaggcaaagtccgaattgccat

SEQ ID NO: 45386 - DNA, 495 bp, Heterodera glycines
tgttgcacagtttgcaggattattaaagccatgctcttccctttattcatctgctgctgcccctgcttttcctttccctccctcttcattcatccatttattcatttgttctcccatttttccatttgtccccccccccaattctttttcccctcatttttcctctttcgtttcctttgtttatttttgccccttaaatcccttagaagccattctttcattcattcactcattctttcattgtgccaaatgttttctgtcatttcgttttgttcgtcctttggccaatccgttcggccaacacttttttttttaaattatttttttttccaaaatttcaaacaaatccattcattttgttcttcgttcgtttgatcattttttgcttttcaattttctccaccgttcgtttccctcccttcgcccccccccattttccccctttcgtcccccttttatccctcctttatccgccctttcgtccttttgtccccc

SEQ ID NO: 45387 - DNA, 1307 bp, Heterodera glycines
  misc_feature (58)..(58): n is a, c, g, or t
  misc_feature (1290)..(1290): n is a, c, g, or t
aattgttgcgcataatgcatttttgacgggagttttttgaaatcattaattttttggnttaaaatagttttttcaaatgtttggctaattgttgagctgtcgttttgttgatgtactcattcaatggcacagtgtcaggctaaaaagcgtggaatttcaagttaaaagtgaaaactcgaaaattttcaatttaaatttaaaaaattattttacaattcaattatttgattgattatttttctaatttattttatatacaattattattatttttttaatagataaaaaattctttgtagtgacggatttatgaaagccccatgttggcggatttataaaacgacccagcacgggttaatccaacctcatccatatcaaatttaacattaattcaatgtttaaaattaaactaaaatttatatattaagatttaaaaaatgatttttttttaacactaattatataaatgcaattttttttacatttgtcactgatcactgatttaattaagactatgtatgagtgggctgctgatgaaaataatacaagcgattaaaaatgccaattttaaatatattaaaaaagaaaaattccggtcctatccaactcaactcacttttgtggatgaagaatgccagaattggtcatcccccacaaagtgccattctcgaatgtgaaacattcgtccgctgtttgtcggcacttcccgaaacacggcaaatggctttataatgtacggcaaatgcacccaaagtgattcggtgagcgaagtgttcaccaccgacttttgcaggagtggaatttttggtgaaacatttgccgacattaatgtgttgagcaacgaaaaatttgccggatttgttgcttaaaattttaaatttataaaagatttcattttttgcattttcaaaagggcagggctcacatataaaattcttaggaccctaattcataaaattgtctatttttggtataaaatatattgataaattgcataaaattctcaaaatttgctctttggcatttttcggcacgaaattcccattaatttttttttaatttggtctaaaaaggccagcaaaatcgtttttctcgtttccgaaattttttttttaccgggctctaatttttaggtaaaatctgttaatcgaataagcaacttgttgtgatttccgtgtgcaaccgattgtacacaaatgccactgcttttgggtcattaagtcgtaaaaattcgtcataatatgtgccatcgtcgggcaccaaaatgtcgtcaaaatcgccaacaatcanaaaatcggctgcatact

SEQ ID NO: 45388 - DNA, 1340 bp, Heterodera glycines
cgatgttgaggaggaagcgccgcacgacaagtgagcattttttggaagaagaagggatggtttaaaactggtgaccctcaattattacagattgctttattccttcgtggcctgctgcggcgattttggtctatttggtaagtgctcattgacatagacaagcggaggagggaggttcaaaagtaccagggatgggaagttcttcgctgactaatagcataaaaaataaatgaatgatttctatatttagctagcaaagtgttattcatttgacacgtactacaggcggaatgcaaagcgatgggagcggaatggaaagtgtgaatgtaggactggaaaggcgagcaaagagctccgtctcttacatgttgcgtcggcgttacgccgatatgttcttctgatcgggatgaccttgcaaacgggaccgggccgggacttcccggtcatccgagctcccggtcccggttcccggtcccgggttttgaaaagctcaggtcccggtcccggtcccggtagggcaaccgggaaaaacaagcactggtaagaatggggtctgagtgaaaaattagtgaagaaaattggagtcaaagggaaaaataaaaaataataattaatatattctttaaaagtaagactgcccaagtgtgcaaatggcttaatggctagtctccttgactttcccttcttctttcccctggttcaatccctctacagaaattagattaattcaatttttttttttgtatactcgtgggtttcctataaagaaaatatgattcctcatagtttttttttaaatttatacatattttatcattttttaaatgaaaatcctaccaattgagcttaataatcgcaaaaaccaaccttttttttgttgaaaatctgttaacaaattgcacccaaatttttaaaatttcccccggcggcgcctatcggcaccgccggaccccttctttcccaaaagttttttgaaaaagcgctccgaaaaaaagtgatgtgaaaatcaaatctgaatttctattaatattcgatgatttagtccaaaaatgattaattgtttgaaataattgaagaaaatttgtttgaaaattttcattaatttaatttattataaaaaaccaaataattttgtattattttcacttgatataaattaaaatttgaattttttttttatttttaaaatttttttgaatttttaaaatttcccggttggtcccggttcccggtttttcttgcggtcccggtcccggtcccgaaaaaaaatcgaggtcccggcttctcaggtcccggcaagtaccggtcccggtttggcaaaaattcccggtcccgtggca

SEQ ID NO: 45389 - DNA, 719 bp, Heterodera glycines
tatcattgtatcaattaggtactgttgtccgactcgactttcattaattagtgtattgaaatacgacacacaaacagaattttggaaatcggcatacattttctgaaatcggaatcaaatttttgctcggccttttgtagtctgtgttactataccgtatacacatatataattatatcaataaatattaaattttaatgaactgcctaattgctcattttttattaatataaaacaattacatatatacggaatagaagagagattgagagagtgcaagaggctagtgacaaacacaaattcatataaacaaaaaccactaaactaaaacaatgcaactttcttgtctctctctctctctctatatatctctctctctctcggcctctatacaaattccaaaatggcttttcttcccccgagggggcggggggtcataaaataatatgtacatatataacccattaataatgctaacaaaaaaggggatttatcgatttttcctccgctcattctcttaccacctcaaatttcaattgatctctctgctgcttctctctgctacttgtggtggttgctgcttctgctgctgttttttttcgggacaaacatttaaaaaggcaaatgagctggtggttggtgcagctttcattttccgcaaaaaaaaaaatttgtttgtgaaaaatgtttttaaatttttcacatgctcatctcttttt

SEQ ID NO: 45390 - DNA, 961 bp, Heterodera glycines
tagcattattatggtgccacatggtggtgcattttattcccctgattcgtttctcctctcccaaacctccatttaattctaaattccaattgttcatataaattactcctaccaaatctcagctcagctcttggggctgggtaattaggcctaaatccaaggcaaattttctcattaattgattaccattactatcaatcactaaacacttttggtatctcttataaattatgtctttttttatttaagtataccgaaaagtcgccgcgagaagtgtctatgaaaaagggcgacgtgctgacgctgctgaacgcgtccaacaaggactggtggaaggtggaggtcagcgaccgccagggcttcgtcccggccgcctatgtgaagcggattgagcccggctcacagcaccaccatcaggtgggaaagccgacatagctaaaataaaaaatcctaatcttaacggacaaccccgtttttggaattttatgagcaatttaatgagagaaattcccaaaattttcaaaaaataaccccttgcaaatgaatcaattataaaaataatttattttttttttaaaactatttcaataaaattaaaatgattcaaacacacaatcgatcagtggacctgtgattttcgagaatcttgaagccaacataatttcgatctcacttctcggccaaattttccataacaaagctgctttatttgtcaggcgttggccggccaaccgatgaacaccatcaatgccaagcagagtcagattgaggaccaatacaagcgcctgttgatgctgggcgagcagcgcaagcgcaagttggaggaggcgtgcaaggcctaccaggtgagtaaaacgacggttagatcattttttaaacaaaatgtttgtcaaaatcttgctcaaagcaatataattttaattttccacctgttttaagtgtgcgcgaagcaaacgatttg

SEQ ID NO: 45391 - DNA, 1552 bp, Heterodera glycines
caccatagggttggcattctggttggaatgccaaaacatttttgccccctccgctgccgccaatggaaaagccctggccgaagccgggcggcagttggtactcatttgtctgcggagggccggacaaaaattgctccaccgcctttccgatttgttggagttggtcaggggcttcggttgctgcgggcggagctttcggagcagaaatctttgggaggcaaatgcataacaattgaaggcgaatgccaacttcgtaagtcttttctgggaaaaagccgccgggacgaggggcgatcaaagtgtcaatcaattcccgagcgtgtccgtccaattcgaagtactttgcctgagggaaacttgggctatcatcagcagcaccgtaagcaatggccaaccaattcaggtggtacggtaggtttcggtgcgtaattttgcccgttgagaagggaggcgtcaagttgggcaagaacagagaagcgcggcgaaagatggaatatggagagaaagaggacaaagacggatgaaagccacattaaagagggggctaaatgaaaatggaaaagaaaatttgaaaaatgaaagggggaggggggggggagcttagaatggaaccggtcaattggagacagaccaatgagaaagaccaaatgcatatgtaagtgagtggacagcggaaggggagaggaggagggatcggatcggatgtgctgttccatgtagtcggtgatggtcgccagccactctcactcactttaagagaggaaaacggcggaagggaaaggaaaatgcgcctgccgaagggatgcagcagcgaatcgaccgtccgtccgtcaagagaatttggaagcggacagcgacgcccgagggcggaaatccaagtgaaaatgggaaggatggattggagaaacgaaatcgaggaaaaagcgagaggagggcgaggggtgtcagcaaatcccccttccccttccgtggcgattcgatttcggcggatgccatcgctcggcttcgcttcccttttcatccgtccgtttgcttttggaatgctttttgttcgtgtgattgtataagcgataaaaagacaattggtgggggggggggtgaatggatgaatgacccaatataagtgcccatcgtcagtgatgaccccaatgtgttgggtgtctcttgcggaaagtgactctcccttttccctccctttcagcgcttttcgtttcgcttttacgtggaataaaaaacggaaaaatatttcagctgtggaattcgagaataaagctataatcagtgaaaagaattacaaaaaaagatttgtttttacacaattaaaaagtgggagatcattttagaaaggaaattaaattgtcgacgatcggaaagactaacaataagaaatatggagagagagaaaagaaaaggcagtttcattcatttaattcgttgtgctgctcgaaagtgtgccatttcccgacagaaaacatcttcattaatgggcaacattttatggttttagccaaatgctttcatcaatacacaaaaaagaatttgtattttttga

SEQ ID NO: 45392 - DNA, 702 bp, Heterodera glycines
tttgacctcacgtgtgcggaaatgaggaaaatgatcagcggaaacaaaaaaatgttggaaaaaatccattccggtgacaaatataagccatttgaataaatgttaatcattttcattgcataagataaaaattttaaatgttcttggatttcatgagttttccccattatgcccttgcaaatcggcataccagtccttggaagccgactttggacgatacgagccctgaaatatctacataaaaattgcgataattttttaaagtttatttgaacagtttaaattttacggagagagataatgtaaaaatgagagactgctgacaaatgagtttcagtcccagtcatacaaaatatttttgatgaaggagggtagagaaaataatttcaatagagagtgctatgggaagagaattctcttcccttcttcgctgaatcttttggtaggagacgcagattcatcattatgttctctgttctctctctgtcttaatctctttccttaatactctcttttaaattaattcttctttattcttcttcatcaaaaattcttttgtatgactggggctgtattaaacagtctcacttttgcgttatctctctccccattatattttccgccaaaagtcattttttaaaaaatgactgttcattttaaaaatttatcgaaattttaaaaatagcgttgacaagcgattta

SEQ ID NO: 45393 - DNA, 612 bp, Heterodera glycines
ctcatataattatggtttactaattacacgcacttactaattaccccccccccccctccctctcccattaaattcatcataaaatgctttgtttcattcttcgcccgtttacccttccgctgtgcgcccgtttcagcttccggatgccaatgcgtacttcaccgttcgccgcttcaacagttgcgtcgtgtaccttcttgtcgtttagtgtcagtgtcaaattcggctgcgggtgtccgagaagtgtggcgaagacagaaaactcttcgccgccaattttgaccagcttttcgtccgtgtagcgtcggagcttcaaaagttcaaaggttttgtatatttgggccaaagcattgtgcccccccacctgtattttaggcgcaacttcgaacttgagcttggccgacggactgcgttctccgctggcctgaaaagtttttcccattttttcaggcgcatttttcgccatttgcggatgaccaatgcgacgcgtgaatctccgacatcgatctctgcaaaaatggatatctccagtgtagcgcgcaggtcaactgcatacgcaaaacacttcttctacatgaatcccactccattgcggaatcaagtggaccgctc

SEQ ID NO: 45394 - DNA, 1514 bp, Heterodera glycines
  misc_feature (132)..(132): n is a, c, g, or t
tttttggcaaattttccccaagaaaaaagcaaaaaaaaggggaaaaaaacccccccttaaggttcgatctttttggaaattaaaaaaatacaccactaaaaaagagatttttcaaaatttcggaaaatattntagttattttgtccagttccgaaaattttcgcttaaacagaatgaggttattacaaaaattttgggttgtatttgatttgcaattgtgaagctagatttaataaaaaattggcattttttaaatgttaaatccattttttggcagtttatagcgtatttttaagtctgttttagcaaatattgaatataaatacatttttcggaattttttaaggtttaaaagatatattttggcagtttttagtccatattttggtacatatttggccattttttagatttttagtccatatttcgggcttttttagtccatattttatgtccatatttgacgttttttagtccatataatttataactctagtaataagtagggatgatatttttatgtgctaaaaactgccaacatgggtaggttttaggttctaaaaatgtgaaaataggtgccaaaaagtcccgaatttagggggtgtaaaatcgaaaattttctttaaaaagcaaaaatattatgccaaatcattaatgagatatataatcttaaaaaaaaattctcgtcaaaataaataaattttcgagatgattttttgagaaatttttaatttcttaggatgtattttataaaaattaaggtcgattcttagtggtgtattttttttaattttaggtcgattttagggttgtatttttcgtttttattgcatttttttgataatattttgcgcaaaacgccagaatagaatcaaataggttttacaaaattttttttggtttttaggctctaaaaataaaaatctagaaaataaatgccaataacttgaaaatagcgtaacaacaaccaaaaaaacttgtttttcgtgcgtttcaaaccatagaagctcagaaaaaaaaacagttaaaaacctaaaaatatcatccctagtaataaattggctttcggctctaaaaacccaaaataggcactaaaacctcaaatttagtagtgtaaaataacaaatttatgaaaaataaaacaaaataagccaaaccagtattgaacataattttttaaaatcaaaaatttgtcaagaaaataaataaataaaatttgtagacgaatttttgagaaactttttaggagtgtatattttaagaacagcggttgatttcgacactgagtgatttcaaccgtgtgatttcgacaatgattaaaaaattttcagtaaaattttctaagattttaagcaattttcttaataaaattgcattaaaatactcaaaaattttcccggcggcgcctattggcaccgccggaccctcattttaccatatttttgaataatggaggccaaaatggcaaaaaatattattttttggcgaaaacggcgaaaattttgtaaaataca

SEQ ID NO: 45395 - DNA, 1303 bp, Heterodera glycines
  misc_feature (1267)..(1267): n is a, c, g, or t
  misc_feature (1276)..(1276): n is a, c, g, or t
  misc_feature (1295)..(1295): n is a, c, g, or t
tccaaattggaaaatcttggtatcattcgaaagctctcgatgaggagaagctttttctaagcaaatgctaaacaattggatgcattaaaaaagttataggagttcgaaattttattttaaattttagaccaaaataaaagtgattgttttctttaaaaaagcgattgaacaattctatatttttttctctatcgatatacaaaagttaaagaaaatctgcctgaggaaaaaaaaggtatgctgttcgaagtaaatgttgtttttcgaaataatgaaaatattatatagtacgccaaaaggagagaaaagttagagaaaaaaagttctctgcactctctctttattgacacatgtctcgatttttgactcggggtgggtttgggcattttttccgtcgtcactttcatttcttttaatgctttgtgtcctcaatgattgccaccgcttcgatttcgactcgtccgttcttcggcagtgctgccacctgataagtgctccgtgcagggaaagtgtccccgctgaaaaaggatttgtacacgccgttgaccgtttggaagtcgtcgatgttggccagcaaaatggtgactttgaccactgaatcgggtgtgcctttctcttggcttctaaaagtgccaaccgttgccaaatgatgtgccggcagcgcttagaatggcacccaaattggtcatcgcctgtcgcgcttcgttttcgacccctcccgccaccaattcggacttccccggcacaagcccaagttggccactcacatacaatgtgttgtgggcgagcacggcttgactgagcaaacaaaacaacaaaggccacgccctcccctcccccatttggccaacctgtaaggcccaatcgccgcgggcgcatttggcgtcgaaattgaacgaatattggacataataacgaattgcttatttgggagtggaataatagaaaatgttgtacaaattatgagccaatagagaaacgtcgagaagttattaccgttttaaaaacatttttaggtaatttttctttccaattaacttttcaatgaatttttttaaatcaatttaaattttatttatctgatggcccaatttttatcaatcgaatgctttgctatttgtgtgttaataaacgagcaatacaatgataagtaataaaatacatttgttttaacaatgcaaacgttacaaaatgatttaggataattaattgatagaggcgataacataagtgctaatagttaatagtgtctttctcccagagccanaattctccnttacttttgttaggccaanggaaaaaa

SEQ ID NO: 45396 - DNA, 853 bp, Heterodera glycines
acggtactttcgggttttgtgtcaacaaaatttttctctttgttaaattgattttaaattaataaaaagtcgtttctatgggttttcggggtcgtagaacccgaatatgatgtccgtttcgacccatttcgaactccgaacccggagttcgaacaattatcaaaattcaatttttttttcattttttctcctaattattgtatcatcgagagaactcacatcatattgccgttgccggtcggtgtgggcactatgtttggttcatggagggtaatgctgcataatgggcagtattgctcgccgacaaatacgacgctgaatggagcattcggacggatgatgtcgacgcggaaatgggcaaaacgctggcttttgactctgagcgcagtacgcatccaatcgaggcaatttctataaattgatattatattgtaaatagagaatatttagggtcctattgataacccagatgaacttggagaaatttacgattcgatctcgtacgcaaaatcaaattcaatcattcggatgcgcttcaatcatttgggcgaagcgatttccaaaaggccattcgggattacttgaaaaagcaccaatacggaaatgcagagaccaacgacctgtggaagagtttgtccgacgcttctgggattgtgagtttaaacaataaattcaatgtcgaagcaaagaatttccgcacattaaatatatttgcaaactttattttcaagaaacaaaaacactaggaaaggaaaatggttttaccttttgggttaaggatgtcaaagcactgatgtcaaggcgcttcgcacacgacggaggaggaagggaaaatttcctccgccaacttcgg

SEQ ID NO: 45397 - DNA, 1444 bp, Heterodera glycines
  misc_feature (134)..(134): n is a, c, g, or t
  misc_feature (136)..(136): n is a, c, g, or t
  misc_feature (260)..(260): n is a, c, g, or t
aaaaaataaagaatttttaaaaattcccaaaaattatgaaacttaaaatagaccatcatatcggtactcagcaccctatttttacccccagaaaaatattttttcacccccatttttcgtcgaaaaaaaaattncngaaaatttctagggggcctagctcgaaaaatttttgaaaattttacatcatgtagtacaccgttcgatagagcttaaaaagctctacaattttgctctaaggcattttttggctaaaaccgacnccctgacgagttatgggcccgggactcaaatgtcccgcttaggccaaaaattttttctatttccggaaaaaaatcgaaattttttcaaaaaaaataccattcgatagagctcgaaaaactatgttttggaagtggtcttcgttttcccgggaaaattcgttaaaaaatcataaaattcaaaaacccgaaaaccgttttttaggcctaacttgaaaaattttgaaaattttcgaaattttaaaacttggttggatagcctttcaaatactacacatttttgctcagaaacaatttttcggtcaaagcaacccctggcgagttattcgcctggtactgaagtgtacattttgagcacacttcagttagccaagcgtgcaggccagggggtggctctaataaaaaaataaaaaataccagcatgtagaggacagttgtggggagtgccctcacagcgggcactttttgattcgggttttagaaaaaaagttaggggccctaaactgcaagaaaaagtgagaaatcggtccccgggactcagtcgtccgcgctgaatttttctctatagttttcccggatgcgcctcaaaaagttgtaagacccttccactactttcagggcgctcccggccttcggccgggagattttgtttttgcaaacgaaactccttgtcaatataacatatatagtaataaaatatcatttcgcaatttgcctgcgttaaattgatgccaatttagcgagggaaaaatgaggtggcaaaagcgggagagaactgttatttacgcaaaaaccaaaacaaattgggattttcacacaaaaaatgtgtgtagaagcatacagaaatgcataaaaaactgtcgcaaattgtgagggcttgtttcattgatttttttttttgaaaaacctttgaaaatcgtaaaattacataaatctcaaaaattccatggatacaatttatttttactcagaaaaaaacttaattaaaagatcatggctttttatgtcagtattatttgtacacaaaaatttgacaaaactccaaaaattgcgcaaaatttacggcgaaatcgattcatcaaaaatatatttttttgaaaatcttaaaaatccaaaaacttacactaataaattcaaaaaaataacaaaattacttatatttttattctaatttgtattttaattta

SEQ ID NO: 45398 - DNA, 927 bp, Heterodera glycines
cccttttgaaaaattttttcacttttttcatatattttttttataaatgattttttttcatgcaattttagcaaatggttaaagtttcaagatattccattaatccgctcatcgcttttccaacattggacgatataaatttgagatggcttttttccaaaaactctgaagagattttacaatttttggcacacaacggacttatccaaaacaaattgttgtgccaaaaacaccaacaaatgtgaaggattatgggcccagttgaagcagaaaacaaaaagaattcatggcaccagtatgaaattgacagaatcatatatgcatgaacaaattttccgattgaatgctagggctaaaggattgtctgtttttaaggcttttgtcgatttattacatcgtaattataattttttgtgattaataatgctaattgtaataaaaaaaataataaaaatatatgaaaaaaaagtgaaaaaaattttcaaaagggaccacttttacagtagcgcccaaaaaaaatgtcatcgatttacatggcggaccccttcgcaaaattggctggaatgccggagaatcgtccaagtgactggaatgatggtgattgagtgagtcccagtgactggaatgccggataattgatgcaatttatatgccgatttattatgcatatttggatttgttacactgatggaaaaaagtcttgcctcaatgtgataaaatttgcagaaattaaaatttagacttgaaaattgaactgattatttttagtttatgtgtttttaattactccaatatatgcgcttttcatgcaccaaaaacatttttgatcgactcattcattcccgagaatgagtcacgtgatcacaaatcgctcaaaaaacgacggaaaaaagtcctgcctcaaaatttttaatcgaccaaaagtca

SEQ ID NO: 45399 - DNA, 1430 bp, Heterodera glycines
ctgaatttgaaaaaaaacttggtcaacctgaatatacatatacttctgaacaattctaatgctaaaaaacaggcactcgcgcgaaaactgaataaaaattttgtatttggaaaattttgtccaaaaatttttatgttctaaaattaccggtttttaccggtaccggtaccggtaccggttgaaaaagttggtaccggtaccggtaccggtttttgcagtaccggtcagtaccggtaccggtttttttgcaattaccgattaccgctcaactctatatgtacataataattatttcgaagagaaatgtgctaaaaaagttttagtcaggaaatcttgtattcttgtcttgccgacaaattacagctaaatatgccattttccacgttaaatatttcataagggaatattctaaatatgccaattaaatagtgctaatggatataattattaatttggtatgtttatttccaactttttgacggatttttttaaatttggaatccgcataatttctgctacttcaatattttacttattattcagaagaaataaaatatccaacgaaggggtgaccacttacacgttagattttagtaaattaatatcaagtccaaggagctcttttacagactgaatttttgtttaactcaatccatttacaacagatggagcatctgttatatctttgttgagtttagaccatattaaggccgttctgttgataaaagaatttgaagttttactggattgtgattttaacacaactttacgtctaagattataagggatgtgaccagaaaattgtgggaatatgtcttttttaagatgagtgagaccattaataattttgaatgcctgaactaaatcaattgtttttctcctttcttctaaagtttgaataaatcaagtctttgtttgtaaggtatgtaaagaagtctgcatttaaataatgcaatttttgtaaaatatttttggcatctttctaatttatttatatcttttttgtatgtcggattccaaatttcaggcgcatacatattctaaaagaggacgaatatatgtcttataaactttggtccaaatacgtatagagcgggattttaaaattttggcaatattgcgaatccttaaataagcagctttagtaattttagtataatgattagtaaatcttaatttattatcaatcaaaatgcccaaatcactaatagattcaacctcattaataatattgttaaataatttatattgttgttttgaattatttttgccaataaataaaataaatgttttatttttgggagatgtttaaaccaaatgcattagcccattttccatattttctaatgcatatttaatttgcttcttcatcacgagttttgtaagagacataaattttgacatcatcagcaaaaagcttgatgcaaact

SEQ ID NO: 45400 - DNA, 1086 bp, Heterodera glycines
agagagagagagagaatactagtgagagagagagagagaaatggagagagagagagagagagagagaaagcatcctttttaattaatgttgaaatgaccaataattggaaaagcaaagtatatgttcataaaattgccacttccaaattccgaatgttgcagaatttcctggtcggtcccctggagggggccgtgcccggcgacgtcgccgtcgaattgggcattttcggctttctgctgggcgacacgcgggacggaagcattgtgcgcaacactcagcaaggattcatagcccgcagcagcacaaaattggtaaacgcagaagcagaagaaaaatacgaagtgtacgactcgctgaatttaatttaagaagccatttcaaaacggaagaaagaaatgaccaagtgattattgtgataaatgataaagacgataagccaaggttggctaatcatttttcattgcttttcaaattaaatttttgtccatttgaatatgttctaaatataattacattttctatcctatatatatatatatatatatatatattattaatatatgtttttatttatatatattcactttttgctgttctcaccctcttttttaattaataaatagtttaatgggcaaaaatactcattgacttagaggctcgcaacccttactcttaccgtacattcgaaaaattctatctctacttttgacattataagagaaactcaaaaatgagggctatttttttgtttttggcatttatgagtcatatcctgagaaattaaaaaaacgttatttcagtgcaattaaaaaacaatacaatcaaattcgatctgctgggagaacacaaaagtttttaaaaacattaggaaaaagtgtcttaattttcttagaattgtctgtacgcaactacagctttaagatcggctcggaagaaacaaattccgtccaatggattttgaaatttggaaaacggaagaatcagtcatttgttcattagcaatgctttacatagttttttgttatttgcttaaataacaaaagcattttactttatcaagtttaattatgactctagagatcccc

SEQ ID NO: 45401 - DNA, 835 bp, Heterodera glycines
  misc_feature (697)..(697): n is a, c, g, or t
  misc_feature (761)..(761): n is a, c, g, or t
  misc_feature (763)..(763): n is a, c, g, or t
  misc_feature (782)..(782): n is a, c, g, or t
gacgtcaacatcgtaaacaatacgtttgcggtagattatttttctcaatttaaaaatataactaaattataaaatgtgtcaaaattattttacctcttcacatactcgtctcacttcaatggaagacattttttcaacaacatggcaaagaattgtttcgacaagatttgtaacttgtctttgttttgcgagtggttccttgtagtacataaggggcgttctggtgttactttgtttgttttttagttagagaaaaaccaagataaattttcaggtcatcctgaaaggatcagatcatggttgtgcaattgattttttgatgagataaaaagttacaatagtatgaattttttagtatcaaaacttgatgctataaatttgttacagcaatttaggacaattttcatttaaaaaattatcgaaaaaaattattgaaaattattcccttttaactgttccattttttatatcgttcttaatattgattagggaagtatgactggtaaacagcttatttgaccccacgcgaagtagttgggatgaaaaaaatcttgcggctataattttagtacagagcttatgtaaacaataagctaatttttaaatatagagaaaaatggcaccttatccaacacttacgtatgtggaagctgtttgtttagcttgtattcggtccatcacgttacccgtacttgtngtatttacgatgatttcgttagcagggcagcctatttgaagaaagcagacatttattttgaagncnacttgctttatcatctcanaaggattagaaaatcaattgctgattggtaaaaagagaaggcactcatgaaag

SEQ ID NO: 45402 - DNA, 827 bp, Heterodera glycines
  misc_feature (821)..(822): n is a, c, g, or t
aaatgggcgttgtctaagttttgtattaagttataattcaaccgaattcacctttaatatttaaattatgttatttgaaatagttactgagcacaactccttcttcgaatgtcatgcaaaagaacgcacctgaaccggaaaagctgacctcaaagcctatcgggacgcttaatgagactaaaaaaatggaagagacaaatgcgacaaaagcgggaaatcggagccaggaaccgttcatgaagcctactacgattgtcggtgaccattctaacgagacagaacatacgcaaaagccaattttgacctatacgccggaaccaagccctgaagacactgatgagccagaagagtcggacaaaacggaacagccaacgaccaaaaactccacttcagagccgatcgaaaattctacgacttccaccgatcgccatgatgagaccgaaacgtataagccaattgtgaccgaaacgactaaaatgccgagttccaaaccgatcgaaaagcttacaactaccaccgatgactatgatgttgagacgagtgaaagcaccaccgaaaaaaaggagaagatccgcagcggcaaaccgaccaaaagtaccagaaaaacgactaaaagcaccaagtcagtcacggctcatagcactgaaactctgaccaataccacaacggcatcggcaatgccggataatggcaccaccactgaaccgagtgaagggacggcactgccccccgagcaaagcactgcggcaaaatttattttcggctttgaatttggacgtattttttttaaatatttgaaagttggttaattaagaggaccnntgcag

SEQ ID NO: 45403 - DNA, 1453 bp, Heterodera glycines
  misc_feature (25)..(25): n is a, c, g, or t
gcatttaattaaataaaattattanttcgctataacaagctaattaatgcaaagattctgcgcatgccatcgattcgattggcatgcgcatcctcggcattggcattggcgtggatgagaaatgtgccgatgccacccatgcacagaagagacttcatgcgggtaatataaatggatgaaacaaagtgggagaagggagggatttggtatttccaccaaattaattttggattttgtcggatttatttggcttattttcacttttcaaattatttcgactatatttatttattttttatctcagtttgcctttttcagatggattggttggtcttcgctgcagacaatttgataacggcgcttccgcaggcgccgtgccgctgcgttcctcgctgaccgggcgcagtacgctcgccgttaatccctcgcataaagcgggtgccgttgtgccggtcgatcagtcagtcgttgctgtgccatcgtatgacgacgacgatgacgtaacacatcaattatcattaacagttgattgcataattaacatttatttaaggcattcttctcatgaatatgggaataaagaaacaacacacaaaaattgcgggtgatttgttatttatgccattttaattttgaaatttgttttttctgatgtaaaacagtttttcttgaaaaaagcaataatattccaaatcattccaaatggtaattttgatcaatttgtgcgtaatcgatgagcactttgaaagtctttgaaggaacaaatttggttctggaatattcccgcaagtcattaacaaatacacaaataaatgttggcattgaccttttttatagaaagcttaattatttgcgtgacaattcattttttaaagccaatggtcgattggccaatattcacatttttgataaagccaaatttttttttaaatgtacgaaaggatctcacttaaagcaaagaaggaatttaaatattcagagatttgaatcaaaataaaaaaaatccaggttttttttttgtttttttattttatttgaagaatttctttttttttagtttttctttttttatgttatgtttggtttttgtcatttattaattcgtcataaaaacattaaaacgtaaatgcatcatttcttaatccaatgacatgcttcccaagaaggcattgattgtaaacgtgtcacaaattctttataatattttatggctaataaataaatccatttctcgcatgtgtaatcccaaatcctcgctttctcttcataaatttctgccctcatttattcataaaatttttgtataatttaaattaaaagcgcccataaaagcgaaaccacttttattaccttttgaaaatgttaatttttactccccattaatttattaatcgccattttatgtctgctttcatctgtcggtacaattggtaaaatgtgaaaaacataaata

SEQ ID NO: 45404 - DNA, 823 bp, Heterodera glycines
ctcggacattcgcggcttttcccccatggcggccaattcgacgccttaccaagtggtggcctttttgaatgatatgtgagcaaatgattgcttttgaaattggagagatccccaatttgtgtcgcaggttcagcggcttcgacgcaatcattgccaaacacgacgcattcaaagtggagacggtcagaagcccttcccccactttcatttccctacggcatcagattggccacacttatatggtcgtctcgggagtgccccgagagaatggcaacgcccacgtgcaacacattggggacatcgccctcaaaatgcgaactgtcggtccattctctcccctctttttatccccccccccccctccgtttcttcctcagttcgtctccaatttcaaagtgacacaccgtcctgaagaaattatcatggtccgaattggcttccacagcggttccgtggcggcgggcgttgtgagtttttttggggcgggggaaggaaaagcattccccggcggaaggtcggactggcggccccgcgctactgtctgttcggcgacaccgtcaacatggcctcgcgaatggtcggtctctctctctctttctctgatttgcttctttccgataaccccctattattacccccccccccgaaggaatccacgggaatggccaacaaaatccaagtgattctcccactgtccgtttcgtggtgtaaattccgttcgttcagatcagtgagccctcctacaacctgatcaagtgcttctaccccccattcattgtgattgaacgggggaaaagtggaaattaaagtaaataaaaaggga

SEQ ID NO: 45405 - DNA, 725 bp, Heterodera glycines
agataaacattttccttattcctaatcttctttgtaggcatttttctctgcttctgctccattaatcttctcaattattgttcatctggtttcgacttctcaattaggtcagcatttcatttgactccattttcccatttgaactggccaacgaattggctggggagaaattgaaactgttacaaaatagctattttgggatttggttcgggggcacgaaaatttcgcccccgcggggacgggggcgggggtttgatttgaattaactccaaaaaattttacaaaaaattaattttttatgaatgtttagaccggcggtaccgatagaccgcctggcgaattttgaaatttaagctcgatttctaacagatgtttacaaaaaaaataagatttttacgataaatttttgtttttttaatatattaaattatcatgatttactcaagcaaaattggaacttagatttgtaacatattttcttgtggcacatttttccaacaaaaaaaaaaacttggtgaatgtgcgagcgtagaggtccggcggtgccgataggcgccgccgggaaaattttttgaaaactgatggatctgttaatagattttgtccaaaaaatgataggtttttgcaatttttagagaatttttttaataagatttacgaatttttgggccctgcgatgccgataggaagcgccaggcgaattttaaaattaaaaaaataaatta

SEQ ID NO: 45406 - DNA, 1079 bp, Heterodera glycines
attcattacccaaaagttttttacaaccacttattgccaatctaatttcttgcagatttaaagccatccattgcctgccggttctcggcacagcaaagcactaatagggtgtttgattcacttcaaaaaataattccttaaacaagttttttacaaccacttattgccaatttaatttcttgcagatttaaagccatccattgcctgccggttctcggcacagcaaagcactaatacggtgtttgactcacttcaaaaaataattcattacccaaaagttttttacaaccacttattgccaatataatttcttgcagatttaaagctatccattgcctgccggtctcggcacagcaaagcactaatagggtgtttgactcacttcaaaaaataattccatacccaaaagttttttacaaccacatattaccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatacggtgtttgactcacttcaaaaaataattcattacccaaaagttttttacaaccacatattgccaatctaatttcttgcagatttaaagccatccattgcctgccggattcattacccaaaagttttttacaaccacttattgccaatctaatttcttgcagatttaaagctatccattgcctgccggatctcggcacagcaaagcactaatttgggtgtttgactcacttcaaaaaataattcattacccaaaagttttttacaaccacatattgccaatctaatttcttgcagattgaaagccatccattgcctgccggttctcggcacagcaaagcactaatagggtgtttgactcacttcaaaaaataattccatacccaaaagttgtttacaaccacatatcgccaatctaatttcttgcagattgaaagccatccattgcct

SEQ ID NO: 45407 - DNA, 893 bp, Heterodera glycines
aacgtacgatcccaatgatttttttgaaaagcaacccttctgactcaaaacagctcaacccctaaagaagtgtcgttcaacctccgccatttttgctatggtgcactcttttgccgaaaacgtacgatcccaataatttttttgaaaagcaaaccttctgactcaaaacagctcaaaccctagagaagtgtcgttcaacctccgccattttttgctatggtgcactcttttgccgaaaacgtacgatcccaatgatttttttgaaaagcaaaccttctgactcaaaacagctcaaaccctaaagaagtgtcgttcaacctccgccatttttgctatggtgcactcttttgccgaaaacgtacgatcccaatgatttttttgaaaagcaaaccttctgactcaaaacagctcagaccctaaagaagtgtcgttcaacctccgccatttttgctatggtgcactcttttgccgaaaacgtacgatcccaataatttttttgaaaagcaaaccttctgactcgaaacagctcaaaccctagagaagtgtcgttcaacctccgccattttttgctatggtgcactcttttgccgaaaacgtacgatcccaatgatttttttgaaaagcaaaccttctgactcaaaacagctcaaaccctaaagaagtgtcgttcaacctccgccatttttgctatggtgcactcttttgccgaaaacgtacgatcccaataatttttttgaaaagcgaaccttctgactcaaaacagctcaaaccctaaagaagtgtcgttcaaactccgccatttttgctatggtgcactcttttgccgaaaacgtacgatcccagtgatttttttgaaaagcgaaccttctgactcaaaacagctcaaaccctaa

SEQ ID NO: 45408 - DNA, 1133 bp, Heterodera glycines
tatttttttaaataaaaatataaatattaataattaaataattttttaaattgtttaattgtttttctttattaaaaaattgtttttaaaatctctcaaaatgataaggttgaaaatttcaaatgtaaattaaattatttaaatcattttgtttgtaaaagtaaatcaaaaagcttaatttaaaaaaaataataaaacaagtaaaaaaataaatttaaaaaaatattttaatattttttttatcatttaataaactaattgttttaaaaatttctcataatgataaggttgaaagtgcaaaatgaaggttaaattatttaaaaccatgaacgaaatcaataggcataattataaaaaagtaattacaaaaattaaattgatacaaataaaattttaggaaaatggaacaaataaaatttgttaccttagcattggcaccattttcggatttgttgaacggaagaatccattcattggatgatgatgatgcttttggttcaatgtgtgccgaaattgccactttttgttgtccagattgaatgctctgaagcggtttcccatctaaggtctcctgaatatgaaaaaaaaaaataaaatttaaattttagcattttattttttgtcatcactttggcatttcgtccatccgggaattggtcatcgtcacggatttgcgcatttttcagctgttgatcattgccaaacgtatcatgttgctttggtagctgtactgcttcaggagggtcttcagtgatcggaatttcatcgccatcatggattttgatcttggaagaactctcagctaaaagaaaaagtaaaaacaaataaaattatttaaataataaaataaattatttaaagaatatttttgataaatatattttttaatgttcatgatataattattaattaatttttcattaaagaattttatattatatatatttttttatttgaaaataataagttaaatataatttttaaattatttcaaaattaaatagttttttttttgccaattcaataatgcaaattataagaaattaacaaaaaattaccaaaaattccggccgaagtgtcattgtttgtgtgctcatcggttgcctgttttcctaaattacgtccatattttt

SEQ ID NO: 45409 - DNA, 1327 bp, Heterodera glycines
cccccttcaaaatgatgcctcagaatccccaatcacacagggatctgaggtcttatcgatgttaaaagtaaaatctgatcacgtattcgtgatcagcgtcataaaatagccctaatgacatatttttggaagaattttgtgaaaaaaaattttccactcaaaaatcctggtcacccccctttggtcccgaatctcaaaatcacttttatttttataacaattcgcaaaaaagtgataaaaatgccaaataaaatttatttaatagagcaaaaaattgcggattttttaagtatttaaaatttcaaaaacacctttacagaaccgagttatgaattttttctgaaaaatcgaaaatttccagaaattctggaataactttttttcttttgaacattataaaaccaaataaaccccataaaattctccttatttttctctatttttaaagctttaattcatttaaattgaccagtcctccattgagttatgaattttcaaatattcgcccaaaatcccgagggccaaaaaattgccaaaaaataaagaatttttaaaaaattccaaaaatcatgaaacgaaaaacaaacatcatattcgtgctcagcaccccaaaaaaccccagaaaaatatttttgacccccattttcaacccaaaaaaaattttcgaaaatttctagggggcctagctcgaaaatttttgaaaatttccaaacatgtagtacaccattcgatagagcttaaaaagctctacaattttgctctgaggtcatttttggctaaaaccaactcctgacgagttatgggcccgggactcaaatgtcccgctcaggccaaaatttttttctatttccgggaaaaaatcgaaatttttctgaaaaaaataccagtcgatagagctcgaaaaactatgttttggaagtggtcttcgtttttctgggaaaaatcgttaaaaattcttaaaattcaaaaaccaaaaaaccgttttttaggcctagctcgaaaaatttttaaaattttcgaaatttttaaatttcagaaaatcgagcttccaaagctctacaataagtctgctggccaccctgcgctcaggtcaaagcctaatgagttattcaacggggactgaactggaaaaagttggtactgaaaagttgccaatttctgcagctcttccaagtataggtagaggcctggaatttttttttaaaattagaaaacacttcaacttagtttcctaccagcaagcattttttgatcagagttttagaaaaaaagttacgggccttcaaacaagagcaaaagtgagaaattagccgccgggactcagttg

SEQ ID NO: 45410 - DNA, 671 bp, Heterodera glycines
  misc_feature (35)..(35): n is a, c, g, or t
atagatagttttaatgaaaacaattaaaatttcantgaaatcttgttaaaaatcgcattgagaaatctgtttttatctacgttaccaatcgtggaacatagccttaaaacagattaaatcaaactaaataaagctcattatttcatcaaaaaattcacattagcatttatagcatcaaggattacttaacatacattatcaaaaaaagaataattaaataacacattattatttttaaatattttaatgtattgaatataatttgaatccacaagatataaattatatcttttgatggcagtttttcatgttatgatgaccaaataaaataaacaacagtttttaataaaaattgaatccaattaagcaattgagcaaaagaaaaatatttttattaattaccttcattataaacaataataaaacatatagtaattatcttttatgactgtaaaaacaattggttaaaattttgaaagtcaattaatcaaataaatttttgtcactgcaactacttcccgtgggccaaaattatatcccacgataaaaattttccaccccagagggtttttttcagaaaattgccggttttaagcaatttaatggtgtttaggtaaaactgaaagagcggtctgattttttgcatttattaaatgtttgttaatgctcga

SEQ ID NO: 45411 - DNA, 993 bp, Heterodera glycines
  misc_feature (13)..(13): n is a, c, g, or t
  misc_feature (50)..(50): n is a, c, g, or t
  misc_feature (62)..(62): n is a, c, g, or t
gcttccctatagncctgtactttaattctgcgtttggatttttgctcccncattaatgttgnagtaccccaaacggacacttgaaaaaaatcgattttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagccagtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgtttcataaatatttttttcagaaagtgctctaaagctcaccaaattttatttacaacttaattttagcactctgatgctttagtatcaaaaaggaagatggagaaaaatttttgttttaatttttcctttatattttggttatatcgttttgctttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttcctattaggtcgtccgttagcgttcgattgctctagtcaatttttaaaaatttttg

SEQ ID NO: 45412 - DNA, 994 bp, Heterodera glycines
agcgtaattacgattttacttacaccattttttgctaggcttagatgacatgcgattttctgcactctgataattttagcgctcataatgggatgtataaaggcgattgtagaaggaattggaagcgctaaaattgtttgaggagctttttgagcgtaattacgatttttacttacaccattttttgctaggcttagatgacatgcgattttcggcactctgataattttagcgctcataatgggatgtataaaggcgattgtagaaggaattggaagcgctaaaattgtttgaggagctttttgagcgtaattacgatttttacttacaccattttttgctaggcttagatcacatgcgattttcggcactctgataattttagcgttcataatgggatgtataaaggcgattgtagaaggaattggatgcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgaaaagctttttgagcgtaattacgattttacttacaccatttttttctaggcttagatcacatgcgattttcggcactctgataattttagcgctcataatgggatgtataaaggcgattgtagaaggaattggaagcgctaaaattgtttgaggagctttttgagcgtaattacgatttttacttacaccattttttgctaggcttagatgacatgcgattttcggcactctgataattttagcgctcataatgggatgtataaaggcgattgtagaaggaattggaagcgctaaaattgtttgaggagctttttgagcgtaattacgatttttacttacaccattttttgttaggcttagatcacatgcgattttcggcactctgataatttt

SEQ ID NO: 45413 - DNA, 982 bp, Heterodera glycines
caccagggatgggccaaattgaaaaataaaaagcgaaaagcgaaatttgcgaaactgaaaaatgcgaaatgaaaaaaaaagcgaaatgcgaaaggctaaaatatgcgaaaatgcgaaaggcgaaatgcgaaagcgaaattttttctgcaactttttaatggttaaaatcataaagcaaaaattatttttttaaattttattccaaatttaaaaatcaataaaacgcttttttgaggcgcgctttttccaaaaaactttttgggaagagggggcaggcggcgccgggaaaatttttgaaagttagaataaaatttgttgacaaattttcactaaaaaatgatcaaattttgtgatttttatcatttttctaatgagaaataagagttttggggcgccgctgagaacagtttttcatcaaattaccaaattttgcgattttgggccatttttctaagaaaactaggagttttgggggcgcggcggtgccgataggcgccgccgggggaaaaaattggaaattttgatcatttataaacaggttttcagccaatttataggtaaaattttgaaaaattttatgggaatttaatccaattcttaggggtgtaaaagtcgcttttcgcgcaaaaagctaaatgcgaaaagcgaaatgcgaaacgctaaaaaatgcgaataatgcgaaaggcgaaatgcgaaaagcgaaaccaaggcacatccctggtcggcaccacagggaaaaatattgttcttgaattttggtgttttacaatatttttccgttttgtttatttctgcttttaggaaaatacaaataaaataaccatatttattatttcaatcctcgtttatttatttagtataatttaaaatttaattttccttcttttgtacccacaattttaaaagaaaatttttttttatttaaaatattttttcttatttcatttttacaaaactattttcctgtcaaattttcgcgatt

SEQ ID NO: 45414 - DNA, 1474 bp, Heterodera glycines
  misc_feature (1400)..(1401): n is a, c, g, or t
tcctccccacggagttggtaatcagtatttggcattcgtctcattgactgaaattccgaccccgatattttagcccattttcgaaaatcttccgcttctccgttgaatagggattctggaacatgttttatcattaaaaacaacaaaaacattttttaaatgtggcgtaaatgtatacctaagtacccaaaacttttaaaaactaataaaatgaaaaaattctaatgcataggtttgcaaaataaaaaaagcttcgaattataagtagggccacgatttataattttttctagagtgccacgggaccgggccgggattcccggtcatccgaggtcccggtcccggatttcctgaagaaaatccatacaaattgagcctaataaatcccaaaacctgccttttttggtgtaaatctgttaacaaatcacatccaaattttcaaaattttgaaaaatattaggtatacatttgtcggcgtgcccataaactgtcataatgccccatattgtaattgtcaatacacccgatcatttgaattgtatctatatgtattattgttgatgtgtgcgcatatataaactaatcaaaatgagaaattttcactttgtcactttttggctgtttcggcacttctgacttatatagaggggggatttttaaaaggatcgaaaaatgactaatttggtatcatttaaaagctctagatgagatataacggacagattttcccacagccgtcaattcggagcataaccaaaaaacttgagaaaagtgctcaaaaaacgcatgttttggattgatgggaatatgcatgcgcgggaagttcattcattgctttgattggcccatccctttgacccaagggcgtagccagacccttggcttcgggggggagggaggctgaagacaaaaattcgatttttaggggtgtatttttgcttttttgaaatcccgaattagggggtatattttgcaaaaattttcgtcgttttcgccaaaaaattactattttttgccattttggcctcaatttttcaaaaatatggtaaaatgggggtccggcggtgccgataggcgtcgccgggaaaatttgttaagaagattgcttaaaatttcaaaaaatttactgaaaactcagaaagtgctcaattggcaacatcaacaaattttttgtgcatatttttcactttttatgtgcatattttacgattttatgtgcatatttttggcatccctatttatcacataaaattttatcaaaagtggtttaaaaagttaaaaaatacaagtataattgtttgccttttatcccaagaaatgccattcttaagggtatattttcttcaaaattcactaattgcttgagactttcctcagtataaaaaaataaataaaatcanngtagggttcagtttacggtagaaacttgaaagagtactcacccccgcggggggcgaaaggtcgcgggagtctg

SEQ ID NO: 45415 - DNA, 790 bp, Heterodera glycines
  misc_feature (774)..(774): n is a, c, g, or t
atcggcgtcattatgctgagagtgcggttggaattctcttgactgtagccagaaaaagagatagccatttttccaaaattttcacgatcaaatgcgctgagaaaataattccagaacaattagtatcggcgtcattatgctgagagtgcggttggaattcccttgactgtagaccagaaaaagagatagccattttccaaaattttcacgatcaaatgcgctgagaaaaaaattccagaacaattagtatcggcgtcattatgctgagagtgcggttggaattcccttgactgtagaccagaaaaagagaaagccatttttccaaaattttcacgatcaaatgcgctgagaaaaaaattccagaacaattagtatcggcgtcattatgctgagaatgcggttggaattcccttgactgtagaccagaaaaagagatagccatttttccaaaattttcacgatcaaatgcgctgagaaaataattccagaacaattagtatcggcgtcattatgctgagaatgcggttggaattcccttgactgtagccagaaaaagagatagccagttttccaaaattttcacgatcaaatgcgctgagaaaaaaattccagaacaattagtatcggcgtcattatgctgagagtgcgggtggaattcccttgactgtagccaaaaaaagagaatagccagttttccaaaattttcccgatcaaatgcgctgagaaaaaaatccagaacaattagtatcggcgtcattatgctgagagtgcggntggaattcccttgact

SEQ ID NO: 45416 - DNA, 842 bp, Heterodera glycines
  misc_feature (14)..(14): n is a, c, g, or t
ttcaccaaaaattntaaaaatgactagagcaatcgaacgctaacggacgacctatggaaaaaatccccgaaggagagaattaattaaatccattccttcggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaatataaggaaaaatttttttaaaaattttttctccatcttcctttttgatactaaagcatcagagtgctaaaattaagttgttaataaaatttggtgcgctttagagctctttctgaaaaaaatatttatgaaacaaaaaaatcgattttttcaagtgtccgtttagggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggtgtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcataaatccaacgcagaattaaagtacaggctatagggaagctattcctgaaggattcggtc

SEQ ID NO: 45417 - DNA, 951 bp, Heterodera glycines
gatgacgaaacggagacgaaacgaccgaaggaagggcaaaggacggcgtctgagaggatgaaggcattggatcgcaaaaaggtgaacgaatgagtgcaatgcaaaacttctatttaacctcattacgccctaattaaggtccataaaatgcacggggcaatccgactcaataagcttatcttggaaaattcgcgcaacagtcaattggttcttttttctctcccaaagccgcctttctttgaggacgaagtcgacgactacatccattatttggaggtgtactttgacttttaaacccaacaatataaaaatgttcaggtgatttcggacaatttgcaaaaagtgctttttgtgcgtggaacgggggcagaagtgatcacatccaaagcttaagcctattctctttccctgtattgttttgtccggtggtaatatgtaatatatgtttatctacacctgtatagttgcgttgtaacgaggaataaaaaatgtgttctagtcagttttgtgcatcccatcgcattttaggcgaatggaaaaaagatcatctgccgtatttgctctaattattccctccccccccctaaagaaattttgtatttcgtctatatagtttaaatacagtcgcactatgggtcaactccacttttctactcatacaattttaaccaaattttgcatatcgacagggaaaaaattcttcatcgattaatacgtttccatttgtaaaagctcggggttagtgccgtggagatgacgaagaccattttcactgcacgccaagtggcctcatgccctgggggtgatgtgggtcttgaggatcgacaaaaacaagcgatggttaccccacgatgctcaaattgctgctgcaaattatggacgtattcccccataaaaaataaattagaaattttttattttccttgggggtacgttttaaaaattaaatta

SEQ ID NO: 45418 - DNA, 1378 bp, Heterodera glycines
acccaagggatgcgattgccctctaaagccaaatactcgtggatcgttccgccgattggggccatctgaaaacccaagggttttgagagtccacctggtggtgaccgagtgtggccagaaggtcaccaggggctgttgcgtgtgaacggtcggtccgccgccgttccgcggcgccgcggtcgacgcgctggcgacggtcactgcgaatggggggattgttgcggccgccggcatatccgtcgccagcggcacgaagcaaaagccacaggtgcgggcgcaatatgtgctggtgaaggtgggcgcggtgatgcagtagcgccgtttggccaactccgcgcagtcgacgcgcaaatcttcacaggcgggctcaggcacgacgggcggttgttgctgaaggccaaacagaattttggcataacatattgtgatttggcaaagcattcgccccggtttgggtctcggtcccgcgacacccatcaatatatttcatagcaacgaaaagagactttgaattggcaatttgtatgaatggatttcgtcatttattaggggctcctcccaccccttccccaccggacttcgtttagtcgaaccatccatccatccccgaatcgatatttgtggattctcggcatactaatgccactttttccagtcgataattaacctttccgtccctaaggtcgggaccaaccctaaaattgttcatttgcttactgtgacagttaccactggtgcaattggcaccggcgatggcattccgtcgccgatggaggacgacggcttgcgaacacccgaacaccaaccgcaggacaggggactaaacaatcagaagaagcggggacaaaaggaaagcaaaatgggggtaattagcaaagcaatcattagaatattagcactaattaattattcggatttgccgacactgtttttgtgttttcctcagtttcccatattttcccttccaaaattaccaatggtcgcgcatccattgtgggtttcgtgtgcaccagccttggcgagccaactgatcgcagtcagggcgagtgtttcgacaaaacttaagaaaagcaaaaacatcccttaattaccatatttgcttgtgtgccacagtaccctggctgtcgtggctgccatttgcgttgtggtgagtatcgctaccgtacccggcgccgttgtggctggttgtgccggaggcatttcggtggaaccgtaggaacctccggcaccgccaaaggacggacattcgtaactgaggagaaaatggagggaggaagtcatattggaaattatgatgataaataaatttatttttatttatttttttgcctacagtccggggggatccacgcgtccaatttgctaaatacgctccgtt

SEQ ID NO: 45419 - DNA, 1518 bp, Heterodera glycines
aatttgaatttaaaaaaatattcaaaaatttgagaaatcttttgctgaaaaattaaacaaatttaacgtggtgatcacttatctcgaatatgaaaatcaatttaaaactttgttggcaaaattggcctaaatatgcccgaaaactattcaaaaaaaaaaaaaaattgactaatccactcataattgttttaagaaaacactaatttaaatcacttttttaatattttataaaatattttactaaccctctcataattgtttatttttaaaccacaataatttaatttttaagaattttttaatctaattattttcccaattttataaatatatttattacattgccgcaggcattatttaatttttttttcaattgtttggcatttttgtcatatttggcaatttcccattagtttttggccatgcttttccatcggtttggcacattggcccatatcattgcctccaccgagttgtggtgctgttcccgtcggccaatggacgcgatcagtgaggaggaactgatggcacagaatgccgtggaaattgccaggtgggggcgtcatggcaaaattatttgatgcggatctcggcttttatagcccgaaaatcattccatagaaatctatttttcggcatttgttatgctcctaaatgaatgacggcgtccttatttgcattttgtacaatttggcccatatttagggcactattttgggatttttttccgattaaaaaattaaatagccttttctttgcatataatttttaaaaaaatctaaattttgaatttaaaaaaataaatcaaaatcttttaaacaaagaatatcaaactactccaattttttaaaaataatgtaaaaaaatgaaaaaaaggagatgaaaatttcaagacttttggatttttttttgataattaataataatttggccagaaaaaatggatcaaaatttgtaattgcctaatttggaatccatttgatcgttcgtgtccagagagttgcaagcaatccgtggcctcaccgactcgtccgattctggtgtacatcttcaacagcaacaacagcacgagttgcaactccgtcatcgccgtccgttcccagcccaacaacaaattcatccaaacggtgcaaatggagggatttaaatagatactaaaaagtttaaaaaattttttatctaaattttcttataaaaaaatttcagagacctagcacgctttcccaaagcttctcaatttgtgcttatttgttagataattaattagtttaattaactactcaatttgcgcatagctttttcggccgagtcgccgccgcctcccccaccgccgcagcggaacagcggacgagcgaacggcgacgcagcgggcatgccggcagcagcgtctgtgccgccagcgggcgttggcgttgcgtctgcggctgctgctgctggccgtagaggtgggggcgccgggacggagcagcgccgcatggacacgctggacgcagcatttcggcgccgcttcttcgcgct

SEQ ID NO: 45420 - DNA, 1609 bp, Heterodera glycines
  misc_feature (42)..(42): n is a, c, g, or t
ataaaagtcagttcaagaattttataccaaggaaaatttttntcgtgtttcacttcattcacttacacgctttggctgaccgagagcttaaatttttatccggcatgccaaacaattaaatcaacaaaaaaaaaaccaaaatagttcttcaatctttttcccaaaaattgtccgtaatttgctgttataaaacaatgaatccaatattaaaaacgagcaactacatactatatttattaactaaacttctttaaaaaaatgggttattcgatgttgaatgcatgagttgatcagatcactctttaagggtgatgttcaactcggaaaacccacaaataaaactgatttggtcaatcaataaggcgatgagcagaaaggggtgctagcgcgtttgttaaaaactgccacccatgcgcgtttgttaaaactgccagcgcgtttgttaaaactgccaatgggtttgaaaacaaaaaatgggtaaaataattaaattaatagcttggctcaaattcaaccaaattaatatttcgtggtatcattcaatagctttaattgttctctttcagaatataattttcctaaatttttaacttaagtataaaagaagttatggtcacaaaattgcaaaaaatcttaagtcagcattttttgttcagaacttttttgaaactcaatgaaattttctaaaattttaaatataaatagagaattcttagggctatcgaaatataaattaattttggttaaatttcattttaaagactttaaaattttaaatgtttattattatatatgcattaccattgcaaaaaacatagcctgttcaatgctttataacttcttttatacttaagttaaaaatataagaaaattatattctgaaagagaacaattaaagctattgaatgataccacgaaatattaatttggttgaatttgagccaggctattaatttaattattttacccattttttgttttcaaacccattggcagttttaacaaacgcgcatgggtggcagtttttaacaaacgcgccagcacgcttttctcgaatattcaaaggttatttgatattctcgattcatgagtcatgacgatggatgggactaatgagttttaatttgtctcgtcgagtccctttaggttttccattcccgacgtttttctcaagaaaccgaaccctgtccgaatttgtccggtccggaaccccgatttccggattatttttgaaaaatgcacccggatcatggccccaaaaatgttcaggaaaatgttgtagtcaaaacgcagcctggacataaacgtcgcgatgttttgtccggcgttgttttgtccctgcgacgttttgctctggcgacattttgtcccgcgaatttttcgtaaaataccggctaatggcctgtctgtgatcagcaacattaatttgctgcccttcctctacagcttgcgatcaaatgggagtgccacattcggtggcactgatcagcgcagcggtgccgccgtcgcccctgtggcgctgccggatgtgccgtcgcgaacgagtccgttcccgttgccgcgcagcggtaccccagcgccagcggtgggcgcgacacgccgtccgtac

SEQ ID NO: 45421 - DNA, 1155 bp, Heterodera glycines
agtttggcaacattttttttctttctttttggcatggcaacggtcgaattttgggaagggcacgaattcttttcttttttcttttaaaacagtgaaagtgaaaggtgcttatgtcaaaatgccatcgtaaaaatgtacatttttttttgtcaaatgccacctgatcatggcaatttttatgatttttatgaatataatattataatagagtaatccatctcaatagctcaattataggtaattaaattgagggcggattttgttttcccctgggggcattcgttttgcttaatccactcgatgttcataaatatgtattgtgttcattcagcgtcagagatttgacctatcaggcaggagctttacttgatcgaatatttgcttttaaaataaccactcaatttttggatcaatttcagtttttctcaattagaaatgccagtgtctctcgttccatgtctttttttctttttttcatcgagtaattcttccactttctctcatcattcctcgcttccttatttgtatgtacttttgtcgtcgttcttttttgcttctcctcctctcatttcctctcactctctctttctttctctctctttttcacctctcaattcatcgttctccctcttattcttccttctctattttccctccttctatcactcctcttccccctcctgttcttcttcgtctttttctcctcttcccatttcctctcattactcttctctctctcgcgctcttttctcttcctcctccttctctcactcttcctcctcttcctcctcttcgtcttcctcctcctcttccacttcctcttcttccacctcctcttccgctgccgcctcttcctcctcaactttgggctgttccacctccacctttggcactgtgaagctctcctcccgttgtggcgtgctatcctccttatgtgactataaatacatttcaaaaatttatctacaacttctattgcttcttcaaactcacctcccgttcttcaaatttctttttgtatttgtcaaacggatgcctaaatttaattttaaaattaaaataaataattaaaagtgcttttctaaaactatactctctctctctcttctctctctctctctctctcttttttctctctctctctccctctctctc

SEQ ID NO: 45422 - DNA, 693 bp, Heterodera glycines
tatttccaattcttcatcatattcctcgctgctttttacattctgaaactttttcatattaagctaacagatgataatctcaggaagggaatttaccgaattgatttaaaatgctttaaattttatggaaaataacgccaaaatatttttgcatgattttcagcgacatacgcaaatataataaatttggagttttcataaatattttattgaaaaaaatttaaaaaatattaaattattgcctctaccgaattagaagagtgacccaaatcgtcagtttttgaagaacacgaattgctctgatcaccggcttgtttctcgtcaatgccatcactgatcatttcgtcgtatatttctttttttggaaactttaattttgtccttacattcattgcattttgttcttcgtccgaaaatgtctcttttttgatttcttctaatatttttggcttaatatcttcttcattttgacgctcactgctaacatcttcagcttttaagcttgtcgttaataaacttttgtcaaaattatgaatattttgatgaatccaattttcgcgttttattccgtgtctttcgtaatttattgctaacttttgtggcttcatgggtatcaggaggtttttccataaatctgcgaataagtcttcttcagtaccttgaatgccaataaaaaacaaatggacgaaaaaa

SEQ ID NO: 45423 - DNA, 1535 bp, Heterodera glycines
aaagggatatttggaagctcaaaagccatgcgaaagagaagtgccgtcgctgatcacctgctgcaagtcgttgaacacgagaatggcctcggcacaccaacagccgtttttggaggcgccgaacgacaaaatgtccacgccgctcttccaactcatttcggccgccgtgcagcccaaggcggccatcggaaaacggggggagacattcaatttggatttgaataaatgtaatataatttagattaccaaaacaatgttggctaattgtgttccttacaattattttatttttagaaattttcgaaataattcttgataattcattttgccttttctgcccattttccctcaatatttcctcggtttctcactgcgtttgcgaatcgcgccccgtccatgtgcaagggaatgccatgcgaatgcgcaatgttcgcaatacgacggatctgtgccaatgagtagagcgtgccgctctccgtgctttgggtgatggacacagccatagggcggcccgcgtgcacagacacgggatttggcggatagcgttggattgcctcctctaatgcctaatcaaacaaataacaatttacaataatatttaaatgtaattaaattattttacgaaaattaataaaaataaattctttcagtatgtacttaatattagccagtaatcacttatacttaattatctcctaattaaccactaattacttatatttggttatcccctaattagggccactgatcacttgtacttaattatccaataaatagagccactaacagatttattatcccctaattagccagtaattacttccggctcaatgcgtccctcggcaccgcttacgccgaccaacctggcgccgcccgtaaaatattcgggcgcgccgcactcgtcctcaatcagatgggcatgccgatgcgcgaaaatgatgccacccgcgcgattcacataagccattgacaacgcattggcagcggtgcctggggcaaaaagtgggaatttagccatgaaaagtgccaatttggccacacctgtcccaaccagaaaaacagccaattcagtctcaaaaatttcgcagaatctcctctcaactttcttgtccagctcactgtcgccatacgcggcgtccgccccggtggaatggcgcgaaagtgcgtccgaaatggccgaatggcacccggtccaattgtcggagctcagattgatcattttaagtgcaaattgtctatttatccttccttcattaacctaatgcttcaataaggtgaaacggcacccaccctttggcacaattcaaattatttcaaccttgccctacggcataaaacaaataaaaaaacaaatttaaatatttatggaatgtatttttttagggttgctccccgaccccgagccctccgacccccgacccgacccgagacgttttgggacctattccccgacccgacccccgacgtgtcactccccgaggtccccggcccccgacatttttataaggagggctcggggagcaaccctatatttt

SEQ ID NO: 45424 - DNA, 681 bp, Heterodera glycines
ctgtctctctgctgtccacactctcgtctctccctctctctctgcatgctctctctctcatttgcacccgctctttctttctttcactccgtctctccggcggtctgtccgttcatccgattggcgtgccggtggcgacccgccacgcgtccgcttgttgcgcagcagtcgcgccattgccgccgcccgaaagcggcacgtcaagccgcggccgcttctcaagcggcggcgattggggcggctccgacttcagatgaaatgttgccggatggtggtgctgctgcgggtggtggtagtcgttcagccagccgtcatgcaactgaattttgtggggggcattgaattttaaattcaattttttatgcaatttattggaaattcaaaattttgccggaaatgaattggacggattaatcgcacaaactcagctgagcgatcatgaatccgcacagggctctatagtccccaatcccatgtactccttccgtcccctgtgggtaccagggctggacataactgatattcaattacggaaacccataatccgtaattacggcgttttttcaattaaggaaatccattattggcaaaaaagcagtaatttccgtaattacgtccatccctggtgagtacgtccatgggcaagagaccccaaccccgctataaaaaattagagactcg

SEQ ID NO: 45425 - DNA, 1113 bp, Heterodera glycines
cgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaaccaaaaaaaaatttttggataaaaattatttaaatgaactgactagataatatttaaaataggttatttctccccctttcagtatcccctgcaaagttttggtgcgctttctgatcagtttcctgaaaaaaaaagttaagccttaaaattttttggccctggttaaaaaaggaaattaaaaaattttttaaaaa

SEQ ID NO: 45426 - DNA, 1017 bp, Heterodera glycines
aattctccaggacttcaatcactagggactctattctcctgcttttcatcacctggactcagtttttatgcattccaatcactgggactcattctcctgcatttcaatcactgggactcaaccctccagcagttcaatcactgggactcaatccaccagcattccagtcactgggattctgttctcctgcattccaatcactgggactcaattctcctgcatttcaatcactgggactcaaccctccagcatttcaatcactggtactcaattctcttgcatttcaatcactgggactcaacacaccagcatttcaatcaccgggactcaattctccaggacttcaatcaatgggactcagtttttatgcattccaatcactgggactcattctcctgcatttcaatcactgggactcaaccctccagcatttcaatcactggtactcaattctcttgcatttcaatcactgggactcaacacaccagcatttcaatcaccgggactcaattctccaggacttcaatcactgggactctactctattctccagcattccaatcactgggactcaacacaccagcatttcaatcaccgggactcaattctccaggacttcaatcactgggactctactctattctcctgcgtttaaatcacccggactcagtttttatgcattccaatcaccgggactcattctcctgcatttcaatcactgggactcaaccctccagcatttcaatcactgggactcaatccaccagcattccagtcactgggactcaacacaccagcatttcaatcaccgggactcaattctccaggacttcaatcactgggactctattctcctgcgtttcatcacccggactcagtttttatgcattccaatcaccgggactcattctcctgcatttcaatcactgtgactcaaccctccagcatttcaatcactgagactcaattctcttgcatttcaatcacagggactcaattctccaggactgcaatcac

SEQ ID NO: 45427 - DNA, 968 bp, Heterodera glycines
taacaaaccgttctcaagaagacaatctgagagatcaacttcaatttgagcagtctgacttggaaatttaacagagaaatttattgaagaataggaagaaaaaagcgccacgaagtcatttgcatcaaaagccgcgggcttttcctcgggcttgccttattttttacttcaaaaaacttcaaaatcgtatattaaattagggttacgggtccgggtccaaccgggtcctgaaaaatccaaaaaaaaatcttcaaaatttgtttcatgaaaataaagcttatactttaaaaatattatataaatattttcatgaaatatatttattaaaactttattatttgtccatttttttgccattcaaaccacctcctttttttgcggtgcatttttttaaacttcggggacagttgggggtccggcggtgccgataggcgcagccgggaaaatttttgaaaatttacttcggatttgttaacagattttttcaaacaatgaacacaacttgtggttttagccaatgtgttttacagaatttgtatcaaaaatgctcaaattttcaaagaatattaggttaaattctagagttgcacgggaccggaaattttgacaaaaaccgggaccgggacttaccgggaccagaaaaagtcgggaccggggccggaacctcgattttcgtccgggaccgggaacaacggggaaatttccaagagaaatttttttttgaaaaaattggaaaaattccgaaaattcatcaaaatgcataaattaatgataatttaaacactaaaatgtttctctaggtaaatgaaaatttctgttccattgggcaattgaacccaagcgaaaaacaatgaaaggcagaaggtttagccaccacgaccacatttgaatttggtctatccgaaaataatgttctctgattttaagacattaaggaagcagagaagaaagagatttatgacgttttt

SEQ ID NO: 45428 - DNA, 1004 bp, Heterodera glycines
aaattaattaaaatcattgaaaataacgtaaaaatgcacaaaaaaataatgttacaccgtccggattcgaacctgcccccccccctcaaaatgatgcctcagaatccccaatcacacggggattctgaggtcttgacgatgtcaaaagtaaaatctgatcacgtattcgtgatcagcggcccaaataacccctaaagacatatttttggaagatttttgtgagaaaaatttttccactcaaaaatcatgtgctcacccctttggtcccgaatcccaaaatcacttttatttttatatctttttttaaaaatgtgataaaaatgtaaaataaaatttatattatagagaaaaaaattgcggatttttgaagtattttacttttcaagaatgacttttcagaacggatttctgaatttttttctgaaaattcgaatttttccagaatttctggaataacttttttcatatttatgctagaaaatccatataaaacccataaaattctcctgatttttctctatttttaaagctttatttgctcaaaattggtcaacccttaggctagatatgaattttccaatattagcccaaatttccaagggccaaaaaattgccaaaaaataaagaatttttaaaaaattccaaaaattttgaaacgaaaaataaacatcatattcgtgcccagcacatcaaaataccccagaaaaatatttttgacccccattttcaacccaaaaaaaattttcgaaaatttctaggtggcctagctcgaaaatttttgaaaattttacatcatgtagtacactattcgatagcatttaaatgctctacaaaaatgttctaagacaatttttcgctaaaatcacccctgacgaggtatgggcccaggactcaaatgtcccgctgaggccagaaattttttctatttccgggaaaaaatcgaaattttttcaaaaatatcaccaatcgatagagctcgaaaaactatgttttggaagaggtct

SEQ ID NO: 45429 - DNA, 1052 bp, Heterodera glycines
  misc_feature (77)..(77): n is a, c, g, or t
gtattttttcatatttaaaaaaactttgaaattacttccgcttccacgcgcaattcccggtaaaaaattgcgggatntagagtgggactccattcctacaaaaatttggcctcgtgcattcagctaccgtttttaccaatttctcgtctagttaaagtccttaaacacgaaatacctttaaaaagcctttcactgattagcagtgggccggcaataaacagcaaaagttgagtggtggtggcgctggcaaacatttttgtcaattttgaacacataaatttttaatggattcagtgtcaaatttaattgcttataaatggtgcaggttttaatcctcatgagtaagcactttaatgagcctatttgttgttattgttgcttttattgtacagagtaatcatttgcataatccgtttgtactgtaccattagcagaggacgcagggggaaattgtagaggggactgagtgcaaattgaaaaagagacaatgagaaaggtcgagagttgtgaaagaaagaaagagagagagagtagaaagaaagagagagaaagttagagagagagatatagagagagagagagagagaggagaaagagagagagaatccgttttgaaaaaagagagaccggcgaaaacgtgtgaaaaataaaagaattagagaaagaaaagggacgatgagagagagggtcttaaaatcgtagcgatttgcataaatttatgagcgatggaaaacgacaaattatgcggtgacagataaaataatcccccaaaatgttttcagttgatttacgaaataggtttttcatgaccaggattctacttttttcaattgaccatgttggattggtaaaaacccaactcgtacaatggaaataatttcttgagcttttgctcataactttaaaaccttttcataatgtttgcctgctaatagacaacattaattgcactcgaataataccaacattttgatggactttgttattctaaatccagttatgtgcccacgactgcaatggtccaaggctggtacttttctgtgttgagaccc

SEQ ID NO: 45430 - DNA, 891 bp, Heterodera glycines
  misc_feature (832)..(832): n is a, c, g, or t
cagcaaaaatgcaattcattttttcaatgttacaacagcggcgagctaatggggaaaaaggcaaaaacctttcctcccgaacggcaggggagagtcatcgccgcaaaaagctaatgtcgcgacggggagagcaaaaaatgggggaggggacgggagatgaattgctttccgtcggctgccatgtttggcacgaagaaaaaagaatggcaggacaaatgcaaaactttggacatatggaattaattaaagacgcagtcaaaagcggggaaattgcaaatttaaagaaaagaaaattcaaacattaatttcaattgaatcgggttcaattgaccacaaatatgcgcgaattacacaaaaggaaatgccggcaagagtgaaaatgatgccgccaattgtccaagcattttccgaaaaaaatgaggaccaactttgagggacaatttttggcttaagttgtccacaagtccatcccaacgttgtattcctttcttcggttggaaatattaaattagtcggctggcatggatgggcacaaaaatggtcacaaatttctttatccactgaaattcctttaatttgattttcttgaggggactctacgatttgaacgttcaaactcaatagcagaaagatcattagcaatttcatgcaagcaattcttttgtccggcccgcaggcatgggaaaaaataattaaagaaaaacttttggtttttggcatttaatatgaattttgcgtttgggttgaaagaaaggcaaaatatttcaggaataattcggaatgcattttggtcttctttggagcctatgattgccaaataagagggcggggnggtgaaatgaaaacattcgcaaacatgccggcacaaggaaatggcgaaaatggacaaaa

SEQ ID NO: 45431 - DNA, 930 bp, Heterodera glycines
aaatttttcaaaaaatatacaatatacctaataaaaaaatttctaaatattttaataggctaaattttttaattcttaaccaagtaaaaggtatttcacaaatgtttttagaatattcgcttgaaaaaattattcaattattttatcaaaatcttttttcgtcatttttcattattctagaacatttttgggaaaaggagtgactatttacacgttttttacagcgcgattttttcaaaaactttttgggaacttggaggagggtacagcggtggcgataggcgccgccgggaaatttttaaaaatttcagttcaatttattaacaaaattgtacaaaacttactagttttttgaaaaaaaaatttaaaaaatttccgacttttcatcaaaaatttcggaagtcggaattccgaccccaaaaatgtcggaaaccggaagtctttccgtgccatacctggtgcctatcgacatctgcgagaaattttatgaaatttaatgcgatttgttaacagattttgtctaaaattgaccaaatgacgcagtttttgactcaatttctacaggattattaagtaaaagcctatccggcggtgccgataggcgccgccgggaaaatttcacaaattttgaatgaaatttgcgatgaaaaatgagttaactttaattaaatttattatttaatttatttaaaaatatttggcattctgtcttagaaaaatagttcaaaaaaatcaataaaatcccgcataatcccgcacaaaaaatcaaatttgcggatcccgctgcgggattggaactcaattcccttttgcggggacgggatcccgcgggattaatcccgcaaatcccgcattttccaaaaaatgcgggattgcggactgggatcccgcaaaatcccgcgcgggatccggtcccgagccggtctctag

SEQ ID NO: 45432 - DNA, 1259 bp, Heterodera glycines
tttttattaatattaatttcaaaaaaataatttaattattttggcattttttggccaatattttatgccatttttttggctttttgtttataaatatctgccagccatttaaaattagtaatgttaatgagcacacagaacacgaacatttgcagtgccacttggcgatggcagctgctggatgggttgttgctgttgtgtcaaaaaatctttcgcaacggtgccaggactcaaccggcttacaatgcccggctgctgttgttcctgccctaagaaagtttttgttgtcccgttgggactcagatggccgaatagggtgtgcaaaaactttaaggcaccttaacattttaaatcaattcattcctataaaaaatattttactcggcgagttgtttattggcgttgcgtgcgatccttggacctttttgaacacttcaataaagccttccgcaaacgattcttgcgcacttgtcgggttttttgtgaaaaaatttgatggtgtcggtgtttcgaggatttgatgatgttgctgcggttgatgggcctggatttgctgttgttgctgtgtaccaactataaaatttcactgtcaaatggagaaggttggaaaaaataaacgcaaaagcaatggcccaaagaccgaacttttgaaaaagccgggcttctggaaagggaaccaggccaggaaaggaaaattttgttattttttttctttttaagtttttttttaaattttaaatttattgttttttttgggatcaaatccctgttctgtcggaatcccgttcccaagagcagggttggattcgagctttcacaaattgaaaaattcaggcaaattttctaaaaatcgttaaccactagagtaagtaacccaatgtttaatctctttaatcccgataaaaaccgatgagatcccgaccccgtcgggtctctaattcgatcaatgagttaatcaaagagctcttgattagaaaaatcaaatatttgaataaaaaaacatgcatttgaaaaaaagttttacgcatatacgcaaatacccgaggcgctaatgttgggactaatatttaaataattatttttatacatcacttaataaatttgcagcttagccatcatgttatactaccaaccagcgacataaaaatataggaaaaaaatgagcgttacatttaaaaaaggcaaatgaggggaaaggcaacgattgatgagtcacacaatcacctcacagtcttcgtccctcaattccccccccccct

SEQ ID NO: 45433 - DNA, 1744 bp, Heterodera glycines
  misc_feature (10)..(10): n is a, c, g, or t
  misc_feature (24)..(25): n is a, c, g, or t
  misc_feature (165)..(165): n is a, c, g, or t
  misc_feature (176)..(176): n is a, c, g, or t
  misc_feature (262)..(262): n is a, c, g, or t
  misc_feature (1733)..(1733): n is a, c, g, or t
cagtggtcancaaaaaagaagaanncaaaattgattgcccatcccatttgtctttatattattatttctgcaaatttcaagcttttatattatttaaattttattattattttatgtttttttgtcaattttcaaaattaattttaattttgcatttaatgtctnaattgttttcncaaaaagccaattttcatttatattttaattatttttgtgagtttccaaaaaacgatttcgggatttgttttttgggtttttagcnccagagaatttttctctggggttttggcattaaataagcgaaaaattatggacctatttttgtttttttggggacttacaaatcctttttttgggttttaaaaccccaaattaattttaatttggggtttttgactcgacaaactaaattctggcactttcaaatcctttttttggggtttaaaaccccaaattaattttaatttggggtttttgtctcgacaaactaaattctggcactttcaaatcctttttttggggtttaaaaccccaaattaattttaatttggggtttttgtctcgacaaactaaattctggacgtacaaatcctttttttttgagttttaaaaccccaaattaattttaatttggggttatttttgctttttttgggttttttagccccagagaatttttctctggggtttttggcatgaaataatcgaaaaatgttggacttattattgtttttttgggttttttaaccccagagaatttttctctggggtttttggcatgaaataatcgaaaaatgttggacttattattgtttttttgggttttttagccccagagaatttttctctggggttttggcattaaataatcgaaaaattatggacctatttttgctttttttgggttttttagccccagagaatttttctctggggttttggtcatcagaaagtgaacatttgttggaattttttaagagattgctaagaaggtaaaaaaattattgtaatttgtagtaaatgatcagtataagttttcttcaaaaaaatgaaaaaaatttaagaaaattttcggttttttgccgaaagctggcactgcccaattgggtaatccagcaaccccgaacggcagtgaaccttgtgttaacgccttcggggtgcgcgcgcgcggggccgtgttggactctctgcagagaaccttcgtgttatcgctaagagttcaacatggccagcccttcccaagcgtagtcccccttatagatatgtttagttttaagaagtaggtcaaaattttaaaaaaaactaacagaaaagaatcgtttaaattttgtttaataacaagttttttttctgacaaattgttttgtaaaaaatctgtcatccttttagataaatgattttaactccggaattggttcacgggttaagaaattataaaatgtgttatcctaaaaaaatacttttttgggtgttcgggagcggcaaattcgacccagccaaaccggtcctaaaattctaaaaaaattgtattggcattaaattaaagatgctctatcgaacggcattagttttcagaattttagaccatttgggcggtctcaagatcagtttaagacctcgggatcgggaaactcggccgatcaaaaaggggtttaaaattctgaaattgatgccgttcgatagagcatctttaatttagtaaaagtttaatttttttagaattttagggccgngtttgtctgga

SEQ ID NO: 45434 - DNA, 961 bp, Heterodera glycines
atctccaaaattttgtcatcccttcagaactcattttagcgaaggtgtaaaggtggccttcgtaagacaattttactttttgttttttggttgcaattgggttagccatatctgaaaaatgtccaaatcagaatgtacatcaaattggttaactattaaaaaataataggatttggaataagtaaaattgtaaaaaatgagcgaatgttaattaaacctagcttatgccaagtggcgagggatccctcaggcttagtttttagaatcttaatttttaaaaaagcacacttttctatttttgggttggggcccaaacgaccccggggcccaaaaacgggggcccaaacgcgggggcccaaaaacgggggcccaaacgctctggtcccgaataattctatggccaaattaaacaacaaacacatttttaaaattagacgtaggtaaataaaagtaatcgttccatccgcccgaaccaattaattaattacccaaactaaaaattgaataaattgcgtttctccgctcgctgctcgaggcttaatgtttcatcttctgctgatcccttgctcatttaattaaattaaccgagagaagttgacattttcattcattctccgcacatttttttcatttttgttttaacattttgtcgtcatttacttattgagtcagttcttcagttttgtacgtctgccaccgccgccgccgccgttgctactgattttgcgggggatggaaagaaaatttattcgtatccgctgaatgaataaagcagcaaatgacaacgagcgccgatggatgaacgaagaaacacagagagagaagcaaatagagcagcaaaagaaagggaaatgatggcggagatggaagaaaagcaatcggacgacgacgaagaagaagacacaacgaatgaatgatgggaaggggaagggaagggggagaaggaaggggaagaagatga

SEQ ID NO: 45435 - DNA, 865 bp, Heterodera glycines
ctcaatggggtggcgcattggcagcattggccgcctctttcattgcccaccataaactcatcgccagtggagcccaattcaatcgacgaattcggctctacacattcggtgcggtgcactgcggagaccgtcggtgggcactcgaattgaaacgggcggtgcccgactcattccgagtaattaaccattgggacatcgtgccacaaattgcgagaagcgttcgcatcgattattaccattatggaacggaggtgaaggaaccaaagggaaagaaagggcaatcagtgcttttactttgtcaggtgtggtacaacaatttgatgttgaaagggcacccattccgacaatgccacgacggccaatccgccttctgttcggtggtcgttcaccctttgctttggaattggcttgatcatttgttttattttggcacttttgtgttcagttcttgtcaattgtgcatgatggcataacaaatgagcagacaaacacttatttatttattaagcatttaaatttgaattttaaatgaattatatacaattaacatttgcattgtgtgtgttttattcgtgctttccttcccctttcaatccaacgaaaatcggtactcatggactttgtatccacattttttttttttcgcatttttcaattttttttacttttttattgtcacaattgctttaaatatcaaataaaggagctttatgtgcttattggatacaattccgcgatttgggtccacaaattaaaaaaaatgtccggtcctccaaattgcctaccccacaaaaaatcggaaatgtatgaggaaaaaagtgatctttgctcgccaaatatcgattcgtgttgctgtttaaacttc

SEQ ID NO: 45436 - DNA, 1022 bp, Heterodera glycines
aatatatttgtgtttactggttagtgcttcaacactgacagtatttcttgtagagttcgacaccggttgacgttttcatttgaatttatttttatctgattaatgcagggtttctttatgttcttatttctaagaaatgttctgatttagggcgtattttcatccaaaagaatgaaatttctgaaaaatttggctaatttctaacaaaattcataaaaaaaatttcccccggtggcgcctatcggcaccaccggctcccaaaaaacctattttttcttaaaaaattagaatacatcaataaatttggtcattctttagacaaaatctgtgtaatttatgccaaaaggaattgaatcgaggcgatacattgactaaaggaatgtggagccaacacatcattcataaaaattaatttttttgtgagattttttggagataattcaaatcaacccccgcccccaaaatgcgcactaaaaaatggaaaataagcacaaaaagcctcaaatttaatggtgtaaaatgaccaaaatttacctctaaaaattcatgcctgctaaaattttctttttctctaaaaaatttcgaactcggaaattttttatttcttaattcatttagtagatcatccctctatatttctttattagtgttgtttggtcgtcgtctcttaacttagaacatagtgtgcgcttcttaaatatctcaagtggtaataaatgaaaaacaaaatctcgtaaacttgcgaaactcaaccaatactacaacaaacttttctaggtaatttgatgcgctaattaagaatgacgtcaaaaatttaagatatctacggttttttcaaaaataaaagctctaatttgtaaggggagaaagatgtcccaaccgctgctttcaccgttaatttctttacaaaaaacaaaaattcgttcataactagggctaataattttatgtagggttcggaccccgcccccgtcacccccgcccccgccgggggcgggacaggatttttggtctcacccccg

SEQ ID NO: 45437 - DNA, 1242 bp, Heterodera glycines
ccccgacccgatgcgcccagtttatggggagaccgaatcctcgggaatagcttccctatagcctgtactttaatttgcgttgatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaaatctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttttctatcaaaaagggagatgaataaatttaaaaaaatttttaattcctttttaaacaggccaaaaattttaagcttgtgtggtaagtgtgaagaactgtgttcctccaggcaaaaaattctaagaaaatttataagcatttgaagggttctcagcagtttccctgcaaaatttggtgagcttctgatcagtctagaacgttgggtgatcaaatgcaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttccgatcagtctagaacgttggggatcaaatgcaaaaaataattaaaaaaaaataatactggtgtggtaagtgtgaagaactgtgttcttccaggcaaaaaattctaagaaaatttataagcatttgaagggttctcagcagtttccctgcaaaatttggtgagctttcgatcagtctagaacgttggggatcaaatgcaaaaaataattaaaaaaaaataatactggtgtggtaagtgtgaagaactgtgttcttccaggcaaaaaattctaagaaaatttataagcatttgaagggttctcagcagtttccctgcaaaatttggtgagctttcgatcagtctagaacgttggggatcaaatgcaaaaaataattaaaaaaaaataatactggtgtggtaagtgtgaagaactgtgttcctccaggcaaaaaattctaagaaaatttataagcatttgaagggttctcagcagtttccctgcaaaatttggtgagctttcg

SEQ ID NO: 45438 - DNA, 983 bp, Heterodera glycines
  misc_feature (970)..(970): n is a, c, g, or t
aggcactgcctctgacatgttttttatttatttagaaaaataaatttattttttttctttttgattattttaattgtatttcatcctgaaattttttaataaacattttcaaactttcaccttattaatttaaggcgaattttgccttttttaataaattctcttgtgaaaaggcaaaaaaataggctcttttaaatatgcctatttaaatgactttaattgctggcctttcgcttacgaccataccacgttgaaaacacgccatcccgtccgatctggcaagttaagcaacgttgggccttcttagtacttggaacggagacgtcctgggaatcgaaggtgttgtaagcttttttacttttttcacttataaatttatttaaattttcaattttttttggcttttttcaaaaaaattttgtctattttttcggaaggcactgcctctgacaatgttttttatttatttagaaaaataaatttattttttttctttttgattattttaattgtatttcatcctgaaattttttaataaacattttcaaactttcaccttattaatttaaggcgaattttgccttttttaataaattctcttgtgaaaatgcaaaaaataggctcttttaaatatgcctatttaaatgactttaattgctgtcctttcgcttacgaccataccacgttgaaagcacgccatcccgtgcgatctggcaagttaagcaacgttgggccttcttagtacttggaacggagacgtcctgggaatcgaaggtgttgtaagcttttttccttttttcacttataaatttatttaaattttcatttttttttggcttttttgaaaaaattttgtctattttttcggcaggcactgcctctgacaatgttttttatttatttagaaaataaatttatttttttctttttgattattttaattgtatttcatcctcgaattttttaatanacattttcaaact

SEQ ID NO: 45439 - DNA, 884 bp, Heterodera glycines
  misc_feature (782)..(782): n is a, c, g, or t
  misc_feature (798)..(799): n is a, c, g, or t
  misc_feature (836)..(836): n is a, c, g, or t
catttaatttcacagagaatttttaaatttatcttatatccaagaaaaatgactatctcttattttgagaaattttatacgttacaaatgctctcgagcaggataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaagatgactatctcttcttttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttcacagagaatttttanatttatcttatatccnnagaaaatgactatctcttattttgagaaatttatacngtacaaaagcgctcgagcgtgagagggagggcggtgcgcaatcgccat

SEQ ID NO: 45440 - DNA, 1219 bp, Heterodera glycines
cattcttaatgaaacacacttcatgttttgtgcacctatttttgaaaattttattaaatattcatggaaaatgtgtgggtattttgggatggttaatatccccccctttcttacaccaccccagttttgctttaataacattaatgttcatgttaattgttttgtttgtgatggtccgccatttatatgttgttcgtattgcagtcgaaatttgtgttttggtcattttctgccctccccccaccgttgtaacgaatgaattacaatttttgaccaattgatgtgaacagaataattaaatttgaaattttttaaaatttattttttttagaaatcatcttgctttgatataaatggtgccaaaagatagagaattttgtgctgatcatttataaaaaaaattgtgcctccagcacctttttaaaattttttatgaatttttgaaaaattaaccacttttatcgatttttcgaaactttgatcacttttttctgatcagttttggggtcagggccaaaaaagccgaaaattggcaatagcaaatcgactatgctctacacgatagaagtggttttaaagtgatttgaacacttacagttcgaaatgttcccttgtcagcatgctcttagatcgatttgtgagtatgtagaagaaaaccggagatgggcaatctcaactcttttaactgaccctacgggttttgccagaattacatttagaattcccaacatacatgctagaaaagtcggtccgaatttattcagagtttggccttgtgtccaaataaacagtactgattattcttttgctcctctagaggaaattaatcctggtaaaacaaaatgttttgataaaataccgattcgattcaaaacagcgggtaaagaaagatttgcgtacttagatccgtcatcgatgatagtctcccctactgctaagatggcgccttgcactcatttccggaagcaagtgctgcgaatttcgggagatgtgatggaagttgattaaataacagcccaaataaaaaaggtcaatgtaaaggaattaaataacttagaatttgattcgcaaaatatcccgacgatcactcctcatgtccgccaaacattcctcccagcttcctaaaaatttttacaaatgtgtcgcaaaaaagggaggtgtcaaagaaaatatcctaaaaatgtaaattgattgaaataggtaaaatttgcctataaaa

SEQ ID NO: 45441 - DNA, 557 bp, Heterodera glycines
aaaaattatttaaatgaactgactagataatatttaaaattggttatttctcttcctttcagtatccctgcaaagtttggtgcgcttctgatcagtttctgaaaaaaaagctaagcctaaactttttggcctgtttaaaaaggaattaaaaatttttaacaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtgg

SEQ ID NO: 45442 - DNA, 1482 bp, Heterodera glycines
tgaaaattcaatcactcatttttcgagtagtgatcacaatcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgttagtttaggcactctgatgctttttctatcaaaaagggagatgaataaaattgttaaaaatttttaattcctttttaaacaggtcaaaaagtttaggcttagcttttttttcagaaactgatcagaagcgccccaaactttgcagggatactgaaaggaagagaaataacctattttacatattatctagtcagttcatttaaataatttttatccaaaaaatttttttttgtgtttcgagggcagtcctccttgatccgatgcgcccagatttatggggagaccgaatccttcgggaatagcttccctatagtctgtactttaattctgcgttggatttttgctcccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagattaatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccg

SEQ ID NO: 45443 - DNA, 930 bp, Heterodera glycines
ccgggtttaaggggaagttttccggaagggttttggcctccccaaaaatttgggggcattggttgggggggatgtgcccggaaaaaaaaaaaatcgattttttcaaatgtgcgtttggggttcttcaacaattatggggagcaaaaatccaaggcagaattaaagttcaggttaatgggaaagttattcccgaaggattcggtctccccataaatctgggcgcatcggttcggggggactgccccgaaaacaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaaggtaaaaataaagtagaggtatagggaagctattcccgaaggattcggtctccttataaatctgggcgcatcggttcggggggactgccccgaaaacaaaaaaatcgattttttcaagtgtccgtttggggtactcaaacaattattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgaggccctcgcaaaatctggttcgcttctgatcagtttataaagggaaaagttaagccttaaaattttttgcaaa

SEQ ID NO: 45444 - DNA, 1055 bp, Heterodera glycines
ttattagttgtttctaagaaataatgataggaagcttatctgaaatgtgtgctcacccaggttggaatttgtcatttcctgcaataaatgttttcatataaaggtttaaaaaatttgatcgggtttaggaacattcaacaaatgcatagataaatttttgaatattatacaatcgtgctttttgctctctatcaatttattataaaaaaattcacttctcttcgaaattgaaggcagaatgctcatttgaagctacgcaaatataaattaatatttgctataagaactgactatttagtcaacagaaaataaataaatcataaaattagaacaaaaaatgattttattttagattgcacacagaagatgcataataagctaatatattcgaatttattttgaaataactgttcaacagattattagttgtttctaagaaataatgataggaagcttatctgaaatgtgtgctcacccaggttggaatttgtcatttcctgcaataaatgttttcatataaaggtttaaaaaatttgatcgggtttaggaacattcaacaaatgcatagataaattttttgaatattatacaatcgtgctttttgctctctatcaatttattataaaaaaattcacttcccttcgaaattgaaggcagaatgctcatttgaagctacgcaaatataaattaatatttgctataagaatcgactatttagtcaacagaaaacaaataaatcataaaattagaacaaaaaatgattttattttagaatgcacactgaagatacataataagctaatatatttgaatttattttgaaataactgttcaacagattattagttatttctaagaaataatgataggaagcttatctgaaatgtgtgctcacccaggttggaatttgtcatttcctgcaataaatgtttcatataaaggtttaaaaaatttgatcgggtttaggaacattcaccaaatgcatagataaatttttgatattatacaatcgtgctttttgctctctatcaatttattataaaaaaattcacttc

SEQ ID NO: 45445 - DNA, 902 bp, Heterodera glycines
gctaggcttagatcacatgcgattttcggcttttgataattttagcgttcataatgggatgtataaaggcgattgtagaaggaattggatgcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggatgcgctaaaattgtttgagaagctttttgagcgtaattacgatttttacttacaccattttttgctaggcttagatcacatgcgattttcggcactctgataattttagcgttcataatgggatgtataaaggcgattgtagaaggaattggaagcgctaaaattgtttgagaagctttttgagcgtaattacgatttttacttacaccatttttttctaggcttagatcacatgcgattttcggcactctgataattttagcgctataatgggatgtataaaggcgattgtagaaggaattggatgcgctaaaattggttgagaagctttttgagcgtaattacgatttttacttacaccatttttttctaggcgtagatcacatgcgattttcggcactctgataattttagcgctcataatgggatgtataaagcgattgtagaaggaattggaagcgctaaaattgtttgaggagctttttgagcgtaattacgatttttacttacaccattttttgctaggcttagatcacatgcgattttcggcactctgataattttagcgctcataatgggatgtataaaagcgattgtagaaaggattggatgcgctaaaattgtttgagaagctttttgagcgtaattacaatttttact

SEQ ID NO: 45446 - DNA, 1070 bp, Heterodera glycines
tgccattcgccgggatggtcggcgagaagatcctcccttgttttgggggagggcaatttttaggggttcaatcactggctttccaactgattttcaggcatgcacggcggcatctccgatcagatccaaagcctggaccagctcagcaacttgcttcgcccgcaaaccgacccaccacttcgttcgctggaaattgatctcctctgggctgacccgtcgaagagcatcacaggcgtcgccccgaacagcagaggagccggcgtcatgttcggcgcggacgttgtggagagcgtgcgcaacctgctcggcatcgactacatcgttcgagcgcatcaagtgagtttttttttggcttttcatttcacttgctttcaataattttccccttcccttctttttcagctcgtcatggacggcgtggaatacttcgcggaccgccacctgatcaccttgttctcggccccccgctacaccggcaagaacaacacgggcgccacgctgctgatcgcgccggacctgagccacacaatcacgcgcttcccgccggcctgaggacgacgagacggacggagacagaacgcacacacacacacacacacacacactaactacacacagaaggatggcggaactgcccgaattttggggtttttttataacttaaaacctacctattttggcagtttttagcacctaaaaatcgcatccctactgatgataattgatattttcaattgagtgacagagtgaaatcgaatcgaatcgagccaagaaaaaaatgtgcggaaaaacgaaaactacaattttgaacaggcctgatagcgtaacttgacgcagctttattcgtaattgtgccatcaacggctgacaattttcgttctgtgtcggctttcaacaacttcgtcgttggacctgttgagtcggccaattcctccccagccttcaaaaaaacaattgtcctcaattggccattccctttcggtgttttcactttgctgttgattctgttttctttggaattttcccttttcgtcaatttttcaaatgcaacattcaacggattccataat

SEQ ID NO: 45447 - DNA, 100 bp, Heterodera glycines
ctgggcgaagctcggcttagcactcgaagccgaagccgaaggcgaagccaaaaaaccgcgaagttttcgaagcttgaagtttcgcccagccctggttggg

SEQ ID NO: 45448 - DNA, 1161 bp, Heterodera glycines
  misc_feature (24)..(24): n is a, c, g, or t
tgctcaaaaatcgcaacatttttntgaggaggcattaaaaaataattaaagcaaaaatgagtgataatcataatggaaatttttgatcattttttgctcaatttgataaataatcaaatgaatccgtccaattcagcagaaataaatgcgatcagccgactgaaaattcataaatttaaatagtcaccggaaaagaaaatgatgaatcctttgatcagccgggatggtcagcaggtgaatttcaaaattcaaacatcttttaaaagttggcataataattaccccccccccccacctcttcaaatgaatgctcccaataagggaggcaatgagtttcaaatccgcgaaaatgtgcacatccggtccccatgagaatgacaatctgtcacacacagtgccccccccccccaactttttgtgtgccgtctcaaaaaggggttggagagaatgagtgagcaaacacctgtggatgatatgggtgatggcaccgaaaacgggatgaatgaatgaatgagcgaacaaacggatgaatgaatgaatagaagaaatgaccaccaccgattggggagggggtgggggggggtggaggctctataaaatgcattatcatcattgatgatgatcatgaaatagcatgggcatcgatcattctctacttccaaccgtaaccgtatccgccaccgtatccatatccaccggtgccccatccaccgttgttaccccatccgccaccgtatccatatccaccgttgccccatccaccgttgccccatccaccgttgttgccccatccgccaccgtatccatatccaccgttgcctccccaattattgtacccatagccgtggcctcgttttggacgagcaatcgcagggcttaaaaaatgaaaaataaattttgcctaaatcaaatgccgaaaagtatgtttaatgttgatgcgtcactgactttttctgtccgccctccgttttttgcgctttatccgtcagccaacacagaaaaagacgaagaaaagcccaggagaattgaagagcagaatggttcttcatttttgagggccccgaaaaatgaattggcccgaggtccaaattccctccccttttatttgccatttccccttccaattccggccaaattgtctgaacctttcccccgtttttt

SEQ ID NO: 45449 - DNA, 1145 bp, Heterodera glycines
  misc_feature (1096)..(1096): n is a, c, g, or t
aaaaaggattaataagatcatggggaccggagaaaaatcagacaaatacttttgcggggcttaaaaggcatggggattttaggattttaaaaattaaaaaattaaatataaggggatttctttccatggaaaaaaaacgaaaaattctttttttatacaaaataatttctgatttataaggcgacggttccatagggaaacaaaaaaacaagaaaatgttaattttttagaaaatttgtatgtgattttttacttttttttttaattatttatattttaatgtcgtcaatttattatataaataggattcatgtcttgtgtttttatttatcacatgctctcccgtgaaaatagtatagttgggcatctaatgaggtaaatgagatttatatgtgataattaattcattagttagtatatgaatttggtattcgtaattagttgatatagaaaatcgtattaatgatcagcgcaacagaaattcgcagtaatcatattatcatgatatttgaaattaaaaaaagttaaaaaatgttcgaattcgggttaggggttcgaaattggtcgaaatggaggcctgattcgtgctcagcgcctcaaaacacccctagaaacgtgttatagggattttcagaaaaaaaattaaagaaaaaactttcgggaccaatgatcgacatgattgcctaaaaaccatttccaaacccatacataaaggttcaccctttgttatttttttgggggctcccaacagcaaaaatgatttactctcttttgaagtccgtccgtcaatagaatttgatattttaatgggactgccgaggagatttacttgtcaaaacgacgtcttttcacttcattttatttaatattaaaatgcatccaatttaaaaattttatcaatacaaaaaccaaaataaatatacattttaaactttgccaaaaatttaattcaactattttatttaacataatgatcactgagcactattttttgaaatataaaaaattgaataattttaaaaattaaatttttttacaaaaattaatgttagtcaaagagttagtagctatccgtatcatagtttggaaacaaggngacgcagaaggacatgagtttgaccgctgcactgtcaatataattattt

SEQ ID NO: 45450 - DNA, 1112 bp, Heterodera glycines
  misc_feature (1083)..(1083): n is a, c, g, or t
ttatttaatgatataaaattaatcactcaatttaagataaattattttcttcgattttatgagccaaattttttaattctttctgttcattaatttgatttattactcttttaaattatgaaatataataaattcgctttcatttcatttgtgacaaaaaataaaataatttttatcaaaaatattatttatggaaaaaattaatcactcaaaattaaattaaattatttacttcgattttatcacacaaaatttttaattctttctattcattaatttgatttttattcttttaaacttaaaaaatatacgattgattataaaaaaaattaaataaaaaaattaattttcttacaaaatatttattcaaatttaatttaatttaattaagattctttattctgcaaataataatgtctgttttgcacaaaatttcggctgcaaaaagccgacgaaattctctgtcagaacaatttcatatggctgaagaaatttgtgaggttttggaagaagcaaaaatgtatgtataaacgatgcttaattttaattattattataattatttatttattcagctttatccaacgacaaaattctactggatttccaccatcggatgtaatttggatttatttacaatttttaaaatttataaaaaaaaaatttcggagttttttatttaattaattcactgaaaagaatgaaaatgatttcatataaattaatttatagtaatactttattaaaattaattaatttattttttaaataattatgttgaattttgattagatttgttttcctcagtggacgcatttaaaacaatacaattcataaaaaatttaaaatgttaattatttcataattcgattttttattatttctatttatatttgttttttaattatttatttttctacacaaattttacacacattaatttaaattttaggattttcttttattatgctctctgcgtgacctattggaaaattcattggttcttgcaaaatcggcagcagaacaaactaattttgagagacgaagcaatgaaacatgtaaactttttttttgattttttanataataattaattgtttttaattacctaa

SEQ ID NO: 45451 - DNA, 745 bp, Heterodera glycines
  misc_feature (151)..(151): n is a, c, g, or t
acatacatcggctgacacagcgccagtgttggatggtgtaacgcattggagatatccactcaattttcacccatcggcaatcattgtttgttaaatttatgcatttgatttccaaaaattaaaatttttagctgcattcgggacaacaatntagaccatcaactcggaacacagctatgcggctaccccagtacagttcggcatcggctcaccggcaccatcaactcttacgtggacaaccactgtgagtccacgggagcagcttgttcaatactcgttgagcccgctatcgacttcggcagcgccttcaggcagaattatttaatcaattcatccgtttaaatttaataaaaaaaattctgttccagcatgggagtacgaaatcgttcgggcaccacattttccaattccgccggcactttttttcaaattgagggatatgcattaaaattgaaggattcgaaaaatatgatgattcaattgtccatgtcccgtaatgaattttatttaatgtttaataaaattattttttcaatgtgtgaagctgagggtgggtctatagagagaattcggatcacataggagccctaaaacttgttcaaattttgatcagcactctttttaggagcttcgaattttttttttgctattttatgtttatattgtgtctggggttaggaaatgggttatataaatgtcgtattcgtattcagcaaccccgaaaaccctaatttaggcccatttt

SEQ ID NO: 45452 - DNA, 1727 bp, Heterodera glycines
cgatccaagcgtcgagagagtagttggcgactctcttcttctccggcctgccgagtgggcagtctgcagctgcactccgtgcttttctgcatgccattgaagaagcgaagggccaacagggactggttttgggcgttgtcgtagcctctttccggtacgatggccaaatgatcagcagggagatgatttgtcctgaagtgcttcatgcaggcgctggcgattgtcatgcactgcttcagaacatcaattccgttgtgcgtttcacggccgtccacaggttcttgacgtcttgtgatttccaagaactcccgccgaaatgccaccagcgctgccattaagatctccacgtcattggtgcagtagctggccaatgcctcgtccagaaaaaatggttcactccgatgttgttcgtaccagttgtcaaactgtcgtctcttttctggcatcattccatgggcgaggtagtcgtcgggggtcggaaaaatttcgcggccatagttgtccgggcggttgaccatatgcgggaagaatggcttctcttcgacgtccaagccgtaggcggggaccagctgaccgagcgcacagggcatcaaattgaacgaatctcggaagacgatgttggggtgtcggttcttctgcgccctcagcttcatttcatacattttattgcccttaatttgtttatcagaataaaatatatgtaaaaacatactcacccgtctgatcatctccgggttatagccgcgacggaacagctcccggaatgtgatgaccatgtcgaaacggccaccaaaatgtgagtaggcgaaggtgttggccttgatcggcaagtcgttgatcaaccaaccaacaaatgcttgcatggggttgtcggtgaccacttgcttgtcaaccggagtgtcggtaaatggtcgttggcagaaggcaacggttcggtgtgggccgcacacccaacatccggcagttccttgcttccatctgccattttcaatgcaggcggggcaagacacttttgctgcaatgaagtttggctcgtggttgcgtcgttcaggcagatgagggtcagcctcgaggtcaaatgcaacgaaccgataagcgtccatctcctccttgggctcaaatggtgcaatgtagcagccgcgctctgtgttgtggaagttgttgcagagaaggcagaatttttctccgcaaacatgtccctttcgtttacgcctgctgttgtcggcaacgttccaaatcacaccacagtctttgcacttctttgagcgcgtgcagtagttggactgaagatggtgattgtagcatcccgcgttgttgaagtttttgtggcattctttgcattttcggaagaagtcaggctccgagggacacggaaacgcaggtccaacgcgcgagcacatcagacagtgcgctttgcaggactggttgtgttccgacggcttcttataaggcttctcgcactccaggcaatacttttttccaccaaaaagtccgctgaggaagtgtacaccgtcaaaatgactgttgttaaaataaagcgccaatggtgtgtcgtagttgtcatggccgcatttgtaaagtggtttgtagtggccagttgttccaaagatgaaaacagcaaagcggtgctgctgttggtgcgcgttgttccaatggttgatgaccagcggcacataagtgtcggcgtcgtatgcgtccaaatccagtggcgctctgatttgccgcat

SEQ ID NO: 45453 - DNA, 939 bp, Heterodera glycines
tggacatattaattttaacttaattagaaaaaaagtagctattaattgttaattttaattaattttattttatctattatatttaatgaagtttttaattcaatcagtaacttcagttttttatacctttattttcaaaaaaaattattaattttcataaataattttgttatagaataaacaagtaatgattatttttaattattattcacaattaattaaatattaaccaacgatttatttgataattccatttaacaattaaaaatgcactatatttctctttttagtgcgctcacagaagaagactgcagtctgcttggactgggctgccagtgacttcatccggaccatcagcacagccaccaacatgtgcttcatttgttttgaggtacaagggttcttttctttgttttagcttttttctcttttaagcagggacatggaaagaaagactgcagtcagatgcaactcagacgtcagtttgaggagatccgccagagcattggcaactctcagcgcgtcaccaatgcgtctgaccccgacaacgcgaaaaccttttgggcctcttgggacggcacccgtgatggtgccattcggcgccatcactacatgcagctgggcgaggaaggaaggtagttgcctttaataatgcaaatgcttttaattgttaatttctagaggcgcaaagagggagactgcagttggaacgggactgagcattggaccatgcgaagagatgcgacaggaagggtatgtgtgcattccatttaaaacatcaccatccacatagttgttggtatttggatggtaaccatccacataccacctgctatgcagtgacacatgtgtatagactaaattggcaactatccacataccaacagctatgtggatggtgaccatccacatagttgttggtatgtggatggtaaccat

SEQ ID NO: 45454 - DNA, 1193 bp, Heterodera glycines
aaaaaccccattcagcagattctcagttggatacgatcaataacagtataaaaaactgattggtaaaaataccaccctaaacttctgtaaaaagtcaactggacgaacggctgggccctgcttccgtctggctacagtctcgagagctaatttggcaaaagcctcattttaaagcctacctcgaaacaggataaaaaactgattggtaaaaataccaccctaaacttctgtaaaaagtcaactggacgacggctgggccctgcttccgtctggctacagtctcgagagctaatttggcaaaagcctcattttaaagcctacctcgaaacaggtacaataaaattcctaaaaaattatttgggctcctataacaacggcggcatcaaattcgggttcagcgcagccaaaaaccccattcagcagattctcagttggatacgatcaataacagtataaaaaactgattggtaaaaataccaccctaaacttctgtaaaaagtaaactggacgaacggctgggccctgcttccgtctggctacagtctcgagagctaatttggcaaaagccttattttaaagcctacctcgaaacaggataaaaaactgattggtaaaaataccaccccaaacttctgtaaaaagtcaactggacgaacggctgggccctgcttccgtctggctacagtctcgagagctaatttggcaaaagcctcattttaaagcctacctcgaaacaggtacaataaaattcctaaaaaattatttgggttcctataacaacggcggcatcaaattcgggttcagcgcagccaaaaaccccattcagcagattctcagttggatacgatcaataacagtataaaaaactgattggtaaaaataccaccccaaacttctgtaaaaagtcaactggacgaacggctgggcactgcttccgtctggctacagtctcgagagctaatttggcaaaagcctgattttaaagcctacctcgaaacaggataaaaaactgattggtaaaaataccaccccaaacttctgtaaaaagtcaactggacgaacggctgggccctgcttctgtctggctacagtctcgagagctaatttggcaaaagcctcattttaaaagctacctcgaaacaggataaaaaaactgatcggtaaaaaataccacccctaaacttctgtaaaaa

SEQ ID NO: 45455 - DNA, 525 bp, Heterodera glycines
  misc_feature (499)..(499): n is a, c, g, or t
tggacccgactgaactgtccgtcgagcaactgaaggcatttatcgctgaggaggaggaaattgctgtgccggaccaaagacttgtctttgctggtgattatggttttgttatttaaaataatttttaaaacatttaaaggttgccagcttgtggatggaactctgctcaggacttatggagttgatgctgattcaaccatccaccttgacctcaggttaacttaaggtttacaatgtgtgcaaaaatatttttagattgcttggtggtgggaaaaagcgtaagaagaagcaatacactggcccgaagaagcagaagcatgttcgcaagaaggtaatttgggtttttaggtctatggacgaacaattccaaacttaggtcaaactcgccgtgttgaaactttacaaggttgttagacattacaattgagagaataggtaaaattttgaagattgatgacaatggaaagattcatcgacagcgtttggaatgcaatttcgncagctgtggagccggtgatcatttac

SEQ ID NO: 45456 - DNA, 992 bp, Heterodera glycines
cttgtaaatgaaaaaaaaacactgggaaaatttgaaatttacataaataaaaatttttcaacatgccaagctccactgaaaacctctaaacaaacagtaacacgaaattaacttttcaacacaaaaaagcagcttctctaagcattttttccaatgttaccaccttttgccgctgagttttcacttcgtttgcatattttaaaatttaatgctaatttgactcaaaggcaaaatttaatttttaaatcgaaaactggataaaatttgacaattcatttttaacccttttcaaacggtcaaacccggacaaatttggtataattcgaaatttttcaggtcttaaactcacggagctctttcaaatgacaccaaatatcttatccgtacggtttgaaaaggttggaaacatagaactgtcaaattttggccaattttttgatttagaaaaacatttcgccaagaaattttcatttttactcgaaaaatttgttttaccctttacccctaaaactcaaattgacagctaattaaaaatttccctattttttagcgatttttttccaataaattactgcatatttaacaaaaatggccggctttctgatgaagcaaatggtgggcaataagtttgacgaggtgaccaacaaattgggcggcgatgatgagcaaaaaacggtggacggagaggacccggaggtgtgaaatatgaaaaaaattggcaattctcggtggataaaaatggcaaaaaattaaaaatggcacacttttgccgttatgtaccccgaaaaatatttgatattttttaaaaaccaaagttggaggaatccttttggtttgcaaattgcaaattttgtcataataaatcttttatatggcttttcggggtcgctgatcatgaatctgccactattttttgaccaatccctaaccaaaactcgaaaaagtcaaaaaaatgaaattttaggggttagggttttttaagattggaaaag

SEQ ID NO: 45457 - DNA, 656 bp, Heterodera glycines
acaatcactaaagttttatctaaaacataacgcacattattgtgactcaccaaagtcacagaacaatcactaatgtttatcagacatgacctatatggcaaatttatcacaacgcttaccaatccacgtacaaaagataccgtcaaagttgatgtagtgaatttcccgaaagtgatcaaaaagttgagtggccgatcgacaggttcaacacttcacaattgtaatccaacagcatttcttcaatatgatggttcccatttctaaattttacatcatattaacagaacaaaccaaaatataactcaaaacaaattaatcccagtaaactttgatgacgcaattaaaatcagtctgagaaagctgttgattgatggccacggcagattccacacttgtgaatgaattcacaaccaatagtacccaatgagcgatcacaaaactttagttcttcataagtcatacctaaattttataaacataattttgaataaaaaaccaagcaaaacaaacttcaactaaaatcacttcatccaaagtattgggtaagacatggatggccgaccggcaggtaacgaagaaaaaaaaatgccgaagcggcagaaagaaagtcaataaactcacctgtagaaaattcaacttaaggaattaattcattt

SEQ ID NO: 45458 - DNA, 969 bp, Heterodera glycines
tttcatcgaacctagcgcactaaaatcgatataatctccttaaattttgcaggccttctccattgtaaaggactaacttaacctgaaaaaatgccaacgcttgttgtttttaaaatttttcgaaattctgactttttcattacttatttattttttgcaaaattaacccacaagtattttttcagaaagtgctctgaaacgcaccaaatgttaattaaaagttaaataaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattacttatttattattttgcaaaattaattcataaatattttttagaacgtgctctgaaacgcaccaaatgttaattaaaagttaaataaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaaatgttaattaaaagttaataaggctctctgatgctttcactatcaaaaaaggaagatgaataaaaaatcctaaaaatttttaattggcttttt

SEQ ID NO: 45459 - DNA, 977 bp, Heterodera glycines
cttcagagcacgacaaatatttcaacaaaaatttttaaaaattgactagagcaatcgaacgctaacggacgacctaatggaaaaaaatccccgaaggagagaatttaattaaatccattccttcggggaaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttctccatcttcctttttgatactaaagcatcagagtgctaaaattaagttgtaaataaaattttggtgcactttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgagggattcggtctccccataaatctgggcgcatcggttcggggggactgaccgaaaacaaaaaaatcgattttttaaagtgtccgtttggggtactcaaacaattatggggagcaaaaatccaaagcagaattaaagtacaggctatagggaagctattcccgagggattcggtctccccataaatctgggcgcatcggttcggggggactgaccgaaaacaaaaaaatcgattttttcaagtgtccgtttggggtactcaaacaattatggggagcaaaaatccaaagcagaattaaagtacaggctataggggaagctattcccgaaggattcggcctccccataaatctgggcgcatcggttccggggggactgcccccaaaaacaaaaaaatcgattttttcaagtgtccgtttggggtactcaaacaattatggggagaaaaaaatccaacgca

SEQ ID NO: 45460 - DNA, 910 bp, Heterodera glycines
ccgaacaaaaaggaacttcaagattttgctcttaacgttagagccaaatcacccagacacgaaagaatacaaatatgcctcacccaattggggatcttggctcgacttttcagtgatctttcgcacctacttcctcccctttatacacacatttggtgtgttataaaattattagaaaattaattattattttttacgatgagcagaattgtaaattagacaaacaggaagttggcaacatttaacaaatatttattaatttttaacaaatgttttatagaatatctcaaccaatttattgctgcattggttaattaatttttcgcgggcgttttcgaaattccaaaaaatttgagaatttattgaatttttgccgatttccaattatattcattaacaacagataaaaatttcaattaatttaagccaaattatattttagaatattgtaaaaattcaaatttctgggtttgaccatggtttggtggctatttatggcatcacttaacacactttctcgcgttcagcatttcgtttttaactgctggctgcacaacacagcgttacattgctacttatttggatacaaaacttgaaaattttccgaaattattttaaaaattgtaaatatttcctaggtatttcgccagggcatatttttaaagcttaaaaatgacagaaagcagctatttattcattgcctgcatattttagagatgatttaaaaatctgacttttgctcgctttaaatgcattcgcgcaaaaaatcgccgcgagtgtttgtttcgcggtcgcgctacacacctgctggtcataactagagctgggatttttatgtttttaatatcttttatacgacttagttatggcgagagaagcacaaaaatagcattttctccgaaccagtttt

SEQ ID NO: 45461 - DNA, 996 bp, Heterodera glycines
  misc_feature (74)..(74): n is a, c, g, or t
  misc_feature (87)..(87): n is a, c, g, or t
  misc_feature (961)..(961): n is a, c, g, or t
gacccatctaaaaaatatgaagtaaaatgagacaaatttgaaagttccagctgtttttttttaaaatataatcnccaccttggagcncaaagaaattgcattttccgtccaaatgccgaaaggtcgaaattacgcagccaaatcggatgggcaccgtcacgcaaagaaacctaaaaacaaaaaagaaacatttatgtgaaatttgggaataggaaaataatcgaaaaatgaaaatggcacatttgatgagcaattaaagtggacggagagcaatgcccccacaaaactgaccatcactccgccctccattatctgcacaatctccgccttgtaaatggctccgaattggtaatgctcctcctgacgttcctccagcaatctttgaaagaaaagtgaaatattaataccataaagcatttgaaatggagcccctttttccaccgcttactttgccaacatttcgttacacttttccatgcattttttgtcgggtgcaaacagcaaaatattggcttcatcttccgaacttatcttaaccatggaaagggaggcgtaaaaacaatgaaaactaattaaaatcttagtcgccataattttttaacaccttcacgccggtctccgcctcgagcagtttgacgttgtaaccgcccgaccggaaaatgatcgactttttgtagacgggcaatggcattgtttcgacgatgggcacggacgctttgaactcggcccttttggaacaaatcattcacattaagcttaaagttttgtgtaattttttcattacgcttaattccggatttttcaaaaaagggggaccggggaaacctaacccaaacttgtgaccataaaattattaagaattattgcacaaaccgtggttccgcgattgtgtcgcgcatcagtcccagcagatggacaatgccctttttgccctggagaagagcgtcgcgaagaacactanaaatacatggaaaatttggcaacgaattccgatgg

SEQ ID NO: 45462 - DNA, 1166 bp, Heterodera glycines
  misc_feature (781)..(781): n is a, c, g, or t
  misc_feature (1051)..(1051): n is a, c, g, or t
  misc_feature (1067)..(1067): n is a, c, g, or t
  misc_feature (1073)..(1073): n is a, c, g, or t
  misc_feature (1107)..(1107): n is a, c, g, or t
tttcagtcactgcaattactgtacttccgcgcaatgcgcgactttgactttctgaaggaaatgcaacgcgccgaaatggaaacaaataagggatttcggcaaatggttgatctcacagaaaattgttataaagacggattcaaacaaccgctgatttggttttgccaacgagcggtaaaaaattgaatttcaatttaaatgaaccttttaaatattttattttaaatttaaataaatttaatttatttgaggattatatgacacatcaaagtgaagaaaatgatgagaagaaattggaattgaagcaggtaaaaattgaattttatttccaaaattttgtaaatttgactaaaagtctaagaaataaaacattttctttttctggtggaaattaatgccggcccaattggcggccttggcacttcgtcccgtgtcactatgcttcatcagcatgtcctttccatggccaatgccgacacttcgcccgcggcgctgccgcctaatcacacggacacaatggtggccaaagcactgcacatggcatggtaaaagcaaaaaatgttaattaaaaatcactgaaaagttctgaaatgaataaactgacaatttttttagaaaacggaaaaaaatatcgaatttcaccccagcgcatccgaatatttgcggggtggcgaaagtcgataaaaatttatataattttgaaatttaattctcgggttttgagaaaaatttcccaggttaaatttcaattaaaatttcaaaagaaaatataaaaactttngggggtggaagtttgggcgccagaaatttgggcaccaaattaaggatttaaaaaataaaaatatttttatttgtctataaattgcaaccatctaatttaaaagcattgtaaatttaatcaagttagggatagaaagttttttaatgaatattcactctattaagcatgcttattttgctaaactcattaccattctttctatatcaatgccatacatatgtattatttataatttatgacattacaaggctcggtctgtttaagacttanaatttcatgagtttanatttanatagaatagacgggtctcttcttatttcggaccncactaagcccggtattcaggtctaagtccaaacagaaactagtatacgtttaactatac

SEQ ID NO: 45463 - DNA, 1083 bp, Heterodera glycines
aaaaaatgaaaattttgaaatcattttccccctccttttccccggggttttttttttaaatttttttttccccaataacttttcaaaccccatttttcgcacgtggatgtttttttatgaaattctgaaccggtttgagtagattagactagaaaaaattgaaaattttgaaatcatgtttcccactcccttctcccaggggtattattttgtaaagtctttttttccaccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtcttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccggtttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccgttttgagtagattagactagaaaaaattgaaaattttgaaatcatgtttcccactcccttctcccaggggtattattttgtaaagtctttttttcccccaataaacttttaaagccccatttttcgcaccgtgaatgttatttttattgaatt

SEQ ID NO: 45464 - DNA, 766 bp, Heterodera glycines
ctttctgttcttattccgctttctctttctgttcctcttccactttctcttccactttctgtttctcttccacttcctctttatgttcctcttcctgttcccctttttgttcctcttccgctttctctttatgttcctcttccatttctcttccactttctgttcccctttctgttcctcttccgctttctctttctgttcctcttcctgttcccctttctgttcctcttccacttcctctttctgttcctcttccgctttctctttctgttccgcttccgctttatctttctgttccttttcctgttacctttctgttcctcttccactttctgtttctcttccactttctgttcgtcttccacttcctattccactttctgttcctattccactttatacttcccctttctgttcctcttcctctttctgttcctcttccactttctctttctgttcctcttccgctttctctttctgttcctcttcctgttcccctttctgttcctcttccactttctttttctcttccactttctgttcgtcttccacttcctgttccactttctgttcctcttccactttctcttcccctttctgttcctcttcctctttctctttctgttcctcttctgtttctcttccactttctgtttctcttccacttcctcttcctcttgccctttctgttcctcttccactagatcttccactttctcttgccctttctgttcctcttcctaaagatgttcctcttccgctttct

SEQ ID NO: 45465 - DNA, 1272 bp, Heterodera glycines
caattatggggagcaagagtccaacgcagaattaaagtacaggctatagggaagttattccagaaggtttcggtctctccataaatctgggcacatcggttcggggggtttgcgccgaaaacaaaaaaatcgattttttcaagtgtccgtatggggtactcaggcaattatggggagcaaaggtccaacgcagaattaaagtacagactatagggaatttattccggaaggtttcggaaggattcggtctccccataaatctgggcgcatcggttcggggggactgcccggaaaacaaaaaaatcgattttttcaagtgtccgttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattccggaaggattcggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaa

SEQ ID NO: 45466 - DNA, 1707 bp, Heterodera glycines
ccccccccccccaaacaaaaaaacaaaaaaaaaaaaaaaaaaaaaaaaaaaaatttttttgtaaaaaaaaaagagaaaaaaaaaaaaaaaaaacccccaataaacccctggggggtttttttttaaaaaacacaaaaaaaaagggggggaaaaaaattccccccctttaaaaaaaaaaaaattttttttttgaaaaataccaattcccccaaaaaaaaaaggagaaaaaatttccccccccttgccctaggcctccgggccagccccccggttcattgggaaaacaaagttttttttccccccgggccagggggcgggttccggggataaattacggaagttcggcgtgcttttaccaatggtaattattccatatccagtttccgaatttcaattcgggtgggttcctttgtaaggtatataaaaataaaaaaataatcatttctctaaccaatgttctatttgtacttcgaaaatgtgatttaattactgtagaaagtattcaaattcgtacaaaaaaaataaattaattaaaaaatgtaagctaggggatgtatctaattcacaaaaaataatttccttttaaacagtcgatttctttaattaattcattgattaccttaccattctttcaatgcttatttcatttgtaaatcaaaacatttttacatactttacaactttctcgttattgtaattttcatctattattatttttctgttattagttcaaattttatgttctttaaagaaatttttatttttaataatagaaaattacctaatctcttaggaatgttttcatgcaatgagattttttagttatattttattttttcataatatatcccgatattgtttaattctgcaaccaaccggtttttaaatcatattgtattataaggttcaaataatttcatttgtttccatgtttaaaataatatattaatttaaacaattaacaaattgttgaattgtgattttttaaattatatttatagtgattgaatttgctttaaaaatattttaaataagaatatattgtttaattcattctgtaacgatgatcaatattttatattcggtgtttacattttttttaatatttggcaattcttatttatttgtttaaaagtttgaaaatttaccggatatttcctgccaaataaaattgtatttttgaaatttttttaattaattaaatatttcactaattgttattggttatttaggatttttaaaattatttctttatgagatctcgaataatagaaaaaagaaaatttaacttattttaaacaaatatttaagttcttttttaatattttcttgatttttaaattttttagaaaggaaatcatgataaactacttttttaaacaaaaaacccgttaccatatataataaaataaattatactacattcttaatctaatatgttaaattaataagcaatattttataagatttcttcgatttcgagtaattgacagaaactgctccatttcgtaatgactgatttttgttttacagaaataattttcgaacgaattctaatattgcttatatattaaataaattagttttatattaaataaaaaggtaaaactattgggacagcaattaggtttactttatttaaaattatatttttaatttcctctaaacgcaaaaaaaattttattaatattttttaaagttaattaa

SEQ ID NO: 45467 - DNA, 1093 bp, Heterodera glycines
ggacattttccgctttttgttaacctctgagaatcctcatacgctctttttcttcttgtctccaacgactttgtgccctaagtgagtaaagtgatcgcaaaggcaaaggatgaaagatatggatgataataataaagtggagaaatgaaatgaaatttaaattaataaataattaaatgcaaatttgtttaaaaattatttcctccgtctcttctgtttttggcatttaattctttcagcattctctggcatctcggctgcatcggtcgtgggcgccgacaaactcagtcaattttagctgggcatcggaattgacattagagaaagacagctaattttttcaaacatggaccaaggatttaaatgcaaaaatatgtgcggtcgtctgttagagattgaaaacgacaggaaaatctgtgttttcaaaactgaaaatattttgagacaatgtagtcggattaaagaagttgtcaaagaaaattgggacatgaatgtatttatccaagggagcatatacaatggccttggaagaaaagaagttatgataaactcaaaaggaataccgaatgattggacaaaagacgacagttgccaattttttgacaaattgcgaaaaaagttaagagaatctggaatggcattaacccggactctgataatcccttcccgaaatgtctccattttggaaatcacaattaattctgatgaccaagaaataaatgctcaaattagttgcaataatttgattggattgattaattcgaaatggttggcatgttgtgtgcagttggatgtacgatttaaaactttatattttgccattttggaatgggctgacgttttaccaaatttgatcaaaattttaccagaaatttttgaaattcgaaatgttacatacacaaagaaacaaatttttgaagtactgaaacaaaaacttatttgggagacaaccaattcccagagcatttcttcactactcattggattttttgaattttatacaaaaatcaatttagaagagagccggttgaatatgaatgaaggaaaaatcgatttttgggagaaagtgctcaggaaatgaaaatgcatttat

SEQ ID NO: 45468 - DNA, 1397 bp, Heterodera glycines
gttttcggggcagtccccctgaaccgatgcgcccagatttatggggagaccgaatccttcgggaatagcttccctatagtctgtactttaattctgcgttggagttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaatcgatttttttgtttcataaatatttttttcagaaagtgctctaaagcgcaccaaattttatttacaacttaattttagcactctgatgctttttctatcaaaaagggagatgaataaatttaaaaaaatttttaattcctttttaaccaggccaaaaattttaagcttgtgtggtaagtgtgaagaactgtgttcctccaggcaaaaaattctaagaaaatttataagcatttgaagggttctcagcagtttccctgcaaaatttggtgagcttctgatcagtctagaacgttgggtgataaatgaaaaaaataattaaaaaaaaataatgctggtgtggtaagtgtgaagaactgtgttcctccaggcaaaaaattctaagaaaatttataagcatttgaagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaatgctaagaaaatttataagcatttgtagggttctcagca

SEQ ID NO: 45469 - DNA, 423 bp, Heterodera glycines
gtgcagagggcaacggagatcgatatatctacaaagtcgatgaaatgcctaaatcatcgtgagacacagaaccgtatttaaggagggggggtacgtaccccgtgtaccccccctccctaaatacggtactgcctctcccgatgatttaggcatttcccccaccccgttgattcattggttccgctggtctaacaaatatttccgaatgaccactccccccgggcaccttccgttgcgtcttccgctgcacgtgtttgtcctcgtctcgccagtacgcgtcttccttcgcctgttcctcccgtgctcgctcttccgtctttgcctccgttttacgcgctcgtgacaccgccgatttggtgttttcgccctggaatttccgcaccactcgataattttatatttttttttttttttttttttttt

SEQ ID NO: 45470 - DNA, 733 bp, Heterodera glycines
acgtgtcaaagggtgtgcatctatgcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggtctaatccagaaaaaatcactatctcttttttttggaatattttacgtgtcaaagggggggcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcgtttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccgggctaatccagaaaaaatcactatct

SEQ ID NO: 45471 - DNA, 981 bp, Heterodera glycines
ttccattaaattttccatcgaaaaaataattttattttcattttctgtctgtactgtaaaaaatactgtaaaacccttatacataaatccaatttgaaaaaaataattgtgttttataaaattcacagaaaatgccctcctgctgagtatggcaaccaacacgaaaaggtgcccgcccccttcgacaaatgtcgaactgcttttgcccaaaagcagtacgttaggtcatcgtccagccacaacaacaattactgtgccaacatgtccgtgccgttgccactggctgctgctgttgaccatcattagcggcactttgatgtcggttattagcgggtccatcagcggcataagtgacagaagccgacggcaaagtaaatttaaaaagcatatttcctttttgcataaaatttgtatgccattatttttattaaagtgccagcaagttcgtcgggcactgtaaattctgtgggcaataaaacggtataatactaacttttattgattaaaaatgggtaaattcgacaaattgttcaaggattccaatttcattgtcgatgagtaaaaaaaaaatttattattgtatagcattgattactgtaatcccgtaattaacgttttcggaaatatttattatgcaaggctagtgataatatgctcataatgtaaattatccatggttttattgaatgaattcaacaactagtcaatgtcggcatcgaacgccctttggaaggcacccgacggaacagtgggtggcaatggtataaggaatttgatgaatgattttaatgattttaatattaccacaaaggcagttcaattgggacggcgggcgggccgggcccgagcagtgttttggccggttcgaatgccaaagttggcggtcagagtgccaacggggaaaccggcgcgcttagcttgggcggcacacggtccgagtcgttcggatcgtctagctcaagtctgcttgtttaaaactca

SEQ ID NO: 45472 - DNA, 1111 bp, Heterodera glycines
  misc_feature (47)..(51): n is a, c, g, or t
  misc_feature (57)..(57): n is a, c, g, or t
  misc_feature (59)..(60): n is a, c, g, or t
  misc_feature (62)..(62): n is a, c, g, or t
  misc_feature (64)..(65): n is a, c, g, or t
  misc_feature (71)..(71): n is a, c, g, or t
  misc_feature (73)..(74): n is a, c, g, or t
  misc_feature (87)..(87): n is a, c, g, or t
  misc_feature (95)..(98): n is a, c, g, or t
  misc_feature (105)..(105): n is a, c, g, or t
  misc_feature (110)..(110): n is a, c, g, or t
  misc_feature (114)..(117): n is a, c, g, or t
  misc_feature (124)..(124): n is a, c, g, or t
  misc_feature (126)..(126): n is a, c, g, or t
  misc_feature (128)..(129): n is a, c, g, or t
  misc_feature (158)..(159): n is a, c, g, or t
  misc_feature (211)..(211): n is a, c, g, or t
  misc_feature (223)..(224): n is a, c, g, or t
  misc_feature (275)..(276): n is a, c, g, or t
  misc_feature (287)..(288): n is a, c, g, or t
  misc_feature (369)..(371): n is a, c, g, or t
  misc_feature (382)..(382): n is a, c, g, or t
  misc_feature (406)..(406): n is a, c, g, or t
  misc_feature (429)..(429): n is a, c, g, or t
  misc_feature (436)..(436): n is a, c, g, or t
  misc_feature (445)..(445): n is a, c, g, or t
  misc_feature (448)..(448): n is a, c, g, or t
  misc_feature (472)..(472): n is a, c, g, or t
  misc_feature (478)..(478): n is a, c, g, or t
  misc_feature (538)..(539): n is a, c, g, or t
  misc_feature (565)..(565): n is a, c, g, or t
  misc_feature (587)..(587): n is a, c, g, or t
  misc_feature (791)..(791): n is a, c, g, or t
  misc_feature (881)..(881): n is a, c, g, or t
  misc_feature (932)..(932): n is a, c, g, or t
  misc_feature (952)..(952): n is a, c, g, or t
  misc_feature (957)..(957): n is a, c, g, or t
  misc_feature (963)..(963): n is a, c, g, or t
  misc_feature (973)..(973): n is a, c, g, or t
  misc_feature (976)..(976): n is a, c, g, or t
  misc_feature (979)..(979): n is a, c, g, or t
gttttgagtagattagactagaaaaaattgaaatctactgggcatgnnnnncactcncnncncnnaggggnannatcttttaaagtntttttttnnnnaataaanttttnaaannnnatttttngnanngtgaatgttatttttattgaattctgaanngttttgagtagattagaatagaaaaaattgaaaattttgaaatgatgtttgngagtgggttgtnngaggggtattattttgtaaagtgttttttttaaaataaagttttgaaaggnnatttttggganngtgaatgttatttttattgaattatgaagaggtttgagtagattagaatagaaaaaattgaaaattttgaaatgatgtttnnnattttgttatnggaggggtattattttgtaaagtntttttttgggaaataaatttgtnaaagagnatttttagnagngtgaatgttatttttattgaattntgaagngttttgagtagattagaataaaaaaatatgagtgaataaacttttgttaaaaagttaagnntaaaattttttgtaaagttaaaaagnaattaaaattttatgaaagtgnattattgatagaaaaagaattagagtgggtaaaataagatgtaaataaaatttggtgggtttgagaaaaatttttgaaaaaatatttatgaattaattttgtaaataaataaaaaagaaagaataagatttttgaaaaatttttttgagttagataggtagggggttattttagtgtaagttagtattttaaaggggagtattnatggaaagtttggtaagtttatggtgaaattagaaaaaaatatgagtgatagaatttttattaaaaaaagttaagtataaattttttggnatatttaaaaaggaattaaaaaattttaaaatttaataattttggtgtagngaaggtattgagtaggtttnttagngggatngtggtggganttnganaagatagtgttgggaggggattgagaggaagagaaatattttaataaaaattttgaaaaattgagtagagaaattgaatgttaagggatgagataatggaaaaaaattggagaaggagagaatttaattaaa

SEQ ID NO: 45473 - DNA, 1078 bp, Heterodera glycines
ttttgagcgtaattacgatttttacttacaccatttttgctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttacaccatttttttctaggcgtagatcacatgcgattttcggcactctgataattttagcgctcataatgggatgtataaaggcgattgtagaaggaattggatgcgctaaaattgtttgagagaagctttttgagcgtaattacgatttttacttagaccatttttttctaggcttagatcacatgcgattttcggcactctgataattttagcgctcataatgggatgtataaaggcgattgtagaaggcattggaagcgctaaaattgtttgagaagctttttgagcgtaattgcgatttttacttagaccatttttttctaggcttagatcacatgcgattttcggcactctgataattttagcgctcataatgggatgtataaaggcgattgtagaaggaatggaagcgctaaaattgtttgagaagctttttgagcgtaattacgatttttacttagaccattttttctaggcttagatcacatgcgattttcggcactctgataattttagcgttcataatgggatgtataaaggcgattgtagaaggaattggatgcgctaaaattgggtgagaagctttttgagc

SEQ ID NO: 45474 - DNA, 250 bp, Heterodera glycines
tttattattttttaaatttaaatttaattacttattggtaaataaattttataatttaaaattaattatttatttttcatgttttacttctttaatcactcatccaatcactgttgtacctcttctaaaaatgggcgcgaagcggccgattgttctcaacaaaattaaaagctgggcgcgaagcgcccgtcttgaggccgagaagcggccgaatgcttcccacaatattaaaaacgggcgcgaagcgccc

SEQ ID NO: 45475 - DNA, 1020 bp, Heterodera glycines
tgtgaattattctcagaaaaatggctatctcttttaggacaatttctatctcgtaaccccgatgctaatacgttccgcagagcctcttcaaaattttttccattaccgcaagagctgcggaaattgtgaattaattctcagaaaaatggctatctctttttaggacaatattctatctcgtaaccccgatgctaatccgttccgcagagcctcttcaaaattttttccattaccgcaagagctgcggaaattgtgaattaattctcagaaaaatggccatctctttttaggacaattttctatctcgtaaccccgatgctaatacgttccgcagagcctcttcaaaattttttccattaccgcaagagctgcggaaattgtgaattaattctcagaaaaatggctatctctttttaggacaatattctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggccatctctttttaggacaatattctatctcgtaaccccgatgctaatccgttccgcagagcctcttcaaaatttttccatttaccgcagagctgcgggaattgtgaatt

SEQ ID NO: 45476 - DNA, 1264 bp, Heterodera glycines
gtcactatttagttaattattttgggattttttatcactaaaaatcccatccccagttatcaatgccgtgcgttcactctcgggctgacacccgcgcagcaaatgccggccgaatgtttgcaatatgtgtgcgttgtggctggtgaaattttccagaaggcacatgagtgcgaatgtgacttgacgggtgggtcggcttttttttgacagcaaaaaagggaaaaatgcataatttttacttaatttacaggttctgtgtccggtatttgtgagccaatgggtggtcaatgcgagtgtaaaccaaatgttattggaagacggtgggcatccttttttaaaagttatctatgactagagaccggaaatttcaattttggatcttgctgcgggattataattcaatttttttttgctgtacgggttccgccggattcgtcccgcaaaatcccccaatttgctttgcggaatgggataccgcgaaatcccacccttgctctctatctctgtgacaatgtcggcggagttgacaaatatcggggtttttgggggagtcggtagcacaagggaaaatatagcgtccgggtcggaaatttctccgggaattgttgtcaaggttccgcttaaccttgtttcttaatactgaagttgcgaccgttgcgcggttggcacttacggatttggtccgtccggctgttcgtcatgcgattgtgacagtgtagggtcactctcaaatgtttgttttacctcattgtggttactgtaaaaaaaaaatgttccttcgtatttaaggcgtgcgacaaacagtctggccaatgcgagtgtcgcgaacgcggcatcaccgggcgccagtgcaaccaatgtcaaccaggattctggtgggatcagcttacccccctcccccccatctctcgctcccgaaaaaatataaactgattttttttaaatattaaagatttttctagtaaaaattaagattttttcgacaagtttttactattatttattttgtacaaaaaaaactacaaaaaaattttcatttaaaaaaaatttcgaagtaggtggaaaaaaagaaaattaaaaaatatgattgatatttgtttgtccaggaattttccggagtgtcgcacctgccaatgcaatgggcacgcgtccatttgtgaccaacgaaccggcgcatgcattgactgtcgcaaccttaccgatggcacacattgtgaacggtcgctttcaccgtcccgaatcaaacctcaccccccccccccca

SEQ ID NO: 45477 - DNA, 946 bp, Heterodera glycines
  misc_feature (55)..(55): n is a, c, g, or t
aaacaggcaatcgacgatgatgcaaaccaacagggtggcacatatcgtgaacatntcataatcaattaaatttggatttcaggacaaatggtcgccggatatttgaattggccacaggcgactttcgccagcaaaattgaagaggatggcgcttatataaaagtaacgcgagaaatcgacggcggattagacactgtgaaattgaaattgccagccgttgtcaccgccgatcttcgactcaatgaagtcggtcttgtttcaacaaacattgattgtttttgttttttagcctcgttacgccaccctcccaaacattatgaaagccaagaaaaagccattggaaaaaaagacagcgcaagaatttggcattgacatgactaatcagacagaaactttggaagtaataaatataaaaacgatatcgtaactaaagtttatatatctaattaaggtctccgatcctccagttcgacaggcgggcggttttgtggacgatgtgcctggattagtttcgaagctcaaggagaagggagtgatttgaccgacaaatgagttatatggccagaagatacatactatatatatttttacactttgtctatttagaagtcgtctttttctctctaatttgcccgctttatcctgccaaatagctgtttaaattctaaattttgcttatgttttttaatcaccggttctaatagtcgtttcttttcatttgaattcaatcttacttacgttttgtttagatgtttcagaaagttttcttggttcttttgtttttacttgcctttacagtctcaaatttgcggtccgatgaaggaattggggaggtattttttatccacttccctctaaaattgaattctttttacgtttagatggatgcgaatcaaaaacctttgaattcggctcgaatactcgcttccaaattcactctttctca

SEQ ID NO: 45478 - DNA, 771 bp, Heterodera glycines
ctcaaatcttaaaatgactttttttgatcatacaatagatcacttttttaatttgaactggcattttttcttaatttatatggggttttccatctgatgaatgccatttttgatcgctcccacctttctgctgattaaatgttgtggtcattgatcactttttaattccaatggcacattttttccgccgcttttcctctttttcacttacatccgtccacccccattttgctgatcgctcgctcactgattggaaagcaattcctccaaaattataccccctaatgaatttcaaatcacttatactttcgcatttttgtattcgtctgctgattggttttatgggtgtgcttttcctcccttcccctctcccggcttataattagtaggcatttttttccaatcccaaaccattaaaaatcacgcgttcattcactcatccacccttctccgagcagcaacctgctgatctgatcactccgatcactgatcaacagcagcacttcccccacccataagcaacaaataataaattcttccgatccgtctcctcctcctcctccttctcctccttcacttttcgtttctttttgatgatggctttcttcttctttcatccgccgtcgtcgtccaccccattcatatttcattatatgacgaacaacataattattttgcaagaaaaatgtaacgggatttacagcagaagaagcagtgagcaaaaagggcctcccccctaaacatcacatttcgtctctccccccccccccc

SEQ ID NO: 45479 - DNA, 238 bp, Heterodera glycines
tatttttaatttgttgttgttaagactacaccttaatttggggtatttcgcttagaaaatagaggtatccttttttgtcgcacttattactcattttatgaaaattcgtaaaaccttagccaggggagggggaggaatttcctccccccgaaatgaaaaattaaaaattcaggaaaaattggcactttttaataaattttatcgctttttcgtaataaaatcattaaaatgcaaaaaa

SEQ ID NO: 45480 - DNA, 633 bp, Heterodera glycines
atccgcaattttttgctctataagataaattttatttcacctttttatcatttttttaaaaaaagatacaaaaataaaagtgattttggggttcgggaccaaaggggggtgaccaggatttttgagtgaaaaatttttttcaacaaaaatcttccaaaaacatgtctttaggggttatttgggccgctgatcacgaatacgtgatcagattttacttttgacatagtcaagacctcagaatccctgtgtgattggggattctgagatatcattctgaggggggagggggcaggttcggatccggacggtgtaacattatttttctgtgcatttttacgttattttcaatgattttaattaatttaaaatattttgttgagttaataaataaaaaattatatttaatttttttttgataaataaattttataagtttaaattaattatttttttaattgatagaatttcatgtattttttaaattagatttgttaaaaaatattttcattttaatttaatgaatcactgttgcacctcttctaatcactgctgtacccctaaaaaacgggcgcgaagcgcccgtctggccccaactaaatttgaaaaacgggcgtgaagcgcccgtctggccct

SEQ ID NO: 45481 - DNA, 752 bp, Heterodera glycines
  misc_feature (21)..(21): n is a, c, g, or t
tttcggggcagtccccccganccgatgcgcccagatttatggggagaccgaatccttcgggaatagcttccctatagcctgtactttaattctgcgttggattttcgctccccataattgtttgagtacaccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatcattcgggagtagcttccctatagcctgtactttaattctgc

SEQ ID NO: 45482 - DNA, 1391 bp, Heterodera glycines
  misc_feature (1349)..(1349): n is a, c, g, or t
tttatttatgcacaaaaaatcagagcaaaaaaaaagtccatttactgggtttttgagttccttctggccataacttttttgaaacttaaccaaaatttttgagattttgcaaattaataataaacacatagagctatcgaacaacaccaacaattcttaatttattgcgagtgattttttggattaatctggatggatcagtccattaaaattagcgttgggaaaaaaacaaatatttatataaaatttaattttccaaaaaaaagaaacaaatgcacttttcttggctctcctccggcgcagctgtgcatgatgtccatgcgcacattctcgaatttgtatctaaatgaaaaaataaaacaaaaaaatcaattcaaaataatttttaaatgacagaaatcattgaaattttcccctaatttgcttgtaaaacttatgttgcattaaatttaaaaataacagaattgagcagccaattttagtaataaattaattatattattaaaatttttaaaaccaaacgaattaaaatttaacaaagtttcggtaattgacattgatttcataaaaacaaaatgatttttttggtttttttgtttccaattttgtaaaaatgtgtaaaattttaaaatctataggtttcgagaaaatttattggctatgaatgctgccaagataatatttattatcttatactaaatttaattaaaaatatatcaaaaattgttttaaccacacacactaaagtattctctaagcaatatttaaggatttagattttaaataagatttactcaagtggctgcatgatcaggttgcttttgtttgcagctactcccattttattgaccattggacaaagactgaaaaatggacaccaaattttatgaaaaattattggcaaataaatgaaatataatttgaaaaaatagttaatcattaaattaaattttctttttggtattttcaaaaaataaaaattcaaatttaccgttccatcaacaaaacattgtaggcaaagttgctttcaccatccgtcaatttcacgttcaattgtctataaaaaaaattatgaaaaatatttttaaaaacaacgaatttttttggtaaaaaatggaaaatgattttaaaaaaatcattttttatttgaatgatcaagatttttgtaaaatcgtgatcaaaaccagcaagatctacgtagactgtgattttaaatgacttaaaatgagcatgaatttccataaaaaaggggtttgaaaatttgtagattaaacagcagggatttctgtaacaatatggtcgatgttacggtaatggaaaggaataatattttaattatagtttccganaaaatattcattttaatagttgcaaaagcatatggccaaaga

SEQ ID NO: 45483 - DNA, 888 bp, Heterodera glycines
tttttagattccaatgacattccaaatttgtactcttccattttgtcctgaatcaccaaaattcagtttggtgttcaaagacaacgctttagcagctgaaaggggcctgaaaaaacttcgtggacgagataatgtaattattattattatatgtcaatttaaaaaaacacttttaaataaatttttaatttctggtttgttatcaaaaattttcaaaataataattaattttataaattgaaaagttttgacaaataactaactgttttcaaatttaattttttcatttattttacatattttatactatttaatttattgtgtttttgtattaattaaccttaatttattactaattttttaaattaatttgttttaggtaaaggaagaattagagcaaatattgtccgaaagttcatcagcagaaaaagggacatcgaacaattttcaattttttgatttgtttaagaaaccactgaattggccacttacgttggcaatttttatgcatctctcacaacaatttagcggaattaacgccggttagaatcttaggattaaatcaaaatgataaaaaattttcattaagcaattttctattctacaacaatattcaagaagtctggccttgctggtcaaagtatatttttatgataatgaacatataaaaataaattagcaatattatttaaataattaaatataataaaatcccaaaagtacacaaaattttacgtatttttttaaatctttaaaaataaagaaaattttcttctagaatgtgaagatttctgacaaattatttttttataaggaacaaggatttaaaaaaaaaaaaggcccctttaacggaaaaattggccttgatttatttaaatctacatttag

SEQ ID NO: 45484 - DNA, 1088 bp, Heterodera glycines
atttgcacatttttatgaattaatttgtatttgacaatcgtatttaggtaaattgggtgggcattcatcgatataaatttgtaaaattgggaaattaacaaaaaagtgaagtggaagacatttggataaacagtgattatatgtaattcaaaatgattttaaattaaaaaagtaatgcttatttgttggtggattattgaaatacgagaatggaattttgttcacttacaataagcattgcacaattagtcaaaaaatttgggaaattaattctgttgaaaacatccttttctcacaaatttggcgtggcaattccaattgcatttgcttcctctgatccgatcagtttcccatttgctgctgctgaacagcggccaaaacggcacggttgagctttgctctgctcggctttgtatcccgtgctcaaattggtcaacttatgatcatgagtcgtaaaattgtctttctccgcctaattaactatttttggggtcattaatttttgtccatgtcaatcagacgttaaaaatggggaaaggtcaaccaaattttacgaagggttccctgccatgtaaatcgacgagctttcggaccgctttatccaaaaaacctttgggaaaaagggggccggtaatgccgataggcgccatgtggagatttttaaagaatttttaatgaatttgcaagaaaattagccaattttttcaagttttcctctttttcccattcgcaacgaatccccctccccccccccccccccctcattacgaagaccccatcatccggagccatttacgacgaaggaggggggcggggggtgtctcaccccaaaaaacctatgatgtcaattgtttgagtctctccgcccgccctttgcttaaaatatattttccagtatatgaaatgaaaaaaaaatcattttcaaaatgcccaaaagagtcccattcgaattggttttggaaattgttggttgggtgcctttccataaaaagtggacacgcattaatgtgtgccggagattcgatcgtccattgatgaagagaatgacactatggctaataaaagtgtgaaaaagttgtaagaaatgc

SEQ ID NO: 45485 - DNA, 1164 bp, Heterodera glycines
  misc_feature (1146)..(1146): n is a, c, g, or t
tttcatggatggattaattttgactggagaagatcgtctcattacgtctacgagcctctgacagatttttgccatcccgttaaatactgctttgaagtgccaaaaaatgacatgtgtcagaaattaaattgtgaatgttttattttattacggtgtgcttattgtgaattatatttatgctttaaccatttttttaatgattaccatttgtgtgaaaatgaataaaattgaatgaaaaagaaggaataaaaatttttgacccgatggaattgatttcaatggccattaatttgcataaaatcaaaaataaaacggggaaaataaattaacatatgagggattcgaacctacgagggcaaaaagggaaggcaggagcacaacctccgcaccaccgaacaacacaaaacagtgcaaatgtttatttaatttattgcaataaaaaaaagtttggcacgtcataactcggcactcagactcatttcgcagaaaataaaaacacttttcttaagaacccatgggtgctctatccacccaccaaatttcatttggaaatctcacggacacctggggaccttcctttgtgagtcgttttaaaaaaacatcataaagggcattagtttttcaacaaaaaaaatattcataacttttctcaaaagcaacaaaatgttaataattcataatatttaatagccctaagttttttcaattagtctgcaatatttcaaaaaaacttgaaaagtttcattatgaccaacagaattcaaaattcctgggttttcaaatatttaaaattttaattttttagtaaaattataagcaataaattttgtattttgatggttttttaaattatctttttatggaataaaaattggaattttagtacttttttgttttaaaccaatctgaaaaatttttcctatttttttaggatactgttaacacagttacgatgattcgactttagtataaaggtataaactggaaaccaagatttccaaattagccggaccggattggcattttcaaaaataaccggattccggatcctgtctctcataatccggtcaatccagattttcaaattgccggatccggaaccggattccggattggtaaaaatttaaattttccaagttaatttgngaaaaaacccgcaaaatg

SEQ ID NO: 45486 - DNA, 1328 bp, Heterodera glycines
  misc_feature (222)..(222): n is a, c, g, or t
ccctgatgatgtttcgcctcgatgttggggaatcactttggcttcttcgcgaaggcgttctgctgtctctctcactgtatccgccaatcagatttaaacaggaaattgagaaccattttgctccaaataatggagcgtgattatgttccacagttacacgcccttctttatattggttgccaaaagcatcaacttgtcaaccagtgcgtacacatgctcttnctggacagtacggtggctttcttggacaacgccaaaattcactggtctcatccaactttgaaacggccttgatttttgcacatttttaaaaaattttattagaaatttccaacctcaaaaacatattcgtatcctccatttgttagcaaaatttttccccgtgtcgattttgtttgatcaaaacgaagcaatgcaatagaaaataagaagaaattgttgttttggttcgcaagacggaattcaaaaaagtgaccaaggaacgagagccaaaaccccaaattttttcttgtgaattgcgataagatgacatttggaacacacacaccgctgaccaacaaattggagaaactgattaggcgcagtatcaaatagattggcgaagcaaatttgtttgttctcgtctcgagatgaccaattgctgacctttccccctttatttgtttatttctatagttaaaatttgtccatgggtttaattttgccttatctggggaaaacaatcaccggcgagttcaattactggcgaaatcaaatacagacggcgagaaaaagagaaatagttcactggcgaaatcactcactggcgaaatcactcactggcgaaatccaactggcgaaatcactcactggcgaaatcaatcactggcgaaatctaacagcgccgttcgaccgaccctcttgtccggtctctacttattagcacctaaaaaaaaacctaaaacgggaggttagcacctttttggcattttcaagttttagcacctattttggccttttttccagaaatttcatagcaaaaatgcgataaaaaacaaaatacacccctaagaattgaccaaatttcagaaatattcccctaagaaatgaaaaattgtcccaaaaattcgttacaaaatttatttatttattttcttgaccatttgcaattgtgcgggcgaaattgataaaaaatgagtcaattctggaattttgtccataaagacactgggtttttccaatttataacacctattttcgcacctattttggcatttttaacacctattttgcactttttggcacctattttagtacttatttcaggatttttagcacctaaaaatccg

SEQ ID NO: 45487 - DNA, 1134 bp, Heterodera glycines
tatggccagaaggaactcaaaaacccagtaattggaactttttttgctctgatttttttgtgcataaataaaaatatttgaaaatttgcaggctaatagcatttttcgaatgctttcgaataataccaagaatgtttaatttggttgagaaagaaaaaagtaatggtcgaaaaattcgttcgacgacgtttcggctgacgacgtttttcctactccggctccagtgttagacaaaatgactcattacgccaaatagtatgtaatttgcgtaattttttgggcgctaattcaaaaattacactgataaatgcttttttgcacaatttattttggtcagccatacctcgctttatttcgaactaaatcgaagaaattttgtatctaaaaaaagttttttgaaaaggagaatctttttctaagtgaatgctaatgcaatttgacatctcagaaaaaagttatgagagtttcaaatttttatcacgttataactagggctgggatttttatgtgctaaaaatcctgaaatatataataaaatatgtgctaaaaaaacccaaaatatgtgctaaaaaccaaaaaaaaggcctaaatatgtgttaaaaatgcaaaaatatgtgctaaaaattggaaaaaccaatggtatttacgcaaaaaaaaaacatatttaatatcagtctttatcaattttcgcccaacgccaatcaaaatgttggcgatgtcaatcaagtggtaaagtcgcggaatcatctttccgtcagcgggatgagttccttgtggcctcttagatatccagaaaagataagtcccgaggttcctttgaggtcgtgtagccactgaaagtcctccagaaaattatgaaagcgttctggagagtccagtagtccaaaatccgggtatcacatccataaattcatgtcaaatccgtgcatgcttttgcaaagtagtccttagcggggaagcgctcatgtcagtgtctgcccatatatagctaaagtattctgtgtccaccgagcaatttatgcgccgcgatctcgttagtttatatattactaaagaaacagtgagtagcattgcttattctaggatctcgggagccgctggcaaaaggggctcgggagtgtggcattccttaag

SEQ ID NO: 45488 - DNA, 1116 bp, Heterodera glycines
attaataatcaaaattctcttaaaattttttgacccaaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaaatggtggatttgtcaaataaattcaagacttcaaattaataaacggaaattctcttaaaatttttttgaaccccaattcaaaaaagac

SEQ ID NO: 45489 - DNA, 846 bp, Heterodera glycines
ttttgcgtgctctcaacaccggcggaactttgtaatttaaatcgaagatattaaattaatatttaaattaaaaattttttttagcattgcaatcgcttgacgatttgtacacaaattatttaatgggcaatgaaacggaaatgccatcgggcaaacgaattgagctcagacggcgaatggtcggcgaatatttgtgccaattgggcgacgaaatggtggaacaaattatgcatttattaaccgacagaattgacaaaaatgtggagagaaataagaaaaaaacggaggaaattgaaaaaatggcaaaacaaattttaaaggaaaatatggaaaaaagcaaaaaattaattgaagaaaaaggaaaagagaacaaggaaaagggcaaaaaagaaacaaaaaaaggaaaagaaaaaataaatgagggaaaacagaagaagaaaatagacaaggaaatagagaaattaggaaaaatattagatggtttagaactaggaaaagaagaaaccaatgtgaaagaggaggaaaagaagcagcagaggaagagagagagcaggggaacgggagagagtggaagagaaaacagcggaatggaagaggaaaagcagcagaggaagagagagagcattggaactggagagagcggaatggaagaggaaaagcagcagaagaagagagagagcattggaactggagagagcggaatggaagaggaaaagcagcagaggaagagagagagcattggaactggagagagcggaacagaaaacagcggaacggaagaagcccttttgatgctcgacttttttaccgatttagagaaaacacacgaaaaaatgaaagcggcat

SEQ ID NO: 45490 - DNA, 1383 bp, Heterodera glycines
aaatttaaatcttcatcgtttgacaatgtttcaattgccataattgttggcattctgttgctcctcctcaccctcctcaccaccactacaacaaccgtcgcccagttcaaattttgccaaattttttgcaaataatgtggcaaaaatttgtgtgtgtaattggccaagcactgtgatgagtgtgcccaattcgtaagtgccaaattgggtgacttttttggcacaaaattccaccgaaaaagatgacgaacaggaggacgatgttcccaatgataatgatgataaagcatcgtcatcagtcacggcactttgatcgatcagtgagtaaatgagattgccatcaaaaaatgcgtcttcggttacttcggcttcaacatttttgcccacacgtcgcattttgacactgtccaaaagtgcaacggcactttgttccatacatcttttactgttcgcagagcttaaggtggttgttttaaaatctaattgatttattggttaattttattatttatttttaattttaaaataaaacagggaggtcccaggctttgaggattttggccaaacttttttttacccagattttcatcaaaattgctaattttgatggttttcttaaaaatttagcgaaattttttgggaaattttgctgaggcaggtcttggaagggatagaaacaaggaaaatcgaaaacatgatataaattttcattaattaccaaaatgcgaaatcatccaaattgttttgtacaaaaaataatttttccaatagaaattgaggctcttcctcagatgcagctgttcggcatttaaatgtgtgccatttctgtttaaaatttggaattttgaagcccagagcatttgacatttctaatttggcttcaattgttcgaataagcattgcaatatgcaaataaattgtgcatttttcatctgttatgttttccaaataaaatttgtaaaaatttgccaaaagtaaatcgttgagaaaatctataaaaaattaattttttctattctttttattttaacaatataaataaataaattttaacatttttaatttttctcaaataaatgattattttttagtttttatcttaccagaaaatttttcaattcttatttgtttcagcatatttaagcaagtttcaattgggaaatgttgtgttttagaactaacgaattgtaattcgtcgttcatttgtcctgttggactgtaggccttttgcccttttgattttatccgtctttggttgaattgttctttcgggctgccaagttttagttctttggatctgtcggttatttgtccgattgacgtgtcacccatttgtccttttgcgagtgtcacccatttgtccttttcggctgtcaaccattt

SEQ ID NO: 45491 - DNA, 1385 bp, Heterodera glycines
ctactaaaaagaaactgataaaacaagctaaatatgaaagaacaaatcttttttcacatttctgtttattttgcgtacagaaatatgtcttttggggagagttatgttgaattttctaagttttcaggagaaattaagggccaaaaggcttaaatcacctcaaacatttgcctaaccgaatcaaactaacagcaatcaacgctaagataacgtacagacatcctttaagcattttgtattcattttatgccataaaaaggcattaaacacaaaatttttgcgggtgaaaaaatacgaaaatctgagtaaattcgaaaaaaaaattctaggggttggaaaaaattctaataattctctcgcccttaagacgccgcagcggaacaattcctggcccgggttgacagcgcatgttccgaaatgtctcaactcggttcgcggatgggtacagattcggacttggtgccggggcaaccgattgattggctgatcttggggaccaccggaggcgcactgaaatacctgcatgaactgttggacgttacgggcacagccgagctgaggacggaggagcaaagccaaacggagacgcccaaaaaggcattggccgcctgagggccgagggacggaccgacggagataaagcggcgattggaaatcactattccgttaattcatttcttccttttggttggttctttcacatttttccatttcctccgtcaaaatttgcttattttagtctcccattatttttattacggctcgtcacatattctttacatatttgtacatttgctgaataaaatcagaggaacataaaaaacaaaaggtaccaaagtcggatggaattcgctcggtgtgtatttttctgtgccctgaatttttgcgattattccccttggtccccatattttccatgtcagtatttatggtaatatccaagacttgaatccttcggacgccaacaaatgttcgatacgatcgaatgaatgtccatccaaattaaatatgctctaataaaacaaattttattgagaattggttattcaacattaaaattggcttttgttattcgtgtaattccaatttcaattttgtctcccgatttgcatggtcccacgcccgcaggtgttcctgtcaaaatcacatctccgggcattacgctcacgcgcgaagtgacatattcgagcaaagtcgggacatcaaacatcatcgcattagtcttctctttctgtctgatttgccgattgactaaaaacaaagaatcgtaattaaaaaattatagggttcattatacccaaacagtaaatttcaatgtcatgggggttttgaataacacttttgtagatgaattcgcccaattgggcacgacgtgtcgaaggatt

SEQ ID NO: 45492 - DNA, 1540 bp, Heterodera glycines
tggcgtgggaatgttaacccacttccctttcggcaaccggatggaccaactgcgcaagcacagaaaagtcgtcatccgtagtgtgttacggcgttagccggtgccttaggatcggctgacccacattcatctgctgttcacgtggaacccttctccacttcagtcttcaaggatctcacttgaatatttgctactaccaccaagatctgcactggtggaagctccggccgggcccacgcccaaagccttcaacgcaaccaccacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatggcccacttggagctcaaacattcaacgcctgggttcagagtcaagcaaccctggcttcatacccatttagagtttgagaataggttaaggacatttcgtccaccaagtcctctaatcattcgctttaccgagtataactgcttaccgagctccagctatcctgggggaaacttcggagggaaccagctactagatggttcgattagtctttcgcccctatacccaagtcagacgatcgatttgcacgtcagaatcgcttcggacttccacccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcaggccaacgtacagcaacaaacgggtgaatgcagaccagatacgccagctctgtccgtttccacctcatcggtttcacgtcctctttaactctctcttcaaagtgctttgcaactttccctcacggtacttgttcgctataggactcgtggccgtatttagtcttagatgaagtttac

SEQ ID NO: 45493 - DNA, 1001 bp, Heterodera glycines
tttgttaagtgcacaataattgcaccaattaattatttgggagaagatttccatgccccaaaaaaataataaatgaataaaccggaaaattgcaaataaatatgttttttcaattttttattttttaaataaaagctattttcaacatcatcagagtctgtgtgtctgtcctccatttgtttgttgcttcgtttttccaacatggcattcatttgtcagcgctaaatcgcagctggacaccaaaatggtggcaaaaaaaaaaaaagaagtaaattggcgaagtgaaagcgatgaatgaatgggttaaaatgagcattttgctttcattttttgtcatcgaattattatttttttgattgatgggttgtccaatttcaattcctaatcctctaaatactccatcaaatattcttatgcaatgtcgccgtggtcgaaaagttgaagtgacaaatgtcgaggaccagcagccttcctcagtgtgtaaacaacaacaacctttcatacatgaaatgtaaaaaagacttaatcttaagcattgaaaacttaggggtaggaaatttggcaacaaaaaaatgcattgaaatctggtaaaagtttttcaaaattttccaatgggttataattttttccggcttcatccattcatagaaatattgtggggaataaattgtttgtcaaacccaccattcaaataggctccgacctcagcttgattcgtcggtgccgccgattgggtttggcaaatggaactcggttggtggcacgttggcagtggccagcgattggatgaagcggcgatgcagcaccaaacagcggagtgtgtaaaaaaaactgatttagaattttttttttctagaaaaaactaagaatttttaataaattttttattttttttggggggggggaggtaccatttgtttggcttcattaacaacattaaacagatgccgccgccgccgcctaaacggtgccgtcagcagttgcagcagaatggccgagac

SEQ ID NO: 45494 - DNA, 885 bp, Heterodera glycines
  misc_feature (141)..(141): n is a, c, g, or t
aaaagagatagccattttctgagaattaatcacaatttccgcagctctgcgtaaaatggaaaaattttgaagaggctctgcggaacagattagcatcggggttacgagatagaatattgtcctaaaaagagatagccattnttctgagaattaattcacaatttccgcagctcttgcggtaatggaaaaaattttgaagaggctctgcggaacagattagcatcggggttacgagatagaatattgtcctaaaaagagatagccatttttctgagaattaattcacaatttccgcagctcttgcggtaatggaaaaaattttgaagaggctctgcggaacagattagcatcggggttacgagatagaatattgtcctaaaaagagatagccatttttctgagaattaattcacaatttccgcagctcttgcggtaatggaaaaaattttgaagaggctctgcggaacagattagcatcggggttacgagatagaaaattgtcctaaaacgagatagccatttttctgagaattaattcacaatttccgcagctcttgcggtaatggaaaaaattttgaagaggctctgcggaacagattagcatcggggttacgagatagaatattgtcctaaaaagagatagccatttttctgagaattaattcacaatttccgcagctcttgcggtaatggaaaaaattttgaagaggctctgcggaacagattagcatcggggttacgagatagaatattgtcctaaaaagagatagccatttttctgagaattaattcacaatttccgcagctcttgcggtaatggaaaaaattttgaagaggctctgcagaacagattagcatcggggttacgagatagaatattgtcct

SEQ ID NO: 45495 - DNA, 736 bp, Heterodera glycines
atttagtagactttataaaagttaaatgtaaacattattaaaaataaaaagatcgatttaaaaaattaaatcctcctattctaattttcgttcgccctcaaacaattcgttcagccagccggcacatcgtacacgcgctcgtcttgcgcaaattgcacccggtgctgcacattgggctgaaatttcatgtttagaaaaataaaatacaaaaatttaaaaaaaaaaatcacgtcggcctgcgaagtcccggccaaaggcgacacaaaggggcggcgcgcgatcgtgaccaatggggtctcctgcgcaccctggcggcagagagaccgcaacgttttctgttcttgaaaaaaaaatattatttatttatttttggtggaaaatctcactctttttttgtcggcgcacaagccgccgatgcatcagtcggttctccacagcatggcgcaatttcagcgccaaaagcaccatctgtatgggaagggggggggggggggcttgcatttttgaaaaaaaaaacaaaaaagaaaaaaaaacacctggacaatgaagagcaccaaaatcagagcgctgctggcgatgatgaaatttgacaaatttgggcaatttgtcttcgtcgtcgtcgtcgttgccggtgtggaattcggcgctgccgcctcttgaacgccctcacgcaaaaactgcgtgaaattgccaatggaccagtgcacacagagcactggtttagggtagccccggg

SEQ ID NO: 45496 - DNA, 1268 bp, Heterodera glycines
agaaatcatttttatttggacaaattttcaaatttttaaggttatagtttttcattttttgcatttttaagaatttaaaaaaaatgtaaaatgtccccaccggtgaatgagtcgtcgttgcgattagtgctcaatgctcggaatatttcatgttttattttcaacaatttgcacattattttggtataaaaatcattggccgattcattaagcgaacttcggtacgtcatcggaccgttcacgtgcaaactgaacaaagaatgagaaagagaaaatggacgtcaacttttattaccgttttctctaattatccccccgtctccaattatccccccccccctttctgagggggttgaaaataatccccccgtctccatttattccccccgggtgataaatggaattttttattttttcgaaaaaatttctttttaacattttactagaaattgttttattctaaattgaaacaataaactcagttgaattcttagcatgaaaaaatctaacaagaattaatagtttcattttatacgaaattttttggttatgtaattttgaaaacaaccactttacaaaatctctttgggctaacttaaaaaatcataaattgtgttttttataagaatatttttttgtcaatggtcacgaatcccaaaatgagtttaaaactcttcaaaggagaggagataaaatataaataaaaaacatcttataaagcaaaaaattgcggatttttctgctattttctttgtgaaaactctctttcagaattgaattctcaatttttttctgaaaaatcgaaaatttacagaatttctgaaaaagtattttcatctttatattagcaaaaccaattaaaatacttaaaattctcccgatttctttattttaagctttattccactaacattgtccaaccctgaagtgagttattaatttccaaaaataagcctaaatttcccgggctcaaaaaatgaaaaattttaaattttttaaaaattaaaaattttctgaaatgatcaataaagttcatatttgtatttgaatattttggggggttttatcaatgttttataaatattttggcatatttcgaagcctttttcggggttttcttgccttaaatgcctttttggcattttgccgttttggtacctttttggcgtttttccgaaaaattccgttataaaaatgcaataaaaacgggaaaatgcacccctatgaaatgacttgaaaaattttcagaaaatacacccctaagaatt

SEQ ID NO: 45497 - DNA, 752 bp, Heterodera glycines
  misc_feature (700)..(700): n is a, c, g, or t
caatttactctctttaatttatgtttttggttttcattgcaatttgcagctgaaacaataaatcatttcattttttaccgtcactcataaatgtttttaataaggtaaaacggactgtttcattagtgagaaaacaaagcccagttagctgtctattttttgcctaattatttttttcttgataaaaaattttgattttaaaatttgtccttatccaaaaaaaaataaaatattaattaattttatttataattgaaatattaaatttttacgtggttacctaaaaatgttttgtacctatttgatgatttttgtgcttatttaatgcttattttactattttttccctgcctttttaggtgcctgtttcgagatttttttgcctaaaagtggtatccctaattaatatttattgggacgtgcataaatataaagtaatatataaagaatccttcaagctaaaattatttttattggtcgaaattgcaagcggtgtcagtttaaagtaaagtattattaagtatatttcccttgaagatttaattttaattttaaaaatcaatttttttttggaattaatatgacgaactatggttcataactgtgaagcttatttataaacagagttaattgattgaaaaaatttctttattttattaatttgattaaatttttttggttttgaaccaaaatacctggngtgccgcaccggataccccaaaaaactgagatttttctcgactcgatacttg

SEQ ID NO: 45498 - DNA, 1533 bp, Heterodera glycines
aaattttttgaaactttgcatgctaatagaggatacttagggctttcgaatgataccaacaatgttagatttggtcgacaaagaaaaaagttttagtccaaaaactgggctggcgccgaaacgaccagcgccgaaacgatacggaccctgactgacgaggtcaaactgtgcgcgcgctcagaagaaacggcccccaccagtgctcagacggcccagcgccaattccacctgacaaatgagagaaacttttttggtcaaattaaagcaaaaaatacataaaaaaactagatttggaaaaaaatatgttcataatttgtccattgagaacagagatggacattttttaaagtaagtttttcataagaaactttcaaggaaaaattttttagcgtttttttcaaatttttttaaagaaaatctactcaatatgcaaattttgttatttttcgacaaaatttgttaacaaatcgcattaaaagcgccgcaaaaaagtggtgtaaaggcaaaaaaaaaaagtcttcgcccgggggggagggctgtacccgccgcaagccgaaatcaatcctgggaccgtccctggtcgcgctaaagctattcaaaaataataaaaaattcactcaccgaccaatccggcaacgcgttcaccgagctgcgatgacgcgtgctgaccgcttcggcaccagtgccaccgccgccgctggtgttgataatgtcgacgccagcggtgtcgatgttgccgttgttgttcatcagcatcaagcacggctccagtgagatggaccagcgattattggcaccagcaaaggcggcggcacttttattggacgacttaaaaaaatgctattaaaataattacccaaaagttccccgtcccgaaaagtaaaaaaatttttttaaaccagaccaggccaggacggttcagtaattgcggcttggattggtctatcgaccacccacgggccttttcttggaaaatctcgtggtggagtaaaaaaaaaactgcgaaaagtctgacagccgacaatgggaatcgaaccaacaccaaagaatgattgatgcatagcactttttagatggtttttttccagaaaaattatttttttcaagattctttcaaacatttaacatttatttcgtgtaatttggtcattttttggtcgaaaaatggctaaaaaacacaaaaatctttggatttcgccctccaattttttttccagctaattgtaaggcctgatactgatgaacccatttattttaaaggaactcgcctttgttgagcctttaagtgcgaatgaatggcgccgcattttggcacggttcgccgccgtctccgccgcgccattgtcgtcaatttcaaaaccgaccactgaattcgaaaaaaacagatttaaaaaaatcacaacaggcataaaacttgaaaaaattccatttaaaaaattatatataaatttctaggggaaaataaagaagtctttttttaaatgatttacaataagtgttctttaagggaattaagtattttgtgctgacatt

SEQ ID NO: 45499 - DNA, 1019 bp, Heterodera glycines
gcacccctctcccatttggtggttgcccttttgagtgctgtctcttctccaccactcacttgtcataaacaaatgccaatccgccgctcatcgccgccgcaaagttccgcccgatgctattcagcacgaccactcttccactcgtcatgtactcgcagccgtggtccccaaccgcctcaatcaccgccgtggcgcccgaatttcgcactgcgaatcgctctccgccgattccacgaaagaaggcagttcctttgaaggaagtgttccgtcatttttgttgtaaaatcatgcatttattaccggaagttgctccgtaaagtgccacatttccaatcaaagtgttctgttcagaggcatagatcgaattgcggtaggggcgaatgacaattttgccgccggacaaacactaattaaaaataattattcaaaaacgccgcatttcactaaaacctttccaacgtaatcattcgcttcgccctccaatcgaacagtaattccattcgccaaaaaggcacaaaaactttgccctgcagcaccaattaggtccaactcaagacgatgcccttccggcaacccattctcgccaaaacgaacggatatctataattaacaaaaaaaaaagcaattaaaaaagataaagggacaacaatcacttcgtagctaagccgagccccaaatgttcggttaatgttcacaatttgtttacgttcgatgcgcttcttcacggccggaccgtcgaaaaatccttgcaattcctgcaataattttaagcaatttttagtgtacattttgtacttacattcttcattaaattgttctccaagtcgttgatggcatgaaattgcttgacggcaccgcctcgggtgttaatgtgtggaaattgcaaggacactttgtgcaaaatctggccaaactccagaagggttgcctttttgttcacctgaattactcatcttacaattagtactaaataatagagttttgattaattattagttttttcttaccagggttagggt

SEQ ID NO: 45500 - DNA, 94 bp, Heterodera glycines
cgttgccggccgttccagccagccgcccgcaccatccggcaccagttcgatcagctccacgcggtcttcgaagaccgccgtgatccgcccgtcg

SEQ ID NO: 45501 - DNA, 915 bp, Heterodera glycines
cccagtgattgaatgctgggggattgagtcccgttgattggaatgttggtgggttgagtcccagtgattggaatgctggtgggttgagtcccagtgattgaaatactggtggattgagtcccagtgattgaaatgctggtgggttgagtcccagtgattggaatgctggtgggttgagtcccagtgattgaaatactggtgggttgagtcccggcgattggaatgttggtgggttgagtcccagtgattgaatgctggtggattgagtcccgttgattggaatgttggtggattgagtcccagtgattgaaatgttggtgggttgagtcccagtgattggaatgctggtgggttgagtcccagtgattgaaatactggtgggttgagtccaggcgattggaatgttggtgggttgagtcccagtgacttgaatgtggtggattgagtcccagtgattgaatgctggtggattgagtcccgttgattggaatgttggtggattgagtcccagtgattgaaatgttggtgggttgagtcccagtgattggaatgctggtgggttgagtcccagtgattgaaatactggtgggttgagtccaggcgattggaatgttggtgggttgagtcccagtgattgaatgctggtggattgagtcccgttgattggaatgttggtgggttgagtcccagtgattggaatgctggtgggttgagtcccagtgattgaaatactggtggattgagtcccagtgattgaaatactggtcgggttgagtcccagagattggaatgctggtggattgagtcccagtgattgaaatactgacggtttgagtcccggtgattgaaatgttggtgggttgagcccaagacgatctgaatgctggtggattgaatccctatgattgtaatgtt

SEQ ID NO: 45502 - DNA, 1138 bp, Heterodera glycines
  misc_feature (57)..(57): n is a, c, g, or t
aaagatgctgtttgacgaaataaagggcatactttatttgaagaagtgtccaagacnatgcagcaataagcctgcaaaatctaataagtggaaaatacctgagtatagaatttattttcagaaagtgtcaacagacttttggaaaaatatatttgcaatttatcaacaattttgagaagtgagttagaaatgataaacttcacgattcaaaccaattttcgttgctctaattaaccgcgataaaaacattcgaatcaattaaatagcttctgagataataaggtttatcataaaatttcaagtaaaaataaaccctcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaaaaattttgagaagtgagttagaaatgataaacttcacgattcaaaccaattttcgttgctctaattaatccaaagcgaaacaacaaagatggtgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaaaaattttgagaagtgagttagaaatgataaacttcacgattcaaaccaattttcgttgctctaattaatccaaagcgaaacaacaaagatggtgttttgaacgaataaagggcataggttattttgaagaagtgtcaaagaacgtgcggcgataagcctgcaaaatctaataagtggaaaatacgtgagtatagaatttattttcggaaagtgtcaacagacttttggaaaaatatatttgcaatttatcaaaaattttgagaagtgagttagaaatgataatcttccacgattcaaacccaattttcgt

SEQ ID NO: 45503 - DNA, 995 bp, Heterodera glycines
taaatttattaaaagtaatgaaaattaacccaaaaaatacaaagaaaataatttacaccgtccggactcgaacttcgccccccccccaaaaatgatgcctcagaatcccaaatcacacagggattctgaggtcttgactatgtcaaaagtaaaatctgatcacgtattcgtgatcagcggcccaaataacccctaaagacatgtttttggatggtttttgatggaaaaattttcccactcaaaaatcatgtgcacccacccccctttggtcccgaatcccaaaatcacttttatttttgtaacatctctcaaaaaagtgataaaaagatgaaataaaatttatataatagagcaaaaaattgcggatttttgtagtattttactcttccctaatgacttttctgaaccgagatataaatttttttctgaaaaatcgaaaatttccagaaattctggaataactttttttctttagaagataaaaaccccaaataaaacccataaaattctcctgatttttctccatttttaatgctttatttaatcaaaattggtcaaaccttaggccagatatgaattttcaaatattaggccaaaatcccgagggccaaaaaattgccaaaaaataaagaatttttaaaatattccaaaaaatctgaaactaaaacaaacatcagattcgtgcttagcaccataatttaccccagaaaaatatttttcaccctctttttcaacccaaaaaaaatttttgaaaatttctagggggcctagctcgaaaatttttgaaaatttcccttcatatagtataccattagatagagcttaaaaagttctacaattttgccctaaggcattttttggctaaaaccgacccctgacgagttatgggcccgggactcaatgtcccgcttaggccaaaatttttttctatttccggaaaaaatcgaaatttttccaaaaaattaccagtcgatagagctcgaaaactatgtttt

SEQ ID NO: 45504 - DNA, 989 bp, Heterodera glycines
catgttttgtaatggtaagcaaacaatttttatcacaactttaaatttaattttttatgttttttaaagaacccaaggcaacgaagcacttgctgaatatgatcagagatttatcgacattttgcgcaaaaatttggagaattctcgtgactttgggtatgttttactcaaactaactgaggaaaagatggacatattgtcgaccagcagtgagaaacagaaagcgaagaaatacgaacaattgtccatgtatgtataactaattaaaattaattagtgagctaattagttgttgataatgaatgggaaattgggtcattcattaataacaaaattatttgacgcctctgtctgggttaactcatttatcttttcttttccatattttcaaattcttgcagattatatgcctatttttaatttattttggaattttggttcacattttgtgtaaaacatttatttttcagcactcgacattgcttttctagaaaattttgtcatttcttgataaattataacccaaaatcggacgttttgcctactggacatttcgcctactgaatatctcgactactaacctaaaatagatctttcgaaaacgaatttcaccaaatatatctgaattaatttatatttagctattttagaatgctaatgaaatttagcctaaaaaagcaaagaaatatttattaaagtccaaagaaacatagaaagtgaagtataaaatcataattcagtttttcgtctgtatcattggcttcttaatcactctttccatttccacggatgtgaagccccaccataaagtcctgcaaaacgagtccgacgagcgtttgctaatccttcgaccgattcaaaggcggcctcgtcaaggattcgcagcacattgttccttgattgatgtacgttgttgttgtttagtgtttttgtggaagtgcatatccgagaaccatttctttggaaaagctctccttttttacatcatc

SEQ ID NO: 45505 - DNA, 1031 bp, Heterodera glycines
  misc_feature (32)..(32): n is a, c, g, or t
  misc_feature (39)..(39): n is a, c, g, or t
cagtactcaagcagacgactgaacagcaacancacaacnaggtggagggaattgacatggacacggcattcaattccaaagcgttgaattaattagtgggctcttcgtaatttaatgtcttgctaattgtaaggaccggcaccccgagaagcgcgtccgcgccgcgtacgccgcctttgaggagcgacggctggccgagctgaagcaggagaagccgacactgcgcctgtcacaactgaaacaactggtgaagagggaatggatgaagtcggcggagaacccactcaatgagcaaatcattggcattgtgcaacagccgtaaaacaaaaatattggcggaaaaggagggaaatgcctttcagagaatatcatttttatgttcccagcacttcgttttggtattatcacataatgtcattcgcttgtcttgtcagataatttcaatgaaatatgtgattaaaattaataaacacaaaatgctttgaaacctccaagggttttaaatgatgacaaattttacaacttcttgaacattttcaaaataatgcaattaagtgaatgttgtaaaggataagaaatgtggggaatcacagaaactttggtcgccaacatcgcggtgagcatttgcgctgggtttgccgcccaccattttatccggcagttcattccggtttttgttgagcggaggttgtacggtttcgacatgtgcaaggtccttttacgcccaagggaatttgtgtctaaaactgttccatggtgggaggacgttaatgctcttcccgaaattcatttttaatttccgaaaaccgactaaatttgcagagggacaaagaaaagatcgctgagccaatgggcgtcgttgcggccgccgtctatttgattttcgtgttcgccttcatccccgtgcccttttacgaatggctcagtcaaaacattctcttcgccggtgccgctgacaatcgccacggaaaaggcactcaaatcgaacggtcagtgcttcgactgggaaaaggcggaaactccttttttac

SEQ ID NO: 45506 - DNA, 1289 bp, Heterodera glycines
  misc_feature (57)..(57): n is a, c, g, or t
tttttaattttttatagatttttaaatgtttggatttttttttggcttaccaaaacnttcatcaaaccctggctctttctattctcattcaaatcgccccaaattttttttacagcttaactaggccctattaagcttatttccagaaaatctcgcatgaattctcatttttaaattttttatagatttttaaatatttggatatttttttggcttaccaaaacttcatcgaacctggctctttctattctcattcaaatcgctccaaattttttttacagcttaactaggccctattaagcttatttccagaaaatctcgcatgaattctcatttttaaattttttatagatttttaaatatttggatatttttttggcttaccaaagcttcatcgaacctggctctttctattctcattcaaatcgctccaaattttttttacagcttaactaggccctattaagcttatttccagaaaatctcgcatgaattctcatttttaaattttttatagatttttaaatatttggatatttttttggcttaccaaaacttcatcgaacctggctctttctattctcattcaaatcgccccaaattttttttacagcttaactaggccctattaagcttatttccaaaaaatctcgcatgaattctaatttttaaattttttatagatttttaaatgtttggatttttttttggcttaccaaaacttcatcaaacctggctctttctattctcattcaaatcgccccaaattttttttacagcttaactaggccctattaagcttatttccagaaaatctcgtatgaattctcatttttaaattttttatagatttttaaatatgccaaaatttttttggcttaactttttcatcgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatatttttttcagaaagggttctgaaacgcaccaaattttatttacctgttaagttaggcactctgatgctttttctatccaaaagggagatgaataaaattttttaaaaaatttttaaatttcccttttcaaaattctctccttccggggaattttttttcccttaaagtcggccggtagcggtccgatggctccagacaaatttttaaaaaatttt

SEQ ID NO: 45507 - DNA, 923 bp, Heterodera glycines
taaatagacaacgacgctttcattataaagctttaagtggagacaaagtaatacgaatatttcaatttcttacttatccgaatagacaaagataggttacacacgaacatttttatagaaattccggctgaaactaaaatccctcttttggtcttaacctatgatttttggcccattatggatgaattaagtatagaaggcgtcgcagaaatacattcatattttctaaattcgggtttcagaaaattaagatttaaaagaggctgaattacagatgcttttcaaattttgggtgtatccgaatagaaagaagttggaaatcagtacttttcacgcctataaaattcgggccgaaaaatattggtgtttgtgactagaaaaatagcagatgcatatcaaatgactacagaaaattacagcctccaagaaaataattgctttgcacaagcaatattttgtagagcccatcaaacacattgtgcttataggaaaggcagaattaaacaataggggcctttttattatgattacaacaaatcagcatggcgtctcactgatatggtatgtttcagttaaggtttagccgatctacaaatttcggcactgtctattttgtaaaagcgaatcaaattcctttggattccaaagtggaattacagaattgcgacggcaaatcctaaatagaaaacgacgctttcattataaagctttaagggagacaaagtaatacgaatatttcaatttcttacttatccgaatagacaaagataggttacacacgaacatttttatagaaattccggctgaaactagaatccctcttttggtcttaacctatgatttttggccattatggatgaattaagtatagaaggcgtcgcagaatacattcatattttctaaatttcgggttcagaaaatta

SEQ ID NO: 45508 - DNA, 1212 bp, Heterodera glycines
  misc_feature (42)..(42): n is a, c, g, or t
tttttcgaaattctgactttttcattacttatttatttttgncaaaattaattcataagtattttttcagaaagtgctctgaaacgcaccaaatgttaattaaaagttaaataaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaaaaatctaaaaatttttaattgctttttaaatttgcgaaaaattttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaaatctaaaaatttttaattgctttttaaataccccaaaaattttaggcaaaatctttttttttataaactgatcagaagcgaaccagattttgcgagggcagtccaaaagacaaggaaaagccctgctatgatggggagaccgaatccttcgggaatagcttccctatagcctggactttaattctgcgttggatttttgctccccataattggttgagtaccccaaacggacacttgaaaaaatcgatttttttggttttcggggcagtccccccgaaccgatgcgcccagatttatgggggagggccgaatccttcgggaatagcttccctatagcctgtactttaattctgctttggatttttgctccccataatttgtttgagtaccccaaacggacactt

SEQ ID NO: 45509 - DNA, 1082 bp, Heterodera glycines
aataataatactaatggacattggaggagagaggaaaaacattttgatcagtgaatggaatgggtgagggaggacatactgctgatcagtcagtgattggagattggattatgtatgaccatgatctgattatgtttctgaaccaatcttaaatttagagggaaaaacatccgacaaattatcgaagaattggggttatgatcagtgatcagatggattcattctgatcagtgatcggagagaattcctcacgaaaagggtcctttcttcgtttgactcgttaattttattcacattaatttgggctggcattaaacattttggtgacgacttttcacaattccattcatttttccattctttttcaaaaaaatccgcacgaatcgggcctttgctgagtggcgaacatacacattctgagaagaaacaaatcatttgccaatttagcaaatgatgccattcccaaccctttgccatttttggcatttccttcgccccgccctccctttgatttgctttgcttacaatcggtcgtaagctgcgcgttgtcggctttgaactgtccgttcgtcccttcgattctctgccaatttctgtctgagatgacgagtgccgaaaatgacttttgaggagggaaactgaaaacagaaggaaagtgatcagacgaaaaaaagggacggaccgtacgaatgccaacgaacgcgcgattggaagagggaaaagcggaatcgaagccgtagaagggatgggacgaaacggaggaggggaaaagcgggagaagaagcagaagggagacaaagaggaggcgcaagaggagaaaggaggaaaaagtggagggaaaggaggagaaagaggaggagggaaaggaggagaaagaggaggagggaaaggaggagaaagaggaggagggaaaggagggttttttcatcggcggagagtgaagcgcgcgccatttgctgaacggactgataacaatcaaataacccaaaccattaaattgtattttgcattcgacacatatgaacaaaattaaagagtgcgcagactcaacgatatggattaaccgcgccaacaaataattc

SEQ ID NO: 45510 - DNA, 1058 bp, Heterodera glycines
tccctaacttcttttgagccattttcagatagggaagaccttcctgatacatttcatcaatttcagaattgttttttgttcccgtaattacgactttaccggtccagaaaattaacgctgtcatgcttttaccccgcttgaaatttaaaccgcaaaatatttcgggttcataaaaggcacgacgatttttttgaaactcgttcagttcaatttcatgtccgaatttaaaggtcgaaacaatattttcaaccgtgtgtccggtgtaagaagcccccggacaccccgagcccttaattatttctataaattttttaatagcattttcgcagtctatcagacttttcgtccccagacatatcatttttccggattcccataataatgccgtggctttgataggagttgtacatttgataaccgcggcattgaattttctagggttatacttaaattcgcattcggtgatcgtcagagagtttagtttaatcccatcccggtaccgagattagcgagagcaattatatttacgattattggtttttgcattttgatacaatgtaccaatcaaatggtgctttcactcctttatatacccctctataaatagcaaacaaaaataaaacaaaattgaaaaatgaactgcccgcgataaaattaaatgttgtcattactgtccttgtcattacgagatttgtaagagatgtaaaagccacgagtcttttgcatttcggtacatcattttttgataatttctggctatgccccaaatgcgcgaaatatgttccctatgaaaatataaatagatcaaataaataagatgcattaaaaatgttttgcgcgcaaattcacattctcaccgcataaaattaaccgttcgaaaaacgccgtgggttttgggccaaatcgatttcacctccacgtccgtaccgaaatgttccttaattttatttccctcgtcgaaattacaccttttaaaatttttgggtgcggcccgaaacgggaaagtaccgaaaatacgttaattaataatttatcccatcgttttaaagtaatggacc

SEQ ID NO: 45511 - DNA, 1282 bp, Heterodera glycines
ggtgcgcatgattccactgttccaagcaccccaccaaaagcaatacgatataaccaaaatataaggaaaaattttttaaaaatttttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatgaggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaacttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccgggaaggaccctgcaaagtttggtacgcttctgctcaattag

SEQ ID NO: 45512 - DNA, 359 bp, Heterodera glycines
acattacataaaataattgtttatctcgaattaattttcaagggcatcaaattcaatttcagcttcaattattaagttacagggcataatttcgaggccccatgccattaaagcaggattaatgaaggaattttgtgacttaaatagattttaaccccataaacattacgttttttgagtgctgtttctcgtaattcaggtgaatagctagaaatttttgtagtaatttcagttttttacgtttttggataatatgaaaacgaaaaatttggctgtcgcatggcgcccaaacggcggcgcccaatcggcggcgcccaaacggcgtcgcctaatcggcggcgcccaatcgacccccaccg

SEQ ID NO: 45513 - DNA, 906 bp, Heterodera glycines
  misc_feature (818)..(818): n is a, c, g, or t
ttttgtcaataactatttttcgtgcgttttcaaacacactattagtgctttattcagcgctacaacagaagacaaaagagttgatgtccaattcccggtagggatttaatagtgactttcagagatagccattttttgtcaagaactatttttcgtgcgttttcaaacacactattagtgctttattcacgctacaacagaagacaaaagttggtgtccaattcccggtagggatttaatagtgactttcagagatagccattttttgtcaataactatttttcgtgcgttttcaaacacactattagtgctttattcagcgctacaacagaagacaaaagttggtgtccaattcccggtagggatttaatcgtgactttcagagatagccattttttgtcaataactatttttcgtgcgttttcaaacacactattagtgctttattcagcgctacaacagaagacaaaagttggtgtccaattcccggtagggatttaatcgtgactttcagagatagccattttttgtcaataactatttttcgtgcgttttcaaacacactattagtgctttattcagcgctacaacagaagacaaaagttggtgtccaattcccggtagggatttaatcgtgactttcagagatagccattttttgtcaataactatttttcgtgcgttttcaaacacactattagtgctttattcagcgctacaacaaaagacaaaagttggtgaccaattcacggtagggatttaatcgtgactttcagagatagccattttttgtcaataactatttttcgtgcgttttncaacacactattagtgctttattcagcgctacaacaaaagacaaaagttggtgaccaatcacggtagggatttaatcgtgactttcag

SEQ ID NO: 45514 - DNA, 1126 bp, Heterodera glycines
  misc_feature (18)..(19): n is a, c, g, or t
  misc_feature (999)..(999): n is a, c, g, or t
  misc_feature (1048)..(1048): n is a, c, g, or t
  misc_feature (1066)..(1066): n is a, c, g, or t
ccattatgataaaatatnntgattgcgaatggggaattcgctgataataaaaacgaaatttgcttaaacaaattttaacctttgaaaaattttgtgtaaatttcagaatttgaccccaaacccaaaattgctattaagaaatggcaaaaaatttgcgaaattttctcccgccgacgcctcttgtgaagaaaataatcgcattaaaattttcaaattcatcgacgccaaaatctgtcgttaccccaaatttcaatttagttttgttttaaaacgcttctaaatgggctaggtattttggaagcaaattgatcatgaaaaaatataacccaaaaaattatattttaacaatttcatggagttgaaatatgtcactgaattgaataagagaaacatgacatggacaatcatcccgagcctaagcttttgactttttttggctttttgccggtcagctcttttatgtattttccaaattgaattttctgagagcgctagcgccctctttggaattgctgagaaaatgtctttgtggagatataatgagagtttttaaaatgaatgcaaaaatgaaacacttcttttgcttttatgaaaattttagcattttaaaattaaacggtattttttcaaattttattcgaaagccattgaatatattactttatctgttctagaaattgtggtttaaatccttttggaatgttcattcaaaatttttgtttaattttccattcttttttagttaattcagtctcgacaagtcttggtctctgatcgtaaatttatttttagacgctttgaaacacattccaatttgtgcaccaattaaaaaattgttgatcagcataataatcatctgaatggcatgggttctccgcctgatccggcgatggaaatgccgccgccaaaagagatcaaagtgttggagagctcggcggatgacattcagcaccggcaaacagaagcaagtggttgagaacagtacacaccattaattcnggcgctaattggccttaattggtcacataatgcctgagagatttaatcngtttttaatggcttcaanttggaatatctgagggcataagtcatttggacaaatttttatttatttattgttttgttt

SEQ ID NO: 45515 - DNA, 1135 bp, Heterodera glycines
  misc_feature (1080)..(1080): n is a, c, g, or t
gcaatatgatcagttgtttgatctgagtttgacggatggccaagcgctgggccaagcggcgcgcgcatttgaacagcaatggcatgagcttaagcattttctgatcacccaccggcactctgatcaagagctcttgatcagagatgtgacgagaaaattgaacaagcgattggagtcggaatgggacagagttgaaaaagccagtggaggaggagaaaagcagcagcatcaccaacgagggcacaattcagtaattagtggagaaaatcgcgaatttttgaaccaattgcatgccgatcagttgaaacggttgttgagcccacaacagaggacagataatgataatgataatactgatgaacagaaacaaactgatggtgaagcaaaacaaaataatgaactgagagataaaatcgtgaagcaaattgaatccggtctaaattaacagaatcatatttttttaattattaattaataatttaaatagattttaatttttgaaaatgagctaagaaaagagattgtccagcaaattcgaaatttgtttacttataaaaattttttaattttttaacaaatttgtcgttaatttgcagagttaactcacttctcagttaatttaattttaaaaaatttaaaactaatttgtctgtgttaattataggtataactatggttgcacaaataaggcctttgcttgccgattttgtgggggaaaaccaagtggacaatattttcaaaattcttggcattccgaccattttggaaggttcgaatgatgcattattattagtagacacggaaagagaagaaaatgttgaaagtaacaaaaaaagtacgacaaaaaagaaaaagccgaagaagaaacagctaaacactgaagaaaatggaggagaagaagcggacaaaacagcgacaagtgacaaattgtcccaaaaaggtgttgctaatgagagtgagcaaagtgacaaagtgtcggcaaatatttcaggggaacaattaacgactgataaacagccaattaatgatgatggtgatggaataattaaaactaataggtaggaaggattagtaactaanaaacatataaaagacctttcattggtccctaaattgaatatcgaatttggtaact

SEQ ID NO: 45516 - DNA, 904 bp, Heterodera glycines
caccaaaagccaacacatcggcgcagataaagctgaaaaaatgaagaatttttgtttatttttcaattttatttacatttcctttttgtgagggcgtcgtcgttttttggcattgtccaaaaagaaccaaagaatggtggcaaaatcgaccaacagaagaatcacagcagaccaactgaaagaattggggaaaggtcaaagcgagggaatccaaaagtgaaaaaaacgtacagaatttcggaagacatttgcaagaacagaatgaccggaaaaatattgggggaatggaagaatgaatggaacaaggaggaggagaagaaaaaaggcatttttatactaaaatattagcgtaacaatttgggtactaatgcactttacccgacataatttttttttgtctaaattcatgtaaaattaagtgaaatcgatgattgttagtacattttaaaaccacaagcgacaattctgaacaaaattataggcccatgactattgttggtgtgtcctaaaaccaacagagacattcactcaattctccaatttggctttttcgtgcatgggtcttcggggcaaggcttttgcaattggtggggaatttttaaaagacttgagcagcatttttctcattttttgacgttggacgaatgagtccttgtgggatttggacactttattagtgtcccaggctcataactctgttcagaattgtcatcgggccttaaaaatggtaccaatcgacttatctccaggagaggaatcagaaaatgtatttaaatattaaaaactgtaattagccgaatttttcaagtttaccgaaaaacgggccccatttaaatacctatgtatcaggggtgtgacttgtctcagaaaagacgagagcaagagtttggcgagaggcgagagt

SEQ ID NO: 45517 - DNA, 1119 bp, Heterodera glycines
  misc_feature (1115)..(1115): n is a, c, g, or t
cctctatttttctataaaattttaaaaattgtactaattctgttagaaacaaatttgaagtattaataaatttttatatggccctaaaaatattagtttaattttgttaattaataaaaagttatattaaaattcttgagtctcatttattatccttggtactttattatgttcaagttagcataaaatgtaggtggaaatgtcacaggctaatgagaccaattcagccagaactcatttgtcagtgctttaaaaattccctgatttggaaaaatatttttctttttcaattgagtcgaaaattaaactaaactcgaacacggacaacgacggaaaggggacaaatgggcggcgcccaacctgtgaaggattccttaatttaataaaatggaaacttctaattgctttatcaacgattcaggcccgtagccaggggggaaagggggcgggaattccaaaattaaaaattttgccaggaaaaatttgcaattttttaaaatttttcatcaattttttaacaaatgcatgaaaatttgaagtttttccgacggcgcctattggcaccgccatacaccctcccaatttcaccttatttttaaaaactttgatcccattaaaaattagtccctttttggcgctaaatcgctacaaattcttgtttttttgctcttcggcgctgaaatttttaaaatatcaatggagaaaaaatttttggcccgaagagcaaaaaaaaaaggtcttcgtggatttcccccttccaaattattttctggctacgggcttgcaatgatttatttggctttttaagttttaaattttggtccaatggctctcctggaataaaagcagaggagttttttctttttaaattgactcgaatggcaattgtcaataaaaataaatgcagtcagaaactgttccgtggacaaagaggtgccaattgcaaaacatagtgcccctcgtctatttttgttttaaacaaaaagttttgtattatgccgtcacaaaaataattaatgcgacatagagcattttgttacggttattattcaagtcgcccctaaaactcggttgtcggcggtacgcttcattaattgctccaatttgtgccctgngtaa

SEQ ID NO: 45518 - DNA, 1348 bp, Heterodera glycines
  misc_feature (13)..(13): n is a, c, g, or t
tttggtataatanttagacaaatggattaaattgaatattgggatgacatccatggtttttgccccagtgacaatgatcttccccgaaatataaactaggcacgtgactccattcaacaatttacaacgaagggctgggaaaatgctagggtcataaataccacccagggtgttttgaagtcgttctacactgatgcgctgggcaaaggtttgaacgccgacaatgttgaccacccgcagctggtggatgcccagtgtgatgctctgggtgtgttggatgcgccgcaaaacacgtgccgccattttactcgcactgcttgggtggggcactccggtgaggaccacacgcgccgattggaagaccagcgcagccagagttttgcccgctgttgtacggatgcgcattatgatagcgtggaagcgtctggggttgtactcggtgtttacgccacgttgcgcaattgtcaaaaattgctcccgagttaatggttgaacatttattttaaaaacaacagtacaattggaaattgaatacatctacaaaacaatggacaaaatttcaagaggaaaaaaggttttgtggtctccgcctccaaattcaacgacgcacggcaaattggggtggcgcaagcggatgccatgttttatgtagtagtgcatccgtacctttaaattgcgtggtaccgacaaaacaaaacaaataaaaacaccgttatgctgaggtagcctcggtaagctggggcggagtgggtgtccaggatggaaaggtcattgcaccgcactggaaaattgcgcacggaagggcgcaggtgggcggtgcgcagttggatggagcgcaaatgctccacaatgtcccggcgtttctctaggcttttgaaaagcacatgcagttcatgggcactgcatttgaaccgcttgcagaggtggtccacgagcggcacggggcgacggcgttcggcgcaaccacacttttttggagtgcctaatttaaaatttacatgtcaatgacaacaaaagtaacttgttgctggcgcctcctcaccaattggagcgagcggctcgcgcttcatctcctcgtcaatgagactgatccagcttggatcctccgcctcctcctcttgctttttcgttggctctttgttatctttgttggcgtcctctaaatccatttcgggataagcgttgtttatccaatcggtggcaagaattaaatccatttttttaagctgtgaaaatgaaaaaactataaataaaaagaaaatttacataaaaaagtaaaatggacgccttccaacaatttaaaagggaggatgggcaattttcttatcccattcaccatgattgtgtc

SEQ ID NO: 45519 - DNA, 991 bp, Heterodera glycines
  misc_feature (41)..(42): n is a, c, g, or t
  misc_feature (52)..(52): n is a, c, g, or t
tttttcataggccagcgtgtttaaagcaaacccgaaactgnnataggaaatntaaattgatcataatagaagtttaatttttatttgtcccatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataacaagttttttttactgaaaattttttacacactacaggatgaaacgcaataaataatgtttgtagacaaaagaaattggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatttttttccttcctctttagaaagtgtctaaaaatttttgttgttaatattcagaaaacgtgttttttttagtgacaatttttttcaagagaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaggcaactgccgaagattaacaaaaattcaaatttattggccccgttctgctttgacaggccatatctcgccagggagtggcggtagaccctttgttgatacatttgaaaatgtagagcgcgtctagctcattcgaataacgatcaaactggtttgtttttgtcacgaaacaacccgctgatggccacgtcgaagaaaagtcccgaaatttgacgtccgtaaaactccgttttttcataggccagcgtgtttaaagcaaacccgaaactgataggaaa

SEQ ID NO: 45520 - DNA, 961 bp, Heterodera glycines
taccccgaagaaatgatttcccaaaattcgactccaatttatttatttttttcttgaaaagttgcaattgtgcgggcgaaattgataaaaaaaatgagtcacttttggaattttgcataatactcggatttttccaggaaaaattttaacaccttttttcataactattttgctctttttcgtaactattttagtaactatttcaccatttttagcacttaaattttaggtgctaaaaatcttaactctattaatcagccataaaccaggggtatcatttatcaccgaaagtttccgaatgcaaaagtcaaaacttcgttttatcctcgaccccatttcgcagcatataaaaaatttttgtgaaacaaaaacatcgtcttggtcaaaaatcgtcatcatcctcctcttccgctgctgccatttcgagagcctgcaaaagtcgaccatgtttaatcaaactgttagattggagtgccattccccgcccccaattaaaccgtaaatgaagtgcctaccctccgcctcgttcggttcggtcagtcctatgcccctttgcactgtaccaactgttcacgcctgcgctgctcgtcaatggtctccacctccgggttgcgcatgtccgggtaccgcagtgccttcaccgcctggtggtacagctccaacagttcgttgacccgcgcgtcgaattccctgcggggctcaaccccgcgatattggtcatcggtggtcccaaatttgacgtagtgccgcccgcccgccaacgggtcgccggcgaccaactgagcacgaacaatgccctctttgatcgccttgaccaactcgcgatgcgcctcctgctcggtcgactgaataggaaaaactgagccaaagaaagcgaggaaacactgccctttccatcggagcgatttgtttttaccgagagtaagtgacaaaatttaaaaaatattgacagggaaaatag

SEQ ID NO: 45521 - DNA, 1217 bp, Heterodera glycines
tttgaaccctaaaagtaaagttttctaaaattgaaaatttcattcatttttgaccgataatgactgacggcaggcgtcgtcgggcacatttttttaacaaaatttttatgaaattactcaaatgctcaaaaaatttttcccaattttctcaactttatcgtttcgtgtacgaggggggaaattgctcattgtcaaccccaccctccgctggtttagggcctgtccaacaacagcagtttttgccccgctgtaatcaccggtgatctgattatattcgaatgaaatgatcagtctctctctatctccctctctttctcgctctctttctctctctcgctttctctgtctctcgctttctctctctcccctccctcactctctttctctctctctccctccctctctctctttcgccctctctctatctttcgccctctctctctttctctctctcgctttcactctctcctccctctctccccctcactctctccctctctctctctttcgctctctctctctcttatccatttgtctgaccctttgagtttgattataaattgatttaatgatgtaataaattcttgacctgttttgcaccagtgcctttcgtcatccgcgattcgtatccttcttcgtttgtcaatttcatgtacgcaattgcgtcttaaatcgccaatgatatatttcgtatataaaaatgatttgtgtgtctatggccaagaatggcactttcaaagaaacggtcaaatttgggcagaatttttaaaacttatcctaaattatgccttctcgttaaattttaattttaattgacgagtctcacgaatattaaaaagtataaatttttatttttctcattgaatcaccttcaatatcctccgtttgcacagaagagtttttcgttgtttttgtgcttaagatcttcagcagttgcgtttgcttaatttcatcctccgtttttgcaaaagtgccatcaaaaatgaaaaacagtgccaaaatgacgatgggaagaacgcgaagagccattcttaggcaccaatttgaggttcgttattctgaattttatttaatgatttaattaaaggaaacacttctgatgttttttcaaataaaaaagaattttattaaattaattttacttatagaaatttatttaattgaacaatattttattacaaatataaataaatgctagcaattttaataataatcat

SEQ ID NO: 45522 - DNA, 1351 bp, Heterodera glycines
tttgaggggatagaaaacaacaacaaaaactttactcatctaaggctttgagccttaaattcagagcattagggctcggttgggttgggaaatccaaaaaaaaaattcccatttcttttgaaaccttaaagatttaggttctacaaaatcattcagttgtgttgaattttgcaatattttctaaatgtagcagcattcacataaatcagtttttgcattgtaaacgaacttcccatttaaaaacatttaaaagtgccaaagatttttggcattatgggtccaccatacaatacgtgcagatattttcgggtttgagttgtaaaaaagggatggatattccctgatttttacggtttttgaaaaaaaaattcatggccaagtcgaaacagttggcccaccggcaaatccaaagaccgaaaaattccatgacccaaattttaaattatattaaatttttttcaaatttttaatttggccctacccaaaatggccatgtccacattctgtgccgcttggacggacagtcccaactgcgtgaccaattggtcgccgagcgcattccctccactgatccgcgcttccaacgccaacgggggcaaaaggccggcgatgagttgggcctggaaaattggcaattttcaatttataaagtactttagagcctaaatgacaattaaaagtttcaaaatggttgaaaaagaattttttgaccaaaaaataggaaaaaattttttttattcggcagattttttaacacaaaaatgccaccatacattttaggtacttaccattgtttccacattatcagcatgtgaacgacgatgggacatgatgatattgatattgatgttgagcaataacagccaccaaaaatgaaaaaaattgctaaatttaaaaaaactggcacaaattgtaaaaaatttattatgtttagggcttatattttaggctctaaaaattgccaaaataattaggttttaggctctaaaataaaaaataggcacttaaaaaaagaaaataggctttaaaaattctcaaatttaggggattagaaaatgacaaaattttatttaaaaagcgaacaaaattaagcttgcgatacataaaaaattttgtcaaaataaaaataaattttcgagaattggaaaaattttcatttcttaaggggtgtattttttctggaaattttagggccgattcttaggggatgttttcttttcgttttattgcatttttgttaataaattttgaacaaaacgccaaaaaagatcaaaataggttaataaaattttttttgaggtttttaagactaaaaataaaaacctagaaaataggccctaataattcgaaa

SEQ ID NO: 45523 - DNA, 917 bp, Heterodera glycines
cggggcagtccccccgaaccgatgcgcccagatttatggagaggccgaatccttcgggaatagcttccctatagcctgtactgtaattctgctttggatttttgctccccataattgtttgagtaccccaaacggacacttgaaaaaatcgatttttttgttttcggtcagtcccaccgaaccgatgcgcccagatttatggggagaccgaatccctcgggaatagcttccctatagcctgtactttaattctgctttggatttttgctccccataattgtttgagtaccccaaacggacacttgaaaaaatcgatttttttgttttcggtcagtccccccgaaccgatgcgcccagatttatggggagaccgaatccctcgggaatagcttccctatagcctgtactttaattctgcgttggatttttgctccccataaatgtttgagtaccccaaacggacacttgaaaaaatcgatttttttgtttcgataaatatttttttcagaaagtgctctaaagtgcaccaaaattttatttacaacttaattttagcactctgatgctttagtatcaaaaaggaagatggagaaaaaatttttacttatattttggttatatcgttttgcttttggtggggtgcttggaacgagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttaaaaatttttgttgaaatatttgtcgtgctctgaagggcgggggggggggggg

SEQ ID NO: 45524 - DNA, 774 bp, Heterodera glycines
caagaatggagcagtgtgtcaattcggtataattataccagaggaaatcgagaaaatgaatgtcagggaataaattgactagcaaagcatgggggagggatgagatcaatccaatcccttctttttcccttcatttccccccccccctcccatttattctttcccccgcccctttttgctcccacttttcttcttcaatttttaacaattgccttatatttaaagggccatccgcggaggggtaaaaacgcacagattgacaatttgttcctttcccaatttaaaaaatccttccaatttttatacatttttggataatcactgattgcgtttgaggtgccgtcccccccccctttccctctccccctctttttcccccctttccctctttccgcgcctttgccgtttttttgtgccgccattcgtcgcgcatttcctcccttttcccccattttcaatatttattgcttctccccccccccccattcattcacttccccccaacttttcccctttctcctgtccattttgcaggtgttactttttcatttgcccaaccaaacattgcaaaatttaagaaatttgcgcataaattcgatttttgctctttcacgtatttccaatcacttgaaaaggttcactttcttaaacacatttcagcataaacattctctgctcacttggcgattgctgaagtgcctcttttagttttattattcatttcaattaaaaacgattcaaagacaacgaaaaatgacggaaacggcggatgaa

SEQ ID NO: 45525 - DNA, 1043 bp, Heterodera glycines
  misc_feature (166)..(166): n is a, c, g, or t
acgccttcacgcaactaaaaattcgccaaatatttcaaaaattacgccggaaaaatttcgcaataaattccccctcccctcgtttcggggctactagacgacccaaaatttccaatcgataatttgtcagcaattctcttacgtcagcgatcgcccaccgctcggncttttcccacaacggcgtctctcccagcgctttgtaaatgggcttcggtggacgaacttcgcggcgtccgtcgcgttccaagtaataattgtcggccaatttgtggtgcacgccgccctgcgccatcgctggctcaatggctacgaccggactgagtgttggggaagcgattgtgtggtctgaactcgactctaaaagaagtgatgaggtattaaaaacaataaaatggaaatttaatgtgtaaagaagtcaaagcacaaattggacctgttcatctggcttaggaatgttcgatggtggtgttaaagtcggatcacgcttgactttgagcaaagcattgcgaagccatgcgataaaaggacttggggcccgattcttcaagccggcgggtgccaatttgggaatctttgacattttaaatggggtagatgctataagaatcacgggtaattagtgaattcgtcagctacgagtgaacgatcgtcataatttaccaaatcctaaattaaccaattagcttctggtcttaaattttctaaaatgacaacattatgccaaaactattcaataactttaaacaaactcattcccaatacagaattttccaatggcatggcatgactaaacgaacaagatagacaaattgtaccaaattaaagacaaaaaaatgaatatagaatacatatgtacataatagaattttacactgcaaatgcacattcgccactgtcctgctgtgccgattgtctgtttcaacagtttttggacattcgtcggtgtttgtccattcaaaattgatcactttgtgtgctttttgcatttgatcagttcttttgaacaattcggttttggacattcgtcgcctctcccccccccc

SEQ ID NO: 45526 - DNA, 1263 bp, Heterodera glycines
  misc_feature (47)..(47): n is a, c, g, or t
  misc_feature (74)..(74): n is a, c, g, or t
  misc_feature (160)..(160): n is a, c, g, or t
  misc_feature (240)..(240): n is a, c, g, or t
  misc_feature (1223)..(1223): n is a, c, g, or t
tttagccactcagatgctttcactatcaaaaaagggagatgaataanaatctaaaaatttttaattgcttttanaacgagcgaaaaactttagggcttaactttttttttataaactgatcagaagcgacccagattttgcgagggcatcaaaaagacanaggaaaaagcactgcttatgattgtaactccagtaatttctgaatttaaaattttttattaatttttaaagcttcactanttttatttttttagcaaaattaattcataaatattttttcacaaactgcttctgaaacgcaccaaattttatttacaagttattttaggcactcagatgctttcactatcaaaaagggagatgaataaaaatctaaaaatttttaattgctttttaaatatgcgaaaaattttaggcttaactttttttttataaactgatcagaagcgaaccagattttgcgagagcatcaaaaagacaaggaaaagcactgctatgatgctaactccagtaattctgaatttaaaattttttattaatttttaaagcttcactattttatttttttagcaaaattaattcataaatattttttcagaaactgctctgaaacgcaccaaatgttaattaaaagttaaataaggctctctgatgctttcactatcaaaagggagatgaataaaatttttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaaaaatctaaaaatttttaattgctttttaaatttgcgaaaaattttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcanaaattaattcataaatattttttcacaaactgctctgaaa

SEQ ID NO: 45527 - DNA, 382 bp, Heterodera glycines
ttggttttaaatttcctaagtgattttgtacccttacaatgaaaattgttagcatttgcgaatttgatgtttttcatgtgttagagacatgaaaatagtacgccaaaatgagagaaaaagaaattcacaaaatttttcaccaaataacttttgattgagccttatttttgtattaaatttccttattaatcgatgcagaatttttttctctataggtttgcaaaatttggtgcaaattgtatgcataggaaaaaagttatatggagagaagtaaatgttgttttttacataattaaaatgaagagatagtacgccgaacagagagaaattacaaagaaaaagaaaaacgacgagatagtactaggcttttctctgcacagtg

SEQ ID NO: 45528 - DNA, 893 bp, Heterodera glycines
aaaattgactagagcaatcgaacgctaacggacgacctaataggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaa

SEQ ID NO: 45529 - DNA, 1339 bp, Heterodera glycines
  misc_feature (22)..(22): n is a, c, g, or t
atattacaataaaaaaacaccnattctgctgacaatgagtgaattacggcgcattaattaatgtctttgatcatttggagaaaatgtagaacgcataatggagacattttccaaaatttggtcgcttttccctttcaaaatgtgaaaaaattgttcatcctttgtgtgtgaccttgaaaatgtattcctaaaaaaccagtttttttaaatagcaaaaattaatttttaaaattcttaaatggaattctaagcctaattaggtcatttttatggcattttgtgcctaattcatcctttacgaggaaattttttcaaaaaaaattaaattttatttacatatttgttttttttgtacatatttcttatatattgagatattttatttacatattttgatcactttgtacgtatttttgccagccctataatcaggattttttggcgaaaaacggcgaaaaagtaaaatacacccctaaaaatcggctaaaaaaagaaaaatacacccctaaaaatcggcgaaaaagtttgcaaaatacacccctaaaaatcggctaaaaaaagaaaaatacacccctaaaaatcggcgaaaaagtttgcaaaatacacccctaaaaatcggctaaaaaaagaaaaatacacccctaaaaatcggctaaaaaaagaaaaatacacccctaaaaatcgaatttttgacttcagcccccccccccctccgaagccaagggtctggctacgcccttgtttcataatacaaaacggagaaatgatcaatttgcaattcgcacacaccgtttcaaaaaacgagatgtgtgtcaataaagagagagtgcagagaaaaaaacatctctcgctttggcgttctatttctttatctctgttaatagagaaaaaccgaatttacttcgtgacgtttaacttttttcctgcacgttaaatccacaccaaattttacatatcgatagagaaaaaaaatctgcatttttctatactgattttatttttgtttatacgttagttcaaaagatataataaaaacaaaatttcgaatgctcatatcatttctctaactcatcaaattgcttggcatttgcttagaaaaagcttatccttatcatgagctttcaaatgataccaagtttttccaatttggttgggaaaaaccttcaaaaataattcccaaaattcgtcattttttaatattttggacaaaaataaaaatattcatgttgcacaacggactcgaacctcccccctttgtccctttactatcttacaaaaaccactgagccacacatgcaaatctttttggaactgggaggccaaaattgaaacgatgtgt

SEQ ID NO: 45530 - DNA, 1186 bp, Heterodera glycines
  misc_feature (43)..(43): n is a, c, g, or t
  misc_feature (116)..(116): n is a, c, g, or t
tttatttacatgttagtttaggcactctgatgcttttctatcnaatgggagatggataaatttttaaaaatttttattcctttttaaacaggccaaaaagtttaggcttaactttntagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaatggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttttttcagaaacttatcagaagcgccccaaactttgcagggatactgaaaggaaa

SEQ ID NO: 45531 - DNA, 532 bp, Heterodera glycines
acttttgtgagcatttgcagaagaattcgttcactcaaatagcccaaagattcgcagaaaatgtcattatcttaattacttaattcattaattatccatttttaattattatttgccatttttcactttgtgcccatttcttccaataatcgactaattttgagaaatttgtccaaggttttaattgcaacgccattgctcagttcaaatttgttcacaattgacaaataatcattttcatgcagcagaaattgtaacactttcaaattggccgcgtgctctaaagcaaataaattaaaaatttaaaaagaaaaaaaatgaaaagataaataaaaattagagtgaagcgggaccgggaattttgggcaaaaccgggaccgggacttgccgggacctgagaagccgtgaccgggaccgggacctcgatttttgttcgggaccgggaaacgggaccaaccgggaaattttaaaaattcaaaaaaaaatttattttaatttatttcaattgaaaataatacaaaattaaattttt

SEQ ID NO: 45532 - DNA, 1132 bp, Heterodera glycines
aaaaaagagatagccatttttctgggataacctctaaatattaaaatcctctgtgaaataaaatgtcgattgtgcacagccctcccgtctcatacgcgagcgcttttgtgaggtataaaatttctcaaaaaaaagagatagacatttttctgggatagagtataaatttaaaaaattccctcaaaaataaaaggtctattgcgcaccgccctcccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttctcaaaaaaagagatagacatttttctgggatagagtataaatttaaaaattccctcaaaaataaaaggtctattgcgcaccgccctccctatcatgcacgagagcatttgtatgtgtat

SEQ ID NO: 45533 - DNA, 1070 bp, Heterodera glycines
aatgatcacactaaggtgaactgctggtcaatcagccgaaatcagagaggatcagatcagctgatcaaatacctgatcaaccaaaccaaattctgtaagtaatcccgaaaatcataatggatttatggtttcatttgccccgccggtgacctgtcctaattaaaccagaaaatagtacccgtaagcgcctctcattcctgctccgccaccgtacgggaacggaccaccagcgccggcaccgtaaccgccgttaccgtacccagtggcgccatacggtggaacagcgattcccggctgccagtacgtgttcgtcccgtaggacggcccttcgtaggcgctgatgccagccgcatagccaccgctgtacgggctgacatacgcgtagctgggcttcccaccgtagaagctgctggtgcctggcccggttgagtacggtgggtaaaaggaacctgtgccaatcggttcgggtattatattgtaagatcacttcgtacagctcaggaacgtaatcaaccgataattccatccacataacctagcaagccaacaaactaccgtagttggaacggagcgagttggggtacgatggatagtaattggacgagtagtacggtgatgctggcgatgccaatgtacaagacaggaacaagcagcacagagtggagataatggcaacgaaggggggcattgacagtcgatgaggcactaacatggaaatgtttaacattataactcaaaacccatataatggcacggtgccataaagaaaaaccgagaaatgcgccccgtcctacagtaccaagtatctacagtaaagaatacagtaataaaattacataattgccccgggaaagggtggacttattaaacacacacacgcaccatcacttatcgtccgctcattcttcttctgctgctgtttcttaattttgtcactgtgatgacgatactggtacggatcgtaaaaggggttgttgttttggccatcgcactgtcgtcgctgccgctgctgctgcacactgtattccaatattttttgagcaattaaataaatgctacaatttatatca

SEQ ID NO: 45534 - DNA, 994 bp, Heterodera glycines
aacttttcgtaaagaaaattacattgaaaaaaaccaatcctcgagagaaacccatattaatggcattggtgggattttaagatcgggacatttttattttaagattttgatcctccaaataagaacattttggatactagtgccgttcaccccctccccttttgaaaaaagatcccatttagggcttttcggggtcgttgaacccgaatctaacatctatttcacctattttcgaaccccagatacgaattcgaacaaaaagtcgaaattcaaattaatctcaaaattcacatttatacaaaaattttaaaatgttaagaaagcgcacaagaaaaaaaaagatgaaaaacaaattttaaatgtaattaaagatgtcaaaatgaaaaattaaaatgaaatcatttaataaatgcgtaaaattttaaaaataaagtcacgtcctaatcctggtacacaatacaattaaaaagatcaaattattgtaaaaatttcaattttcaactaatctagaagcaaataggcacaataaaacattttttgtttaaatatacttcagatttaaataaagtttaataaaataaaatattattacgtatttattttttatagcatgattaatttatagttaagaaaaagaaactctaatatttgtacatccatagaaaaaatgttttataaataaaaataaataaatctatgtaataaaaattaaagtgaggaaaaatagtgtcaattattaatgatacgctatgagtgttatgataataaaattcatcttcttttctaaaattaatacaacaaaaattaaagtttaataattaaaagttatacatgaacaattacaataatgaaggggagactattaaaaatgcagagcgattaaattttattttatatattacaatattccctttacattcatatgaattatagaataaaaaataattttttaaaatacaattaaactaattatttcaaactataaaactataca

SEQ ID NO: 45535 - DNA, 1294 bp, Heterodera glycines
gctgtttgtgttcgtcgtccttgtcgccgccaccttcgctgcttcgttgtgccgcggtcgtgccgttcggaggcaacaattcggtggatggcgacgcgtacatttgggacaacactgtgttcagcacttcgtcctcgtgcgcaacaccgtaagcaacttcttcgaacagattcctttacaaattggaagagaaattaactctggcaattaatcaaagaaaatgaattgaagaaatattaattagcccaaaagcaaaccgaaatttattaaaaattattagaatttttgaaaatttacccgtctttttaaaaaaatctcacttttttacatttctttctttttcatagattaaagggactggacagaatactcatttctcaccaagcgccctccggctcccccttgccggacagtgcaattgcttgaaagaagcggaaggcatgcgccagctcgggcggcagcaccggacgtgaactcattgtgcaataactctgtgcacaaaaaggcaaacttttacaatttttttaaaaatttgccaccatcagtgcgtcgaagaatttccggtcggccaaaaagcggggcaacgtcaacgatgcctcgggccacagcgcgtaaatggtgccctccaacagctcttcaacgaaacgggcaaagcgtggcattgcggcgcccggcaccgcagcgattgttgtggcggtcgtcgtcgtcttcttcgcccttttctcatcccaacgggacggaggcggacacccactcggctgttcatccatcgaaatgtcgtcgtcatctgtgccaacaaaaataatgtaagtccataggatttatccgagcaaaaagatcgggtacaatgataaatttgccgaaagaattttcaattcaattttttaaatgttcgtttacccggaatttcctcgtccgatccgcgcacaaatgagtcgtcgtcgtcatcctccttctgttggtttagttctgcaccattttgatcgaccgcagcatccttctccatgtcctcttcgtcggaaaattcgccgcaaaagcgtttgaccatggcaggcccaccgtacttcagaaaggcctgggccacgttcaccaattgctgggacggatggtcacggctaaagcagttgtatcattagtagaaaaaatgaaaataaaatatcctggccaaaattcaaaagcaaaaaaacccacggactttgtggttctaaaaaattcgggaacaggacaaaatcacgccgccgaaatcacgccgctagaaattttttaaaaattttttcaaacagaattttttcaa

SEQ ID NO: 45536 - DNA, 1037 bp, Heterodera glycines
agatgttcagcaaacaatcgttctatcatgttggtcaagagttttttctcttttaagaaacattctcggtatcgggacagcacagtttctcttgtttttatgatttttatgcaattcttaaaaatattccattttttttaaatttcataatggcaatggtaaccagtgccccgcccccagcaacaaagttttttttttgcgagaataaaaaacaccaaaaatttcaggtaatcttttttgtgcccagctaatttcaaacgaaagattccccaatgccttttcgctgttccaaaattttttcaaattggctttactaggttattacgaagttttaggtttgttcggaatcttcgaattcctaatataaaatttgtttgtttattttcatttttttgagagtggggtgcgtttaattgcgtccaaaaaaaagaaattaaattttcctataaattaatcaccacctcattactgtagacattacaaaattggtaatattttgtatccagcatggcatgctgtagaataatcagttgaagggcgcaattgactcggcggaatcgtttcaaaagtttttccttcaaatgatcatcattcaaaaagtacaacccgtgccgaataatttcccagcgtgcagagaataccggtaactgaaaattattgggatcagaattacctaaagctccaaaacaatgagattttaaagaaaataacgtatttttaagcagttttgtttagtctttggcaaatatcttggcctttttggggtttttgcaaatatttttggggttttatggcaatatttatgtacatatttggacttttgagcacatatgatcagtttgttccatttttttatatttaattattaaaaattaattaaaactgcgaaaaatttaaattgtgatgatattttttttattggtttaattacagttcaacaaatttttatattgcttcgtaatttaagaagcatccgacactgactgaccttctacatgctagcaaacatttttgcgcccggttgaacatgaacgctg

SEQ ID NO: 45537 - DNA, 1420 bp, Heterodera glycines
  misc_feature (1403)..(1403): n is a, c, g, or t
tccttttttgaagacagggataattatgaacgttttccatatttcagggattttagatgaatctaaaattattctaaagagttcagttagtatgggtgccaaaggtaatgcgcattcttttaataatatgtaagggatgccatcaggcgatgtcgaatttcttctagggagttttttcaataaattccaaatattatagacatttaattcaatgtctgtgatctgattagggttttcatggctgagtaagtcattgttattttccttgtacaaaaatgacttttgaaagacatcagccaataaaatacatttttgttcattccgaaaaataatttgcccttgttcatcaataagtgttggtattccggtgttagttttaagaagatttctaacaaatttatagagagaatttcttccatttgaaataaatttagcttcattttcacaatataatttgtggatatgttttttgtactccctgcataatattttatatttaattttaagctcacggcactcagcttttccttttagcatgctatgtgttcgggctttttcccttactaaagttttaattttttcatcatgttttttcttatagttgttttaagcaatttcatgggtacatttttatcaaaacgcttttttaattcagtggtaaatatgcagtatttctcatttatgtctgaaactgtaattggaagggaatttggcccattaaaaagaatttcttggttgagtttagtaaaatttttctggcgtaaatctctgataaaaattttttgactatctgtttttggaatagtttgatttatatcaaaccaaacagtattatgatcagaatagaaaaaggggagccaacctttacattataaatgagttccttgggttgactaaaaaccaaatctaaaatattattttcccttgttggttctttaacatgctggaaaagttgattttgtgccgtgaactcaattattgttttgaaagtttatctttttttgttattttgcattcagaccaattaattgaaggacagttaaaatcgccacatataattgaattttttgaatttatttcagaaataaatttcagcgcttttttggtgttgctaattttttagacacatatcatcgaaaaattaaaaaaatgatccatttaaacacaactttttactataaggtcatttctacccttattattttaatttatttacttttttcattcttatcccgttagctgattggatcataatgacattgtgatgcatttttgcttttgcattttgaaaaaaaactattttgcgtttcgcccaattatagactttttcaatagacctgtacggggccaggtcgtttctttttcagttcattctgagtttaaatattttttgactcacaatntttcacactcatttaaa

SEQ ID NO: 45538 - DNA, 1312 bp, Heterodera glycines
  misc_feature (29)..(29): n is a, c, g, or t
tatgcaaaatttagtgcagatttaacatnagggaacaaaagctacacatagaaaagtaaattttgttctttacatcattaagaatgaagagatagtacataaaattgagagaaacaaagataaaaagtaattgtggcagaatgccaattttttccataattattagggctgcaaaaaatatgtacaaaaagtggtccaaatcgcgccaggtgatttcgccagtgagtgatttcgccagtgaattatttctctttttctcgccgtctgtatttgatttcgccagtaagtgaactcgccggtgattgttttccccagataaggcaaaattcaacccatggacaaattttaaccatataaaattaagaattattattattaattttacaaaacattttatcattgatttagttttcttttaaccgaattccatttaattttcatttttatttatcgcatattatcgcacaaatacatggattaactttcttaaatttcttagttcaaattgaatgtatgtttgaatgatctttcttaatttaaaagtgtaagtggtaggcacatgcgcgtaggtattcaagcggatcacgttgatcaaaatcagcgactaaagcttgcaggttgttgtcttgccttatgtattttgccttccgtcgctcatatggagcccttatgccatccgctggagctgcctgaaaatcagcaattctgtccgcccacatattatcctcttcaatcatttttcgaatgaatgagctcaagcgctggttccctttcagatgaacattccagatgaaatgccaagcctaaaccacacttgcaatagaacagagatgccattaaaaatttcaaaagtaccgcactgataaaaaatgcacaaaatatgaatgttttgaaatgtgaattttttaaatttctatgatttagctcctccaaataaacaaaaacttagaaataaatacaaatggcatctctgcaattgccaatcattcacctcaactgagttattggttcttcccaacccttcagcagctcgatcaactacattccagagttcacaggggaacattgcgaatgcttggacagatcgcagagccactcgagtgtcttcattttcacggaagcgtgtgaaaagatgtggcaattgttgaatctgtctgaacaaagcattgccaaaatggaacaaacaaccggttgcagttgtgtttggaaaaatgttgtttgcagccgaaattgcagcacgctcaaaatcactcatcatgcgaagtggatgccagccagcaggcatcgcatcgcgaattgcccgaaagaaacg

SEQ ID NO: 45539 - DNA, 850 bp, Heterodera glycines
  misc_feature (828)..(828): n is a, c, g, or t
tttgatttttgttcgagtccgggtgagctttgtcaaaattggtgtaagattcgtgattagctacccccgaaaccccataaaataagttttcgcgaaataaaaagggccctcaccctgtggtttttttcggagtgcccgaacagcaaaaataattcccagggaaagaacggattgaaaaattttttttgtttttgaattagatttgtcgcttatttattctggcataatgttataagttaaacaatttgagcaagaaaatgactgcctgcttctattgctgttgctggagcccgggaatttgagttttgctctgtgcgtttgtcactttttgttactcagattcctattgagggagagcgcaggtccaataccgagggcgagggtcagatttattcctcggcgattcagacgtggagggcgacggaggggagcggaagctgagcgagtgacaggaggtgcgagagagagagggggagagagtgagagagagagagagggtgggaagagagaggaagggcgagagagagagagagagggcgagagagaggaagggcgagagagagagagagagggagagagagaggcagggcgagagagagaggaagggcgagagagagagggagagagagcgagagaagggcgagagagaaagggagagagagagagggagggagggcgagagggagagagagggagggcgagagagggagggagagagagagaaagggagagagagagaggggagggcgaggggcgagagagagaggaagggcgagagagagagggagagagagtgagagagagagaggaagggcgagagagagaggnggagagagtgagagagagagag

SEQ ID NO: 45540 - DNA, 1079 bp, Heterodera glycines
ctaatttaatgaaaatttccgttaagaaaaaatccccggatatagtgctttggctggtggtggccataagtgcgcttcacatcacagcccaattggtcggcggagttttggccaacagtttgtcaataatcgctgactcagggcacattctcaccgacttggtctcctttctcatctccatcttcatgattcgcatttcggttgctaactgtaattatccctcttttgcccatttatttttttttccaaatttagctaatcgtcgtttcacttttggctatttacgggccgaatttattggcgctttggcgagcatttttatcatttggacaattacgattctcatggtaaactatttggaatgtgtttttttttgtcggtatcttttgtgattctgacattttgcagatcgttttcgcgactcaacggataatcagtggccaaatgaccgtcgacactcgaattatgctcatcaccgcgttggttggcattgtgttcaacttcgttatggtcctttttttaaaatggtcgaccggtggcgctcatttttcgcacggacactcccatttcactaataggtgaaatcttttgtttattttaaatttatttttaaaaaaaagttccgtaaatgatgctgagaatggcccaacggaaaatgtgaatgttcgtgccgcctttatccacgttttgggcgatttcatccaaagcatcggcgtgctcagcgcggctttgctcatccgatggacggactttcaattggccgaccccctctgcacgtacttcttctctctggtggtgctctgcacgagtgttcccatcgcgcgggacatttttcttgtcttaatggaaagtacttcgcattcggttaacattttgtatagaaccaaaaaatttgtcttggaatttaaaaattattgatcggacgccataatatatggatataaaaatggattggtggaatgtaaataatttaagggaatggaacgtaatgttgacattcatttcatttttcccgtcatttaggcactccgtcctttttggattttgacgccgttcgtagcgatttgaacggcatttct

SEQ ID NO: 45541 - DNA, 1195 bp, Heterodera glycines
  misc_feature (976)..(976): n is a, c, g, or t
cagagcacgttctaaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttgaagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaattttgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcgcatatttaaaaagcaattaaaaatttttagattttttattcatctccctttttgatagtgaaagcatctgagtgcctaaaataacttgcaaataaaattntggggggggtcagactttatttgtgaaaaaaatatttatgaattaattatggaaaaaataaataaataatgaagtgtactttttaataattttcctgtaacgaaggtactcactcggccgcttcgcggcctcgtggtgggccttctgttgaaggatgtagaaaaattagatagccacttttctgacaagactattctatatgcatggagccattttccg

SEQ ID NO: 45542 - DNA, 966 bp, Heterodera glycines
ttcggcagaatgggcaattttcaagtacataattaaattcaagcacgcttgaattgttaagcatgttgccctatttttcaagtatttacttgccattaatatatgaaatgattttccatggaaaaacgtaggtttcagccccgaccccgagccccactaacccgaaaatattatttattaaaaaacggattgttttgtcttaaatctttaatttagcgaaattttttttatacaattcaaatattttgtattcacatttatttaaaaaaattttgcattttttttgccatttttaaaaaattttgtatcattgccattaaatacggtgtctttttttgtgccattgtacgaaacgacattagtttcggcatttgtaatgacacgggactccgtttcagcactttgagtagttgtcgcctcagatgactaataagggaaatttaattatgccgccgtaaagaagctaaattatataattaaattttgtgcattttattcaaatttaatttccctaataaaattattacataatatttttatactcttttatcagttgggctttgcccgactgggctcaaatgttgggatagggaatatttctattttttcaaaaatggcaccccaaaaacagtgaattccgtgccggtccatgcaactttaaaaatggattatataatgccaaaaataaaccacaaatctcatttgtagggatgtcaattttatataaaatattcggggttttatacatattttacatatttctaagttttatacatattttggacttttttctacatttttcatttttttttttacatattttgaggattttttatggaaatttttggaaatcctcaaaaaaatccaaattttctacaaatttttcgtatacattttcatttttttaaatattttgagaacttttttttaaatttataaaaatttctgatgaaaaaataactaaat

SEQ ID NO: 45543 - DNA, 1313 bp, Heterodera glycines
  misc_feature (523)..(523): n is a, c, g, or t
  misc_feature (583)..(583): n is a, c, g, or t
caatatcgcatcatgcgttgtggtcatccgcatcgcatgttgtggcgactccccacctcctccccaatttcgcatcatgcgttgtgggcatccgcatcgcatgttgtgtccaaataataccgactcaaactagcaatgttcaatgtacaaccccgtttttcttaattatttggcgaaaaaaggtggccatgatgatcatgacgattatggcggcggtgatggtaataatgatgatgatgatgacgatgatgatgaggacggaacccaaaggggcaacagaaaagaaacagaaggcgcgagggtggaggaagggaggacggaagcggccagagcagatggagaggaggagagacctgagaggacggaagcggccagagcagatggagaggaggagagacctgagaggacggaaggcgcgagggtggaggaaaggaggacggaagttgtgagaacggatgaaggggaggtggtagttcagagaatggaatgtgtgggggtggatgaagggaggatgggaagcgcncagagtggacgaagggatggttagtgctgagaggatggaagcgcaagaattgggaaattnggcgataattgaggagagcaatgaagaaaatgaagaagaggaagcagacgaaggaaacaagaatcgtgtgggatgtaaaaagcgagatgataatgatcgaagaggaccgaggggaggaggggcgggagcaggaggatctgggagcggagctagagggggagaaggattgggaggaggaacaaacgggggagggagagcagaaagaagagatgcgggaacgggagcgggaatttacgaaagaggcaaagaaggaagaaaaactgcaaataatgatgtcataattgatgagcagcgttgcagaacagttgaaaatgatgatgatgaggaagatggttgtgccgaagttgaccttccggaattggagtttgaaaaaaaggtgaacgagacggattgttgtgcagtcggacttctgattgccgatctggaaggatcggctttcggacttatgattgccgatctggaaggaacggctttcggacttctcgatcaaaagtcagaatggtatttgatctgaattattcatcttatgctgttcaaggcttctgcgaaaacattaaaacgaagactacaaagaaaaagaagaaatgcaaatgaaagaaccgatgagcataaaacaaaaaaaagatcaaacgaaaagcacagagaatgaacaacccaaatgttcatcatatatgttcgtaaaaatttgtcctaaatttatcaacaaaaagaaatggtgaaaataaattat

SEQ ID NO: 45544 - DNA, 1223 bp, Heterodera glycines
  misc_feature (130)..(130): n is a, c, g, or t
atcagggcgatcggtgatgacggaggatccgatcaaaacggagaaggatgccctgaaaatatgtaccacgagaggacagaagcaaaagacggacgaggaggggagggagagagaagaggacggaaaaggnagagagaggaggaggggaagagagagagggaagagccgattttgggaagacagcgaaagtaaacggaaaagaaacgaccgacggaagaaagcgaaggacagaaggccaaactcattttcggctggcaaatggaatgggtgttctgctgctgctgttgtcctcttctgtcgctgctttttcttattatttttccccttttttaatttaatttttattttccaaataaaaaatatttaaaatgcgaaaaacaaataggcaaatttgggctgaatcagtttgagatcactcgtacatacaataaaatttaaattaaaactcgcgaattgatgacggtggtctgagaagttgtgagcacgcagaaagtttgggacggtgaatggccggcggcggatgcgaatcgcggatcatccaccgatagattggggttgatctgcaggagcaagcgatttgtcattagatatttattttgggatttccttattttcttcctttcctcttaattttcttcatctctttctcgcccctttcactctttctacactttccttccttctctctaatcactcccttctctctctttctctctgataactttcctctctctctctctctctctctcagtctcagatcatttcccctcttctctctctctctctttctctctaattgcttctctcttttttctctctgattactttcatttcttcttcttctgatcactcccttctctcagatcacctaccctctcctttctctccatttggattattatttgtctctctgtcactttcttttcctctcctcttttttctctcttttcccctcttctctctcttttcttctctctctctctctctgctcttctctctctctctctctgatcactttctttcccatctctaattattatattccaactcgcctccttcttctcatttcgctcatttgtactgctgttccccctttgttcccgattccttccgatgcgaaatttggcaccatttgaatgggctgatgatgggcagaagtaatgcatctgttggaggaagaaaagtacgttgtaatggcggtggatgaaaagggaccgtttaaa

SEQ ID NO: 45545 - DNA, 1070 bp, Heterodera glycines
ggaagaaccgaccgaggacgactttgaatggatgaagcaaatcatcggcgaattcgtcgaggaaaccgactcgaaaattggcacgcgcattttaaacctttggcagatggaaaagaccaaattcattaaggttgggtttgacgatttacaaattggacaatctaattttgctgttcccagattttcccgaaggactacaaaaaggcattagcccaaatggcgatagaggcagaagcggagagaaaagcgcgggaagagaaggaaaacttggacagagaggagcagcggttgaaagtggccaacaacacattgcaagtgagtggagcagcgcggaaacgcacgtccattctataaggggcacgtattccatgatacgttcccaattgacatgttgaaattaaaaaaacatgacaacattttcatgaacgtaagtttggccattaaatccgcccctcctctttttcactcacacttttctttctcttcgctttttccttttccattgatgaaaagccctttctttccgtttttctttatttccttttcctttcactttgttttgtggtggttgtcttccttcacaatgtgttgtaaatcgttgcagaatgtcagcgaagagtttctggaactgttgactttgaagcggacaaaccgtgcctattccatggacatgcaaatttcgctgcaggacgaacgaattcagaagcaagtgcggaagcaccaggagaagcgacgtcgaagtgtatgtgcacggaatttggtggttggcccctcccaaagagttttttggtggtcgttctttctcttttacactttcatttcctttcacacttgcacttaatttttaaaagctgaaaatttaaaaaatcgctttttgtttcagattatccatcaacgacgacgcaaattctccaagggacttcgcgacgtcgattttgttggcttcgaggccactgaggacattcaggacatgcatgcggagaaggaggacgaggagatggagcagttgtcagacttggactcaggggacgacccatctggtcaaacataattagtatagaccaatggca

SEQ ID NO: 45546 - DNA, 1232 bp, Heterodera glycines
gctcccaaaaatgagcccatcagcggacagcaaaatgacgccacaacaacagcagcaacagcagccaaaacatgccgagaggacggaggaggaggcggccatcaacatcggtctgagcaccgcggtggtggaggtccatgaacaggtggccggggaggcacagttgttgttgaagctggggagagaaatgccggaaacaacggtggaaggagttcaatgtgccggaaattccatccattttgcagggatatctccggtttttttgaaaatgcaggacgaagtggttctaatgcccggaatttcgtctattttacaaggggtatccctgttttttttttttttggaaaatgcttgcaaaaattgtttcaattcccgaaatttcgtccattttacggtctcggccctatttatatgaaaaaatctcttttcaaatgcaatttcggtcccatattgaatgagtgtgggcctcttttgtggacaacagacgactcgactaatagaaaactgcaaactcaccttggcaaaccaattttccgccctattttacggggaaaatcccccaattttttttaaatttgccccccccccctattcagttggcctcccagatggatttttgcaacaatttgttgggccaattcgcctcagttcggcacatttcgtcgacgccttacgccgttcacgtgccgttggtgaacagtttggcgttgcgtcgtcgccacccgaattggaccatccggctcaaggtttatctgtctaaaaaatctccttggattcgttttttgcactcgaaccaaaaaaaaaaaaatttcgttttttgcactcgaaccaaaaaaaaaaattttttttttttgtattaggctgtcagtttttcaatttatgttttttttaaataaatttttttaacttgcatgtccggctccattcttcgctcagtgaatgcgttgagaatttgcgccagttcagtgcccaccgtttgccgacattggcacgccaatttgaccgcgcccaatcgtcgacaaaggacggtaagggaagaaaattttcgaaagacacattatgccgaaatgataaaatatacccgaaaaaagggggaaaaaaatttgtccgcactctaaacaggaacatttttttcaagatttccaaaagtttttaattaatgcaccaagacaaatgccccaaaacaatccagagatgtggcgccacattttaaaatctcgaagcaaaccgag

SEQ ID NO: 45547 - DNA, 752 bp, Heterodera glycines
atttaaatgtgatttttaaaaaatcatcctttaatttttccttttaaaattcttcactctctctcttcaaaattcctcattctcttcaaaatccctcattctttttcgccgctgctcatttggcctccactccctgcaaaaaagagattacgatggaatgcattttatgcacacaatccccccccttcccataccacttcggcgcccgcttcttcggtgcgacgcccggcgggagggtccgtcgagacctgggcaaaggaaaaagaaacaaaatatttccttcccatcctcccccccccctctctacctcctccacaccgacgcgctcaacgcgcagcccgaagcgctggggcgactctcgcccgtgcgacgcttcaaaaaaaagaaaaatgttaaaaataggggggggggggcaggaaaggaaaaggcaaacattacctcgcgcaccacgctgaacacctggagagggcgaggtgcattgtcctcattgactccatccgggcgacgaggtcggcgacgacgaacgaatgccggctccacgggccggcatgttcaaaaacatggcccaaaaaatacagaccttaacaccataattattaatttaaaaaaataaaaaattattaattgaaaattgaaattaatccacctgggcgaggaagatgaaaaagatgaacaccatgctgttcacgcatccccgtcgccttggcaatgttggcgttgttcaactgctccaccacgtcggtgagggtgat

SEQ ID NO: 45548 - DNA, 1093 bp, Heterodera glycines
attctgaatctacattttttctgggctccaataatcacctagcgcttcctgaaagtgtttgtcatcgttcatctttgtttggttcttcttcctctattcccgcattttttatttgtggcacacaaactctggcaaaaacaaaggagttgatggccccaaaaattcagtatttaatcacataaatctttcttcccaatcactgcaatatgtttatttctaaatttatgtacctcttctattattaccattaaaattctgaatctacaatttttctgggctccaataaccaaccaccgggcgcctcctgaaactgtttttcatcgttcatctttgtttggttcttcttcctctattcccgcattttttatttgtggcacacaaactctggcaaaaacaaaggagttgatggccccataaattcagtatttaatcacttaaatctttcttcccaatcactgcaatatgcttatttctagatttatgtacctcttctattattaccattaaaattctgaatctacaatttttctgggctccaataatcacctagcgcttcctgaaagtgtttttcatcgttcatctttgtttggttcttcttcctctattcccgcattttttatttgtggcacacaaactctggcaaaaacaaaggagttgatggccccaaaaattcagtaattaatcacttaaatctttcttcccaatcactgcaatatgcttatttctagatttatgtacctcttctattattaccattaaaattctgaatctacaatttttctgggctccaataatcacctagcgcttcctgaaagtgtttttcatcgttcatctttgtttggttcttcttcctctattcccgcattttttatttgtggcacacaaactctggcaaaaacaaaggagttgatggccccaaaaattcagtatttaatcacttaaatctttcttcccaatcactgcaatatgctgatttctagatttatgtacctcttctattattaccattaaaattctgaatctacaatttttctgggctccataatcaacaaccgcttcctgaaagagattgtcttccatcatctttgtttgg

SEQ ID NO: 45549 - DNA, 672 bp, Heterodera glycines
  misc_feature (646)..(646): n is a, c, g, or t
  misc_feature (654)..(654): n is a, c, g, or t
tcaatttgtgaataatggtccaacagctgctgatggtgagttgcgcttcaacaatttttttgtgtgactcagataattttagctaaaataaattaaataaaaatgataatttgaacattttttacctcaacatgagaatctgtgctccgccagctgttgtcaaaattggaatacaagaaataaaagaaagtaaaaaataatttactaacagaacattttgagtatattcttgaatatccttaataaacaatatgaagtaattgatgaaacggttgcaattatacatccgatcaaaatgatggcgacatgaaactgatcgttacattcagcggattgaataaatcagggtcctaattaggtgaattaatccatttttaacttcagaaatcaaggattttatttttttattttaataataataataataattagggatgcaatttttagatttttacctactgatcctaaaatttttaaaaatatacccctaataaattacaaattgctcaaaaattttttttgacgaaaatttttgattttaaaattatctcaatatcgatttattttaaacccctaaatttgaaagtttttagcaactattttcccattcttagcacctattttggggggtttttttaaaacctanaactaacntattttggcagtttttag

SEQ ID NO: 45550 - DNA, 1097 bp, Heterodera glycines
  misc_feature (21)..(21): n is a, c, g, or t
  misc_feature (47)..(47): n is a, c, g, or t
  misc_feature (108)..(108): n is a, c, g, or t
  misc_feature (836)..(836): n is a, c, g, or t
  misc_feature (872)..(872): n is a, c, g, or t
  misc_feature (875)..(876): n is a, c, g, or t
  misc_feature (1072)..(1072): n is a, c, g, or t
cttatgtatcaaaatactctntagctaattatcatacctttcattanccataaatgatttatttattcattaaagatcagtcggacctgatcagctgctacaaatatntaatgagtgctggtcagccaatttcaaaaagtgatcaaaaattgctgatagtgaatgcgacatattacaaaatgaaagcactgataaacggagcattatcaaccacaaagcaaataaaaagtggaggacgcaaacacaacaacaaattgagacgaatggcaaatgatattgaaatgacagcacaaaaagcccatctgttggaaaaccccaaaaattttgatgagaaattggtgaaaatttgctatttatgcagtttttggacgcatgtcatatcaaatcgcaacttgtacaaagaaagcgaaatttggcgaacatttttagcttatcgctttggtggagaagtaattttaaatttgaaaataaatatttgcatttttattgcatgtagtggcacttttttaatttgtttatttgttgttaatcaaaagggactccattttaggcacaaaaaatcgcgaaataggcacctaaaaaggcagaaaaaaatcttaaaatagggattaaataggcacaaaaatcctcgaataggcatttttaaagaaaatttttatcaagaaaaaataccaaatttagaagattaatttttggaaaatttaaaaaattcttattggtgttttctgatgtttttttcaagtcatttcttagaggggttttttcgaaaatcccgaaaataggtgccaaaatggcgaaataggcacaaaaataggcacttaagcattaagcacaanaaaatccaaatagtaggcataataaatttgatctanatnncatccagcggaaaatcgtttttttttgtagaaatttagacatttgcataaattgagtccactattaaatcattactatattaggaaatgccaccttttgcacaagtcccatggaggagaagacataatgggacaatccattgtgagaaagtgaaaagttctgaagtttgcagcattgctgaagtcaccacatcggnaacacgcacgaattgtgctgcatga

SEQ ID NO: 45551 - DNA, 656 bp, Heterodera glycines
  misc_feature (647)..(647): n is a, c, g, or t
taatgtataaattagaccggtctgaacgtacttggatttatgttttgtgctatttcccccattttcctcttctgtcggcacttttctctcaagaattttggcttgaaaattggaatccttcctgtttttgaagtcacacaccaaaaatttaaaaaaacaaaaatgcacgaaaaatcacacaacttctttcgcaggctgacccatttgatgagatttttaagtagcgaaaattgacgcatttttctcttacagaaaatttaataaaacttttctttattgaaattgtttctgaaaatgactcttatccctcgtcagtggatctgccgaggcgaagggaaccgcccggttcgccgcggccacttcgccgcgggtttttcgccgcggggttttttcgccgccggctttttcgtcgcggactttttcgccgcggccagttcgccgcccgaagaaaaatgtccatttcgccgtcataattaaaaatctcgaaaaattttgaaattatgttaaacaacccactatgtataaaaaatcatgctttattaaaatcctttttcataaaaaattaacaacctcaaatgaacaaaatcaaattacgggtccataacacaattatttgaaattccccggagaaattcacaatattttgngcatcaaaa

SEQ ID NO: 45552 - DNA, 919 bp, Heterodera glycines
  misc_feature (847)..(847): n is a, c, g, or t
tcgtgtggtgcgtcactgccttcatcgcctcttgggccaccaaaccgccgatgagcgaagcgatgggttggagatttccacacgccttaaagacggggaggaattcgaagttgaaagtggcacaagggacctggtaagagaagttgaagagcagtgagtccggcatttcgggcgcatcttttggcagcatttcctttaacaattttgcgtcggcatcggaacggggcaaagggctgtagtttttctgaaaggaaaacccaaccaaatggaaagtcgcaagatgacgaaccatctcctcaaaactgtacaaagcctgccaaagggcgtgaagttgcgcaggttcgtcgaacttggcaaagtcccaaatcataaagtcgggctcggcgagtgcgcgagacaatggcttgaaggacattttcttgggcactttgacttgctgaacacgtccacgcgaaacggggccttgaactgcgccagaaaaggccgcgagagcatttccaatgttgaagactttgcctaaaaatgggaggactgtagatgaaccaacaaatgatcagtggtggcactcacttcccttcaaagtgactggcactggtggaagttcgttcagttcggcgtgctcaaagtcggtgaacacaacgtggtccccgtcctccaactggtgaaatgcgccttcgagtgtcgtcatgtcgccgctttcgcagtcgatgtactcaacgagcacctgaaaatcggaaccattcaattcgcaattaaattaattattccaattttcacctctttgcacgtctccccgtcggaatcgttcacaacgaattcgtcgcccaagtccacaaatgcataaganaaaagtccgcgcgcgtctgccgagatgacattttgcgatggttgcgcatccaccgttcacttccgtctgagt

SEQ ID NO: 45553 - DNA, 958 bp, Heterodera glycines
  misc_feature (941)..(941): n is a, c, g, or t
ttgctgtgccgagaaccggcaggcaatggatggctttcaatctgcaagaaattagattggcaatatgtggttgtaaaaaacttttgggtatggaattattttttgaagtgagtcaaacaccctattagtgctttgctcgtgccgagaaccggcaggcaatggatagctttaaatctgcaagaaattagattggcaataagtggttgtaaaaaacttgtgtaaggaattattttttgaagtgaatcaaacaccctattagtgctttgctgtgccgagaaccggcaggcaatggatggctttcaatctgcaagaaattagattggcaatatgtggttgtaaaaaacttttgggtatggaattattttttgaagtgagtcaaacaccctattagtgctttgctgtgccgagaaccggcaggcaatggatggctatcaatctgcaagaaattagattggcaatatgtggttgtaaaaaacttttgggtatggaattattttttgaagtaagtcaaacaccctattagtgctttgctgtgccgagaaccggcaggcaatggatggctttcaatctgcaagaaattagattggcaatatgtggttgtaaaaaaatttgggtatggaattattttttgaagtgagtcaaacaccctattagtgctttgctgtgccgagaaccggcaggcaatggatggctttaaaactgcaagaaattaaattggcaatatgtggttgtaaaaaacttgtgtaaggaattattttttgaagtgaatcaaacaccctattagtgctttgctgtgccgagaaccggcaggcaatggatggctttcaatctgcaagaaattagattggcaatatgtggttgtaaaaaacttttgcgtatggaattattttttgaagtgagtcaacaccctattagtgctttgctgtgccgagaaccggcanggcatggatggctttca

SEQ ID NO: 45554 - DNA, 925 bp, Heterodera glycines
  misc_feature (780)..(780): n is a, c, g, or t
tctttgactttgcttttttgtccatttattccaatcgcctagtgctttaaggtttgtctttgactttgcttttttgtccatttattccaatcgcctattgctttaaggttttgtctttgactttgcttttttgtccatttattccaatcgaccacgttaattcattctctatacatttagtgtcttatttcatgaaattatatataatttaattttaaataaagaggcaaatttttacagaaaataaatagacgctgactaattagctaacatttataaagaaagtagaaatttgattaaatgcatatacaaaatattacttttttaaaatttgtataaagttccttgtatacgacttgactactggtcagggggttgttagcagtagagcagcttttacactgcgatctgttgagacttagcccttgatcggatgatttgtcttctttttccccctttactttttgtgccaacaacattttaggtacaagtacatgagaaggaaggctctcttaagggagtcaaatgcctcgttgccaccatgaaattaggtaggataagttcttgactttgcttttttgtccatttattccaatcgcctattgctttaaggttttgtctttgactttgcttttttgtccatttattccaatcgcctattgctttaaggttttgtctttgactttgcttttttgtccatttattccaatcgaccacgttaattcattctctatacatttagtgtcttatttcatgaaattatatataatttaattttanataaagaggcaaatttttacagaaaataaatagacgctgactaattagctaacatttataaagaaagtagaaatttgattaaatgcatatacaaaatattacttttttaaaatttgtataaagttcctagtcgtatgtgctttgc

SEQ ID NO: 45555 - DNA, 1470 bp, Heterodera glycines
  misc_feature (66)..(66): n is a, c, g, or t
  misc_feature (112)..(112): n is a, c, g, or t
  misc_feature (119)..(119): n is a, c, g, or t
gacgtacgtacgtatgaatggcaaaaataaaaaagggggcagggtcgattcacccctctctttgcntaaaatggggtactcattcgtagcgagggcaatatatgataatttngacgttntaataaccaaaaattaataaaaattccgaaattacctcccaaaatctttttgtacattgacgttttttctttagattgttggcactcatttctcatatgaaaaccattaaccgaaacagcagtgttgaagtcaccgtggacgtgctcaatgccctcagcgagttgtctttaattgggggacaggaaattgtgcgcaatgttggcaaattgtttcctccattgatcgcattcatccaggactccaccagcctggacagacgcgaagtgagtgggtagccatatttattatggactattgcatttaattttatttgtacattgactctaataaacctataattcgtcgtgacaatttcaaaattgcttttaggccgcacttcgcgcaatggccggtgtttgtcaaagtaccggctatgtggtcgagccgtacaaagattacccggaactgctggacgcactgttgaagttgtttaagacggaactgtccagctcaatgcgtcgtcttacaatgaaagtgctcggtgtgattgggtgggttttatcaattaaagaaaattgtaacaaaaaccaaaaaaaatttttcagggcttttgatccgtacacacacaaagtttaccttggaaaagttcattcgcacagcaagtcaaggtcgttggcacttaccctgccaaattctggcgaaactgcggaacactgtaaacattttttcacttaacaaaattattgcatacattggtgtacaacagggatgggccgaggtttcgcatttcgcctttcgcattttttggcgtttcgcatttcgctttttggcgcgaaacgcgacttttacacccctaagaattggattaaattcccataaaatttttcaaaattttacctataaattggctaattttcagtgaaaacctgtttataaatgatcaaaatttccaatttttttccccggcggcgcctatcggcaccgccgcgcccccaaaactcctattttttcttagaaaatggcccaaaatcgcaaaatttggtaatttgatgaaaaactgttctcagcggcgccccaaaactcttatttctcattagaaaaatgataaaaatcacaaaatttgatcattttttagtgataatctgtcaacaaattttaatcaaattttcaaaaattttcccggcgccgcctgccccctcttcccaaaaagtttttttggaaaaagcgcgcctcaaaaaagcgttttattgatttttaaatttggaataaaattttaaaaaatgatttttgctttatgattttaactattaaaaagttgtagaaaaaatttaggtttcgctttcgcatttcgcattttcgcatattttagct

SEQ ID NO: 45556 - DNA, 1015 bp, Heterodera glycines
caaaccggttcagaattcaataaaaataaccttcctcgggcggaaaaatggggttggaaaagtttcttggggaaaaaaagactttacaaaataatacccctgggagaagggagtgggaaacatgatttcaaaattttcaaatttttctagtttaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaacccggttcagaattcaataaaaataacattcacggtgcgaaaaaaggggtttgaaaagtttattttgaaaaaaagactttacaaaataatacccctgggagaagggagtgggaaacatgatttcaaaattttcaattttttatagtctaatctactcaaaccggttcagaattcaataaaaataacattcacggtgcgaaaaatggggtttgaaaagtttattggggaaaaaaagactttacaaaataatacccctgggagaagggagtgggaaacatgatttcaaaatttttgttgaaatatttgtcgtgctctgaagggcgtgggaggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttgttttttgcataattaattcataaatatttttttcacaaaaggctctgaaacgcaccaaattttatttaca

SEQ ID NO: 45557 - DNA, 975 bp, Heterodera glycines
ttcaatgcgatttgttaacagattttgtccacaacaatggccaaattttgcgattttgagcaaatttttgcttgtaaattaaggatttttacggtccggcggtgccgataggcgccaccgggggaaaaattaagaattttgaccatatttttagcatattttcattaaaaaattctttattttgcgatttttctcaaaaaaccacaaaaagcctcaaagcctcattttgaaaatttagcctcattgacccatcaaaaaaccacaaaatgaggctaaagcctcagatctggctaccctgactaaaatgatcacggcactattcacgattgacggcttttttagttcacggtgcatttttacaaatcatctgtaaacaaaaaattcagctttccccggccgcggcgccgaccgacgtaccgttagccctccataagtcagtcgcttgagccaacattttcgagtttagtgtcgggttttaatttcttatgtacaaggtttctaaataataatttgtcattttcttaatatatatttatttgattgtgttatttgaaatgattttaaaaagttttgctgaagtttttaaatttaatttctattttgtctttttgcttatttgagaataaaaaaaacagagaaaatcaaatatttggacgaagtcaattgtctgctcaattccaaaaataactaacacagtaagtaaaaaaaaaattcataaattttaaaataaaagtcgcttcagatagaaagattcatttttgtgcgaatgccatccgaggcgaggaaactcagtcctaatgaatgtgctgtgcttcttgcaatttaaattttaattttaatcatttatttggatttgttcatttgttcgccaattttctctcaattctgactaacagcagaataaaaaaattttttgccagaagcgtttcagaaaaatacttttttacttttatttttattttttcagcatttttt

SEQ ID NO: 45558 - DNA, 1581 bp, Heterodera glycines
cccaatttgatttagcgatgcctaaaagcacaattttcatttaaaaaaaggcggggggggggcatttgtttaaaatagtgaaaaatcaggacagaacacatataccgatttatttatatttttcgcattatctacggatactgtgtcaattgtctttcaaaaattgtccattaatatcacatttaatgataattgacaattcattcattatttacttactattttggcctttacttttagacctttttgcaagtgtttttgatttctttgatcaacactttgactgcttccatttgcttgtacatgcaattccatgaagtccatcaatggatgatcactctcgccgaatttgcttggtcaatcaaattttaagcatttaaaaacaaatatttccaaatgttttcaggttccacgtgcatggtttgtaaaatatgtgtaattaaattgtgcttgatttttctaaattaaaatattgttttatttcaaaatttcagtgtctaattaataaggataaatgtttttcataaggttttccccctgtcatttatttgacactgaataaaaccgtgcgcgaggactgccgtgtactgttcatgaaggtgttcaagcgggaccgtatcagttacgttggtgggattacggtagtccgaccgaagacaacgaatctggtgacttctgctgcttcgtagaaaaatgaggaactgaagcaacaaattggcaaaaatgggaaaatgaacaaatcaaattgtagaacttttcatgtggtttattcatagataaaaattcaaatggttgatggatttaaatagttaaatttcaaatattaaaaaccaaaatcattttttaatagtaatattaattacccaaaaataaaaaaatgtaaaatcattaaaaagattatttattctatttctttcacttaatcaattccaactcggccccattcaacaagcggatataccgttaatttttatttggcaatgacaaaggaaaactaaaaaggacaatatgtttgtttactgttttctgtgaaatttctcaaaaaatttcaacaagatacaaaaaaaaatctgtcgctaaaatggacagaaaaatattatttttgagtatgtttctatatgcatattatatacatcagcgcaaaatttgataaatgccacgtttttcaaattataaaattaaatttattgctattggcaaaatattttatttaaattaaatgcttgcaaacaaataatgctgaatttgctagcaaaaagattgttttaagaaagaagagtcatcgaattagtttttcaattaaaaaaaaaataataattaaagagaagaaaaaatttatgaggtgtcgccgtcggcggcgacagacaaaaaccgggggaggtggcgggaatggcagaaacggcaaactgaccggtttgctgcgacgggctgagaggttggaaccaggggtgggcgaaacttcgagcttcgaaaacttcgcgttttttgggcttcgaacttcgagcttcgtgaaaatgctcgaaacttcgagaaaaatacacccctaaagattgagttttcaaagtgaaaatacgcccttaa

SEQ ID NO: 45559 - DNA, 950 bp, Heterodera glycines
  misc_feature (865)..(865): n is a, c, g, or t
aaatttccgaattctggaataacttttttcttttttgtgataaaaaactcaaataaatcccataaaattttccttatttttctctatttttaaggctttattatagttaaatcgatgaaaccatcaccgagttatgaattttcaaattttaatccaaatttccaaggaccaaaaaaatttaaaaaattttcgaattttaaaaaattccaaaaattatgaaacttaaaatagacatcataatcgtactcagcaccccaaaataccccagaataaaatttttcaccacccttttcaagcctaaaaaaattttcgaaaatttctagggggcctagctcgaaaatttttgaaattttccgggcatatagcacaccgttcgatagagcttaaaattctctacaaaaatgttctaagacgatttttgactaaaatcaacccctgatgagttatgggcccgggactcaaatgtcccactgaggccaaaaattttttctatttccgggaaaaaatcgaaatttttcagaaaaaaataccagtcgatagagctcgaaaaactatgttttggaagtggtctccgttttgccaggaaaattcgttaaaaaatcctaaaattcaaaaacccgaaaaccgttttttaggcctagctcgaaaaattttgaaaattttcgaaatttttaaatttcagaaaatcgagcttctaaaactctacaataaatctgctgggcacctttccctcagatcaaaccccgacgcggtattcgcctggtactgaagtgtactttttgagcacgcttcagttgccattttctgcaggccagggggtggatctattaaaaaaataaaaaataccagcatgtagaggacactnttggcggggtgccctcgcagcgggcattttttgattcgagttttagaaaaaaagtatggggcttcaacgcaagcaaaagtgagaa

SEQ ID NO: 45560 - DNA, 920 bp, Heterodera glycines
aaaggtcggtttgaaaattgctgtctcagaagaatagatattctcagaaaaatggctatctctttttttctacaccgttgtacatgtgggttttccccaaaaacgcattactatctgcggttgagccctacaaaaggtcggtttgaaaattgctgtctcagaagaatagatattctcagaaaaatggctatctctttttttctacaccgttgtacatgtggggtttccccaaaaacgcattactatctgcggttgagccctacaaaaggtcgggttgaaaattgctttctcagaagaatagatattctcagaaaatggctatctctttttttctacaccgttgtacatgtggggtttccccaaaaacgcattactatctgcggttgagccctacaaaaggtcggtttgaaaattgctgtctcagaagaatagatattctcagaaaaatggctatctcttttttctacaccgttgtacatgtggggtttccccaaaaacgcattactatctgcggttgagccctacaaaatgtcgggttgaaaattgctttctcagaagaatagatattctcagaaaaatggctatctctttttttctacaccgttgtacatgtgggttttccccaaaaacgcattactatctgcggttgagccctacaaaaggtcggtttgaaaattgctgtctcagaagaatagatattctcagaaaaatggctatctctttttttctacaccgttgtacatgtggggtttccccaaaaacgcattactatctgcggttgagccctacaaaatgtcgggttgaaaattgctgtctcagaagaatagatattctcagaaaatggctatctctttttttctacaccgttgtacatgtggggtttccccaaaaacgcattactatctgcggttgagccctac

SEQ ID NO: 45561 - DNA, 959 bp, Heterodera glycines
  misc_feature (936)..(936): n is a, c, g, or t
cccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttatttctctatgccagaaaaatggctatctcttttttgcgagaaatttcgtaccatacaaatgttcccagcatgggcagaggggcgcggagagcaatgggccattctattctacagggaatttttaaatttattctctatggcagaaaaatggctattctctttttttgcgagaaattttgtaccatacaaatggtcccagcatgggcagaggggcgcggagagcaatggccattctattctacagggaatttttagatttattctctatgccagaaaaatggctatctcttttttgcgagaaattttgtaccatacaaatggtcccagcatgggcagaaggggcgcggagaagcatggncattctatttctacaggaatttt

SEQ ID NO: 45562 - DNA, 1091 bp, Heterodera glycines
aagtttattttaggcactcaagatgctttcactatcaaaaagggagatgaataaaaaatctaaaaatttttaattgctttttaaatatgcgaaaaattttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaatcaattcataaatattttttcagaaactgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattacttatttattttttgcaaaattaattcataagtattttttcagaaagtgctctgaaacgcacaaaacgttaattaaaagttaaataaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaataatctaaaaatttttaattgctttttaaacttgccaaaaattttaggctta

SEQ ID NO: 45563 - DNA, 1473 bp, Heterodera glycines
aaatatttaatttgtttattttagtcggcgttcgatcaaaattttttcagatcagagcagaatttttttagataaacttttgtggtcaaaatcagaaaaaaacactacaaaaaaggagcgtaaggtgatttcaaaggacataaggagacaatttttgaatttaaaggacttttcaaaagggagccggaaaatgcgacaccgagagaaagtttttcatttcaagaaaatgcgacaccaagaaaatactacatcaaacttagatttttaaaaatataaatttgtgtttttttttgaatttaaagtcttgaaaatgagcatcaaaaccaaaaaagacttgttaattgtgggtaagttgattttgtaaggtaataaaggaaaagcatcttgaagcaccagaattagcttatgagtctttaaaaattttcatttgcttagaaagagtttcttttcatcaagagcttttgagtggccaactttatatatttttattgcgaaaattcattttaatttttttgaacaaaagaaataaaaaaacgatgctgtatagttttaagggctgccactgatcaatgtttcattttttacgggtgtatttaaaatgttcaggtcaattcatatatatttcctggactgtgggggacctgaaacgcacgaaaaacatgtttttagcttggtttgaagcttctaggatggatttctatatccatatttcgcgatttatgtccatattttggcatttttccaaaaacctattagaacggcccccaacagctaattggccgttttgacccctaaagacctacaatcaggtccaaaagttttacaccaaaaaatattttagtgaaaaacccgattttcttaaaaaaaggaatggtggcaataatgttttgtttatgccaaaagaaacgccaattagtgcactaattaattcccaaaacttccccgataactctcttagtcgacaagaaaattttttcatgacccgaacaaccccctttttggcggtgcaaaagtaatgcaccaaaagatgtttgcacgattaattcaattttttatgagattttgatgctgatcaaacagtcttttggaccaacatgatcagaacacttcttcatggtgatctggaaagtcaaaaatggcttgaaatcgggaaaattttcaaaaaaaattctaggggattgaaaaagttttctggaagtttttgggaatttattagtgcattaattggcgtttcattcggcaacatttttgagaaaatcgagtttttcactaaaatattttttggtgtaatactttttccacttgactggtaaaaaatttccgaaacggacattttttagcaaaattttttaaaaatattgattaaatttagatttttcttacaaaattggttaatttatgtcaaatataaacaaaaaagcgaaaatttcgcttttcaggttgatttttcgctaaaatgagcaaatgttaatc

SEQ ID NO: 45564 - DNA, 787 bp, Heterodera glycines
atttacatatttatacatagcataatttgcgcgattaaccggttatatatatcaagcacagatcagacaaaacaacacatggcgaaatattataataatacgatacaatgtgtacatatatctttggggacatacagtaggataaatatttcaacaacaacaacaacaatacacgtgattgggatatcattgggttttcatgtcactaaacggtatttcgacatcgatgtcactaagagctctccgatgaagacgatgatgcgtccgaagttttgtcagaagtggcgtccgaagtcgaaccctccgatcccgagccagaggcagatgacgatgccgagccggagccgctttcggaagtctcagtggttccagaagtttcgtctgtcgtttccgtcgtttcctcagtcgtctcttccgtggtcgccgacttctctccgccggtctccgcggctgcctcctctttcttctcttccgctgccgacccgccctccttcttctcctcttcagctttgtcgtcactatgaaagaaaagcaacaaagttcgatgaaagcaccaaaatgcgcccgttttgctcacccctcgtcctccttttgctgctcatcaaccacgcgttccgatggcaccgccacgccgtcaccagcagcagaaggtggagtctcctttctgaaaagggacaaaaaccgttattcctcttccaattgttgacaaataaaatcggacttgtcgtcgtccgctcccttctcgacatcgccgtcagctcctcctttgccttcttcgtcttcttcg

SEQ ID NO: 45565 - DNA, 226 bp, Heterodera glycines
ttggattaatggcttttcctctaatgatgatgacaataataaataagcatccactgcttctgggagcgccttttatgctgctgcttcttctgctgcttctccgcttgcccgtgcccgtacccccggcgatttccgcgcgcgttgcgcgcattcggcggaacacataaaagggagatggggtgcacttttgctgcttggatacttctctctctctcagtctctctct

SEQ ID NO: 45566 - DNA, 922 bp, Heterodera glycines
cccaacaacaaaaaaaaaatatatgggtgaattatgtaggaggaacaattgcctcttcttgttggattgttgcagaaaaaagtgttgagcatggccaaggacaaattatgggagttaaaaaattgggaaaattgatggaaatttactaattgttgtttatatattcttaataaaattaaaaaatttgaaaatattcataaatcagaaattaaaaactggaaattttttttctccgactaatttgccattatatgtggtgcaaaaaattttcttaatgaagtggtattttcagtaattgaattcccatattgttttatcacgaattttccgattgaaaaatttacccaaaacagatttaattaactgaaccatgaaaagaatttgcgagacgagagaatttaattaaacttcgtaaaccccattttcttttatttcttaatttaaagaatgaaaataataaaatgtaaaaaattttaaataaaattagacatttcttatctatttcataaaaaaaaatatttattagttttgttgttagttttcaactttgtgttctttaatttctttattttacttcttaatttctaaattgattccgctttctgttcttacagagtgccaaaaatatttcgctaattaaaaaaattattttgaagaagaggcgggcaaatatgtatcaaagggaagctgagtgtttgccaataattttagggcccgagaaaaatatcaaaattttttaaatgctttttgagccgagaacatgtcgtcgtcgtccatgacacaaacacacatataaagtgaataccatgtgctatatattttatgttggcgtggtgcttgaagtgaagccagaaaaagagcaatggcagggaataaattagtgagagaatgagaggagtgcgagagagtgagagaacagaac

SEQ ID NO: 45567 - DNA, 893 bp, Heterodera glycines
aaaaaaaattctcgcacaaaaatggttatctcttttttctcatttttttaccgcaaacttggtaccaacagttgccttctcttgtctggccctatcaaacaatcttacgatatttgaaacgcaaacaaaaaaaattcttgaccaaaaaatggctatctcttttttcgcatttttttaccgcaaacttggtaccaacagttgccttctcttgtctggccctatcaaacaatcttacgatatttgaaacgcaaacaaaaaaaattcttgaccaaaaatggttatctcttttttctcattttttaccgcaaaattggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaaatggctatctcttttttcgcatttttttaccgcaaacttggtaccaacagttgccttctcttgtctggccctatcaaacaatatatttgaaacgcaaacaaaaaaaattcttgaccaaaaatggctatctcttttttctcattttttaaacgcaaaattggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaataatctgaaacgcaaacaaaaaaaattctgaccaaaaa

SEQ ID NO: 45568 - DNA, 1201 bp, Heterodera glycines
tgctaattagatcgattcttgtccaacatcaccagagagtcgcattcacccataaccaccagcattatccctccggcgggcactggttgtttgaatttgatgctcaccgctgtagttccattttttatcaggtcaaacagcgcagcttgatcatccccgctgttagtcaaattgaacacataaatgcaatgggttttcccgaactgttcatagctaatcccattgctttccaatgaattggcgaatcccaccgcttcgttcatgtcattgaaagggcgaacatatttcaaattagggtagtccaagtcgtaaggcgcttggggaaaggagcggccattagcaacaattgagatttcgcgcacattaaacggttgaaagttgaacggactacgcgaaattgttccaatatagtcagagttagccaccaatcccattgtgatacggcgaggaatttggtccatgaacaaattggcagtaaactcaaaacgacctggactgatgaacattgacttcatcaacgttttcctcacggcgtatcgtgccggtttcacttcaagttttcgcgcaatgtccaacgccagtccatccatcaatgaaatcttcttcacatacattttcaaaccgacaacctcaaagtggtagcgaggggcagccgcaagagtcgtaattaacaaaaagttgttgtcattgggtaaaacttcaatgtccagctcacagaagttgatcaaatagagtggctggttgaacaaatcggcgtcaattttggcaatgaattgagctgttctgcttcctgcaaacaagttacgtcgcgcaatgcagccgtcccctgtctcaagcgtgccgcccgtgtccctataatagcccgctgcattcaaatgagagtcctttgccgtagtggaataggacaactcatgggagaagtatgttttgtaggccatcagagaatttgagttgaaaacttcacgtccatttatgctcattttgatgtttcggatgaaagtctgaccaatcatctggatcggagcaacttcgtcagctgcgaggtcaatcagttgaccatgctcattttctttgcgaattcggaattcagttagtaaataacatttggacaaatcaacaaagttttggctggagtgaagcttaaagtggtagggagtgtccgtcagtggattactagggcacagctcaaaaacttttgatg

SEQ ID NO: 45569 - DNA, 10330 bp, Heterodera glycines
  Genomic contig location: Contig_ID=SeqID_6; Location=1..10330; Strand=-
  SCN-specific regions: Sequence locations=1-1522,1544-1634,1660 -1679,1706-2037,2070-2386,2409-3069,3091-3504,3526-3597,3630 -3909,3935-4008,4030-6258,6280-6370,6396-6415,6442-6772,6805 -7395,7499-7500,7525-7841,7878-7881,...
  SCN-specific regions: Sequence locations=...7904-7986,8008-8427,8449 -8503,8525-8722,8745-8989,9018-9819,9841-9882,9904-10004,10026-10330
  Gene Ontology: Mol. function=protein binding; Cellular component=cell wall (sensu Fungi)
cacacaaaatcgcttcacaatgccacgacgacgactcgtatgaccaaaaaatgccacgacgacgactagtatgactaaaaaatgccacgacgacgactagtatgactaaaaaatgccacgacgacgactcgcacaaccaaaaaatgccacgacgacgactcgtatgactaaaaaatgccacgacgacgactagtatgactaaaaaatgccacgacgacgactagtatgactaaaaaatgccacgacgacgactcgcacaaccaaaaatgccacgacgacgactagtatgactaaaaaatgccacgacgacgactagtatgactaaaaaatgccacgacgacgactcgcacaaccaaaaaatgcaacgacgacgactcgcacaaccaaaaaatgccacgacgacgactagtatgactaaaaaatgccacgacgaccaatcgtatgaccaaaaaatgccacgacgacgactagtatgactaaaaaatgcaacgacgacgactcgtatgaccaaaaaatgcaacgacgacgactcgcacaaccaaaaatgccacgacgacgactcgtatgaccaaaaaatgcaacgacgacgactcgcacaaccaaaaaatgccacgacgacgactcgtatgaccaaaaaatgcaacgacgacgactcgcacaaccaaaaaatgccacgacgacgactcgcacaaccaaaaaatgccacgacgacgactcgtatgaccaaaaaatgccacgacgacgactcgtatgaccaaaaaatgcaacgacgacgactcgtatgaccaaaaaatgcaacgacgacgactcgcacaaccaaaaaatgccacgacgacgactcgtatgaccaaaaaatgccacgacgacgactcgtatgaacaaaaaatgcaacgacgacgactcgtatgaacaaaaaatgcaacgacgacgactcgcacaaccaaaaaatgccacgacgacgactcgtatgaccaaaaaatgccacgacgacgactcgtatgaacaaaaaatgcaacgacgacgactcgtatgaccaaaaaatgccacgacgacgactcgtatgaccaaaaaatgccacgacgacgactcgtatgaacaaaaaatgcaacgacgactcgtatgaataaaaaacaataactatttcgagattcttcgtcattaaaaaatcgcaaccctacttattactagggcttccaattatgtatatggaaatccattttttttcatggactgtgggaggcctgaaacgcacgaaaaccatctttttagcttggtttgaagcttctagtatgaatttctatatccattttttccatatttcgcgatttatgtccatatttttggaagccctatttattaccctagtgaatttttttctaagcgaggaggaaggaaacaaaaactactgtatttccacattctataaataatcgtttcattgataattaataaatgttcaacaaaaaagccaataaaataaatgttttatataattggaacgaaacaattaacaaaagcatttctgagagaaaaaagcacaacaaattgagatagatcatttctcaaatagaattattcaatcattcatttccgtacacttaatcagcagacgacatttccgttgcttttatccgcttcttcttcttctttttcttcttccgttggtggcgacaatggcctaaaattaattaaatattttatttttcgataaaattcaaatgctattgctgctgctcactcaatggatttatcgaaactccacagatcaaatctgatactgttcaaattggcactcggatttaagctgtctccccatttaattgctggcaccctcgccgtctccccaattgggcaccgttgcaacagccaattatacacatttacgtcgaattcgtcgatctcctgtttcagtgtcagcttttcattcgtccgtttgttcaccaattcaaatggttcagttggaattgtgttcacatgaaaataaagttgaatattgtaactgacagaagtggtggcactgataaatggctaaacaaatttggaaaaacaaaaacaatttatagaaaatatggctagacacacctctttgaagttgttgacccattcgagattctgtggaccaaaataattattgcgatacaatcgcttcggttggccatttttgctcggagtgtgaagccatttgaccaaagcttggccagcagttgcatttgcccatcgtcagcaattccatcgcgtaacagagcaccagaatcgattgaaatcaattgatcaagatcagtgagaatcgttggtgaaatgcgactgcgcaagttgttcaaagcatcggcatcgtgaaagcccaaatgacgaatgcttttcgcaaaaaactcaaatttggtgcccattctgtcccaaattggcttgtttgaacggataaatgtgagcacagaatggtcaatgtagctgaaaagggggaacaatgaagaagatgaccaaccatattaattggtttctgtatagtttttgatttactgaatctgaaggaaacgaaaacggattttgtttggcagcgaatggtccggcaatggaaatcccacaaatttgccatcgatcgccacagacagtttcgcttattttgatacgtctccaaattgtcaattcgctttttccatcgaaatgtttgtccaccaaaacatcgaaacggtcggaaagcaatgccattttgagtccgagttgagcatggtcaaaagatgggagaatgtccatccacacgtcgccacaaatccaactgaaacataagaaaattgggtaaatgaaaacttgcaattttttaaatcctttcttaccgtcggtccatttttgtggttcaattgaatgaacaatcgttgagaagtgacggggccaattgacgcaaacgacgaaaagcgatggtattcaaaatcatcgcacacatagaattgcggaacattggccaaatgttgtccaaaaggctaacattgcccgtgaaaatgaacaaatccgttaaacaaacggcgaaaatacaacggtgaaaacggcggagaaatgcgatgacattttgatcgatgtaactgaaaagcagaaattaagacgaaaaattgcaaattaatcaatctttacatgcttttgatgtgtctgaatccgatgattttgttcggaaacggattttggggattggcaatggatttgcatcggcattgtgaatatgcatttgcttagtgccattttcttcaattttgtagcaaattcgaatttcgcccaatttccatttgcgtgtcttgaaatgttcgtccacgtaaatgtcaaagcagcggttgatcaatgcaatttcggggccaaattgggaaggcgtaagaaaatcaaacaccaaaagccaacaatcggcgcagataaagctgaaaaattgaagaaatatttaaaattttttgttgaatttttacatttcttttttgttggggcgtcgtcgttttttgacatggccaaaaaataaccaaagagtgatggcacaatcgaccaacagcagaaaagtgcagcaacaaaatgagaaaaatttagggagaacgaatgaaatgaggaggaggaaacgaaaaaagggaccacataaaagcaagcaaataaataaattaattgtctcttatgtatgtcatgggaatttttttttggggggggggggaaccactttaactactaccaaattctttagacaatctttcaattatcctaaaccaattggccaacaaaaaaaatcgagaaaaataaatgagtatgtatattatagaaggaatgaattaacaagcatttctgagagaaaataagcacaacaattgagatcgatcatttctcaaatacaataatattcatttccatacacttaatcagacgacatctttgttgcttctatccgcttcttcttttcttccatcactttttcttctgctgctcaccgcactaaaaaaagaaatgcgtatttttgtttaaggtatagtgagtaaacatacgcggctggagcggtccttctggcgttcaacgtaatccgattttgccatggaagacgaattgtcattggaagtgcccgcggcagtggcagatgccgacttgtctttggaagtgccagaggaatggtcagatgacgatttggtgttcgctccagatgccttggcagatgccgacttgtctttggaagtgccagaggaatggtcagatgacgatttggtgttcgctccagatgccttggcagatgccgacttgtctttggaagtgccagaggaatggtcagatgacgatttggtgttcgctccagatccattggcagatgccgacttgtctttggaagtgccagaggaatggtcagatgatgatttggtgttcgcagttccagatgcattggcagatgccgattgctttgaagcggaagtggtcttcttcgaagttttgacagagccgtaaaaagtagaacaaatcaccggccagagtgcaccgaacttaaaaaagaaatattttgtgctaaagtgaaaattacataacaactaccataattccaatgaggaatgaaaaggtcgcaacagtcagggcataataatccaccacctgaagaggaagacagtgttattcagaaaaatggaattgtatgactaacaaataagcagatgccgaacagaatagcggaaaacaaaatacattcggaggtgctcagcggcataacggcaagaatttggtaaatatgtccggtggtgttcgcgaaaaaaattatttggtatgagataaagtgaaaagtttcatcccttttatacacagatagtcagtgctggacaacggaaaaattctaaaatccaaccaaagtgattagggtcggaaaaaccgattccggcatctattttcgcccaattcgaaccccgaacccggaattcgaacaaaaaagtcaaaatccgttttttaaaaaattcacattttacacacaaaatcgcttcacaatgccacgacgacgactcgtatgaccaaaaaatgccacgacgacgactcgtatgactaaaaaatgccacgacgacgactagtatgaccaaaaaatgcaacgacgacgactcgcacaaccaaaaaatgccacgacgacgactcgtatgactaaaaaatgccacgacgacgactagtatgactaaaaaatgccacgacgacgactagtatgactaaaaaatgccacgacgacgactcgcacaaccaaaaaatgccacgacgacgactcgtatgaacaaaaaatgcaacgacgacgactcgcacaaccaaaaaatgccacgacgacgactcgtatgaccaaaaaatgccacgacgacgactcgtatgaccaaaaaatgcaacgacgacgactcgcacaaccaaaaaatgccacgacgacgactcgtatgaccaaaaaatgccacgacgacgactcgtatgaccaaaaaatgcaacgacgacgactcgcacaaccaaaaaatgccacgacgacgactcgtatgaccaaaaaatgccacgacgacgactcgtatgaccaaaaaatgcaacgacgacgactcgcacaaccaaaaaatgccacgacgacgactcgtatgaccaaaaaatgccacgacgacgactcgtatgaccaaaaaatgcaacgacgacgactcgcacaaccaaaaaatgccacgacgacgactcgtatgaccaaaaaatgccacgacgacgactcgtatgaccaaaaaatgcaacgacgacgactcgcacaaccaaaaaatgccacgacgacgactcgtatgaccaaaaaatgccacgacgacgactcgtatgaccaaaaaatgccacgacgacgactcgtatgaacaaaaaatgcaacgacgactcgtatgaataaaaaacaataactatttcgagattcttcgtcattaaaaaatcgcaaccctacttattactagggcttccaattatgtatatggaaatccattttttttcatggactgtgggaggcctgaaacgcacgaaaaccatctttttagcttggtttgaagcttctagtatgaatttctatatccattttttccatatttcgcgatttatgtccatatttttggaagccctatttattaccctagtgaatttttttctaagcgaggaggaaggaaacaaaaactactgtatttccacattctataaataatcgtttcattgataattaataaatgttcaacaaaaaagccaataaaataaatgttttatataattggaacgaaacaattaacaaaagcatttctgagagaaaaaagcacaacaaattgagatagatcatttctcaaatagaattattcaatcattcatttccgtacacttaatcagcagacgacatttccgttgcttttatccgcttcttcttcttctttttcttcttccgttggtggcgacaatggcctaaaattaattaaatattttatttttcgataaaattcaaatgctattgctgctgctcactcaatggatttatcaaaactccacagatcaaatctgatactgttcaaattggcactcggatttaagctgtctccccatttaattgctggcaccctcgccgtctccccaattgggcaccgttgcaacagccaattatacacatttacgtcgaattcgtcgatctcctgtttcagtgtcagcttttcattcgtccgtttgttcaccaattcaaatggttcagttggaattgtgttcacatgaaaataaagttgaatattgtaactgacagaagtggtggcactgataaatgttaaacaaatttggaaaaacaaaaacaatttatagaaaatatggctagacacacctctttgaagttgttgacccattcgagattctgtggaccaaaataattattgcgatacaatcgcttcggttggccatttttgctcggagtgtgaagccatttgaccaaagcttggccagcagttgcatttggtccatcgtcagcaattccatcggggaacagttcattggaatcaattgaattcaattggtcaagaccagtgagaattgtcggcgagatcagacgacgcaaattgtcaaaggcatcgccactggtaaagcccaactggcgaatgtttgccgcaaaaattggccaaatttcatgggcgaaaacatcccaaattggttgttcatttgaaatagacaactccaaattggtgccacttctgtcccaaatttgtttgttgacacggataaatgtgagtacagaatggtcaatgtaactgaaaaggggaaaaatgaagaagatgaccaaccatattaagtagggttgcaaccccgacgtcggggttggaagtgtcggggtcggggttgccaaatcgttcggggttcggggtcggggtttttcaatttttgccttatgccaaatagtcaaaaaactttataaatttttgcttaaaaatatttaaatttcgtaataataattttatgtgctttttatattttttttatcataaatattttgtatagaattaattaaaaacacatacctaaagcatttaaaatggccaattttcagcgaaaatctgtataaatcttttttttttggtcttttttttgcggcgctctttatctaaagacgtttaggagaaatgggttcggcggtgccgataggcgccgccgtgaaaaattttgaaaatttggatgggcctgttaacagattttgtccaaaaaatgatagattttttcgattttgggccaattttttttaagaaaaaataggtttttttgtggcgccggcgatgccgataggcagcgccgggtgaattttgaaatttaaggtctattttgtaacatattttcaccaaaaatttatgaatttctggtaaatttttattttttttcttttttttgtaaattttcatgatttagtcaaaaaattgaatttttattcaaagaaaataaaattgggttcaatacgtctataaattacgggacaggacgttttcgcgtggccgttttcgcgtggttgcatataaaagagaagtgcaaaagcaactctaagcacacttattgatgtcaacagaaattcaactataagaaaaaaaaatttacaaaagcctaaacttaggcctagtctaacaataagccattgttcgagttgcctgtgtatgagttgtcatgataaccttaggtttaacaacgaaatttatagttaaaaactttactgaatacctaacaaaaaaaaatagtttttctcttagttattaggacaactataataccatgagaccagggatggcacggaattccgatttccgaaaatttttggggcctcggaatgccatccctgccatggacacaaaatgtcatgggacgcgtaaagtgttgttgggactcgtaaaatgtgatgggacgcgtaaaatgttatgggacgcgtaaaatgtcatgggacgcgtaaaaccgactagaaccaattttaattattttttccgtttgacgcacatccgaccaaactgacaaattattgtagaagatactagccgcaagaaataaaaaagttaagaaatttgtccgaattcgggttcgggattcgaaacatagatgttttgcacaaatccgaccaatttcagtcctaaacaggtactcacgcgaaaacgtaccccacgcgaaaacggccacgcgaaaacgtccccacgcgaaaacggccacgcgaaaatggccacgcgaaaacgaccccgaccgaaatccaactgaaacatggaaaatttgtaatttttaaaaattttccttaccgtctgttcattgtttgctgcaattttagagcacacttttccctttcaagaagtactgaaatttgaagatatgtagtattcaagcgtaaaaatgttcgatcgtccgccaaatcatgggtccaggatctttgctttttgaaaaatcgattctgaggggtgcattttttgaaaaaaagtaacgccaattttttgttttgtttttttattgctttttcataataatgtttctgttaaagcagaaatattttaaaagttttttaaaaatttcacaagtcataataattgtttaaaagtcgctctaaatcgaaaagtgatcgaagaaaatgtgttttttgcgcttatctcagcatatgttatccccccaaaaaagtaggtgaaaacctaaaaatccgttccctgctaatatcgatgattgaaaaattgttaattgctaggaaactgaggcggactctctgatcggggttttccggatttggtaattctcaccgatcgatgcacgttcaaatgcacgaaagcttgcctttgatttgaatgttgcttgcttatttgttagctcggattcgtatgtacttgaatggcaagtacgtacttgaaattgactctcatgcgagaaaatttagaaaaactctcgagatttttcgtcactaaaaatcgcaacctttcttattaccctagtgaatttttaattatttttttctaagcggggggatgagtgaacccttaactacttaatggatttccaaattctctagataatcgtttcaatcgaaaattcatttctcaaatacaattaatcaatttaattattcatttccgtacacttaatcagcagacgacatttccgttgcttttatccgcttcttcttcgtctttttgaaaggttaccaaaatgctttcttacgcacaacaattaagaactactgaatatataaaggggtcaaaaagactttttggatgcacagacggtgaggaatttcattttcatttacccatgctgtttttcaaaagaaattgcttaccgtctgttcattttttctctattctgcatcaaaaatgtcttttcgacctctttatatatctaccaaaataaaagtgagagatttgaaaacggatgaacggatggggggagattaaaatgatttgttggccaaaataatggccataacgcattaatttatgcgtatataaagagagagtaatggggaagggtgttttgctgattttgttcaatacatacataatttacacggcttccttatttttgtaaatgcatatatttttttcctggattctccgtatcctaattgctgctcacccaatggatttatcgaaactccacagatcaaaagtgacattgttcaaattggcactcggatttacgctgtctttccatttaattgctggcaccgtcgccgtctccccaattgggcaccgtttcaacagccaattataaattattccgttggataatgcttcgatctcctgtttcagtgtcagcttttctttcgtccgtttgttcaccaattcaaatgattcaattggcattgtgtccaaaagaaaaaacagttgaattgtgtaac

SEQ ID NO: 45570 - DNA, 5670 bp, Heterodera glycines
  Genomic contig location: Contig_ID=SeqID_3545; Location=1..5670; Strand=-
  SCN-specific regions: Sequence locations=1-119,141-1169,1194 -1222,1244-2032,2054-2480,2575-2580,2602-2611,2654-2654,2718 -2768,2929-2929,2981-2982,3009-3036,3117-3135,3157-3182,3204 -3474,3497-3573,3595-3602,3624-3727,...
  SCN-specific regions: Sequence locations=...3784-3869,3894-4021,4043 -4100,4123-4198,4223-4275,4297-4330,4352-5232,5254-5670
  Gene Ontology: Mol. function=SH3/SH2 adaptor protein activity; Cellular component=nucleus; Biological process=signal transduction
tgaaaaatagtgacgacgccaaaatagtgatttttaactactattttagtgacggagtcgccaaaatagtgatttctagtgactgataatgacatcagaatcgaaaaattttaatgcagaacactttttattataattttagtaattttacaaaaggaaaaattttgcgttagtgcatcattaatgcagtggactttggacaagtacagtcgattggcagacacacgtaatatgcaattggtaaatggttgtccaattagtgcgttgaatgtttcatttgaccatttttagacgatcgaaaggggtccttttgagcagttatttttacaattggattaccctatcaaaatgctcttcgtttaccataacggaaaccaattagaaatgtttttgcttcatccgctcgcttttccccatgatttggtgcgcagagaccagcgaattttgttctgcatcaaagaccaggtcagaataatattgaaattgattccctttctataattttagaatgatggaaatgtttctgtgaagtttcgcgtccgtttctcatctccggactctatgaataatttttgcgctacaatcggaaaattcatcggagttaaggccttcgatgattggaactgtcgcagctcctcgcctttctcagtcgatttgaattgttcgtccgttactaacacgaatcgcccaataaagaatggttcaaacgaaggtgaggagagatacccaaattaatttaaggattcattggcggtcacttcttttcaattgtcgtttagcttcctttgttgttgaccccgatttgtcgacgtcctccgtcagtttgctcaactgctttagccaaagcagcaaattttcttcccaagacacatcgacgtttgacattttctcatacgcaagcgccggaacaaaagaaacttatcgatatggtaattgacaagaaaaggtttctttctaatgttaagccagtattaatagagcactcagacggttgtggatgagaacaccgaccctaaccaaaagtcaaaagcccctccctcctcttccacccacccctctgcgtcttcgtcaatccatctgcacattgaaaatctattctcatcagaagctgtgcacgcatttggtggagtattgcgtcaattggcgaatggaaccagcaaaactgagacgagggggaggaaaaggaagagagacaaagggacgaaaccaccaaagagaccggtgagaaatgacaggaataaaacaaaggaacaaccaatgtttttgtcagttgaattcgtatatgctgtggaacacggatggccgtaaacgcagcgcaaaagagtggcgagaattgccagcagaggaaaaggaacactggaaattgtgcgctgccgtgggaagggtccgttacaacgaacaggtcgagcaataaatagcaaacccaaaccagaggacacgaatttatgtttttagatggaaacctataaaaagtcacagcaaacatgagggatttggcatttaattggtatattattgaatttggaaaatttaatttgccatggtgcttttcatttcactttccaattgttgtattttgtgtgaatgtgtttcaaccaataaaatggcaaaaggttatataataataaaaggcgaatcagtgtaatctcttccatccttcccatccaatttcactgtggatacctgaataatttgtttaaaacagaaaatgacttattgagagaaatagctaactgtaagaggtatacaaatttcctaacctttttcatctacgcattttgaccggaatccccgttgacaaccttcatgatctgcttaaaggatccagccgaaagaatctcagaaactggtctgagggagtcatcagtcaaatgacaagccatcacggaatctttctgtttctgttgtttgtccgacccattgctttcactgacaacgcaagtaacgatggagcccggctgttttccctgttgattgccaatattttcaataaactttttcacacacggcccttgtttcgacttaaaaaggattggttatttgtaaaagaaaatagaattacttgacagttatcaatgggatggacatgtcccaccggcagcaataaattcaattcgtcatctggaacatcgccaacttgcgcgggagtaaggacaattgaacgctttacactttgccatgactaaaagctttctccttttttgtagttagtatataaaatatattaccgcttcatatacaacggcaatgttcggctcatcggtttcgtaaatgtttgtgagagaaaactcgaaacaagccctaggagaaaacattaaatagtgacagttccgccggggatccatcgttgggtctctttcctaagtcaaacttgaggctaccatgaatatctttagctcaaaaggctttcatatatgactgtgtacctgtctgcctctttgaactgcttttgccaccaaacaaaactgcagattcccttagaagcccagcttgcaatagttccatgaaaaacatttaatttgacagtgcctctatatggtttgtttggcaagtacttaaaacggagacattttgtaggtaaattaaacaaaaatatttactgcccacttacgtcgtttaagttgatcaaagtcttcatcagagtgcccggcaaaaaaggagaacaaacaaagacttgacgaggttgctcatcggagacggccacatcgacatccatctgcgaaacggaatttattttaagtgtattacgacgaattgtcaccgcttaccatccaatccgacccgcgcttatccagtccaaataagccagtcccgcccttcatcatacaagtgactttcgacgctttcgaatcaacttggacagtgacaacggagtcttctgactgaacagtggtcatcttattgcactgagattttgacatgtacgcatgctgaagcggatccaaagtgtacaacgaacgagggacagggtaaaggatctaaaaacaaaaggatggaaatgtttaatttaaagtcggtctattattattatgcaacctcgtcaggagcaacataaacaacattggcaatttccattccaaagtcgttaggaaaggacgaaacgatcagagccggtctcataatgccattttcttgattcttttttccccagaattccattttgggagtttgtgaatatatggaagagaaaaaagcaaattaaattatcctaaactattgcaaaattaaaggcaataatgaaggtgtttggcgtatgtatggagtagacccaactcatcttacgcaactcttttatactcaattcatccataataggagtgtttcactatgaggaagtggatcatctgatcaagttggataagtttttttttgatcagcaataaaagttagaacagaatgaattatttaggattttaggcccacaaaaatagttttgtaattgatgctaaacatatgactagggatattatgatattatttttaagttataaaaaatccaaaataggtgtaaaaatggagaagtggcaattagagctcggtattttgaaaaaagcctggacctggacctggattccatgttggacctggacctggatttcctggacaaaaatccaggaaaatccaggctcttcgagacctggatccaggcctggacctggatttttttaaactcattttaaaaatcaaaaaaatgtttgaaaaattcaattaattgcttgggaacatctaaaaatatctaatttacaataataatttgtttttaaatatatttaatcattttttgaaaacttgaaaaaatatcggtcacttgaaataataaattctaaaattttgtccaggaaaatcggtactttttcactttacgccacataaaataatttttaattttttttctggagttttcggggtcgctgatcatgaatatgacgtttatttcgaacaattccgaaatccggacccatactcgaacaaaaaatcaaaaatttaattatccaatttatctttttcatctaaaaacgatttaaacacatggaaacaaactgaaagctatccactcatgcaataaaagatcattaaaccatttttagacgaaattcgaaaaattaaattttagattttttgttcgaatttgggtccggatttcgaaattgttcgaaatgaatgccatattcgtgatcagcgaccccgaaaatcccagaaaaataaaaatatttttttttatgtggcgtaaagtgaaaacgtaccgaaattccaatccatctaattttaccatttatttttggtcaaagaaaaagtgggagaaatgagttttttaatgaaaagaaaaagcttcttaaaaaacaattaaagcaagagattgtgttgagttttttgattcaagcggttctttttttctttgtatttaaccggatttggacataattgcgaaattcggaaattttttttaaggttcgggattttggttgatataatgtaatagagtgatcaaagcccccttgaaatttatcttcctgaatttttaggcgtggaagagttggacgcgtcaaattttgaccgcactgtcctacttgcactcgtgcgacccgcccattgtgcacgccaacctcacgtgcaattccgtgttcatccaacagaacggactggtcaaaattggatgcggtaaatgcctattcagtcacagaaaaaccgggtccttacccaaatttttcgaaaagtttttttcccttagaatttcttataaacccaatgaattacaatgcccatgttccatatggacgttcttagcacactttcccatcaatttttagtcgcgccaaaaaccattcaccaccatgtgaagacattccgtgagaacatcaaaaatgttcattatctggcgcctgaatacgaccgtaagtgtttgttatgtttttgaagtgctttacatggggaacaggattacactaatgttattagtaaatttttattttgttactttttcgaattttctccgcccccccccccccccacttggtatttgtcaatgcgatttttttttaatttaaaaggttttattacccgaaataatgaattgatttttttccatttagaccaaacggagacgacaattcaggcggacatttattcgttcggagtctgcgctcttgaggtttttttatttttaattaacacttgctatttcttcatcaatgggatgggggaggaagttgcagaaaaaaattattccggacgaaaaaaatattttaaaaaattctggtaacgtctgtcgagccgaaattttagcatgtttgttcaattccccccccccccccccctcaacattggacgcgtttttttttgcattcttgttgccaactcggacacattccacccctttgcagatggccaccacgggtgcactgcaaagtggctgtttcaacggtgctcctccgtccagcatggcatcgtccgccagcgtcgccccaccctccgccgcctctttcgcgtcgcttccgcttcatgcgacggctgtgcctttgccttcaaccgatcgggacagaggagcggtgaccgaaaatgaaccaccaaatggcaccggttgttccctggcatccgcagcctcgaccggtacactgcaggcgacggtcagcaactggccaaccgcgactgcatcagctgtgacatcattac

SEQ ID NO: 45571 - DNA, 1650 bp, Heterodera glycines
  Genomic contig location: Contig_ID=SeqID_3549; Location=2209..3858; Strand=+
  SCN-specific regions: Sequence locations=1-175,197-519,544-858,882 -1650
  Gene Ontology: Mol. function=cyclin-dependent protein kinase activity; Cellular component=nucleus; Biological process=mitotic cell cycle, embryonic
tttttaatggatataaaaaccaaaaagaaccgtcgatatgaaaaaattaaacatttgggtgaaggtcaggtaagtaaaacaaaagatacaagaatagttttgctcttttaagttcgcaaatgtttaccaagcaaaggtaaataaataccagaaaatggcaaatttttaattgacattaaaataaaaataggtatgtagacttgtttaggtaccttttaataaaccttttataaaacgacatatttgtttcatattttaggacattgaaaccgggacgatagttgctgtgaagaaggtgcaactctcagcattttattgcaattaaattcaattatggctttatagatcaaacttggctcaagacatgaagcgcgcgatggtgttaataggacggcaattcgcgaaatcaaattgttgatggaaatacgccatgacaacataatcacacttttggacgtgattggtcacagaacgagcatccaattggtattcgactttatggagacagatttggaggcgagttatccaaagtgactttcaaccgcattttgccttatgggcacttcatttagcgttttaagaagcggggattctcccctttctcattgtcagccttccctcttgatgagtttcccgtgaataaattttctcaggtttagaatgttatcaaggatagtgaaacaattctccagcactcccacattaaaaatatgcttttgcaagtctttttgggccttgaacaccttcatttgctcttcatactccaccgagtaagcttttacaatttatttattcgttaaattttatttccaggatttaaagccaaataatttgcttatgaatacttctggtcgcataaaaattgctgattttggccttgcccgttattttggctctcctaaccgttattacactcaccaagttgtcactcgatggtaccgagcaccggaattgctctacggggcacgggcatattcgacgggtgtggacatttgggcgatgggatgcataattggcgagctccttttgagggtgagttggtttcgcctttgagtcagttttgacgatattattcctttctaataatttttttagggcgcgaggtgtaagtctgaaaacggttttttttcaggcgcacttttttcaaaaaaattttgtcttttaatccgtttttcggcactgaattttacttcggagtccgtaacatcgtcttttaggttcctgtttttcaaggcgagtctgatcttgaccagctgatgcaaatttacaaagtgcttggcattcctacggaaacggattggcctgtctgtctgtttttttaaatttgttttaaaatcgcttcagggcatgacttctcttccggattatgttcaaatacaaaattgtggtccaggacatgaattgactgccgtttttcctgccgcgagttctgatctgattgagttaatcggccaatgccttcgctttgatccgttgaaacgatggaattccacccaagcacttcaatccgactattttcgctcccagccattcgcatgcgacgactccgaattgccggttgcaggcagacgaaaacgaaaacagcaatcgttgagggagaatgttgaagcgggtgatgagccgccgtttagtcgaaggcgtttggatttt

SEQ ID NO: 45572 - DNA, 1653 bp, Heterodera glycines
  Genomic contig location: Contig_ID=SeqID_20327; Location=270..1922; Strand=+
  SCN-specific regions: Sequence locations=1-91,113-955,977-1155,1177 -1402,1424-1653
  Gene Ontology: Mol. function=alpha DNA polymerase activity; Cellular component=alpha DNA polymerase:primase complex; Biological process =metabolism
atgttttttggcgaagagattactaaaattccgcgggaagtcggcaaagaggacgtgtgtaaagcaatttctcatcaaattgaggccattgacatagatcagtgcaatttgaatatgtatttgaagcctgacacgggagtgatttcacttgaccaattccaagcgatgggttccaaaagattgacaatgctaaggaaactcgaaatgcttaaagaaaaatttggaaatgccaattcgcaggatgagtacaaaaaggcatttcgagaggttgttgcatattgcgttgcgttatcatcgttaattattttatcaaggacatcggtgctctgatgccattggtaaccaatttatgcgtaaatgccggactcaatgaagcaagaagagaggaccgcatttcgcattttatacttcgtcttgctttttgccatattccagaacaatccgattggtttgttcggttggaaaccgaactttttcgcatgcgctttcaaaacgagacgaaaaaaaatatggcactttttgtggcatcgatcggcatacaattgaaccaagtaatggtggtttttttgcgatttgttgttatctcccacccctcacagtgacggtcccaaggttaagggtttttggggcctacgggtacccttaggaaaaaaatttttttttgccattgttttgaataacggcgcctttttaaatcagataaacgaagtttaaaaatttattattctcgcgtcgtttttaggttgacacttctgagagagagcagttagttgacgaactttgccaagcgctgtcactgagtgctgaagagatggaaggggtagatttgtacaaagtgaacgaacagcaatttgttggtcattattttctcaatgtttactttaggttgatttcgttgatgttttggaattgctttcctcacaccgaattctgttaaaaaatggcaccgcttacatttcctcaaatgaactttttgcatttgtggtgcctcgttttcgtgacaacctttccgcgtcgatgactcgagccaggaaagaaatcggatttttgcaggagaatgacaggctagtgcccctgatgaggagcatggtccagggaggagcaatgtgccaaaatgagttcgttttattttttattcatttggcataactgtgtcaaatttagaaacacaaatgtcgagcaaatcacttcggacatgattgattcactagcccaaagctcattcccactttgcatgcggcaaattcatttggttttgcggcgggagcaccaccttcgacattttgcaagacgacagttcggccttttcttaaaagtttgttcgttttttgacggatatttacatgtattttcagggcgctggtctttcgctcgagggatctttggaattttttaggatggaattcaccaagaaaatgaataacgagaaattttcaaaagaatactcgtataacattcggcacatgtacggaagagaaggaagtcgcatcgaccaaaggcctttgtcctgtgcctccattatccttggcagtttaccaacggcgctcgattgtcacgggtgtccgtataagtgagcaggcaccacgggtcaatttaaaaatgtgtaatttcttgaatttatgaaagatacccaaaggcttaggatatgaaaaa

SEQ ID NO: 45573 - DNA, 683 bp, Heterodera glycines
  Genomic contig location: Contig_ID=SeqID_3553; Location=261..943; Strand=-
  SCN-specific regions: Sequence locations=1-683
atgctggacgaacgagaacagcagcaaatggaggaggaggaggaggacagctgctactgggtgaccgtctttggcttttctcctgaccatttacaacacattttggaactgttttctcgccacggcgatataatggcacaaaaggtcaatcgctaaatggcaaaactagaaaatattgccaatatttgactttcagactccaaaacggggcaattgggtgcacattcgctactccactccaatccatgcaaaacaggcgttgggcagaaacggcagcatttttgaagggcaaatgatcggcgtggttccgtgccaagaccgcgtgagtaaatggctattgtcgggataagttgggatctaaagcacttgtttaaggaagcgctggaagacgatttgtcactttcccgaagtgcaactccgctcatcccgcgacattctgtgacccctcatgacacttctcgacagaacggctctttgttggacggcaactattccatccatgacgactcacaaatggtcccttcaacatctcaatacaaaaccaatggacttccaaggtggcgtagttttgtcccgattttaatgccacctttacattcagccgggctcgactcagcatttcgtctcgtgccggaatgcgtccattgaatgccagtgccatttcggacggaccgaaccaaagt

SEQ ID NO: 45574 - DNA, 765 bp, Heterodera glycines
  Genomic contig location: Contig_ID=SeqID_3555; Location=763..1527; Strand=-
  SCN-specific regions: Sequence locations=1-171,201-209,231-487,509-765
atggcatcaattgtggacagcgcaaaagtgaacaattttggaattggcactgttgttgagccgattctcgtcaataaaaatggatccaccggcggtggcggacggaggaaaaagaaaagtgaattcgaaattgaaatatattctaatttaatatgcatgaaaagattgaacatttaaaattattttaaaataaaataattcgttacaataaaatctctctcttttttatagctctgttcggcatttcacaagcagtgcatgccgaacatcctcaacagcaattgtccgaattcgctggtggcatttcgcctgtcgacgccgtgccaatgccaaccgcggccaatgactgcaacaataattccatcgaagacattcaatcggaccgccgaaggggcccaattgagtgaggcggcacaatgagtggcatttaatattttatgcctttggatcttattcaaaataattgggttttggggttgctattaagaaaatgcttaaaaaatgggaaaacgcacttttggctttttcagtccgacaaacttcgaccatttggtccgtctgagtgagctcatccgttccatggccgaccttggcactttgcagcccgagttcggcataatctgtggctccggattgggcgcaattgccgaccaaatggagggggcgcggattttgcctttctccgaggtgcccggctttccacagccgagtgttattgggcacaaaggcaaaacaaatcagaggcgattgattaattgtcgatga

SEQ ID NO: 45575 - DNA, 2634 bp, Heterodera glycines; identical to SEQ ID NO: 20342
  Genomic contig location: Contig_ID=SeqID_20342; Location=1..2634; Strand=+
  SCN-specific regions: Sequence locations=1-539,561-767,789-957,979 -1867,1889-2010,2052-2442,2465-2477,2500-2634
  Gene Ontology: Biological process=embryogenesis and morphogenesis

SEQ ID NO: 45576 - DNA, 1670 bp, Heterodera glycines
  Genomic contig location: Contig_ID=SeqID_3560; Location=514..2183; Strand=-
  SCN-specific regions: Sequence locations=1-238,273-394,418-758,797 -797,822-856,878-1189,1211-1640,1662-1670
  Gene Ontology: Cellular component=CCR4-NOT complex; Biological process=sex differentiation
atggagaaattgctatcgccaaatattgccaatgctcagtcgacctcgacaacgacaacttcagcaacagcgtcgtccaataataaagaagagaatagcaaagaaaaggacgcggaacaaatttgtcactggattcgcgaactaagggagcacgaaaagcgagaaaatgcacttttgcagataaggttaggttggggagttgccgttctttttaacgcaatttaaggcagactctgtcaaataaaagccaaaacaaattttataaaaattttggatgaatgcgacataataaaaaacatcctgttaaaatgtgaacagttttttgtttttattaataaaattttagttcccactatccataaataaaaagaaaagaactgatgaatttggtagttgttttttccaaattcaaaaatccgttttcaaatgcctaaataatcacacattttgttcagcaaacgtcgcgagggagtggaggacctcgccgtttggttgtggttctcttatgggacagtgaggtgctgctccaatttgattccaactgaaactgcatttccttcggcttttagcgtgcttctccaagagatcattagcatttacccgttcattttgccgcccactctcaccgctgcccagtcaaaccgcgtctgcaacgcattggcactaatgcaatgcattgcctcccatcggaacacccgcaaacaatttctggacggtaaatgaaatacaaattaagggaaatctgatcagacaatgacatatttttttctattaaaaatctaaaattaattttattggaaaggaagttagaaaattaaattaagaaatttgtttttcaaaagtttctaaggggggtggggcgatgggagaaaaccaaatactcccgttttcagtgcatttttgggttccgttcacccgaaggagttagtctgaccattttatctatcatcaacactatgtttctttggatgttttaccattctatcaaaatttattctttcaatgctggataattcgattgttttctttcgcttactcttttttctttccttttagctaaggttccgttgtacctttaccctttccttcacaccaccagcgattctcgtccttttgagtacctccgtctcacttcgctcggtgtccttggcgctctggtgaaaacggatgaaaaggatgtacgtatcgcccctttttgtgtttgattgtttggaattcgtttaggttgtcaaattcttgctgtccacggaaatcattcccatttgcttacgaattatggagcagggcactgagctttctcgcactgtcgcaacttttatacttcagaaaatccttctcgacgacatcggcctttcttatgtttgtcagacgtacgaacgtttctcccacgtcgcaattgttttggtgagcgaaacgatttgaattttagttaatttttaggcttttcccattttctcagggaaaaatggtcattcaattgtcaaaagagccttcacatcgtttgctcaaacacctcatccgctgttatcatcgtctctccgaaaataatcgtgctcttcaggcgttggcccaatgtctcccggaccaacttaaggatgacaccttcaagaatttgctcgaccaggatcgcccaacaaagcactggtggaagatgttgatgaagaatttaa

SEQ ID NO: 45577 - DNA, 113 bp, Heterodera glycines
  Genomic contig location: Contig_ID=SeqID_20402; Location=1724..1836; Strand=+
  SCN-specific regions: Sequence locations=1-63,86-113
atgatggaaattacagtgaatgatcgtctgggcaaaaaagttcgaattaaatgcaatccgaccgacacaattggggatctgaagaagttggtgtcaactcaagttggaaccaa

SEQ ID NO: 45578 - DNA, 584 bp, Heterodera glycines
  Genomic contig location: Contig_ID=SeqID_20423; Location=991..1574; Strand=+
  SCN-specific regions: Sequence locations=1-269,308-381,403-584
atgtccaaccaaaattcgtccaccggtggcgcggacagtcggaaaattgaccatttgttcaacaaatatgctagaggtttgttcattttattatgatgataattccggtgtgcccttggatcgtaaaaaaataacgcggttcggaaaatttgaatttacaactttttgttcgagtttacattagtagggattagcattggtcaaaatgttgtcagagtatcgccccgtgatcaaaaagtttccatgacttattatgacaaaaatttagcaaaaccaattgaattttaaattttgttttttatggtccatcctaaggtcgagactatccctaacaaaaaaaaatttttttttcctaccccccccccccctctttttcagatgcaaaggacaaagcgcagaaaatcggacccgatcggatcggtcccaatggcatggtgcgtttcttgcgcgacttgaacatcgagccaacgagtcgggcagtgatggttttggcgtggaaaatgggtgctcaaaaacagtgcgaattcactgtacaggagttccgcgacggaatttccacactgatgtttgtgtctttattttaa

SEQ ID NO: 45579 - DNA, 1831 bp, Heterodera glycines
  Genomic contig location: Contig_ID=SeqID_20441; Location=1..1831; Strand=+
  SCN-specific regions: Sequence locations=1-5,42-671,694-925,947 -1480,1519-1831
  Gene Ontology: Mol. function=zinc ion binding; Cellular component =nucleus; Biological process=neuroblast cell fate determination
aaaaatggggaatgcaagttttgcctgtttgtttgttttgatataaattaattgttccctcctcccggtgcacagatttacctctgttttgaatgtgtgccgccgcgcaatctgtgcaacgacgtgcgcctgtacaaccaccggacaaaattccatcgtggccaaaattcggggttcaaatgcaacctgtgcaatcagaagtttttgacgccgcgcaagttgcgcaagcacaagaaaatgtcgcatgtgttcaccaagacttaccagtgccatttctgcgaggaactgttcatcagcgaaacggcggtgggatatttttttttacacattttatgtactgatgccataattattgggatttggtacctcatttaaaattgaaatgtcaccagtttggtaagcatttattgttaccgccaacttcaaaccttggtatcttcatttctaaactcaaatgtcatcagtcggagaatttcttggtacccccattttcaaatcgtggtacccctattttcaggtcttgctaccttccttgataaaatcgaatgccatcagttggcaaccatttcttggtaccccaattttccactattgatacttccattttcgtaaattcaaatgctcattgtttttttatccaaaaatgccattttcccatgataggtgaccacccacgagcgcatccacacgggcatcatcaaatttgagtgcaaaatttgtgactacaaatgcaatcgtttcctgaacatggaggaccatgtgaaggaggaccatggctatctgtgctccatttgtcagagcaaactcagcgaatggggtgacctcaaaaatcacatgctcatggaccacggcggctatctgtcgtcagagttcaactcaggtcagactggacaggaccggcggcgtcatttcaatctcttcctcctggtgtggtggtggtggtcaggcaggctcgtaaccagaaaaacgaaaattcggagaggagttagttccatttttgtcccaacaaatttttgcggtaattttcagtatccattttggtgatttttgtttcaaaaactgagagagtaaccaattgataggcgctgccaacaaaaaaaatttttttttaccaaatttgaaaaaatatttgacagaaatatcaaaaaagaatgaaacctcccaccttccatggttatgtgcctgctttttcttgggtcatatcattcattatttattaatggcgttttgaattttcggccgatatctcatcatcgcttcccatcttcaacattaccaagaaccattcaattcattatacgattttaaaaaaatggattttatcattttaacaaatttgcgcattgatcaaatagccagccaaagagtgctaatggctttgatcgcgctgctttaatgtgtttttaaggaatttgtttattcaaaacccatttcagccaaccaaactcttacggtataccacaatgggacgaggccgaatttgttgttgttgttgttgttgttgttcttattgttgttacccacccattgggcgaagcgaacatttcttattattacaattactgtcatttaaggaaaaaaaagacaattttaaccgctcattttttattcgcttaatcacaaacattttcaacaaatcttgttacacatatattacttttttttttacttgtttcttggcgaaatttttgtgatctgacatataatcaaccggcacaaatcccatggtggaaaccgccggatgggacacactttcagagactgtgaatggagatgtgctgtttcagggtacatcgaaagcccgcgcgtttggctgatgttcaagggggac

SEQ ID NO: 45580 - DNA, 808 bp, Heterodera glycines
  Genomic contig location: Contig_ID=SeqID_20460; Location=417..1224; Strand=-
  SCN-specific regions: Sequence locations=1-338,360-403,438-458,480 -533,555-624,646-808
  Gene Ontology: Mol. function=ATP dependent DNA helicase activity; Cellular component=chromatin; Biological process=DNA recombination
atggaatggcgggaggaaaacaaagcgcaaataatcccgggtgttctgttcgtcgacgaagtgcacatgttcgacctcgagtgcttctccttcatcaaccgttacatcgaatcggacctttcgcccattttggtgatggccaccaaccgcggcattgtgaacattcgtggcacttccgttgagtctccccacggcgtgcctttggacttattggaccgcagccttatcatcaggacgtcgagttacaaagaaaatgtgagtgtttactccggcggggaaacaatcctttcgattctttaaggcccgaaaattaaaaaaaacatttgcttgtaaatataaaatccaaaacttgaaaaattaatgcaattatttatgtttaatacctttctttattggtcaatcagaattgggccccgaaaaagaaattattaatttagcgttgctatccaacaacaattttggaattttgaccaaaaaccttcaggaaattggagagatactgaaaatccgtgcttctgatgaactcgttgaaatggaggatgccagcatcgcagtgctcgtccaaatagcattggaaacatcgatgcgttactgcatgcaactcatttcaactgccgacattttacgacagagaagaaaaggcgaaaaggtctatttacgagggttaaaaagggaacacaaaatcagacaaaatgtttaggtcactgaagaagatgtgagaaaggcgagaagtcttttcatcgatgtgaagcggtgcagaaaagagatggaaaagcacggggacagtttcatcaacgatttcaactga

SEQ ID NO: 45581 - DNA, 1886 bp, Heterodera glycines
  Genomic contig location: Contig_ID=SeqID_3588; Location=17..1902; Strand=-
  SCN-specific regions: Sequence locations=1-926,948-1656,1679 -1703,1790-1886
  Gene Ontology: Mol. function=structural constituent of muscle; Cellular component=cytoskeleton; Biological process=regulation of striated muscle contraction
atgtccaatccatcattttttcaggctcgcaacgtgcacaaacagggctgcacgttgagctggaaaccgccagaagatgatggcggtgcgccaattgtgggctatgtagtggagaaaatggacacctcgcgcggcacttggcaagaagttggccaattccctgactgcgaggccaaggtcaaccggctggtgcccggcaaggcgtacatgttccgtgtcaaagcggtcaacgtgtacggcgagagcaagccgttggagggggacaaggaaatagtggccaagaatccgtttgatgtgccggatgcaccggacgcgcccgcgatcatcgactttgatgagaatcggattgacgtagcatggaagccgccgacaaatgacggcggcgcgcccatcaaggagtacattgtggagcggcgcgagaagggctcgtccagctggattgaagttgggcacacgcccgccacatccttctcctgcaccgggctgcgcaagggccaagagtacgagttccgtgtgctggccgtcaacgaagcgggcccgtccgcaccgtcggccccgtcagcgtcccaaatttgcaaggcgcgcttcctgaagccgcagatcatcaccgcgcaacgcaagtggaaagtacgcgccggcaacacactgacgctggacatcgaatttgttggcacgcctgacccgtctgtgggctgggtgaaggcaggcggtgccggcacgctgccgcccgagctgatcatggacgtacgccgtccgggcaacacgtcaatcttcttcccggccgcaaagcgctctgagaccggcatctatgagctacggctgaagaacgaagtgggcgagacggaaggccactttgaagtgctggtgcaagaccgtccggcgccgccgaaaggaccacttgtggtggacaacgtgacgcgcgactcgtgcacattgtcatggcaaccgccggaggacgacggtggctccgaggtcaccaactatgtggttgaacgccgtgatgtgggcagccaagtttgggtgccggtcaacaactttgtggtcggcacaagcagcaccgtgccgaagctgcaggagggccacgagtatgagttccgcgtctgtgccgaaaatgcgtttggccgttccgacccgttgaacaccgattcggccgtgctggccaaggacccgtacggccggcctggcaagccgggacgtcccgagatcacggaccacgacaacaatcacatcagcatcaaatggacaccgccgacggacactggcggatcgccaatcacccattatgatgtgcaacggaaggacgcaaaaacgggccgttggatcaaggtgatcggaaagattgcgaatttaaaaaaaaaaagattaaaccgatattgaaaaacaattcaacaaaaattttttgatggtttcatcagcccaaaagaggaattgttctccgcatttattccaaagtgtttttgttaattagcctttaaaatttcatttattattcaagaaaacctggtttttcaaaatattttgtcataattttttttaattaattcgatttttgaaatttgctgggagaatgtttagggtttttagtacgacataacaccgaaaaaaaggtatgactaaaaaacagacgatttttaattttttttttcggtttgattgattttttaattaattaaaaaaacaattaggcttttttactagaaaggaaattattttctttttataaaaaaattaaaattaataatttaatattattcatattaatttcatttttcattttttttcaaaatttgggcgttttctaggtgaacacacatccggtgtacgactgcgcgtacactgacgaacgcgtacagcctggtcacggctacgagtatcggatagtcgct

SEQ ID NO: 45582 - DNA, 593 bp, Heterodera glycines
  Genomic contig location: Contig_ID=SeqID_20470; Location=141..733; Strand=+
  SCN-specific regions: Sequence locations=1-39,106-532,576-593
  Gene Ontology: Mol. function=MHC class I protein binding; Cellular component=tubulin; Biological process=embryogenesis and morphogenesis
atgtctggcgttacaacttgcctccgtttcccggggcaactcaatgccgacctccgaaagttggccgtcaacatggttccgttcccgcggctccactttttcatgccaggatttgcgccgctttctgccaagggggcagctgcgtaccaagccttgtctgtgtcagaacttaccaagcaaatgttcgatgctaaaaatatgatggcagcgtgtgacccgcgtcatggccgttatttaacagtcgcggcgatgttccgcgggcgaatgtcaatgcgcgaagtggacgatcaaatgatgtcggtgcagaacaaaaattcgtcttacttcgtcgaatggataccaaataatgtgaagactgccgtatgtgacattccgccgcgcggtctcaaaatgtctgcaacttttgtcggaaattccaccgccatccaagaattattcaaacggatttcggaacaattcacgggttgttttttgcaatttttttcatttatattttaagtttttagcaatgtttcgccgtaaggcatttctccattggtacactggcgaaggaatggacgaaatggaatttaccgaagcggagtcaaacatga

SEQ ID NO: 45583 - DNA, 2046 bp, Heterodera glycines
  Genomic contig location: Contig_ID=SeqID_3594; Location=709..2754; Strand=+
  SCN-specific regions: Sequence locations=1-284,306-841,863-960,983 -1071,1093-1323,1347-1489,1515-1879,1901-2046
  Gene Ontology: Mol. function=hydrogen-transporting ATPase activity, rotational mechanism; Cellular component=vacuolar membrane (sensu Fungi); Biological process=transport
ttctgccaggaatcccaatatggctttgtttacggcgtttcgggaccgggttggttttatttcgcctcattttttgataattttttacttttaagtggtaactgctgagaaaatgtccggtgctgcaatgtacgaactcgtcagagtcggccattctgaattggtgggcgaaatcatccgattggaaggcgactacgccacgattcaagtctacgaggagacttgtaagctcgtcaagttcgataagttcactcgtcctccgttaagcgtccgtcacaatcggtgaccccgtgctgcggacggggcagcctttgtctgttgagcttggcccgggcattatgggctccatttttgacggaatacaacggccattgcacgacatttcagaaatgaccaaatccatttacattccgaagggtaaaatttgtgattttattcccttcgaattttaatttgacattttaggggtcaatgtgaaggcattaaaccgtgcaaaacgatgggaatttatgccgaggaaagatttgcgagttggggaccacgtgacgggcggagatatcatcggaatggtgcacgaaagtgcgttggtcaagcacaaaattatggtggagccgaaggcgtgcggaacggtcaaattcatcgccccgcaaggccaatacaccgtcgaagttggcatttggacgaaatgccaaacttattgactctttccccccccccccccccctccacaaaggacaccattttggaagtcgaattcgctggacacacccaaaagcttacgatgatgcacatttggccagtcagaaacccccgcccgtccgccgaaaaattagcggccaatttccctctcctctgtgggcagcgcgtgttggacgcgctcttcccgtgtgtccagggcggcacaacggcaattcctggtaaacagttatttttgctctcattggcacttcggcgtttttctattttatattttttaaattttcaatctattttgttggtctaataaaactttgtgaaacgtgctaatagagaccgaaattttgaaatgaccagtacttggaaaagggaccgggacgggatccccccgatcccaatttttggagcggagcccgacgagacttttcaaaaacgatgaaaaaatgtaataactatttttttaacttttctccgacgatgattagggagagtaattccatatttgcagtgtaattggtcgcttttcaaatttttgctccgttagctctgtttttacccaatttccttataatttttcttccccagtcttttaatctgttgtcatttgtccgtcctttttcaggtgcctttggctgtggtaaaactgtcatttcgcagtcgttgtccaaatattccaactccgatgccattatttacgtgggctgtggcgagcgtggcaacgaaatgtcggaagtgttgcgcgactttcccgaactgacgatggaagtggatggagtgaccacgtccatcatggagaggacggcgctggtggccaacacttcgaatatgcccgtggcggcgcgtgaagcgtccatttacacgggtgggcactttgccaagactgtatttttatttttcgttaaatctcccctcccccttccgcaggaattactctggccgaatacttccgcgacatgggtctgaacgtggccatgatggccgactcgacctcccgatgggccgaggcgctccgtgagatttcgggccgtctcggggaaatgccggctgactcgggttaccccgcctatttggccgcacggctcgcttccttctacgaaagggcgggaaaagtgaaatgttttgggtcgcctgaacgcgaagggtccgtcactattgtcggcgcgtaagtgcatgtcgaccgatggcactttcccttcccttccctttgctcagagtgtcgccgcccggcggagacttcgccgaccccgtcacatcggcaaccctcggcattgtccaagtgttttggggactcgacaaaaaattggcccaacgaaagcacttcccttcaatcaattggctcatttcttacag

SEQ ID NO: 45584 - DNA, 1847 bp, Heterodera glycines
  Genomic contig location: Contig_ID=SeqID_3596; Location=576..2422; Strand=-
  SCN-specific regions: Sequence locations=1-655,678-712,734-999,1021 -1127,1149-1340,1363-1847
  Gene Ontology: Mol. function=RNA binding; Biological process =embryogenesis and morphogenesis
atgcactcaccactgttcggctcaatgttggacaacaaggaatattcacgtcatatcgaaaacttccgttcttctatttctccacccaaaggcatcaccaacggactccactgtcatgacttcagatctccttcggatttcgacgttttagtgaagttggcaaaagaccccgccggggtgggcaaccgcgaattgcagcaacggatggaccaggaccaacaattccgacagcaagtacgatcaaatccatcaaaactgacttttggattcatttggcagagaacgtcttttgttgatgttgtgaattttccaggttttgtgtgcaattgtcaacggtggaaaagaacgctttctgcaattgtgcatcgattgcaacggatgtttcgtcattcaggtgcatcacatttgggactgaaacagattcgttaacaatagtttcagaagttagttgagaacggttcaaaagaaaccaatcaaatgttgctcaatttggtccgtccgctcgcctttaaaatggtgctcaatcgttttgcttgtcgcattgtccagaaggtaaaaaaagacggagcaggacaaaactcagccgccgaaactcagccgaccaaaactcagccgagacataattcagccgtgaataaatttttttaaaaagaaattttcagttggttttttcaaaatttactaagaattcaaaaaatttaaaaaaaaaatcgctgaaaatttcttgaaaatttgaattatgtctcggctgagtttcggcggctgagttttggggtccaccgaaaaaaagacattattacctattgagacacgtccttgattcatacttatgcccattttgtttagctcgtcgttaatttgtccgggtcccaagtccgccaattgttctgccaacagttcaaaggacacgagaacactttggtcaccgaccaaaacgggaaccattttgtgcaatgcgtagttgaccattttgcgcccgacgtgtacggaccttttatcctcgccttggccaactgtcccacccgactgagcgccgttttcgaagttcgattgaggggagggtagtggatgagatgtatagacaattcaaagaattgggagtgaagctaaatgccgtcacgtcgatagaatcattcaccagaatattccttcgttgactgtttagttaactgattgcgtgtctttttgcagaataagtacggctgtcgtgtgatccaattcgtccttgaaaatgtcgtccaactcgtccatggcactgcgaatgccaacaacagcttggaaaagtgaattgttctttttttggcccgttatcattcgtaaagcttaagggaaatttccatccaaatattgcatgttctcattgaacccattctcaaaaatgcgtattcgttggcccaaaacgaattcgccaattacctcgtccaatttattatcaaatcgccctatctccgccgccaacgctgttacatcatcaaaactcacatcatgtaaaataaagcctaatctttcatcgctcaaaaacacaaatttcagtcgcaacgtttaccatctctcgctgcttaaatactcttcgcacgtggtcgagcaggcttttaagcacgcggaggaccgctgcaactgtttggccatgttattccgggaggtgttggaggggtacaaaccttcaacgtaattgtttttttccgaatttccatttttaccaatttattttcagtgatggaaagcagcggactgctctgtatgaaatgctgttcaatcaggtgaacctgacttattccatgaccttctgcatgggcatctcattacgtgtccctttcagtacggcaattacgtcgttcagaggatga

SEQ ID NO: 45585 - DNA, 1629 bp, Heterodera glycines
  Genomic contig location: Contig_ID=SeqID_3599; Location=146..1774; Strand=+
  SCN-specific regions: Sequence locations=1-817,839-1207,1238-1629
  Gene Ontology: Mol. function=protein binding; Biological process =purine nucleotide biosynthesis
attgacattgtcgcgcgatgccaaggcggtaacaatgcgggccataccgttctggcaaatggccgcgagtatcatttccaccttttgccttccggattggcctcagaaaaggtgacccaaaaaacaaaacaaaaactaatgttgctgttgcaggtgttgaacattgtcgggaacggagtcgtcgtcaatttggacgcccttttcgaggaattggagagcaacaaaattgaggattcggcagaccgactgttcgtcagtgacagtgcccatttggtgttgcctgtgcacatcgcaacggatatcatgcgggaaaatgcgttgggacaaaactcgtaacaaacggaacattaaacatcgatcaaattatttacatttttgcagaaaactcggcaccaccaaacgtggcattggtcccgcctattcgagcaaatgcttccgcaatggcatacgactgggcgaactgctccaccaaccagagaaatttgaacaaaagttagtcgattaataaaattagttgaccttttgtcgtgtttagctatcgttcgctggtcgcccacttcaaaactcttttccctgacattgaattggacacggaaagtgacgtcaaacagttgaaggtagtttcttttttaaatttcattttgcatttgtcctttttttgttaggcccatgccgcacgtcttctccaaatgggcattgtctgcaacacaaccgttttcctgcacaaaaagcgtttggagggcaaatcgattttggtggaaggagccaacggcactctgttggacatcgactttggtcctatccaataatgttccaatttcttttaccttttcttctcaggtacctatccgttcgtcacttcgtccaattccaccgtcggcggttgcatcaccggccttggcattccgccgacagccgtccgtcgcgtcatcggcgtggtcaaagcctaccaaacgcgtgtcggctccggtccattcccgactgaactgcttgacgccgatgtatgtacttgccccaaaaattatgttaatttgatcgcattgtttgtctttccatagggacagcccagcgaagagggcaaacgtttgcaagaagttggtgctgagattggcgtgaccactcgcagaaaacggcgctgtggttggcttgacttggtgctgttgcgttattctgcaatgatcaacggattcacttcgtacgtttcacccatttattattttatatgttcatatttatagtttttttcataattttagtttggctgtaacaaaggtggacatcctggaccaatttcatgaaattaaaattgccattggttacgaattgaatggacggcaaattgagtaccctccaggtgagctgaacaaaattaacgactgtttttatgccattccaagtgtttatcttttttcagcgaccgtcgatgattgggcaaatttgtgcgtccattacaaaacctttgagggttggcagtcgccaacgaccagtgcccgtcagtgggaacagttgccggacaaatgccgtgcctatttggagttcatacaaaatcaactgggcgtacccgtcgaatacatcggagttgggaagggacgggagcagctgattgtgtgcacgaataacggagggtga

SEQ ID NO: 45586 - DNA, 1452 bp, Heterodera glycines
  Genomic contig location: Contig_ID=SeqID_3599; Location=5897..7348; Strand=-
  SCN-specific regions: Sequence locations=1-19,42-59,81-144,166 -385,412-429,451-464,486-754,825-863,897-943,967-1345,1368-1420,1442 -1452
gggttagaaatttcaactgaaaaatgttttgtttcatattttagggaaaaataatatgaaaaaagaatattttattaactcaaaaaagatttctgagtcggataatgttcgtgacttgggcattataattgactcgaaacttaatttttcagaacacataagcaaaattgtacgaaacgcatatcttagaagctttcagattttgagagtgttgaaaagcagggaaataaagactctaacagcagcttataaaacttttgtacgacctcaattacaatacgctaccgaagtttggaaccctaatttaaaaaaagatatagacaaaattgagcgggtacaaaaatttttcacaagaaaagtttttcgaaaatgtggatttgtgtacaaaaaatatgtggaaagacttaaaatcgcgggtttacataaattagaagaaagaagaaaaattaatgatttgacaacagcttttaaaattataaaagggttcgccagcctagaggctgagcaaaatttctttttctcagaaaggcccaggaggcctttacttttacgagtaaagcgccacacggccaaaacacaaaataatttttttcataggatagtaagaaactggaataaccttccagtggtagcggtgcaaattaataaggcaaaggaattcaggggtttactaaaagcaatgagttctgagtaggaaattttctgtgtcacatatacactatattttaatcacctgtgaatttttaacatttgatttatttttattcatttttattacggtattcattttgtattttttatttgatttttatttgtttgtttttggcaccatataagagcactatgtgcctttggtttgctcgataaaattaaattaaaaattaaatttaaaaaaaccaaataaaaaaggacttttgtaaaagtttgtatctttgccaattgtcccagggtttggcaaatgatttgtggccattcagcggagtaacgtctctccaattggtccgcatgaatcagaacttttctgatggagttccccgtcatgtccttttttctgaacgcttccctcctgacccggatgcttctgaaaaattcgttcgcaatttccgcgctttccgttgacccttcgagctctttgatcaaggcatttccaatgccctggaagacgtgaaaaggcgccagaattatccggtcaaattcgattgatccatggacccaaaaaacccaggggataaattttcatgactatatattaagaaattttgcgaaccaaatggtccccccttttgtttttactttttgataaattcaaaaacgaaaacggtaactttgcatatagcgcgctttctttttagaaattaatgttttaaaattttgcaattcggcaattttttattcgattttcccccgtgccgcacttttgtcttcgctctgtccattcatttcctttgaccg

SEQ ID NO: 45587 - DNA, 1608 bp, Heterodera glycines
  Genomic contig location: Contig_ID=SeqID_3605; Location=272..1879; Strand=+
  SCN-specific regions: Sequence locations=1-413,437-512,534-1028,1072 -1366,1388-1608
  Gene Ontology: Mol. function=glucosidase activity; Cellular component= endoplasmic reticulum; Biological process=N-linked glycosylation
gataatgaaatgaataaggatcattcgataagacaacgccgtgggctaaaacaagcggattcatcagaatccaaattaccaccaaagcaaagttcaaaagctttgacaaagattattttggctgttatattctgcattgttggtgtgttcgcctttatctcttttcgctggaacaatactttcattcgtcgaaatgattctttacaaaaatcgaatcttccacttgcgtcaaatgatgatctttacaatcaggtagcaagacaaagtgacaacaaagtctgcccactaatttttaaatttcgactggaattttagctgattatttttgtttatgtatatttatttatagaccaactggagcacacacagaccgcaactttattttgggttaaagacgaaacatcctgaatccccattatttggttttatttggtatcagcagtcgaatgatacgtttattaaacaattttcaccaaggcattggtgcgaacatggtgaatatttttaataactatttaattcatctgacttttaggggataatgttaaattttcttggctcgcgcacgatggtcggacttttggccgccaagtgattgaagacaatgacttggcaatgcaagtggattggatggcaaatggcagaaagtcatggaaagtgcatctttcagcgaatagcacaaataattatgcactgctcttctatttggctttacaagacaaagcttcacattttgttttacaagaccagcagtaccgcaaatcgtcaaacaactttggctatggctttctcgacggatattctcatattcttggtcaattcgctatgaatatgaatatccaaggcgttttttcctccgaagctgtttcaaaaattgcttacaaaatgacaccgattttggatgtacgacacgtcgatgaattgattaaagtttcaattggacagactgaagggaagctcggactgcagttaacgcaaaacccagagatacctgacgaggaagcaaatttcgcagcgattcaatttgatttttcaagttggtggttttaaatattttgtaattagaataatttagagaatatccatattgaattagaaatgcttgctgaaggcgatgctaaaattgcgaatttcgatcatatttttactcgaaaattggaaacgtttagcaacaaatttgatgaaatattcccgattgatcaccaggtcgggtttcttttttcttttttacttctttttgacattattttaggaaggctctgattcatttaatcgcttgggaaaaattgcattgtccaatttactcggaggaattggagtttggcacggatattccttggtcaaaatcgacgaatccgaccatatcaactcatatggtcccctttctctcatttccgcagtgccttcaagaccatttttccctcgtggttttttatgggatgaaggtaaaacgcactcgtaacattcccaaaccaatttgttgttcttaggttttcataatttaatcattcgacattttgacccgcaacttacgcttcaggtttacttctatcgttttgcccttcccataaaaatgcgtctttttcagattttggcttcttggcttga

SEQ ID NO: 45588 - DNA, 1185 bp, Heterodera glycines
  Genomic contig location: Contig_ID=SeqID_20525; Location=230..1414; Strand=+
  SCN-specific regions: Sequence locations=1-101,147-149,171-177,199 -336,358-443,466-1185
  Gene Ontology: Cellular component=mitochondrion; Biological process =lipid metabolism
catcctcaagtgaaggccaaaggatcgacgttggacttgtccgatttgacctccgacccgttgttggcattccaacgaaagtggggcgccaaataattggcataataatgattaatttaaatttatttattttttacaattttaaacacttttttattttcattttcacaggttttacctccctttggtccttctgttctgctttctgttgcccgtggtaggtgtattcaaccaattttttcaaaacgatattattggggttttgaaaatggtcaaaacgtgtccccacgactcaatctcttggccaaaaaccaaatctagcaattttgatttgtgtgtttaaaattagaattatttataacggtaaatcttaattttttcacccacaatactcaattttcattccttttcagtttattcccgttttgttatggcatgaatcggcaagtgtggcattttacaccgcctcactgttccgctacacattcacattgcactcaacttggctgatcaacagtgtggcgcacatgtgagtgatgaaggccaatcaatgggctgatcaatagcagctacacactgatgaaactaatgatatagtcattttgatcagaggcatttgactgggtttctcgagaatttgtgccctgtgccatgagtttggtcagtcaaaaatgtgatttttaattccgttcagaacccgggagtaattttttctggctcagaaccgatcattaggtcaaataccctttgtactgctgataaatagagggatttttggattaagaaaatgtatatttattgattagtcgcgagaatttttttctttgctcttactgatcattagttggaaaatgtctacttcctctgatcattagctcactgatcatcgggggtttaagttccattctgatcaattgggatttctttcagtgttggctaccgcccctacgacgtttcgatcagttccaccgagtccgtgtggaccaccgttttggcgggcggagaaggcggccacaattaccaccacacattcccacaagactatcggacaagcgaaatgcgaacactgctcaacttcaccaaggcaccaaacaacagaaaattggcactatttacctttgccattcattttaggcattcatcgatttgtttgagaaaatcggatgggcctacgatttgcgaacg

SEQ ID NO: 45589 - DNA, 1088 bp, Heterodera glycines
  Genomic contig location: Contig_ID=SeqID_20528; Location=167..1254; Strand=-
  SCN-specific regions: Sequence locations=1-181,211-348,370-678,701 -887,909-1088
  Gene Ontology: Mol. function=microtubule binding; Cellular component =spindle pole; Biological process=meiotic spindle assembly
atgttttttgccaagggattgcgtgccaaattcacgcctcacgttttgttggttgtcccggtgattttcgacaagttcaaggaaaagaaacagttgctcagagatgcgctggtcgaatgcatcgatgtcatcgcagcatataccgtaaaaatagataaaaaaaacccgattgaaatggatgatttaaaaaaaataaaaataatatttttagagtttcgaccacctaagcaaggccttgctcgaggctatgacctccaaacagaatccgagtcagaaatcacagacggatttgttcatctaccgcgtgttccgttctctcccggccaaagacattcccaagggtttgctgaaggatttggtggccattcttagcaaagtcaacattttgtcatgttttacccctattttttggcatttttagcatggctctgatgccgactctgaagtgagggactcctcttttgctgctttgggtgccattatgaaatgcattggggaaaaggccttgggctgtttcatttcgcctgaattggccaaagatgcgaacaaaatggccaaggtcttttcataaacttttttcaattaatttttgttttattttacttttagattgccgaaaaccgtgacaaggctttgacagactctccaaatggaccaaatgtattacctatttccctcaatttttaattattattattttcaaattcgttttaggatcgtgttgagctctttgccaatgcgaatccctcttcacgtcctgttgctgactcggcaaaaaagagagatgcgtccacttcgcggctcaaccaaacaatcaactcaactgcggacgatccaaatgcgacaaaaagggctcggtctgctagcgggtaaatgaaaaatcgtacaattttcatttttgctctttattttttagccgtcgtcgttcggttgctgtcctccccaacaattcaatgctcaatgacaacaccgatgagggcaatccgcgtgccccgcgccggtcacattttgttggcagtggtggactttcctcagccgtttcgtactcatccaacttgaacaccacgatgacacttcaatcgcaaaat

SEQ ID NO: 45590 - DNA, 3616 bp, Heterodera glycines
  Genomic contig location: Contig_ID=SeqID_3610; Location=398..4013; Strand=+
  SCN-specific regions: Sequence locations=1-229,251-382,404-581,604 -946,971-1551,1587-1916,2023-2232,2255-2475,2497-2957,2979-3022,3060 -3090,3112-3250,3272-3313,3346-3616
  Gene Ontology: Mol. function=zinc ion binding; Cellular component =Golgi trans face; Biological process=intracellular protein transport
atgattggattgctcactcgctacgcccgcactcagttcacttcaccgtttaagaactcagaaacaaacaacgaacagaaggaactgtacagcagcggggaagagagcgaagagaaagacggcggaagacaggtaattaaatatgagcaaattaatggtctaatacgttttccattaacgagaaaaggtggggggtgtagaaaaatatacttaaaacgaacctagattttttaaagaaaacaaaggatattgtttaagttccaaaatgagcaaatgcatttggaccccgactacaatttgctaattgcctccgttcgtccgttgcttcaaagtcgcaatccggcagtggtcatggtgaagctgattagttcatttgagtttctttattgcttcctttcccattaggctgttgcccagcttttctttcacattgctccccatgcccaactcgtcgccgttccgcgtgcgttggttcgcctcctccgcggccctaccgaagttcagtacgtcgttctcgtgaacatcgcgacaatttgcgcaacgcgtcaagcggaagagctttttgcgattaataaggtgagttttttaatttaaaatgtattcaaaaatctttttcttttagaaccttttccagccctttttgaagagttttttcgttcgtaattccgacacaattcatgtgaagagaatgaagctgtacgttctgtccagtttagtgaccgaagcgaatgttcagttggtcgttcgggaattgcaggcatttcatttagtgccacaaatgcttggccaactcctcttaattgttaggcctatctccaaatgacagacattgccgagacggccatcgacacaattggacgttgtgctttggcagttccctccgcttctgaaacatgtttgagttgtctgattcggcttatttcaacgagtggcaacgatcaaattgtaatttttatttatttttaaaataccctgtccattattttttataattgttacaacataaggtttgtgcttccgtcgttgtccttaaacggcttcttcacgctgatgccccaatgggactgttgaagaaaatgttccatttgattaataccgtcaaagtaagaatcagctgaatttgcatgccatttttacctaaaaattcatggaaattcatttgatacaatatttaggctccaatggctcgttcatgcattctctggttggtcggcacacacattgacaaagtgccgaaattggcacccgatttattgcgaattgttgcgaaaaccttttgcgaagaagctgattttgtcaaggtgatttaaaatagtattgttagtaactttatttcaacttcgttcccaatttagctccaggcattgaatttggctgtccgaatttgggcgattgattccgaaaaccgcgaaggaaaatgtgctctgctcatcaaatatgtgttccaactcgcccgctacgaccgttcttatgacatccgagacagatgccgttttctgcgcaattttttgtttgacaaagaccaaaattcagtgagtttttaaatttctcatataaatgttaaattaaaatattttatttattttcagttaaaatttcctttggacattttcctgcaagaacgtcctgcgcctgctgtgaataattctttcactgatcgggctgagcatttccaattgggcactctttctcacctgctcaaccaggcgaaaattatgattattagcttacactgatagaatccattcatttatttggtttattaattagttttttttcaacctttagaaatgcaatggttacactgaacttcctgactttccgtcggaacagcccgacccaaccattcgacgttcggcataccctttgccaagcgacggtatcgtacaaggaacggaaattgcaatggacgaagcggaggaggaggaggaggaagactcattggatgaagaggaaagtgaagaggacgaggaagacgaagatgaggaagaagacgaggaggaggaagaagaggaggaggagagcgagggagaaaaagtaccggatggtgggtttttgaattttaaaaataaaaaaagaaatgggcaaagaaaaactttttccgtaacaatcccatgtcactcattcacaaccaatcagtaataatcatttctacgtgaattgttgtaataatattcctgtctgccgtcgtcttcgaccgttggctgtttcattgctgcagggtgcggaaaattgtgcacgtttctgaaacaaagggacaaataattcattttggaattcattgagactgacctggcattgtagaaaacgatgtctccgtcagtttgtaccggatttcggaatgatcgtcggatcaccctaagggcgtagaacaccaccaaagcggagcagcagaggacgattaccaggaaggaaacgaccaaaatccacctgattaattgttgaggcattggacaactttttctatctatcgttgttttaattcttctctctctgaatgcttttacatcatcggaacgagaacagacgtgagcagtcgcgtgtcgaagggcaaacacgcgtaatgcgcattggccgagtcgccacaattgtccacgtaaacgcactgcgaagatgcggagcatgaacgagcacctccaaaagaaacgcaattcaaaaaaacaaaacaaaaatttgacggcttacaatagtcggcactttcgtaacaggacaacttgtcagaatagacaatgtttcccattttgatgactaataaacaaaggaaaatgtccgaaaatgggttaaaatttaagtgatttcattttcgccacgcctcgaacgcccgaaccggttctgtcttcgcacatacagttcaaaaaagggaaaaaattaaacttttgaaaaggtgatagtaaacaattcggcgagaaagaatgcacatatcaaattgattttatgaattcaagtcgaattaacgctttttttaaaaattaaaaaaagccatgaacagtctttttgactttggcggcaagttcaaaataaatttccattcatttttgaaggagggggagggattgggggacagtcgaaaaaactaatatatctcaagaaaaaattacatcaaatatatttgaaacagaaaaattaatgaatgttttgattgatacatcaacagcaacagattggaatgttagaatggttgcacttttggtttgattaattggcttaattcgtcacatgtattcgtaacttcaaacaattgaaaagggaactgacaaatgaggaaatgaaatggaaacatttgtcgcaatatttaccaacatcgaaaacatcaaataaaatttaacaacaaattacattttttaagtcataataagtccattaagatgaagatgcaaagttgaaaagtcgtcagtttgacattgaagcgatttcaacaaattcgacgacgactcgcgaagatgccatttccgaagaacaaaaagccgaatcgcagcccctagtggctaagaacgcttcgaaaaacgatggacagaaagaattacggtccgagcatttgcttctcttggacatcgattttgcacaaacaacggcacaaagtccgaatgaggagggcgaggacaaaatgaaggactaa

SEQ ID NO: 45591 - DNA, 2999 bp, Heterodera glycines
  Genomic contig location: Contig_ID=SeqID_3619; Location=846..3844; Strand=-
  SCN-specific regions: Sequence locations=1-96,125-196,218-276,312 -498,520-664,694-771,793-847,870-875,960-965,988-1001,1025-1037,1059 -1068,1090-1175,1203-1360,1400-1524,1559-1733,1770-2123,2153 -2207,2239-2241,2263-2389,...
  SCN-specific regions: Sequence locations=...2412-2561,2590-2608,2663 -2886,2926-2999
atgccccaaattttgccgccgattttgttggcgcatttccccccaaaatccaaccccgattccacaactattccgactgacaacatccaaaaagcaccaagaaagcagcagcagcagttgcagctaatttgctgtgatcattttgggtcatcccttccctttctcctccataaggtgctgtgtaatgatgcatttggaaatgtgtgattttcatttattcggatcggataaatttctaattatcatttctattcggcagcacaatttctgaaaatgttttatttattacttaaataaaataatttttttaactctttatgcaaaatagatgatcagaattattcataagttaaaaaaaatcccattagcacttatctaaatcattttaataaaaaaaaagaaaaagttaacaaaccctaccttagcaacggtaaattttttattcgttttttcaaacttttattttaattattacatcaattaaatttgttcctttaaattccattttaaaaagggaaagttatgctaacacatctattcatccttgtattgtgcttgttcacttcaattcttggccaagctgcacatcggccataccaatatgaatatcaacagcagcccaatgaacagtcacagcggactgttgttatgcgattggaaccggtaaaaattgtaaattaattaatataatttcttaattgttttagcttccggcaaagccaacatttatgcggcaggcggatccgcctcgtgccgtgccgcaagcggccacacgacatttgccatcaccagcgaagcaatcggcaccaatcgatgttgctgcgatggctgaacgctcttcagttccgccatcatctgcaactgtaataaaactgattattaaaatttagaaatttttaaaatttttaattgatcatttaaaaaatacccattaaaacttttaaatttattaattaattgcatccaaattcttaagaatggaaaaaatgactttttgaacattaattaattttttaattgttttgactgattgatggccctatttaaattaaaatcagataaattttaacttttttctagcattttacaagtcctgaaatatgaaataattgttgaaaattattatattttaaaacaatttggtggctaattattatatttgttgtcatttcccgattggcttttcattagcattaagtcctaaataattaattaattgcatccaaattcttaagaatggtcaacaagctgtgtcaacatcaaatccaattgcagcattacagcctgtgttaccattgaatccagtacaacagaaattcaacccgcgtgaagacgcaacgccaccgcccgcgccaccgagtaaaaattaatttaaaatatttttataatttaaaattaagtgaatattccgaccgatgtgcaaaatcaactgatcaaattccttggccttgactcatttggtaaaagtgttcatattgtatgataaattcatatgatagtggttgggaatgatttcctgaacggatttttattttctaatttaatttaattattttttgcaattttcaaggaattcctggccttacgggaaatcatccggagggatttgcgggtgctgtcaaggaacttcgttcagccggcattccagttcagggaataccgttagagcatattggaggacaaacagttcatgccccgcaggtcattaaaatgttttataaagcgatttgttgtatttatttttatattttattgtgttaattatttaagttttttgtcgttcagaatgaagcacttgtccaagcgaatccgaaatttggcaacgaattgaacacgttcattgaaagtgccaaagcaccattcaacccatctggcagcagtgctccgtgagcgtccgcccatttattattaattaaacaaaattcaattgttttttttcagcttgccagatgctaaaccgggcgagaatgggttgatcggtttattaagcagctcagtgcgaaaaattgtcaaagatagtgagtatattaaagtttgatgggtccaattaacatattcactttgactttttaacttaatcattttattaattaataacgaaaattcaggtccaatagagcaagaaaaaataaagtaaaaataaattatttaacgactcattgccgtaattcaaattaattaccccataaaattggtggatatcaatgaacataatgaaaatataaaatttaattaagttggcatggctgatgcttaataaagaaaaaaattattcaatgaccataaatctgaatatgtaattttttttaattggttctaaaatcctaattaagcactccataaaattgatggagctcattaaattaaaatcaaaaatcattagaacataatgaaaataaaacatttaattaagctggcatggctgatgctttgtctaactcattgccaaatttgcttggcacaaacactggcccaaatggggctgctgacactaaatccatcgcttcggcacttgccaatgccgccgagtcagtttcatcctccgctggcacaagcagcagttcatctgctgctggtggtggtggtgcttcatccaccagtgggaatggtaaattaaatatccaaaaaactaattttttttttaaatcaatttaatttatttcaaggaattcgtcgccaacaatcgcctgcagagcgtgccattgccggtttcgcttccgcattgggtggcggcggcaatgccaatgggccagcccatgctggattacctagaattcctggtaatgaataatgcattattatgattcattaaaattcggtgcgatcggaaatcttaataattttttttttgttttggttctcgaatttttaattataacgaaatttgtttaaaaaatttatgaaatttttctttaatcttgccttttaaggtatcccaattttacccggaggcattccacgcaattctcaaggccaaattgacgttgtccagcttattg

SEQ ID NO: 45592 - DNA, 1178 bp, Heterodera glycines
  Genomic contig location: Contig_ID=SeqID_20626; Location=748..1925; Strand=-
  SCN-specific regions: Sequence locations=1-429,452-1094,1117-1178
acaaagtcacacaaaaggccgccgtcttagaattaaaaccatctgaagaacacctaagaacggaaaaaggcgaagaaagtacgaaaaatgaggatgaaatacacaccgaagaagcggaagaaaatgaggaaaagggaagcgaagcctcggaaagagagggaccaaaatcggaggaatgttcggtggatgagaaagactccgacgaagaggagaaagagcggttatacgaagaacaaatggaaaaggaaaagcaaaagagtaagacatttgctttggaaggaaattagggctctaatgcactttatgagtccaatcgacttttatgagtccgatttaacttttatgagtccaatcgattgacaatcccgggtttttacacaataactttgttcatgttcgaacaaatcctatctttttggtatcattcgaaagcacaaagtctaattaatgtaataatacgataaaactaaagaattctaacatttcaagaaagttacaggcgaaaataatcagcaattacttaattaatcaaatcttttttagcaattgccttaacgatatggttttatatattttagcttcgttagactttgtgttttcgaatgatatcaaaaagatcggtttagctcgaacctaaacaaagttattgtataaaaacccgggattgtcaattgattggactcataaactgcattagagccaatttcctattttcaggattgaagtcattctgaacgtgaatcattcggtcgacatcgaagaggacgaggagtacgaagacgagccacaagcagaaatggagccagaggtttctattttttttttgttttgcttgggtctaagtttcatgtttgatttgacctgaattttcttggaaaatccccaagtgttgcctgtatagtccaattttgggctgggtgtttgaatttgtttaaaagaagctacttacaattagtacttaaaaaatctaattgataataaacccaggcataagtcgaactctgattttcaatatgatccattcattttcagtctgtgcccgtctcgttgccacacttcaccattaggtgttttttcaattccgtttttacaaaacaaatgcattatttttagcatcacaaaaaacaaccagagtatgttcttcgctcttgaaatggtgaagacggaggacggcggat

SEQ ID NO: 45593 - DNA, 1174 bp, Heterodera glycines
  Genomic contig location: Contig_ID=SeqID_20635; Location=366..1539; Strand=-
  SCN-specific regions: Sequence locations=1-500,522-701,725-1174
  Gene Ontology: Mol. function=ATP dependent RNA helicase activity; Cellular component=nucleolus; Biological process=RNA localization
gcaatcgtcccctttgacgttgaatatcaacagctaaaaaagaccaacaccccggcaaagctttacgagttcaaactcgacatgttccaaagccaggcactcaaatgcctggacaatcaacagtctgtgctggtctcggctcacacatcggccgggaaaactgttgttgccctgtgggtttattaaactataactttttatcaatcatttcgtttcgggtggtgaatcgttgagttacttttttttaattgtcgtcctttttcagctacgcaattgccatggcattgcgggacaaacagcgagtgatttacacgtccccaatcaaagcattgagcaaccaaaagtaccgtgaacttgttgaagagttcgaagacgttggccttgtcaccggggatgtgacactgaacccaaatgcatcatgtgttgtgatgaccaccgaaatactgcgttcaatgctttaccgaggctgtgaaattgtgagagaagtcggctgggtgatctttgatgagattcattacatgcgcgacaaaggtaagcaaaagaaacccaaagattcattttcatcggattgggaccttggaactcgtcgatgttttaatattctaataattcagttcttttctatcgtttcgtttttagaacgtggcgtcgtctgggaagaaactctcattttattgcccaaaaccaccaatttggtgtttctttctgcaactattccaaatgccaagcaattcacaggttggctttacatttagttagttttcttttttggaattcaaactttcagaatggatttgctatttgcagcacaaacagtgcaacatcatttacacggactatcggcctgttcccctccaacatttggtttattctgccgggtcggacggtctttgggaagttgtgaacataaaggcaaggaaaaatgtttaaaatttacagccaaacattttgtgcattttcagggcgagtttaaacaggacaactttgccaaggcgatgagctgtttggaggagcgccaaccgatgggcggcgaagtgcggcctcagcacggacggcggagtggcgcgaacgacgcgacgcagaagagcaacgttgtgaaaatcattagaaccattcgagagcgagacatgttgccatgcattatcttttcattcagccgaaaggagtgcgaggc

SEQ ID NO: 45594 - DNA, 923 bp, Heterodera glycines
  Genomic contig location: Contig_ID=SeqID_20648; Location=368..1290; Strand=+
  SCN-specific regions: Sequence locations=1-303,329-395,418-434,456 -609,631-896,918-923
  Gene Ontology: Mol. function=protein binding; Cellular component =integral to membrane; Biological process=vacuolar protein processing/maturation
atgcatttccttaccggcaatgagcaatccttcgattctgagggtcaagaggctttgcttgactcggcacttaaagtggtgaaaaatgagtccttcgagatgaaacgagcgttggatcggaacgaactgatggaagggctgaaacacgccgcacaaatgctttgcgaactgcggacatctcttctgactccgaagttctattaccgattgtgtgagtcgaaattgaaaaaggaaaacccacggggcgtacagtcaccgcctttttggcaattgcttcgttaagacatcgacgtcaccaatgagcttcaacatttcctaatttatctgagcgaccgatatttgggtgaagagcggaagtattcagttgcggagctttacgaaactgtccaatacacggggaacatcattccgaggctgtgagtttggttgggaagggaagagaagggtaaaagggctcgatactcgataatcagcgattgtttgttcttaggtatttgcttatcaccgttggcacaacgtacataaagtcgggcgagtcttcgaccagcaacattctcaatgacctcgtcagtgcccccccatggctttgctgggggtttttgttttaccattcgcttttctgttttgtttcttctgttggaccctgtccgtcccttatttcaaccaattcccattttcaggtcgaaatgtgccgtggtgttcagcatcccctgcggggtcttttcctccgcaattatctcctcacttccaccaaggaattgctgcccgacattcccagcacttcgtctgaaaaatccgctcaaaattttgctgcatcggaagaagaagaagagcaaagtttgggcacgcaaataaatgggggaacggtgcgcgacacaatcgaatttatcatgacgaactttgcggagatgaacaaattgtgg

SEQ ID NO: 45595 - DNA, 1061 bp, Heterodera glycines
  Genomic contig location: Contig_ID=SeqID_391; Location=2285..3345; Strand=+
  SCN-specific regions: Sequence locations=1-498,520-1061
atgacatttcataaaatcgacaatgactccgtgaactcaatcaccaatgcgctggactttttccgcattccgccgacaaatgtcagcgtctcttcatcaaaggtgtttgaactgcttcccagcaaccctctgacggacaccccctaccatttcaaacttcattcaagtcaaaattacattgacctctccaaatgctatttgctcaccgagttccgaatccggaaggaaaatgcgaatggtcaacttatggacctgaccattgacgacgaaaacattgcgccaatccagatgattgggcaaacattcatccgaaacatcaaaatgagcatcaacgggcgtgaagtgttcaacgcaaatgcactgatggcctacaaaacctatttttcacatgaactctcctactcaacaactgcaaaggactcgcacttgaatgctgcaggctattaccgggatacgggcgagacactggagacggggccgggctgcattcaacgcagggatttgtttgccgaaagcaaaacagcccaatttattgccaaaattgataccgacctattcaaccagccgctgtacttgattaacttttgtgaattggatgtcgaaattttgccaaatgacaacgattttgtgctaattgcacccgccatcggcggtgttgttcctcgttaccgtttcgaggtgatggggctcaaaatgtatgtgaagaaggtgtcattaatggacggattagcgctggacattgcgcgaaagcttgagataaagcctgcacgttatgcagtaaggaaaactatgatgaaatcgatgttcatcagtcagggtcggttcgagtttaccgccaatctgttcatggaccaaattccccgccgcatcacaatggggcttgtttcaaatgccgactattcgggcacaatcacgcggagcccgttcaattttcaaccgtttaatgtgcgggaaattgcgatcatcgccaacggccgttcctacccccaggccccttacgatttggactacccgcatggcaaatatgtgcgcaatgtcaacgatatgaatgaggcggtcgg

SEQ ID NO: 45596 - DNA, 588 bp, Heterodera glycines
  Genomic contig location: Contig_ID=SeqID_394; Location=114..701; Strand=-
  SCN-specific regions: Sequence locations=1-216,240-507,529-588
  Gene Ontology: Mol. function=heat shock protein activity; Cellular component=centrosome; Biological process=reproduction
atgactttttcccactgcattgctacaccagtgcttttcatcatgtttgccattttgtctggacaatccggcgaaaccttttcgttccaagcggagatgcccctgatcatcaacacctactcgaacaaggttttaaaatgggaaatgctctgggagtctaattaacccgtaaagtctaatctaatcagtttttaaaatcttaatctggtttaggaaatcttcctccgcgagctgatctccgactcatctgacgctctggacaagatccactaccaggctctgaccgacccttctcagatggagagtggcaaagagctcttcatcaaaatcgtgccgaacaaagccgacctcgtcaacaaccacaaacccggaactgaggcgttcattgaggctcttcaggttttgttttttcgtttggtcaacccctaatccctaaaaaacacttttgttggtaatttttaagttgtggaaaaacaacccgggattttcggcccttctgatcacgaatatgatatcagatttgcaaaaatgatttattttatcattgtctggtttttttgagaccttagatttgaaattttgattaaa

SEQ ID NO: 45597 - DNA, 625 bp, Heterodera glycines
  Genomic contig location: Contig_ID=SeqID_3636; Location=524..1148; Strand=-
  SCN-specific regions: Sequence locations=1-274,296-625
atggcgcaacttccaccagaggacgtcgcaacaatgcccacgcagaaggtcgtcttcaacgccccgttcgacaacaaggccacctactacatgcgggtgcgtttggcgtggtgcacgtggcatgcggaataacccccccccccctttttcaggtgatcaaccctgggacgaagcgcatcggctacgccttcaagaccaccaaaccgaagcgcatcaacatgaacccgccgaacggagtgctcggcccaaaggagtccgtcaacgtggccgtctcctgcgacgccttcgaccccggcagcgaggacaccaagggcgaccgtgtgaccgtggagtggaccaacacgccggacccagccgccaccgcgttcaagctcgagtggttccagggagacgggatggtgcgccgcaagaacttgccgatcgagtacaacgtctgatggaaggatgcttcgtcacctcaacatggacatgataggatcccacccacccaccgtcccaaaattgtcattttgtcccccatcatgtaaattgttgtatctgtatgtaaatttctgtgatcatcacttcaaatgaatgtatatttaattgttgcctatgtaattgtattgttgttgtgcttaataaa

SEQ ID NO: 45598 - DNA, 622 bp, Heterodera glycines
  Genomic contig location: Contig_ID=SeqID_3637; Location=296..917; Strand=-
  SCN-specific regions: Sequence locations=1-271,293-622
atggcgcaacttccaccagaggacgtcgcaacaatgcccacgcagaaggtcgtcttcaacgccccgttcgacaacaaggccacctactacatgcgggtgcgtttggcgtggtgcacgtggcatgcggaataaccccccccccttttcaggtgatcaaccctgggacgaagcgcatcggctacgccttcaagaccaccaaaccgaagcgcatcaacatgaacccgccgaacggagtgctcggcccaaaggagtccgtcaacgtggccgtctcctgcgacgccttcgaccccggcagcgaggacaccaagggcgaccgtgtgaccgtggagtggaccaacacgccggacccagccgccaccgcgttcaagctcgagtggttccagggagacgggatggtgcgccgcaagaacttgccgatcgagtacaacgtctgatggaaggatgcttcgtcacctcaacatggacatgataggatcccacccacccaccgtcccaaaattgtcattttgtcccccatcatgtaaattgttgtatctgtatgtaaatttctgtgatcatcacttcaaatgaatgtatatttaattgttgcctatgtaattgtattgttgttgtgcttaataaa

SEQ ID NO: 45599 - DNA, 3760 bp, Heterodera glycines
  Genomic contig location: Contig_ID=SeqID_3642; Location=2221..5980; Strand=-
  SCN-specific regions: Sequence locations=1-9,31-190,231-390,431 -773,811-852,874-936,958-977,1002-1015,1037-1079,1117-2024,2064 -2166,2188-2547,2569-2651,2673-3162,3185-3385,3407-3653,3675-3760
  Gene Ontology: Mol. function=protein binding; Cellular component =peroxisomal membrane; Biological process=physiological processes
taatagaataaattaacaaaataaaagtttatatgactatagtaattaagactaattaggactgattggcacttttcccttttcagcattgttttcgtcgatgcattcacttggcttcggtggcattttcaatgcgaccgtccctatgagctttcttttacgtcttctattaattcctccgatggaattgtaattaattagttttatttattttttattttttaaaatttcccctcagattgatcatttctctcgcatttgcttcgtccgtccttttccttttgctttgctaaattttcgatttgcaattctttcgccctttactgcttttaatctgtttggaatctcaacaattggaaatgaattcacaaatgtttttctcgttgtcagttttatttattattttatttcttttttatttctttttttagaatgcaatttgcgttgagtcatcgcctaaatttgcgccctcttttcatgtcaaattaattgaccaacacattaactcatttccttttgagtgtccattggagcctgaagaggaactcaacaacttttttagagagccaaagttttatttgccactttttaaatgcttttttcttttatttaggttgctttatgatggcgatttatttaatgtatcatcaaatccgaggaattgccgcatttacaaagtgaaaatttcgccatttgaaaattccaatgaatattaattatttaattgaccttcctaattgacatattttcccattaatccgtccccaattaggcttcttttcctccgtcttcttcttcttttgcttcttcagctgctcattttgttcaacgcgacttctcctcctgttttgaggacctttccccgttttctttccacggccgtttcccccaacattcaaatttggcactccatcactttttgccctttcctataagggaattggcacataaattggcaaaaatatttttgcaattgctcagaaatgaaaatgaaaggtaaaataaacgcaaaatgattaaatatattaattattaagcaaaattaacccattagttttgttccaatcgaacttcgaagcggccaaattggccatggaaaggctttgctgccaattggatgttcgactgataagcattgattgtttcgaattcttattaagtgaaaaagaaggccaaaatgacgaaaaaatgttgaaaaatttagcgatggtttttttctcaaaaattaatttgaaaatcacttacaattttcagttcaaaatttcgcgccttgtgtttgttgggttcgcaattccgaagttctgttttcggatgaaatgtcgacacaacgccaaggcacgcgccatttttaaactaaaaaacagaaaataaaatgtttctattttttaacagatttgttcgatgctttggttcggtgcttaaatgctgccaaatgttcctcttcttctgctaatcgctggccttccgttttctttttgaacatttcgccactgtttaacacgagcgaagtgccggaacgtcttgcgaaagcattccattgggaatttcggcttgaagagggcgacgaacgaatgggtgcggaagagagggcggaatatgcggaatgggcactcaaaaacggaccaattgagtggacagacacccaattagtgaacaaaattgttgaaatttcaaaggtaatttgtgacagatgggggggggggaggcagagaagtgatgtgatcagtgaacagaatgagtgcacatgatcaaatcactgatacagggggtcaacaagatcagttgcaaggaattgattgttttgttgtcagaaggactggatggatcattaataaggggtggaccttactactgatcggtaagactagaatgatcagaagaagtggacagatcactgatcatgcgaagtgcggtcgcttattggaaggaatcggtgatcagttgtcatgaatatgatcattatcagagttgatgactggatcaatgatcataagtttagaaataacttactcttaaataagtcattaaaaataaattatgtatttcacgtttattttccatttaccagagcttctctctgtcgcaattgatcaaattgtttgatgatgccaaatgcgttgccattggtgagcatgatcgccattcgttcacagttgccaattcacctcgccttggcattggccattttgaattggcactcaaacggtgggaatccgcttcgaaaagggccggtggctattccgacgtgcaaatggacgacattgggggattggaagaggcgaaggaattactatccgaagcattggccgaattggtggaaaaggatttggccagccaaagcagctgctaatttacacaaattaaggtcgaagagcgaaaatggtcagcaggcgaagaaaatgcaagtcgtctccgacgacggaccggcattttgctgtatggccccccggggtgcgggaaaacgatgttggcaaaaggtgggcaaaacaacgaaaaatggccaaaacgtgcttaaagccgtggccaaccaagcgggactcagttttgtcagcgtgaaggggcccgaattgctgagccaatttgtgggggaaagcgagcgcaatttgcgcgaagtgttctctaaagcgaagcgtactgccccgtcggtgctgttttttgatgagttggactcattagtgcccgcgcgaggggccaattcggactcgggcggggtgatggacaggtgggcaaattgtgatggaaaagaagcggctaatgcaaggatgttcgaattggcaccatagtggaactttaaaagcaattagcttaattattgctatttatttaaatttcgtttaatccgatccccctcatcccccaatccctccccctttctttccttagaatggtctctcagtttttgactgaactcgattcgtgccattggactcgcaacaaagctgtgttcattatgggcgcaacaaatcgcccggatctgcttgacccgtgccttctttccccgggacggttgtccttcaaatttgccgtttggaagtgcatgttggcttttttcagcttcgacaaactcgtccccatcaatccggcaaatgatccaatcgccaaagagcgcattttgcgctcactttgcaagaaaattaaattggaagatggactaagcatcacagaaattgtaaaataaactaaaaagaccccatttcacaaaacgattatttgtttaaggcgaagaaatgccccgaagcgatgtccggggctgaattggccggtttggtcaccgtaaattggggatcccagcagatgtgataatgttttatcatttggcagtggcttttttaataaagtttttgaaattttgaagctttttgtaaagcaattgtcattttttgatcaaaaagcatagaaatttttattttcctttatttcggcctaaaaacatcacaattagacattttagacgaaatctttaagaagactcataaacaacaaatttttgaaaaatgaaagcaaaaaattgttgaggattgaaacagtgtgaaaaaaaggataataataattaatcgtttttactgtttttgaggcttttttggcaccaaaagacttattttcgaattttcatctgtgagtcgagcttttaaggtatttgtgtttcggcgcctcctgttattatcacatggaatcggtgataggcaaaacgccgaacgaacagaaggacaaacggacggaacttttgcagagagtgcggatgtttttggaggataccatc

SEQ ID NO: 45600 - DNA, 1418 bp, Heterodera glycines
  Genomic contig location: Contig_ID=SeqID_3645; Location=2406..3823; Strand=-
  SCN-specific regions: Sequence locations=1-210,259-515,618-665,755 -1031,1053-1139,1171-1296,1335-1418
caaatgaatttggcactttttgtcgcaatttgtcaattcctgcttctgttttttggcacttttcctcccacaaatggcactatttctacggcattttcacaatttctacgaattacttcaatgatgaggtggagaagaacattgcacgcagagatttgggcactgacggaagttttggcggtggaaaagggcgaattaaggcaaagtatgtaaattataaattaattaattttttttcaaaattaaattcaataattagcctattgaagccaatttcaaatttttaagaaaacgtcctgtaatttttgtgcacggcttaacaaatttagcgggagagttggactacgttcggcgactgttccgcgaaaaaggcggctaccgtgacagcgaattgtacgcgaccacttacggttacggtatgaagggatggaaatggctacgtgatgcaatgaaatgtgatcatgtgaaaatggtgtctgtctaaatacgcattaaaatagttaaattaatgacagtttaattttaaaataaaaatatattaatttaaataataaaaattaatttgtattttgatcattttattcgtcgaaataaataattattaaatttattttattcgatttattccttgaaaacaattacctcagtaggtgtctaatgaaggcattataataaaataattaaattaatcacagtttaattttaaaaataaaaatttaattaactaattaaaaaattaatattttattttaatcgatttttctcttcgaaaataattaccacacaattcagattcgcataatgattcgtgcaatcacacaatttactcattcatctcaagtggatattattggctacagtatgggacgaagaacaattgggcccaccattaacccatttggtgcatacattcatcggcgttggcggtgccaaccgtgaagctgtccatttgtgccgactttttgagtgggcaatgccgtgcaatcctgtcaatggcatgcgatgccattcccaatttttagatgacattaattcaaagtaggaattttcattttagaaaactattttttaaatttacataagccgaaaaaatcggcaggatttattattaaaaacccaaatagggccacaaaattgagaaaatttaaatttaaaatattttaaattaaagggttggttatgaggcaaccacacgaattttcgtcattcggtcaatggacgacggaacggtggggacaagggattgtgaagggcgttcagtgagcgcaattgatggacaaaatgacgaaattgtggtaaatattaataataatttaaataattaaaaattatttgtgtttattcagctgcggaactacagccatcagatggtaatttttggaactggagaacaacagctcaaacttttaacattttga

SEQ ID NO: 45601 - DNA, 5597 bp, Heterodera glycines
  Genomic contig location: Contig_ID=SeqID_3662; Location=2112..7708; Strand=+
  SCN-specific regions: Sequence locations=1-218,240-297,319-546,568 -630,662-662,690-2223,2245-3389,3411-3917,3940-4142,4164-4180,4204 -5357,5379-5513,5549-5558,5583-5597
  Gene Ontology: Biological process=regulation of protein activity, epigenetic
tctcatggccaaaacccctccgcctgcggactttcgctcgctcgtctctatcgaacgggtcgcatatttgctgttcttttcgctgtacggccgatatttgagtgttggcaagtttcacaatgttttcaatcgcgagtttttcaaatacacaagtgccggagattcggagagagtcgctttccttaaggtgccatcgccaatttatgggaagggacagcaaataatatccatctttcagatttgtcgaataactttcgaggaatacaagcgaagagtaattgaacacaacaaacgggcctacaaactctcacaaaagcatctgttcagcgatgggcgggcgagtcccgacagtcggtgggacaaagcgcgagtgacttgtctgattttgctgtttaaggttaagcgatcgaccaagcatagaaagcgaggacgtgaacagcaccgactcgctggctaaaggtcggaaaggatcgccatcgcctctttttggccctgactactaacaagggaaccacccgaactaaaaattcacaatagaagtcgaccctgctctatccaatgataccaaacaaatttatatacgttttccgagttacagttcgggtggttcccttgtaagtcgttcaataaaaatgaattattttccttccttccaaaaattattagtaaaaataaaaggtaataataaagtttattcccttcccttcgaaaaatttttagaaacgaagtgaaagacattattgcttcaataaaaatcattcaaactaatcattcaaaactattagactaaaatgaaatcgaagtatttgagtttttgactttacgaatttcggtccggggttcggaattggttgaaatggatccccgaaaaacacttggaaatatgtttccagcctcatctttatgaaacgacttagtaattgcctcttttagttcaaattggcgttttctcctttccgtttagaattgatgtttttccgttttccccacactcccgttcggtttggccgtggtggaagaataatttacgtggacccaacccgctcagttagcactgtctgtattgaagacctgaagcgtttcattaaagatgctgaaggacggagatacgtcgaaattttggaaagttttaaaggttggcttttgccttttcaatgtcggcctaattttcactgtttccacaggccctttgcttgtcggtcacactccgtctcaaacgccgctgctattcatccaatgccaaatcaatcggctcctccaatcggatgtttaccgtgccaatccctcttccggtgatgccaatgattgtctgctcatttggagtctgctcgaaatgctcattcgccaacacggagtgcgcttttctcgatttgttcatttcgatccttacaattaattttcgtgcaaactgtataatacttgtggccgtttaatatatggataattccagaaagtgactggccctgaccttgctcgtctgctttgttccaatcagccaaatcatttggccgctctccgaaaaaactttctcaaaactgacgctgactttgtgcggagttcttctgccatttctcgccaagactctgctgatgctgaaccatcccttgacatttccgccattgaacgaatgacacattttttgcttggcggtcacattgacgtatttcttaccattttttgccaatttatttttctctccaggaagccattgacagtgccatcagcgacggacttctattcgacgcgcttttgctggcccatcgtttgtttcgcgacgacaaggaccgtttggaagcggttgaggggcgtttgatggcttataggtcgcccgatcatccgatcaccaccctgttgagcgtcgcagccgatcagcccgtccctttactggttggttttgcgtttcttacggaacctttcttttccaacttgacatttcccttcagaccaatccaacttcatatgaaaccaacggttggcgttcgcacattgcaattgttcttgccaacttacaaagtccgactgcgatgaacgccgtttatcagcttggcctggctttggcacaaaaggaattcaattcggcagctgatttctgttttcttgcagtaaatttgttgtacggattcgattgcttccaagaacaacaatcgtaaatttgaactcattcacctgtcattttttctttattttgactggaagtgatgaaaatcaccgccgtacaattcgtctgatcagcgccactttgcctgacgatggggcaaattcattccttacgcgttttgggttcgattgatcttttgcggaacacattgttcttttcagctggtctattttggattatcaggcgaccgaactgttcgatttcgccctgcaattagccaacccaaacagtcccactttgttgtccaaatcccattattatgcaaaggttcgtcttcaatacgcgcaattgttggatgaattgggcggattcaaacatgcggttgagctctatcgactcggtaggatttacttattttgttgctccaaagaaggaattggtgtggagtgttagttcggactacattcattttctgataaatttcagagaattccaaccattcgaagacaccgtcgcctcctccactcgttccttctgttcacaaaaccaaattagctcatctcaaaaggcaggaccatgagccaacacctgccgttgctcctgctccacctacttttctaccagtgcagttgcagtcggcatccaaagaggaccatgcgccaaccccttttgccgttgctcctgcttcacatactttccaaccagtgcagtcggcctccacgcagggccaagagccaacggcttttgcagttgctcctgcttcacaaactttcctaccagtgcagttgcagtcggcctccaaaccggaccatgagccaaccccttttgccgttgctcctgttccacatactttccaaccagtgcagtcggcctccagtcaagaccacgagccaacactttttgctgatgcccctgttccacatactttacaatcagttcagtcggcctccatgcaggaccaagagccaatggtttttgccgttccttctgctccacatactactttcctaccggttcagtcggcctcaaaaggaattccggatcactctgttcgttcgcccaacagttttgacggtgagacggcattttgggtggatagataacatacatgaaaaaagagagggcgggggggggggggtcagaaacttgcctttaggaaatacccccctcctgtctacctatgatagataagcagcctttagataggcccgtatagaaacatttgaaaccaatagttcggcagtgcggacatgctcctcctgagaaattttgttggatcttttgttgagaaaatttctccaaatttttacaaattgtcagattgagagtaacccccccccctcccaaccgccctggtaataagccgtttggctttttttctcacaaccaattttttgttatttaagatcactatgaatataagcaccgcccttcgaggagtccgtccccgtcctccgctgccattttgacacattcttccaatgtctcttctaatcataaatttgtggaagattccaaaaagagcgaaagtggtggtggtggcggaaaaggatttcttcgcggctttctctcgaagattaaagcgcctatggagtctaaagaaatgaaactgccgaaggacaataacccgaaggtattattgaatcggtcgatttgaccaacctttccgaaattggtaaaatgcttttgctttgactgctatttcggtgttcagattgtgtgggactcgcagttgggccgttacgtcgaccaggaacaagaacagcaaccacaagaggagctcgcgccccctcctatcatgccgacatatcagccgcaacagtggcaacaaataacccaaccagcggagcagcagcaaccgccaacagcgccgtctgttggccgtgctttccaaggagtaaaagtcggtcgaacgccaaccaaatttatttgttattttagaagtcgagatatgccaatgcatggaattcgtaaaacgcataagaataaagcagttgttgtgattaattgactttctcttagtttctaacggatttacagtcattgtgaataaataagaatcaaaactttttcgctacaatgtgatttttaattcatgggaagatgataaatttctggcataattattgcatttttttatctcgaatagacatttactcatcttggctgaaatgcacgaccgtaacatttttaaactttgcccgcctaattatgaactccttgcaaggaaataccacgatttcagagtcaaatgttttattggggcgggtggaaaggtaactatcgaaaatgtcctcatttttgctctgcatattttggtgtctttttaggtttgtgtgaatttcgcagatgctgagtccgtgcgtttgttgtcccaaattttgctgattgaatacttccaattgaatgtccaacttccaattggtcatctcgtgccgcgcgtccctcagcgattaaattacattttattagtggaggatttgatttgcaaaaataacttcgatacttccaacgtttgggggtttgacattggtactaatctctctctgactcggataacttaataatttctgggacgggtgcttcgtgcatatttccgcttttgggggcacgtctcaatggatggaattttgtggcgacagaagtggacgcgaattcattcgcttacgcagcacagaacgtcgaccgaaacaatttgaaaggacggattttagtggagcaaacggagggaaattcgcttctgaaagttattgtgtgtcttattttagtgatcgggtaattcggttcaggaagtgatgtcgaagggaccgcacaaagacaaaaagtttactttttctatgtgtaacccgccattttttgaccccgacgaagccacgcaagttagtcataattggtataatccaattgcccacttaatcaagaaatttaccgtcaattccgctgggaatacaatgacaaatttgttagttagcgatcacaacaaccccccaggcaaatgcccgccccattctgccaccactgcaacgcgcacagaactttcttatgtggtactttttcgttcgctaaaaaggaagtgcttacattattagggaggtgaaagtgcttttatcatcaaaatgttagaagaaagcgtcgatttgagcaaatctttttggtatgatttgcattcattgggctgacaattacactaatctttttctttttttgttagtttttttacaacgatggttgggaaaatggcgagcttaaaactgcttaaggaggagctaaacagaagagaaattcggtggtctgtccactcattgtgccaagggaaaaccacgagatgggtaaacatggaaaaggcggagaaagaaactattcgattgttttttgtttaggttttgacgtggacatttttggatgacttcaaaattgaataaaataataataatttacctttcttatggcacaaaaattgatcatttttataatactattttaattgttgttttatttc

SEQ ID NO: 45602 - DNA, 5352 bp, Heterodera glycines; identical to SEQ ID NO: 3663
  misc_feature (2214)..(2214): n is a, c, g, or t
  Genomic contig location: Contig_ID=SeqID_3663; Location=1..5352; Strand=+
  SCN-specific regions: Sequence locations=1-125,162-275,298-431,465 -585,643-778,819-860,983-1003,1027-1083,1107-1257,1288-1370,1392 -1518,1604-1606,1629-1652,1914-1949,1978-2886,2916-3083,3107 -3989,4015-4425,4447-4671,...
  SCN-specific regions: Sequence locations=...4693-4864,4889-5048,5093 -5098,5131-5352
  Gene Ontology: Mol. function=structural constituent of cytoskeleton; Cellular component=membrane; Biological process=protein targeting

SEQ ID NO: 45603 - DNA, 1184 bp, Heterodera glycines
  Genomic contig location: Contig_ID=SeqID_399; Location=648..1831; Strand=+
  SCN-specific regions: Sequence locations=1-327,357-392,414-447,469 -594,619-722,744-929,952-1184
  Gene Ontology: Mol. function=single-stranded DNA binding; Cellular component=nucleus; Biological process=DNA replication
gaaaatcaaaacacatccgagtcactggcattgtccgcgttcgtacagtcatcgtcatgttctgcgaatgaccaagataacaatttggatggtaggaacagcctgcatgaaaattacgacaactacgactctccatcagttggagcacctggaaatcgaatactaagcgaagtaacttgagacatccaatattcttctgttgtatatataacttttactccagaccaatctgtacattagaggactcgatgaggaatgcacggatgagagactgcggcagatgtgttcaagatttgggaaggtaaagatttacttaatgttgtctaactttccaaaaaccagaattttttctgggtctatcaaaaactccgggtttacttcctgacaaacgattcctgttttctttctttttacagattgtgtctacaaaagcaattctcgacaaagccaccaaaaaatgcaaaggctatggcttcgtcgattttgagtcttcagcttcggcacgagacgccatcgaagggctcgagaaagagggaatcagcgcacaaatggccaaggtggcgtacacacatctttcctgaacttatatacattttagcaacaagagcaagacccaaccaatttatatattgccaatttaccacctgaatataatgaagacaagcttactgatttgttgaaagaattcggcatggtgatcagttcacgggttctcaggtcacaaaatttaaaaaaaaattttacttaaatcaaatgttttagacacccagacgggtccagcaggggggtcggcttttgtcggatgggctgtaccgactcatgtgattctataattgcggtcagtttcttccgtgggagcctttagtaaaaagaaaagttttaccttaagaaatacaacggtcggaaattgcctaatgcacaagctcatttgatcgtcaaatttgcggacagcagcagtcggaaatttaagcggtctacgccctctttgaggtccgtctactcggagtcgtgctataaacccaaagggggtgttcctccgctgttgacaacaccgttcattgaaccggtaaacccacaaattcgaattttatatgttaactccgtttttagacctttaaccagactgggtaccaattcggtggaactctgccgaacccttctgctcactatggaccttcgtttta

SEQ ID NO: 45604 - DNA, 732 bp, Heterodera glycines
  Genomic contig location: Contig_ID=SeqID_3668; Location=299..1030; Strand=-
  SCN-specific regions: Sequence locations=1-140,162-362,384-732
  Gene Ontology: Mol. function=U6 snRNA binding; Cellular component =nucleus; Biological process=growth
atgactgtagacgaaacgagcaaaaagaaaaaagaaagcattgtcgatttatcgcgttttattgacaaaaaagtgagagtcaaatttcaaggaggacgagaaggtgaatttagttttacattaaacaacacaaactatctattttttaaaattatttttgtacatacaaccaaatatttttagctgccggaattttgaagggttacgaccaattgctaaatttggtgcttgacaatgccacagaatttttacgcgatccagaggacccactacgaataactgacgaaactcgtaaccttggacttattgttgcccgcggtaagaatattaaagaataaatggtacttatatgttatctgtgtacatatattcaaaaatattttgttttggctataacttatttctttggcatccaaatccaacattgttggtatcattcgaaagcttaacatgtttcgaagctatttctaaggtatcgcttcgcgagtagactattaccaaaaaagttatacatgaaagttgcgaaaaagccgaaattttgaagttttttcttagtaaaattttgtccaggctagaaaatttttaggttttttgaaaggctaatagagcatctgaagagctttcgaatgataccaacaatcttggatttggatgcaaaaggaaaaagttatagacaaaaacataaaatatttttgaaaatctgtacacagataacatataagtacgaataaa

SEQ ID NO: 45605 - DNA, 1081 bp, Heterodera glycines
  Genomic contig location: Contig_ID=SeqID_3670; Location=2305..3385; Strand=+
  SCN-specific regions: Sequence locations=1-8,30-959,981-1081
  Gene Ontology: Mol. function=snoRNA binding; Cellular component=small nucleolar ribonucleoprotein complex; Biological process=rRNA processing
atggccgcgacttctcttcaacaacagctcaagaggcttaaatcggcacccaccggggctttggcggttgagcgtgattattcttcgcttcttttcaccaaaaaagcggcggctgctttagaccgagacgagttttacaaaattggtgattttctattaagacattgttagaggcgtgggtggggatttgttctctgcaatgattattgcgagttgcgttttttaggacttgctgggctctctggcatgaaaaaaattgacaatgcattcgacacttatgcgccagaattgttttggaaggacaagaaacggttcaatagagcgatgctccagaaggatgaggcggagcagttcgaccggcggattgagacatttttgctccgtctcgccgcccatttccatcaccagtgctgtcggcaggtgctcgaatggctcatccataactatcaggttctcgacgttagaatactaacggaagatcccctttaggaatcgtaatcgatcaattagaaaagtcgctttctgtctctgcctgtcacgactaactttctaggcgtttccccatgtatattggtttgatccttccattttcagattcacacatacaatgccgaggcgcttctgctcgcttttctgccttatcacagcgtcaattccttcggtcggctcctccacattctcaaattcaactccactgcttgggattggctgacggaatatcaaagggacgcagcacctattccgatgaatattttatgtatatttacgaactcgcttccgttttatttcaaattaaatttctaaaaagttttcaaatttaataattgaaaggaaaagtcactgttaaggcagagcatgtcaagtcggtcgttcctatggactcgtttccacactgtcgaacttcgtccaaatggcaattgagcagcttgggtccacatatgccaatgacaaaatgcaaaattattttacttttttggtgtctttgttcggcattttgattgaaaactcgacagctgacggaactgttgatgaccaactccttgccagattgatgccgtttttaagcgttgcattgaagtga

SEQ ID NO: 45606 - DNA, 2236 bp, Heterodera glycines
  Genomic contig location: Contig_ID=SeqID_20848; Location=976..3211; Strand=-
  SCN-specific regions: Sequence locations=1-40,86-202,225-353,375 -399,515-588,625-823,893-903,1013-1197,1231-1354,1376-1384,1563 -1568,1590-1631,1666-1855,1892-2236
  Gene Ontology: Mol. function=RNA binding; Cellular component =cytoplasm; Biological process=mRNA polyadenylation
atgaaaaatcgcgaaatagaaaaacaaatttctaaggaggttaatttaaattgaaaataataatttttaaatatttgtatttttagattcaaaattttgtttctcccaaaattaatccgattaaaaaagaagcaataaatcatttaaaactaaatatcaaaacatcagtagagaagtggacagctcaatttacagcaattagtaataattattaattaaaattagctaattgatatttcaatttattatttgttttagaacctcgattgcttgttggtggctcacttttaatgaatggttttgtggatggatcagatatggatttgctctgtgttttaccagacgaaattgaatttgaccaattatttggtgaagaagataaatgtttatacaaatttcttaaaaaagtaaatttaaaaaaatattataaaaaacactacagaaataaattaatttaaatttttaaatatattggctaaaaataatttgaaaattatatttaaataaatttattcttcaatcttttgaaaaaaatatattgagtgatttacttttgttttccacacaaattaccactaattaagtttgaaaaaataataaataattattttttagaatttaaatgacgtcatcagcgttaattggctgcagggcaaagtgaacattttgcgaattgatcaccaacaaattgaagttgattttttgccggttattgtgcctggaaaatatttattagaaaaagacattcatattgaggatgatcaactaattaagcaaatgaccgaagaaacaagcatttaccctttggcaggtaaaaaacgacaaaatattaaacaaaaaaacatataaataagatttgtgaaataaatttaaaaataataaatgaaaaaatgggccaccatcaattaaaaattaattttgataatagaaaaattaattttaaaactattaaaataagataaatttattccataaacaaaatccattaatagttaatttaataaaaaaaaatgctacttaattcatatagttaaaaaaatttattgcaaataacacaaaatatcaatgtaaacaattaaattgattttatttcaataaatcaagtttaggctacagatcatcaaaataccaattatcgcttatcccaaatcataaagaattctctgcacttttaaaggcagtcaaattgtgggcaaaaagtaataaacaaaattttaattttaatcttttgaattttaagataaacaaatatattcgggaatttttggctacttaaatggtgccactttgtcagtgatggcgtctaaaatttgcattttgttccccgacgcaccgttgacctttttattatatcaatttttctcacattttgccaattggtacgaatttattttgttatagaattatttttatataattttataaattttttttattattacaattgaaggacaataataaacaattttaaaatttaattaatttaatttcaaaaggaatttgcgtttgaataagttatttttaattatttatttattgaaatattatgaattattaattatcgcgatcccttagatagttaattaatttgatcacattcttaggtcagagtgaattttctaattcaaaagtatttaaataaaataataattattttttattttagggattggtctcaagcagtgcttttaaagaaattgacacccgttacaatgaacaaaattgtgcgaaaatggccacccctttttggcatttcgccaatgactgttataacgccaaagtttcctgaacaaaattcaacattcaatgtgaacacttacacaattgaaacaataattgacgaattaaaaatgggttaataattttttttattattaatttaattaaatttgcacttcgtttagcaaacgaaattctgacggaagacattaaaaaatggaaaaacattttccaaaaaaggaaaatgaaacaaagttttgatcattttgcgatcattttatgctcgggaaatgaatttgatgaatttttgaaattttgtgcttatcaaaggagcaaaatccgtgaaaatttgcttggctgggcaaatcaacaaaatgtggcggaaattattgaacaatttcatctgatccctcaatcggaacaaaaattcgcatgcaaattgaaaaagtaagaatatattatcaattcaattaaaatagactaattagtattaaatttcgaaagattttttaataaa

SEQ ID NO: 45607 - DNA, 1770 bp, Heterodera glycines
  misc_feature (187)..(187): n is a, c, g, or t
  Genomic contig location: Contig_ID=SeqID_3681; Location=1..1770; Strand=-
  SCN-specific regions: Sequence locations=1-92,122-229,251-1077,1099 -1174,1205-1206,1228-1770
  Gene Ontology: Mol. function=actin polymerizing activity; Cellular component=cytoskeleton; Biological process=cell cycle dependent actin filament reorganization
ttgatgcatgccaatttgccagctgctgtaattgattgtggcaccgggtaattaagaattactgctttttgcgttttttatttttcttttaaggtacacaaagcttggctatgcaggaaattcggagccacagtttatcattccgtcggctatcgctgtcaaagatgcgaatattttgaaaagtgtncggcggaaaaatcccggacttggactttttcatcggtgacgaggcgttgtctcctttggctgcgaattattttgttaaggttctgtttttctcattttattgtctattcccaaagtatattatgcttttctcagtatccaattcgacatggaattgtcgacgattgggacctaatggaacgtttttgggagcattgcattttcaaatatttgcgagccgagcctgaagaccattactttctgttggttcgtccgtattcccatccatcatttcctctttaattgctaaaatttcagacagaaccaccgctgaatacgccggagaaccgcgaattcactgccgagataatgttcgagtcgttcaatgtgcccggcctttacatcgctgtccaggctctgctcgccttggccgcttcttggcaaacccgcgagttcaaccaccgttctctgactggccttgtgaatccccccccccctgaaatttgttaatttgtttttgaggtggtggacagtggagacggcgtcacccattgcatcccggtgtgtgatggctatgtcatcggttcctgcattaagcacattcccatcgccggacgcgacattacgtactttttgcagcaggtattcgactcgtgttcatatgcaatctggtcagaatgtttaatttaagatgctgagggatcgtgaagtgaatgttcccagtgagcagtcgtacgaagttgcaaaggcaattaaggtaattgcgatttgtattcattatttattcgttcaaatgctgggcgtcatgtgcaagagatgtaccaaggcgtgtgactttttttgcttgtggtatctgatttgtaggccacacttttaaaaaaaaaatggcaaaaagcatatggcatttctgatagatgtttcctggaaaattgaaattttgcaagtatttttagagattttgtgcaaaaatagtctatttttgtgaaagataacatggaataattattcgaattataataatattaaatataataattttgctttttccattaggaacaattttgttacgtttgtccggacattcacaaggaatttgtcaaatacgactcggagccggagaaatggctgaacaaagcatataacggagtgaacaatatcaccaaaaagccttttgcggtcgatgtcggttacgagcgatttatgggcccggaaatattcttccatcccgaggtttggtttttgcacgaattatcaccgcggaataggacggacgataaacagaattcatcttcagttcgtcagctctgactacaaaatgtccatttcggaagtggttgaccaggtgatccaacagtgtccgatcgatgtgcgcagagggctttacgagaacattgtgagcagtggacaactgttacacatgcaaatgttaaagccatacacttactatcgttttttaggttctttccggtggctcgacaatgttcaaagtgagcaaagaaaggaaacgaccgaccaatgaccattacatataaattaattactttccaaggatttcccgagacgccatcagagggacgtgaagagactttcggatcaaagatgaca

SEQ ID NO: 45608 - DNA, 1016 bp, Heterodera glycines
  Genomic contig location: Contig_ID=SeqID_20859; Location=903..1918; Strand=+
  SCN-specific regions: Sequence locations=1-609,631-747,776-804,826 -1016
  Gene Ontology: Biological process=reproduction
gcaacgcgttaatcattttccacggagttggatactgaccagaaaagaccaactttacgagagcattgagcgtgcctccgttctgtacggttccgattggttcaatttcgtatgtttcgaacaaaatcatttgaaaaagcattcatttttcagattcccgaatttttttgtactccgatgagcagcgctgcgcgacattccatgggccaaaaatttcaaggggctaatttaggatcggatgccaagtttattgtgaagccggccgacggcagtttggggaggggcatttacttcttggacaatggcaatttggttggagagcaatgcgagtgcccgtttagcagtgctttttcagaacgaaactctcgagactgacaagaaattggtggtgtcccgttacatcgaccgtccttttctaatcaacggattgaagtgggatttgcgcgtttatgtgctcgtcacttcgttctatccgctgattgcctacatttacaggcaaatattctattcttttgattctgtgaattaattaccaactcaaaaaatgaatcgcatttttaagcgacggattggcgagatttgcggtgcataagtacgacgaaaaagatgaaattgacaaggtggaaggaggagtggacatgaacaagcatctgacaaattattcactcaacaaaatgtctgccgaatttattcgaaacaccgactgtagggaggagaatatgggtaaaacgcgattttggaatttccattttttctttctttaaaatatatttaaaagcattgtttatcgtcttcgtttcgaatttattttaaaatttccacaaaaattcttctcgatgcatattttcaggccacaaatggactctaagcgcacttctgagggaattggagaagcgtggcgaggacgtgggtcttctgatggttcgaattgaggacattgtcatcaaatcgctgctttccgtccaaaattccattgctgcgatgtgccgaaagtgtaaacattctgttggagaaga

SEQ ID NO: 45609 - DNA, 1068 bp, Heterodera glycines
  Genomic contig location: Contig_ID=SeqID_20867; Location=1319..2386; Strand=+
  SCN-specific regions: Sequence locations=1-248,270-379,401-662,685 -866,896-1068
atggccgaaacaactgttcttattaataaaacatcaaagttaccttacaaattaggtaggtaggtacctattctacaattgttagaatttctactttttaaataaaaaaaaaacttgtgaaccgccaattacaaaacgccaaagttgaaacaattgaaattttgccgaccgacacacggcagtaccagctgaaaactttttttttttacttattctaaaaaatttacaaaaaaagaagaatacaacccattaagataaaatatacataactttctttatttaaagccttttaatgggtaaaaaacgaaagatccgaactggtgccggtgatgttgtccccgttcctgggcctcttcttaaacaaattgaaaaagacaaatttgcaaaaccaaaatcacatcttcaccttggcaacaatcagaaaaaggaggacgaacagggaaaggtggttttataaattaatcattttgtgcattaaaatcagtttttagttcattgatgctgcgctgagtaccaaaattttacgcgaagcgtccaaacaatggaaagcggaggagaaaaaaagcggagaagaaaaggcattggaaattgaagaaaaatcggacgacgaagaagacatttgcaagcaagcgcaggaattggcagaacaaattgcagtgagttttctttaatggaatttaattgaacaataatttgcaatggaataaactgaaagatcaactcggaagaagaagccgatatttgcggatttaccagtgaagctgacaatgagcgacgtaatattagcagaacaaagaaaagggagaaagaggcgaaagcggagggcagcacaatcactccaccgattgaggcaattgtcaaatcgcatttttatttgtaaatttaattttgtattgtcagattgacggagttaatccggctgtggttgccctctttactgaagttggagctgtgatggcgaagtaccgcagtggaaaagtgacaaaagccttcaaaatgattccggcaatggcaaattgggagcaaatactcgagtgagtcacttgttttgtattggccagtgaaaaa

SEQ ID NO: 45610 - DNA, 928 bp, Heterodera glycines
  Genomic contig location: Contig_ID=SeqID_3687; Location=1..928; Strand=+
  SCN-specific regions: Sequence locations=1-94,116-176,198-282,304 -630,652-715,737-764,787-928
ccccccccccccccccggttgagtgatatgctgctgatcttaacattttgggaacggacaattgattaagataattaattatttttgtcccagcactgtctgtagagtttttgaacgaattttgagtagcaaaattttagaatttctgaacaatataagattttttgataaagaacaatttgggtttctgaaaaataggtcgactacaacccaaatattaaaaacgatggacgatatatataattctatacaaatgaatcagcaaattgacatcatctatattgattttgtcaaggtttttaaaaaatcggagttttaacgttaaaattggcgaagaattgtcagacagtttcagaatattttcaggagtgccccagggaagtgtcttagggccattactctttttaatttttataaatgatctgccgtcctttattgcaaatgaagcggcatcagttggcataaaaatgtatgccgatgatgttaaattatattatgcacatgaaaacgatgaccattcaaatcagttggataaagcaattgaggctttggaaaaatggtcaaaaattaatgggttagaaatttcaactgaaaaatgttttgttttatatttagggaaaaataatatgaaaaaagaatattttattaactcaaaaaagatttctgagtcggataatgttcgtgacttgggcattataattgactcgaaacttaatttttcagaacacataagcaaaattgtacgaaacgcatatcttagaagctttcagattttgagtgttgaaaagcagggaaataaagactctaacagcagattataagacttttgtacgacctcaattagaatattctaccgaagtttggaaccctaatttaaaaaaaagatatagacaaaattgagcgggtacaaaaatttttcacaagaaaa

SEQ ID NO: 45611 - DNA, 1761 bp, Heterodera glycines
  Genomic contig location: Contig_ID=SeqID_20881; Location=175..1935; Strand=-
  SCN-specific regions: Sequence locations=1-572,594-778,809-830,852 -911,932-991,1015-1463,1485-1546,1576-1591,1614-1761
  Gene Ontology: Mol. function=transcriptional activator activity; Cellular component=cytoplasm; Biological process=N signaling pathway
tgtccccattttggccagctttaacaatttttgccagctttttccctgttttttttttgccaatttgtcactttgtccgcattttggagcaagttgacattttgtccccattttgaccaagtcggcattttcccattttggccagtttaaatgtgtttccaactttgcccctgtttttgcccattcacagttggaattttgtcgccattttactgcccaattaattaggcactttgtcccatttaatcacttttttttgggccaagtggcattttgtccccatttttgccaactttattatttctttttccccctcagattgccctgttcaaccgtttgcgttcccaaacagtgtccacccgttatctgcatgttgatgagaaaatcagcaccaaccaaaagatgcatgaaccgcctgcgtttgtggccagctcaacaaaatggggcgcatttcacatcaatgttggtcagtgattgattgattgatcagcgaaaatgaggctatttggggcctaatgggtgggtgtaattaattggtttcctgaaattttttgcggaagccatccatagcgaatttttaaaaaattgaaaaaccgttattccgttgcctgaaatttgtgacaaaaatcaaaacagcgccaggcgataccggcagggaaaaaatgacactgtttctaacaaattttcagcaaaaatttaccaatttttgagtcaaattttgaaaatttagggcaattagggggggtttccgtgtcggtgccttttggcgccgtcttggaaaaattttaaatttttaataaatttttaaggaaattaattacccatctctattttttgtataaatttctttaaaattgtatgtgttttttttccgttcagttgaccagcccgaatttggtggccaacagtcccagcagcagcagcagcagcacacggtcacctacgggtcggtcattcagttggtggacagccaaacggaaatgcgacttccgttgatggtcagtcagtcagtcatcagtttcaagcagtccaacacaccgattttgatctgatcagatcttgcttgtgaaaggcttggtctgtaatctgctgattgatccaaaattgatcaaaaaatatccacccaaaaactcaacccgccgatcagagccttccttgatcatggagctgaatcagatcaaacacaaaatgcctaaatttcctgtgaaaatgtgtgccaaaatctgttttctttgggtttctcggttctcaaaaaacatgaaggagatttaggaaaggaataacgggaaggatccttgtgaaaaaaagtcgggtttttcgctggtcaaacattttgcaagacccctgtattttaaaacaaaaaaaaaatgagtcaaaatttatgaatacctgctgaaatcgaatattttttcttgcatcccgtaattctatgctaaagagtgtgagcatttttaatccaaacattttatttttaatgcaaatttcagcgaattcgcaaggtggacaaacagcacgtgttgttggaccctgctggacaggtaggaccaaaaaaacaaaaaaaaaaatttattttttgacgaaaattttagctaaaattatgaaaaattttcccctcaagggcgagccggtcagtcagctgcacaaatgcgccttccaaatggttgacgtggccagcaacggggcggagctgttctacctgtgtttgagccaggacaaaatcatccaattccaggcacagacttttcaatgggaaagaaggaa

SEQ ID NO: 45612 - DNA, 850 bp, Heterodera glycines
  Genomic contig location: Contig_ID=SeqID_3691; Location=629..1478; Strand=+
  SCN-specific regions: Sequence locations=1-59,136-437,460-470,507 -535,584-659,682-779,802-826
atgtcactaatgctattacgtcttcttcttgttttgctaatgtttgctgttgaagcaggtaaaatttcaaaaaaaaaaaatatgcaaaatttcaaaaaaaaattatgaaaattttcttaaaaatcaaaaaaatttcagcccatcaacaacaactcggtacaccagtaatcggcggcatatgtaagctggacacaccagacgtgcacataggcggcaagcaaacacaattctttctacgctgtgagccgaacacggattcggcacagggcgaaggcgtttgggtggtgaagagtcggcatgccggttcaacagctgccaagtaagttttttatgtatgatcagcagcagggataggacttacacatataccatatttcctaaaatgcaacccctctaaattagagccccccccccccctctgaaatatagccacccttttgagggggatttgaaaataaaccccatggggcttaatttttagatatatttttacatataaatattttcacctcaaattaaaacgactttttagcacataaaaaaataaaaatcttattttatctttttaatttaaaaaaattatccactttttagcaaatattttggcatgtattttttggatttttagcatttgtgcactaccgtggcttaaaaatgatagaaaactgtgattagctttctgagtatcagcaattggttaagaattttgcgacgttatagaatacctgccgctgctgttgtcagccaacaagaaattgagcaaggcgaacaaaattcacaaaaaattgcagcaacaaaacaaatttcaagctatgtgtgcggtccgtttaaattaaaaattattttataa

SEQ ID NO: 45613 - DNA, 658 bp, Heterodera glycines
  Genomic contig location: Contig_ID=SeqID_20889; Location=1526..2183; Strand=-
  SCN-specific regions: Sequence locations=1-544,566-658
catgttggcagctgctcaattttcactggagcacgtgggacgactttccacgtacggattgacattgccaacccgtcggtgagtgccaacaattgcccagggcactttggttgcgcaaatgttgcggcgtgtcaccaaaaatctcgaccttggcgccgaatacatttaccatagggacgaacggtttcctggttggttgaaaaaactggaaacgaatttgttaaaacattaaatggcaggcaaacagtcgaacactctcagctacgccttgcgctacattcagcccacttggatattttcgggaactcttgcgccaaccgaactccatttgtgttactaccacaaacagagtgaacacttgcagttcggcgttgaatttgaggcgaatttcaagcttcaggtccttttccaaccaaatttttactttttttaagaaggcatatattttcatgaatttcaggaggtgaacacgaccttcgcctatcaaattgaagtgcccgactctctgactctgagggcctgctgcgacacaaattggaaggtcggtgctgtgctggagaagaagctgtccaagcagttgcccttctcgctggcgatcagtggcgtgctcgatcacgtcaaagcgcagggaaagttcggcatcggactgctcattggc

SEQ ID NO: 45614 - DNA, 3232 bp, Heterodera glycines
  Genomic contig location: Contig_ID=SeqID_3705; Location=1773..5004; Strand=-
  SCN-specific regions: Sequence locations=1-127,149-204,245-406,437 -571,593-594,618-648,670-1069,1193-1275,1306-1624,1646-2109,2131 -2181,2203-2255,2277-2969,2991-2998,3020-3232
  Gene Ontology: Mol. function=heterogeneous nuclear ribonucleoprotein; Cellular component=nucleus; Biological process=RNA processing
atgaccattgttgtactgtcagggctgaccgtggaagaggtggtgttcgggaaggaaccggggctagaggggcgacctacgggcgaggggtttgtcagattcagcactgccgacgaggcagaacgcgctttgcaacaaaacaaccaacacatggggaacaggtacggtgtttgccgactgtttgtcggtgatttcatcgttcacaaaatttaaaattttcaaaaaatatataaaaatttattaacccgaaaattccgccaaccattcattctctgttgttgatgatgtgacgtgaaccccccaaacgcgacccatcccaattgatgagatgagatgtccattgatggaggagtgtgtgtgtctctttggttgaccaccccactcactcgcacatgacgaggaggttggaataggaggtggtggtggtggcaaagaatggatggggggttgcaaatggtgcaaaattggtggtggacgcattggacaaacggaatgcgggagggtcgggatggaaagagaggatggacaggaggaaatggcggagggttgggcggtggaaaaaaacgacaactgaaaacccccaacaaatttacaaattccacaaataaaattttatacgaattcatctttaaaaggatgctatttgaattaatgctttccctttttctacagatatttggagttgttcaagagcgacggtgccgcctttgaagcgttcaaagcgcgtgccaccaacaacattgttccgctgaaggcgttagcccaggcgaccggcgacccgtacgcctcttatggatatggtccggctgcatatgggcaagtttccatttattttaacacaattccattaaactacaaattttctactatttgtcaggactggttatgaacagcgtgccgctggcgggcgtccgatgggacgaggcggttatggaggtttgtgttgaatcaactcaccaaacagcatcatctcattaatccattcagctgggggtggtggtccggcctctcaccgatactcgccttacccgagctatcccaactacgggtacggcactccgcgacagcccggcggcgccggtggtgcgggaggaggcggttacggtgctggacgtggcggtggtgctgctgctgctgctgcagccatgggtggcggtggttacgatgacggatacggcggctatggaggtggatacaatgcaaatcccaacgctggaccgaccaaagtaaaaaaggaactatttaccggtttttaattcattctagtgctgcgtctatatattttaatttcaaatattaattttagctttacatgcgcggaattcctttccgtctgacagccaatgacattgaacgtttcttttctccgctcgtttgcgtggatattcaggtagtgattgtgtgaatgtcgaatttttgctttaatttcaatttataggtcggcacaatgccggacggtcgttcaagcggagacggaattgtcgaattccaaacaccggcagatgcgcgccaggcaatgagcaaagaccgggaatgcatcggaaaccggtaaagagacatgtgcatttacgcccaccaattaaatgttaaaaagagagtgggggtcgaccctacagttcgcaagacgagatttttcaaaaaattaatttagtgaataggcaagtcttcgtccagtttattgataaaaatttcgtcaattcgttaaaaatttgatgaaattgagtcacatttcgatttttataaaattatgacttcaacgttcttttatatgatttcattttttacctatattatatgtctttcaccttggattcgttcaattcagttacgtggagcttttcccgtcactgtcagcgaagattccaccccatgtcacttacgaaagcatcggtggtaagggcggcggtggcggagggcgtggcggtgccgcagttgggccggtgatgccatccgcagcgcaacaatacgcgcaggtctgttacgtttgccgtgtcaaatattttttgttcaataaataactcgcatatttcatttttttctttttggactaatatccaattttgttttctctcatattgaaaatccattccgacaataaattagtcacttaattctttgtctgttctttgtttttacatttgccatcattattccatgctcattcgtttatttatctgctccattttttctcttttcacagcactctgactattcaactgactatagcccctaccaccaggcaagctttggacattgggaagaaagatgagagatggaggaagggaaggcgtaaaatgaacgtccaaccgcctcctttcctttttttgtttgttgatgggttgggagaagttctaccacgaattaggaagatacaaaaaaggagtcatttgtgttatgtttttgactcggataccgatgtccttatcccatttcgatcaacttcgtttggccattccccataccatctttttgtttatttctggtcaggcccacttatcatgcacactcacgcttgtgtccccccttccctccgtttgtaggccgtccaacaacaggtggcagcattcgcgagtggcaactatccgccgagtggtgcgtctgcaggcggaatgtcgggcggcgttggtgcgatggccgccgccggacaacaccaccaatatggacagtacccgggcgactattcgaccgcttattatggtgcgtacggaggcggcgacgttggggctggcgcacagccgaaaacggattacaactggttagtttagtggttgggttgctgattgccaaatatgaaattgtttttaaggcctgcacctcaattctgagcagcgggatggactcaaccaaagcagcaacgcggacggatacctgcaacgaaacgatctgttctcttctatttttcgatttgtttttcttttttcacacaaattgtgtcctcctcttttttgtcgtccgcactgttgttgtctcaatattttttgtatgattttaccatcgttccattttatgttatgttaaacttttaaaatccacaaaatgcgtcgtcatggacatcatttattagcccagggccaattaaaacggaattcatggggctcttttattgggggagtaatggatctcatcacatgggttgctcccattttcctgcttcctctccccctcatcagttatactaattatctttggcccgaatcaaaattttgtttttcacatttattttcgtaataaa

SEQ ID NO: 45615 - DNA, 1226 bp, Heterodera glycines; identical to SEQ ID NO: 20968
  Genomic contig location: Contig_ID=SeqID_20968; Location=1..1226; Strand=+
  SCN-specific regions: Sequence locations=1-309,334-448,478-561,583 -595,619-800,823-1172,1195-1226

SEQ ID NO: 45616 - DNA, 1368 bp, Heterodera glycines
  Genomic contig location: Contig_ID=SeqID_20971; Location=307..1674; Strand=+
  SCN-specific regions: Sequence locations=1-1368
atgagcgtaattaaaaagattgacaaagacagtgttgagggtctggaaggaagtctttcattattctctttgccgccaacaaatgtggccataaataagacaaacgtccgtgaattgttgcctctgtctgcacttaatcagacaggtccttatttgtttcgcctattctcggacagccaattttgtgacttgagcaaaacctatatgtacctgctcagctcaattgaacggaagaatgacgcgggagaatgggtagcactcagtgacacggacccaaacgataaacatgttggcgtcattcaaaactttgctagcagctttgttcgctcgctgaaggtcaatatttcaggcattgaggtgtttgacagttcaatttattatcactaccgcgactacataatgaaggagttgggctattcacaggaaattcgcaaggctttccatgaggcatcgtgctactatgccgacgatgatgaccagaacagcgcaacaaacccaggttttaccgcacgtgcggcacggttttcaggcggcagacaatgtgagacaatggtaaaactgaattttgatttggcacgtcaaagtgcattgatgttgaacaatcaggatgtaatattcactattcaccgcaacaatgattcattcctcctgcttacgcccccatacaaaaaaccagatggtacacagcaggaaaataagaaagagtaccgcatccgtgtgcatgacatgcgtctctatgtgcgcactgtggacgtaacgccaagccttaaccttgccattagccggcaattagagtccacttcagcaaaatatccgctgcgtaaaattgagatgaggtctattttccttggcacaggtcggaccgagctggcacacaatgtgttcacttctacgttacctcgtcgtttaatttgcactttcgtttcaaccgatgcatattccggtaaccgaaaaatgtcaccctacaagtttgagcacgccaatgtacgttcgattagtgtcgaggcgaacggacagacttttcccagcacaccgtatttgctgtccttcgatggtgtacagccccgctttgtccgtgcttttgtcgacatgtacgcaggcctgggtttggatgactccgacaccaaaacggtctcgattgggatgcagcgttttcttaacggttgggcctttttcgtcattccgctgacttccactctggaggacacacctggttttgagctgatcaggcaaggcacatgcacgataaaggtgcaatttgagcagcctataaaagcggatggatatgagatgcttgtccttggtgaattcgattctgtgttgtccattaacgcagaccgggttctgagtacagacggaagtgtgtaa

SEQ ID NO: 45617 - DNA, 1629 bp, Heterodera glycines
  Genomic contig location: Contig_ID=SeqID_21006; Location=1426..3054; Strand=+
  SCN-specific regions: Sequence locations=1-57,81-123,145-812,834 -980,1006-1236,1258-1279,1321-1629
  Gene Ontology: Mol. function=transporter activity; Cellular component= mitochondrion; Biological process=transport
atgtctgcgaaattagaaacaaccagtccagatggggctaaagtcagcatcaacatccatgacagaaatgaagaaaaagccttgatcaactccaaggctgtccatgtgaggctgtttttttggaaaattttgaaaaatcaaagaatctgacgcttaaacggattgctattgatatttatatggtctcatattgtaaattttaaaattatacatcgggtcccgatctttttgaaaaaaaaatttgtgaaaatttgtccccgtaatccgtgttttctcaaaaatccataaaaatctgattttaggttattgaccctgccgaggcggccaattcacttggcactttcaaggagcaagaaccggccgcccagcgaattgctttacggttaaaacaccataaattttccaattttattttttttcgaaaaatttttgaatttttcaggacataccctcgtcgttgggctgtgcttgctgtggtggcattgttgaactgcttcaacacaatgatttggattgccttttcaccgatttccaaccatgtttccaatttttatggcgaggtttgtattttttttttccaatttaaagttttggctcacaaataatgtcataattaggtattgttcaaactgtgctatcaattcaaatgatagtaagtaacaagaacggccaagattttctatggaatacggtcccatttatttacaaaaaacaaaaatggttggaattttaggccaattaaaacactggatcgatcccgtctcgttaccaaaaatgaaaatccctaacctaaatttggacaaaatcgaaattctaaaaatttgaatttttccgatcacggcctacgctcttgcaaaaaaaaaactgaaattttttatttttagaaagattccgccacttatttctctggaattttcatttttgtgaccataccagtgggccttgttgcgatgtggtcgggcggacggtttggtgagctgaaaaattttttttataaaaaattaactcaaaaaatatgttttaggcctcagatcatccattttggttgcagcatgggctaatgggattggagctgcaattcgtttggccaggtcagccgtctggggttcgaattaacccatgaaaaatgtcagtcgtcaaaattcaaaagatatcgtattttcgaagctgatgggcaccccctataaaatttaggtacgccattcggtagatttttggctcaaaaacgactaatttggtgcttttttgtcaattttttcaattcaccctcccctctctgaaatttttgaaaatttatttttttcaaattaaaaaaaaattcggtgcgtgatttgtctttcgtaaaagattttaaacagtaccgattgcaatgaagaaaaatgagttttccattttccctcccaatttttcagttcatttttgcccgattcgatgatccatctccgttttccggttggcatcactggccaaggcgtggccgcgttggcctacccgttcatcatgtttttgcccaccaaagttgctgctgtttggttcccggacacggagcgcacattggcaacaacaattggggtaaaaatgggtaaaataaataggaaaaaagcaagactaatagaactcactttttaa

SEQ ID NO: 45618 - DNA, 1520 bp, Heterodera glycines
  Genomic contig location: Contig_ID=SeqID_3715; Location=1719..3238; Strand=-
  SCN-specific regions: Sequence locations=1-399,433-993,1020-1412,1438- 1483,1505-1520
  Gene Ontology: Cellular component=nuclear speck
ccagtcgaggtgagattgacatcaaagtgcttgtccatcagtctcacgctggtgctattattggccgaaatggaagcaaaatcaaagagtttcgcgagcaaacgcaatgccgctttaaggttttccaagaatgttgtccagtttctagcgaccgagtttgccgttagttttttcgtgttttttcttcgtttaattttttcctcagtgatcactggcgatccgtcaaaattgccctgcgccgtcaaacaactcgtcgattttgtcaaagaaattcccttcaaaggaccgcaccagccttacgacccacacaattacaacccacacatgtgccacgcttatggtggttttgaaggacaatcgatgggtgagtgccttcattgatgctttattattgccaatggaaggtggaccacctccaccaatgcctcctcctcatttcgactacccaccgcaccacggaccaccaaatgcgcctcatcaacctggtgttgggtatgccggtttcggaccgggcggaccgcctcctcaccatcatgggggaccgccaccgatgggttatccagggccaggtggagagcaaatgaccacaacacaggtatgtttttcaatccagagttttttccaaaacgtgttaataaagtattttaaggtgaccattccgagcaaattgagtgggacaatcattggaaaacgcggcgagtgtattaatcgaattcgaaacgagtccggcgcacgcattgaaattgacacgcagtcggatgtcttcggaacggatgagcgtatcatcacaatcaccggatcgccacatcaaatccaattggctcagtttttgctacaacaaaggtggtttggtagcataaggtccaatttttgactgtgtttttaagtgtccgtcagtctgaggcggggcgccgttatttggccgagagacaatgaaagacggcgcatcagaggagtcagccctgtggaatgacaaaagttgtatgtccgcaagttttccatttccattgaaacactttcgaccataccttctgattgagttgtccccatcaatcatttccctctcttcaaatcatttggtatttttccatttttaactcgtatcaaacggctgaatatttccacttcttacttcatgtctgtacctcaaaagtgttcgatacgagttcgtccatattcgtaccaatatattatgccctatcatcctctttgttcccttggtcgacttgctccttcatctcttttcttatactattgttcatggttccaactttgtttagccaggggtgttttgttattcggttcgcatcgcatatttggaggtataaaaagagcattcagatttgtatatttgtcgacctgttcctattaactaaattatactgcttaatctgtgtgctcaaagaaaattcgattttgaaaatttatttttaaactagcaaagaatgtttttctttggtctataaaaatgatgagcgaagggaccaaagaacgaaggggagagaaacggaggagacacc

SEQ ID NO: 45619 - DNA, 1659 bp, Heterodera glycines
  Genomic contig location: Contig_ID=SeqID_3725; Location=65..1723; Strand=+
  SCN-specific regions: Sequence locations=1-247,292-837,884-1618,1641 -1659
  Gene Ontology: Mol. function=structural constituent of muscle; Cellular component=sarcomere; Biological process=regulation of protein activity, epigenetic
tgtcatgcaaaagcgcccattatcgacgatgtccaacacgagcagagttggcagcgcattcaagagattgaggcgcccaaagagccgttgccggagcccgagccggcaccaaaagtggcgcccaaattcacttcgccagtgcttacgccgggcgaagtgaacgagggacagccgacacattttgagacgacggtggagccaattgacgacaacgaactgaaaatccaatggtgggagagcaaatatgaaatttaaagaaaatttattattcaaatttaaataaatttatttgccagattaatttaaaaaaattagatttatttctcgggtaattagggcctatccctccgccgatttctttcaaatgatcaaacgattttcttactgaattgctcccatgttttgaccaggttcgtgaatggagcacctgtgccggactcgtctcgtctgaagcaaattgccgactttggctgggtgattctgaacatcaacgacaccgaactgcgcgacgcgggcgactgggagtgcgtggcgaccaattcggtgggcgaagcgcgtgccagcgccaaactgaacgtgctgccacgggaccgactgctgttggagccgatcaaccagtcaagtctggcacaaattgaacagttggaggcaccgcgagcgggcccggcagagccggaggcaccggtgtacgaagcgccgacattcaccgcgcagctacaggcaccggacggactcgcggagggtgacagcgcgcacttggaggcgcactacacaccggtggccgacccgaagacgcgcgttgaatggtaaacgaagcggagaatttgaattaagggcaattaaatacaattaaaattaattaattattttttaaatttaaattctataagcaaaattcattttcccatggacaggtacaaagatgggcagcccatttaccactcgaacagacaacgaatggtcaacgactttggttttggcattttggacattctctatctgctggcacatgactcaggcgaataccaaattaaggtgctttatccgttttagaaatgcttatctcaaaaacggatttaattaaagggcaattaagcagaatttaatttttcaaatttacaattattttaattggtgctcatttgtcaggtgatcaacgaccaaggcgaggcttcgtcctccgtccaacttgaagtggcgcccaccgagtcgctgctgcttcagccgcaatcggagcagaaggcgaaggcggtcggcgacttggaggagcggttggccttccgtccgaccaaagaagaggtggcacgtgagggacgaatgccggtgttcgtcgcgccgttgagcgcgcccagcgaaagtgagcagggcgaccgggcgcatttcaccgctcgctacgaaccgatggacgacaatcagctgaagatacaatggttattaagctgtgccatgccatggcctttgttgactgatcggcatttccccgcaaattgcaggttcctcaacaacaaaccgttgctgaccgggtcccgcgtgaaaactatcgacgagttcggcgtggtcgtgttggagatttacccggtatacccggaggattccggcgactacgtgtgcaaggcgaccaacgcgcagggagaggcggtgacgagcacttcactgaaa

SEQ ID NO: 45620 - DNA, 1368 bp, Heterodera glycines
  Genomic contig location: Contig_ID=SeqID_3732; Location=795..2162; Strand=-
  SCN-specific regions: Sequence locations=1-11,39-162,184-484,518 -1002,1024-1368
  Gene Ontology: Mol. function=serine C-palmitoyltransferase activity; Cellular component=mitochondrion; Biological process=growth
atgatgggagggaagcgaaagaaaaaggggaaaaaagcggaactgagcgaagaggtgagggaaagaacgatgggacggcgacagaaattttggcgtcgaaaaaacccataaattcaacaaaacaaaaaaaaaagcgattacccaagtgccatttgaattcgattaaaaacggccattctctgctggcaaagattggtttttgtgtgcaggaaaaggaagcggttattgcgaattgggagccgagtccgttggtgccgctttactcggaaagggaacaaaacgacccgaattatcggccccgttcaattgaagggttcgattttcatttgaattgtttggaccggtatcacggatacaaaccaaatacaggcgaatgggcaaatttgttgtcatcgatgacaaacgatgcgtcaatttggcgtcgactgattttttcggctttatcggaaaccagaaaattgaagtttgttgttcatacatggcttatttaaaaatatttttgttttgctttccatttcataggaagtagccaaaaatgccattttcaaatacggcgtgggctcatgcgggcccaggaatttctacggaacggtggacgtacatttggacttggaaagggaattggctgaggtagggacaaagcaaaaatttgcagatagttcgttttggcggcactttcacactgtattgtcataccgtaattgtcattcaaattgacagttcatgggctgtgaagaggccattctgtacagctacggattccccaccatcgcaagtgccatcccagcttattcaaggaggggcgatgtcatttttgcggacaaaggtccccgggagtcgcccaatcatttgttggccatggaaaataaaagccatgtttttaggtgttaatttcgccatacaatccggactgatggcgtcgagaagtgacattttatggtttgaacacaatgacatggcggacttggagcgcaaaatggtcgagttggaggagaaagacaaaatggtggggagaacgggaaaggggaaacaaaagaattgccgagggaatgcattccgcgcgacggccctccccaattgagccgcaccaaaattcggattattatatcggattagattgtttagcaaacccatttaaattttttatacttgtaagaatttgttctgtagaattcagcaaaaagccattttcgcagaatccgaaaaggaaagcgtccattcgccgtttgatcgttgtcgaaggaatttacacaaattcgggcgacatttgcccactgcccaaactgatcgagctgaaatggcgacacaaagtgcgcattttcatcgacgagtccttctctttcggagtgttgggaaagcacggaaaag

SEQ ID NO: 45621 - DNA, 1640 bp, Heterodera glycines
  Genomic contig location: Contig_ID=SeqID_21097; Location=257..1896; Strand=-
  SCN-specific regions: Sequence locations=1-8,33-82,106-244,273 -290,337-351,412-515,543-578,602-632,810-949,971-990,1013-1033,1060 -1401,1423-1640
  Gene Ontology: Mol. function=ATP binding; Biological process=protein kinase cascade
atgatggcgaagaaaaaggaggaggaggaactgatcggtcagctgaaaaggacattccggggagagaggcgggagggttagaccaaaagccgaaatttggggtttaaatttgtcagaatttaatttaggaaagcagctatagagaaggaaggccggctttttcaaatccaatttatccggtacccatttttctgttcccgcttatcccttccccaccgtttgacatgaaaagccccggcagtccaaaagtgtaaataaaaaataaaatgccatttgaaattaaggaggtgataaataaacaataatataaaataaaataataatttgattttaattccatttcagcttttactttttctcactctctttcttttctctctctctctctctctctctcttctcacactctcttttttcgcctttttctttttctttcgcactctttcctcgtctctctgtcttttccactctagctcttttccagtgttctctctcctcatccatttgcccttaagttccgacgaagaggttgaggaggaaagtattgccgcggatgaagtgagcgtgcaggaaccggcaccgcccaaagaagaggagccggcgccggaagccgaagcggaggcaccgccggcggaagaaaaggaagaggaggaggaagaagagccggggtcacccggaggggcaggcgatgcgccgaaagagtaagtggggaaggaagggaaaagttagtaatgtgggaggaagaggaaaagggggagggacgaagagggaaggaggaagggaaaaagggggaggggaaagagaggaagtgactctcgagactcggttcgagaaattaagggcggacaggcgagagtcaaagaccgagaccaattgaaagccatacttgggcatttcagagaatttcgtcgcaccagtgttacggagtccgtcgcgccgacggcgcaacttcgccgcgcgccgccccctcagccgaagccggcagaagaatcgatgacggaggcggaagcggcgatgctggcggtgaagaagcgccacgaggaggaggaggaagccaaaatgcgcgacaatgacgagcgacgccgccaggaactcgctgcagttgaggacgaactgcgcgttttgaaagaacgccaagcggagaggcgagcggagcgcgagaaggaggaggccgaattcgccgaacgacggcgccaagacgaggaccgacggcggaaggatgaggtgaagcattggcgaaaaggcactgattgactcattagcaaataatgagagatcggcgagtgaatgttggcacagtcagactgatccatgggccaggcattaacattgcgtgccaaaataagttttaagtgtgcattagcaagttgatgagaatgaagtgatataataagccgacacgcgttcaggaggaacgaaaggcacgactcgaagcggagaaagcgaagcgcgacgaggagaagcggaagcgccacctgatgatggccggcggatttggcggatttgtggcggcggacgcggaaggagcaggcaaaaactttgtggttcccgagaaaagcgagaagggcgcacagcagggaatgccgggacagacgagcaaaccgcgaggactgagcaaagagcagcatgaggaggccaaa

SEQ ID NO: 45622 - DNA, 1930 bp, Heterodera glycines
  Genomic contig location: Contig_ID=SeqID_21101; Location=24..1953; Strand=-
  SCN-specific regions: Sequence locations=1-368,409-424,452-478,500 -881,904-1306,1401-1595,1617-1860,1882-1930
  Gene Ontology: Biological process=positive regulation of body size
atgccaaaaatgctatttgtaagacaccaaaacccatttgactgtcttgaatcccgtcggggtttttctccaattctgtttgtcttgttcagctacacgcccgacttcctgctgaccagcaacgaggccacgctgcagctgtacatgcacatgaacggcacgccgtggacattcaacctagtggccactattccgccccaactattgtccgtttgtcacgccgcactgccccgtccgcccttcgagagcatgatgtactacacgtgtgtgcttgctttaacgtacgtttcacaacttcatacactcaccccttaagtgatgatttttcatcattttatggctttttaggtgtaaatagcgttctgttttttgaggatttaatgacttttgctatttttggaaaaaattacatttatggtgacacaaaattaaaaaaaaaaaatttaaaattccctggcggtgcttgtcggcatctcatttattatatttctctttcctctcgcacccctctttactctcttcttctgtctaaggttctgcttcatttgtgtggtctcttgcgcttatttggagggcgatcgtgtgatcagctgtgcttatcgccaacaatttgctcctccaatttctgtggattgccagccacaggatgacaaagtgtccgcttcatcgtcattagcatcggaaaagaacggtgtgctgtcgacggcaaaagcactggtggaagacgacggcgacaacgacgatgcagctgaattgttggcaccctcccggcggacccaatttttgcaggcggccaaagatgcgggaccattcaacaagtgcgtccaattactaaaattttaatcgcaaatgacgctcgagagtctcggcattttttttaattcactcagttttctcacattttttatttgtttgatttgctttcaggttattctggcgaacgctgaatttcattttgttcctgttttcctacatttggcctttggtgcgtggagggaacaaagcgccgccaatggcgacgattgggcggcgaaaggcggcacgggcgacgatggcacggaaggcccaacagcagcaacaacagaaaattgtgttggcaaagactcaattggttgatggaggacaacaacatgacgacaaagatggacaaaaacaactccaaccacaaaaaggagatgatcgcctctctgtcggggacaaaaatgccaaggaaaccgccgccgccaaaattggcactggacgagtggcggagaaagtgccaacagagagaagaacaacggcacccatcgttacggcgctgaaatacgatgaaaatgatgatgaagatgccgatgatgatgatgaggaggaggaggaagaggacgatgatgacgaagataatgatgatgaggatgatgatgttgtgcaacatccaaaagatcctgaacacatgtccaacaatacaacagaggatgccatcaagaaccaaaatgttgcggaccgccatgccactgcaactgcagttgttcatgaaaacgatggccatggtccggaccaggacggtgttgatgctgatttgttggacctgtctgacccatatctctacatgaaattgtgtgtttggaatgcaaaaaatattatgaaaaaacggccaatttttattgcattttttggtaattaggagggagaagcttctggaaacaaaaattcacattataaaaaaacgaatgtttcttgccagtaaaaactgttttaccgtaacccgtaattacaaacttctttaaaatccgtaattcgttttcagccgttcttttttggatgcggagaaaaagaaaagcgccgcactgttggccaaggaaagtccggcggcggcgagtggcggaaaaaagcagcagcagagacagcaccacatttcgatcagcaacagcagtacgacgaggacgaacagtag

SEQ ID NO: 45623 - DNA, 1177 bp, Heterodera glycines
  Genomic contig location: Contig_ID=SeqID_3746; Location=413..1589; Strand=+
  SCN-specific regions: Sequence locations=1-30,52-435,459-931,955-1177
  Gene Ontology: Mol. function=structural constituent of ribosome; Cellular component=cytosolic ribosome (sensu Eukarya); Biological process=protein biosynthesis
atgacccgcgtgaagacccatgaacttcgggccaagaagaaggaggagttgatgaaaatgttggaagaacagaaaacggagctggccagtctgcaggtttacggattttgaaattttcacttgcgattcctagtggatcaggattaggattaccaagtgctaatgtgctaaaaccatattttgttagggttttttgtcgtaggctagaatgggtggacgacttggcaaatacgggtgttctaggttttcatttacggtccaaaactgactggaaaagacgaatttttttttttttgcgaatggcgactgactaaactagagctcggcctggacctggatccaggtccgggtcattttttgacagcctgggtttttcctggagtccaggaaatccaggtccaccttttttcaaaataccgagctcatgggtaaacaaacatttctttaacaatactgcacaacatccgtttgttcattttcatgtttcaatttcccgctgtgttttcaggtgtccaaggtgacgaacggggcggtgtccaaactgtccaacatccacgtggtgcgcaagaacattgcccgcattctcaccgtgatcaaccaggcgcagaagatgaacttgctcaagttctacaaggtttttctaatttatgtttgactgactgtcgtcaattgttccgacccctcggggattggggtccgtaaatccgggatcgccgtatattgtgttgccagcttaaatctctgaattcattcacgcgaactggttcggttggcatacactctaaattggcttgatagatcttgttcatccgttccgtacaagggatggttggtactcagtttcaattttttttttttgaccggaatgccgttttaaatttttgaggctctcgaaacactagcttttgtgcgagtttgaatttaaacgtactttagcaaatcatttgttttaatttcaaatggtatgccaaccataacaaaaataggacaacatatgagacggcctaaaacatctatcctcaattttttttttttttcaaaatttccaatcaatcattttttaattctttttttacagggcaagaagtatcgtccgattgaccttcgcttcaagaaaacgcgtgccatgcgcagagagttgaccaagcatgagctttcattgaagacacacaaacag

SEQ ID NO: 45624 - DNA, 2148 bp, Heterodera glycines
  Genomic contig location: Contig_ID=SeqID_21152; Location=131..2278; Strand=+
  SCN-specific regions: Sequence locations=1-450,472-1740,1762 -1816,1838-2080,2102-2115,2138-2148
ttaaaaatagacgaaatattgttgtattctaaatcgaaatgtatcatacaagtacgatgaatgtggacgacacaccggccatccgttgcactgatcggcgcgtcgaattcagcatcaacacgcgcaatccgttccggtaggctgcctagtcaattaaggtattttcgcctaattgctaggctcgggttttgaaagttcccgaatttcggaatcaatatttactgaatttgaacaccttggggatttatttttcaacctcctcgaaggggggttttatttcagagggtgaggtgtcaaatttagggaggggggaattcagtaaatacgacttctcggtttcattctttattgtcaaaattaaatttgttgattacgggttttagttcggttccgagtcttgacccaaagttgaaaactctctctatcctattgttagacccattcccatacttttaatcaattttaatttacatggcaattccgtcccgagttttaactcggcatgccatttccgagcagttccgagttccgttacctaatcaagttcaaattctcaaatctcatttaaataattgctggccaggcaccacattatttcgtctggtacgcctcccccccccccccctcattaaagaattttagaattttttgaaaatcttttttatccatcggcgagttttagttttcttttccagtggcaacctctacgtgcagggcgagttcggcttgacggagtgccgtcgcgagttctacaacaacgaggcaccgtttgcctcgcttgaggtgcggctgggcgactgtggcatgatccgcgagaagagaccgcatgggatgagtgagtgccgggaatttgattacatactaatcaatacaacgcccgacggtgaccagaaccaacattttaccatatgaaattaataagggggagggtatttagataccactaatcaattttaatagcaattgataatgatgacatgccatttttgtataggctattctctgatcctgatcaccaactttcatccccgcttcgtcacccgggttgaccgtgcctacaaaatcttttgtgcttatcagcaagcggaacgcccggttggtgtcgatcttgaagttgggtgagttgttagaaaatcttcaggattatgtaatcatttcaaaacattcggatattgataaggatacgattaaaaactaacgcgccgaatagcatttatcttgatcacttttgcattttttcgcgattgatcactcactgatcataatcaaaaactggttgatccgttatccgttctcccatccgtttgttaggtctgtcccggaagagtcggtgagttcggatgcgcttatggtgcccgaatgtgagtacacaatgcgtatcggtgatctgaatgggccactggcgacaggaacaggtgaatcctgatcactcaaattgtcgagactcaaaagtctcgacgaattaccgctctcgacacatgtttccagacttttgggactcaagagactcgggattttcttaatgaattttcctagacttaagattctcgaaagttaagggagaccaaagttgatatcccaagattgttgacaacattctaaggctctctaaaattattaccagaacacccactacttttatgtaggaaatcttggcatcatagttttattgacttttgaaaaaatagtgaaaaaaattttcaaaattttttttcatgaaattttcttctataattctgtggtttaaaatttttaaaaaacgggggggacgaactgcttccatgtcagagatcacattccgagacccatgaccatttaatgaaattgttattttaaacacaaatactttaaaattccgagaatgtcttaaataatttttttggcttttttttgcagtgaaagttggcgatctgatctatcaccgatgggagtgccaacggtcggatgcgcatggaatgttggtgaaaaactgtcgggtgtttgacgggggcaacgacaatgtgacactgctggacgaacgggggttgggattaagcgaaaaatgaattcataaaacaaattcagaggccataaaaaggtctaaaaattaagtacataaaattagagatcaagtctttcaaaatttaaatttaatttacaaatgacaaa

SEQ ID NO: 45625 - DNA, 2670 bp, Heterodera glycines
  Genomic contig location: Contig_ID=SeqID_21165; Location=1..2670; Strand=-
  SCN-specific regions: Sequence locations=1-458,488-788,810-973,996 -1121,1143-1481,1505-1535,1557-1762,1784-1890,1913-2003,2025 -2332,2354-2551,2574-2576,2606-2670
  Gene Ontology: Mol. function=protein binding; Cellular component =centrosome; Biological process=embryonic cleavage
gtgttcgaggaaattcgtcgtctttacccccgccatttgaatggcatggaaatttacagcaccgcgctgtggcaactgcacgactccaaaaagttgtccgccctggcgtcaaaaatggccgaaattgcgcgcaaccaaccgcaaacgtggtgcatcgcggccaactgcttcaggtgggcacacgcaaaacaacaaattaaatgaaaattaattcggcatttgcccttccccaatttcagtgtcgagaaacagcacgagacagcaattggttggttgttttgcagacattacccgccatatttcgatagacccctttccaatggggacattttccactttaatttaattcccaatcccgaaaaaatgtttggcctacgaaatgggttccagtgttttaaactcggaatcggtacaatccatttaaaaggtccgggattacgtagaagtgattaggtactatttttgaattattttttaaaattgttgatggcggcagtcgttaaactttccctccaaaaatgcacattttgcctttttgtaaaaattccgccgttaaaagagtgtctggagcgatcaatccgtcttgaccaccgttttgcctatgcctactctctgctgggccacgagctcatcgacatgaacgactttggccgtgcggcgcaagcatttcgaaaggcggtccaattctcgcccaacgactacagggcttggtacggactcggcctggtcaatttcaaggtgaatcagaaaaaaagttacgaattttagtatcttttccgcttgattcccaaattttatttaaaattttacaatttctgaggagaatgagtgaactgcttccccccccccaccgtcgcccctgggaggggtttaaaaaaatttcctttgttttcctccattttttctgggtttcttactgtgtattagcagcagtactacaaatactgtatgttcataccaaatgccaccactttttgacaattaaatgtttaggaagaacagttgcaaatggctcggatgaatttgttacgtgcggtgggcatcaacccgaacaacaacgtgctgctgtgccaattggccgtcattgaacaggcgctgcacaacacggacgcggtcccgaacaaaatttgaaaaacttaattgacaccataaccatttgatttttcaggccatgcaatatctcgagagtgcgctcaaacattcgcccaacaatgtgccgtgccgctttcacaaagtgcgttcccaattcgtggccacaaccatttgttgtctctcagaatccgggaaaactggcacatttgtagtcattttcgctaaaaatggctttggccattttggggtcaatggaaaaaatttcgtaactttttttttatgtataccatttatgtcttttgtcgcggaccgggtcgattgggccccgccagttgggccccatggggcagtcacttttttggtcggcttttgatttactttcactaaagaaaaattatttttaaaaataaaacgtggtttttaatcgttaactttggttacacattaattaaaatgtatttattttcatgttgggttcgaacccgggcctccaaaatatgaatttaaccaattgagctacaaaaaaaaaatactgaacgaactgtcattgtaagaattaccattaatccccaccgctgaatgtaagaagtatttaggtgcagaccaaaaaattttgaagctgctgactcagagtgaattttttcatatgtaatgaaaaatttatcatccccaaaaatttattcataaaattctaagcatgcatatggtaatttcgagaaacaccagtcaaaaattcctaatgttcagtgggttaaaattccgtgtcagtctcaaaattctctcgtctgcagtgcagacgtttggacttttttcactattttggcatttttactcactattttagttaactgtttcgggatttttcgtcactaaaagttgcttccctagtaattagtaatacatcaaaaataaatataatgaattaaacaaaattaaatgcaatgtgcctgttgtataaatctaaaaaatttgataatataaatggaaataatttgtatgggattggcgcccagttgggctggcgcccagtcggcgtcgcccagttggcgtcgcctagtcggcggcgcccagtcgacccccaccggtttaacattatgaattttatcgatgttctcgaaattatcagataaataggttgaatttaatacttaataaattaggaacaatttcaattttttaaacactggaacgaagaaaaggtgactgcccatggggcccaactggcgggcccaatcgtaccggggcccaaccggcggggcccaatcgacccccaccgcttttgtcgtgccagtttcaattcttttttaaatgccttcacattaggccaggctactctttgacattggcaagtacgaggcggccagggccgagttggaggagctccgcgttttgtcgcccgacgaggcgcacgtgttcttcctgctgggccgggtcaaccgcaaattgggcaacacgcacatggcactgctgaatttcaggcacggttttacacccaaaattttggggacaaaatcaatttactccactaacaaaaattaaaaaatagcgtttacaaagaaatttcaagtgaaaaaatga

SEQ ID NO: 45626 - DNA, 824 bp, Heterodera glycines
  misc_feature (382)..(382): n is a, c, g, or t
  Genomic contig location: Contig_ID=SeqID_21183; Location=1248..2071; Strand=-
  SCN-specific regions: Sequence locations=1-539,578-716,738-778,801-824
atttatgccggtcaactcgccgttcttccgaaaacccatcgtctcgttccgataattgaacaaatgcgacgcgaagaaagacatcatttggacgagatggagcgattgatagtcaaatacggagtgaggtcgactgcgttggctccgatttgttcggtggccggttttatgttgggtgagtggggacggagcaaaagaaatggatttataggaccacaatttaacaaataattggcttatttttccttttttcttaaggtgttggcaccgctttgcttggcgaaaggcagcgatggcatgcacaattgccgtggaggaagtcattggccaagtgggcacttttactgaagcgggagggagggtgcttaatctgtcaatcatntaattgtcattgtctcttaccatttcccgtcctttcattgattttattattcctaaaattaaatttggccgcactttggacttttaatagtgaaaaaaggttttgtccatttctttgtccgagggggaaggaggttaaaatatccatcaaaatagatataatttcattaataaaaataaaagtgaaatttaattcattataaagtttctttttttaagcattacaatgaccagatcaaagaattgatggcggatgatgccaatgccaaccgcgaattaatggagaaattggcccagtttcgggacgaggaattggaacaccacgacacgggagtgcagcaccagggcctggaggcacccttctacgatggtagtgggcacaattacgcaccaaatgccattgctcccaaattttcagctctgaaaacgatcattcagacggg

SEQ ID NO: 45627 - DNA, 1802 bp, Heterodera glycines
  Genomic contig location: Contig_ID=SeqID_3765; Location=287..2088; Strand=-
  SCN-specific regions: Sequence locations=1-121,144-229,251-368,398 -539,564-903,939-1144,1167-1635,1665-1750,1784-1802
  Gene Ontology: Mol. function=RAB small monomeric GTPase activity; Cellular component=endocytic vesicle; Biological process=cytoplasm organization and biogenesis
cgcccggggaacggaggagcgcccacgaaaacttgtcaattcaaggtttaaaacatttttaatccatttgttgacccattttgaatgcttataaatattggcattaattgtatattttgtcacccccaaaattttgggattttccattgaatttgcgctactaaattaagatgaagagcagggggttttattgcagttcaggaccataaaataattctgtaatgcgctataatatttctataatgattttcgtttcaaattgtaaatatttcccctcccccgcctattttcaaattttgactgttttccccctcaagttggttctgctgggcgaaagtgcggttggcaaatcgtcgctggtgttgcggttcgtcaagggtcagttccacgagtaccaagaatccaccatcggcgccgcctttctcacccaaacaatttgcctggacgacgcgacggtcaaattcgaaatttgggacaccgcgggccaagagcgctaccactcgttggcaccgatgtactaccgcggggcccaggcggccatcgtcgtctacgacatcaccaaccaggcttgttttaaacccagtggtggacttgggctcttgcaaaaacccgtccaaatctaacatttgcggtcccaaatttcagttggttagtgatcataaaaattaataggcatggatttgtggcccatatttcactactacccaaaaaagacctttctcagtgaatttcgttacggttacgtctattaattacttggaccttattcgtcatttaaccgacatacaaaatgtagagaaaagccagttttttcgtgccgtacttgcatctgaacctggattttatcccatattggaccttgattttctggacaggatccaggcctgaattcatattatgctctataaatatgtttatatttttttataaattaatttcctttttttttgcttccataaaacgctctctgtcccttccttcgtcaggaatcgtttgcgaaggcgaggaattgggtgcgcgagttgcagcggcaggccagcccgaacattgtgattgcgttggccggcaacaaggcggacttggccgccaaacgcatggtggagtacgaggaggcacaagcgtatgcggaggacaacggactgttgttcatggagaccagtgccaagtcgtcgatgaatgtcaacgacattttccttgccattggtccgttgtttttttttgtttcagtgcttttcgtcttccctatcccacccgaaatttatcattaaatgtcaaactaaaatcccagactttgtttttcaatcgacagcaccccatttcgatttctccgtttcgatgcttatttattgaagtttgaatgccatttcaaattgatcatttccaatactgttccggcaacaagaaccgctaggcgccgacgggaaaatttttgagaaattgttaaaagaataaaaaaagcccattttcaataaagattttttacaacatgaatgtggttatatacaaataatttgccatcacgagttgtcaataagcaaaattagcactgaaatattctgaacttgacagttcgttctgatttagtttaatcatcatctgtcgatcatatagaaaaataaaagtttcagcattttcaaatttaaattcatttttttattttttttcaattttgtcccctttcagccaaaaaactgccaaagacggagggcggcggcggtccgtcgggccacggacgcagcggcgtggacatctccgcggcggaggcggcggcacagcagcggcgcggcacgtgctgttccaag

SEQ ID NO: 45628 - DNA, 1342 bp, Heterodera glycines
  Genomic contig location: Contig_ID=SeqID_3766; Location=472..1813; Strand=+
  SCN-specific regions: Sequence locations=1-215,238-292,315-451,593 -654,676-676,721-726,783-789,879-930,952-952,999-1342
atgtcggattggtcttttgtcgggttggttttttgtcgttttttattggcgttggtgttttgtcgtttttgggtgagttggtgttttgtcgggttggtgttttgtcggttggtgttttgtcgggttggtgttttgtccgcgcgccttccttccttctcttcccattcccaacacctccctttcctcccctcccattcgtcgattaacgattaacccactttttgctttctctcctttccacatgtgctagacatcgctgcatctctgccttaacatttattcagcgcttattctcctctgagtttcatttctaattttctcggtctttccaatttcatcactttttctttcccaatgtaactgtaatgtcatcatttttatagtggccttaatacataacatttgaattatcttttagcgatcgaattcaacaccctttcaatttggctatcatgcaaatcttcgtcaaaactctcaccgggaagaccatcacccttgaggtcgaggcgagcgacaccatcgagaacgtgaaagcgaagatccaggacaaggagggcatcccgccggaccagcagcgcctcatcttcgctggtacatcgacttttgatatgccgaaacaatcatttttatacccaacccttattttcagggaaacagctcgaggacggacgcaccttggccgactacaacatccagaaggagtcgacgcttcacctcgtcttgcgtcttcgcggagggatgcagatcttcgtcaagacgctcaccgggaaaaccatcaccctcgaagtcgaggcgagcgacaccatcgagaacgtgaaagcgaagatccaggacaaggagggcatcccgccggaccagcagcgccttatcttcgctggtacaatttgatgtgccgcaacttttaatcataaacccttgttttcagggaaacagctcgaggacggacgcaccttggccgactacaacatccagaaggagtcgacgcttcatctcgtcctgcgccttcgtggtggaaagaactagaacgacgaacggaggagatgattgatccgtatcgatccatattttatgtaacttgagaccgtcctgtattgtgttccgttttattcatcatcatgaaatgtatttcaatgatcacggaacgataaatccatcaaaactctgtcttatcttctcccgtcggaaaattaaggttttgtctatgaaaaatttgggcttagaatttacaaagtaattggtagaagtaaacatacgtaccacaattcgttggtacacacccaacttgtactttgagatgagttccagctttaaagtttacttacactcaaaatggggtggagca

SEQ ID NO: 45629 - DNA, 1261 bp, Heterodera glycines
  misc_feature (19)..(19): n is a, c, g, or t
  Genomic contig location: Contig_ID=SeqID_21219; Location=7..1267; Strand=-
  SCN-specific regions: Sequence locations=1-458,480-682,704-773,795 -860,882-1261
  Gene Ontology: Mol. function=protein tyrosine kinase activity; Cellular component=plasma membrane; Biological process=intracellular signaling cascade
atgggccaatttatttttnacgatcttcttttgttgttaatggaaagtcccttttccgattgtccaagaggcgttggagaaggccagcgagggaaggacttgcgttgtaattgcccaccgtttggccaccgttcaatcggccgatttaattgttgtgatgcgcgatgggcgcctggtggaaatgggcacgcatcagcaactgctccaacggcgaggcctttacttcggactgatccaaaaacaaacgacacccggggcgatgggaagcaaagcaacgaccgattgaccaaacctagcgaaccgacctcatttcaaaaaccttatcaatcagttttaaaaagcaaatttccatttggcaataaaaattcctcaaaaatcagcatttctcttaaaacaccaaaaaaatgcaagccaatatttaatttaacagacatgttttccgtttaacaattaaaagcatgaatttcttgtcataagaagaattaaatagaaacaatgttccttgaaaaaaagttattaaaaaatatggcattattttcatcactatttaatttagttaactatatacagtcaggtgcataagtatgtatcaggggtgggacgcgactgcgattcgcggcttttttttttgcgcgaccgcggaaatttgaatccgcgactggggtatttttttgggacaaaattttataaagaaaattttttgaagtgattgtcttttttgaatttgaaaactgacagatgaactgcagaagtcgagtcgaatgaagagaggccgaatttgtgatgtttgaaaatgattcacgcattaaaatgcagccccttttatacgctcaaaaataaattcggtaaaattccctttttcagcaaaggaaggtgattctcctgaaaggggtcagccggcagaaatgggagctcgcacattcgaccatcacgcagggcgctgaactgggcaagggcgcgttcggcgttgtcaagcgtggcgtcttccgcgacccaaccatcgggcagccagtgcagatggccatcaaggaggtgtcacagacgagcacaaaggcacaggtagaatgggcgggcaaaaaattgaatttcagccttttaatcgattcccctccccactttttcagatcaaggagttcatgaacgaagcgaggatcatgcgccatttggaacacaaaaatgtcatcaaattctacggcgttgctgttgggcgcgaaccgctgatggtcctcatggagctggcgtccaacggctcgctcgacac

SEQ ID NO: 45630 - DNA, 1329 bp, Heterodera glycines
  Genomic contig location: Contig_ID=SeqID_3772; Location=656..1984; Strand=-
  SCN-specific regions: Sequence locations=1-1329
atggcattccataaaattgacaacgatagtgctaactcaataactaatgccttagacttttttcgaattccacccaccaatgtgagcgtctcttcagcaaaagtgtttgagctgctgcctagtaatccactgacggacactccctaccacttcaagcttcattccagccaaaactttattgatttatccaaatgctacttacaaagtgaattccgaattcgcaaagaaaatgagcatggtcagctgattgacctcgcagctgacgaggttgcaccgatccagatgattggtcagactttcattcgaaacatcaaaatgagcataaatggacgcgaagttttcaattccaattctctaatggcctacaaaacttacttttcacacgaactatcctattccaatacagcaaaggactcgcatttgaatgcagcgggctattaccgtgacaccggcggcacgcttgagacaggggatggatgcattgcgcgacgcaacctgtttgcgggaagtagaacagcgcaattcatggccaaaattgacgccgatttgttcaaccaacctctttacttgatcaacttctgtgagctagacattgaaattttaccaaatgataacgactttgtcctaatcactacgcccagtgttgcccagggtgttgcagccgctcctcgttaccgcttcgaggttgtcagtttgaaaatgtatgtgaaaaaagtctcattgatggatggactggcgttggacgttgcgcgaaaacttgaagtgaaaccggcacgatatgctgtgaggaaaacgctgatgaaatcaatgttcatcagtcatggacgtttcgagtttacagccaatttgttcatggaccaaatcccccgccgtatcacaatgggattggtggctaatgctgattatattggaacaatttcgcgcagtccgttcaattttcaaccgtttaatgtgcgcgagatctcaattattgctaatggacgctcctttccccaagcgccatacgacttagacttccctaactggaaatatgttcgccctttcaatgacatgaacgaagcagtggggttcgccaactcattggaaagcaatggaattagctatgaacagttcggaaaaacccactgcatttatgtgttcaatttgaccaacagcggcgatgatcaagctgcgctgtttgatcttataaaaaatgggacaacagcggtgagcatcaaattcaaccaggcagtgcccgccggagggataatgctggtggtgatgggtgaatgcgactctctggtgatgttggacaagaaccgatcaataagcaccgatatcactatttaa

SEQ ID NO: 45631 - DNA, 568 bp, Heterodera glycines
  Genomic contig location: Contig_ID=SeqID_3774; Location=70..637; Strand=+
  SCN-specific regions: Sequence locations=1-120,150-158,184-568
gtgcatttccgcgaaattccctcccacgtgctgcagaaggtgtgccattactttgcgtacaaggcgcgctacacgaacagcgcgacggaaatccccgaatttttcgtggcacccgaagtggcgctggaactgctgatggcggccaacttcctcgactgttgaccaaacaaacaaacaaaatttgatgcaaaaatggtagcaacgacagacagacgaaccgatggccagacaaaacactgactgattgtgattggcaccgatttggaatttttgtgccaaagataaagccaattattaatttgtgaacgacccacacaaaattgttttttgcggattcgtttttttatatttatgtaggagtgcagacagtgagaagttagacaacgaagccgcgaaaaaagagttggttttttactgttttaaattgacttttcattcatttgcccttcgccgctcacagttgagacagtataaaaagcacacgccaatgctttatgttttggcacttttacagtgcaacgactttagcatctcttttttggtttttgataaaatcgtggaaaaataa

SEQ ID NO: 45632 - DNA, 2170 bp, Heterodera glycines
  Genomic contig location: Contig_ID=SeqID_3775; Location=349..2518; Strand=+
  SCN-specific regions: Sequence locations=1-747,770-1030,1052 -1066,1088-1249,1271-1542,1564-2012,2034-2170
  Gene Ontology: Cellular component=membrane fraction; Biological process=fatty acid desaturation
agtacggtcatcagcagcactttggctcctggtggtggaacgacgtttgtggctatgtgtgcggcaatttgatgcagggcttttcgctcggcggatggaaagtgtgtcggaaggagaagcatttttctgactttttgatttattggcactcggaaaataaaatttcctggggcaatctaagtgtcacactctttcttgtccaggaacagcacaatgtgcaccacgcggcgcccaacgtggacggaagggacggcgacttggacttgttgccgttgtgggcgaccatcggcacacaactcaaagtggcgggggaggggtggaaattagggcgctaattggggatggcatcggtgccaaaactgacatatttcgaatttgatttccaaattccttccagcgcattgacagtgcttctccgctcgcccatctgttgcccttccagcatttgtattggtccttcgcgttgccgttgctccgtttctcgtggctgctccaatccgtccaatttgtgtgccaaatgcggcacagtttttacgatgtgaattcccatttttggcattttccattttcggcatttttttgctcagatccatcgccagagggcacttgttgagcagtgttcgttggcattgcattggtcgttggtgctcgttcagctgtactttttgccggacaatttggtgaaatttgagacacacttttttattactactctattctatgcttttgtaattgtaaatttaattcatttccccgccctctaaaaaatgaaaattcggcaaattctccggcagattttcgggatcgttgaccaacatcaatttcgactaattccgaatccctaatccgaattcgaacaattcaatatacttttcggtcccccccttttcaggcccgtctccaatatttcctcgtctccaatctgttcgccggtttcctcatcgcacacgtggtcacctacaaccactactccaccgacaaattcgcatgtgcgtgaaaacggcactcactgatttttgggccaaattttcgcgcgagaagagaggagggggtgtcttgggtctcggaacttgaaaaaatttgggtcgcgagtctcggcatttttctcgttccgtttcaaatttatacccgaaggttttgggccatcccttcccttacctaatacctgtttttttcgattttgggccaatttttaagaaaattaagtttttcggatccgacggtgtcgataggcacagccgggagaaaaattgaaaattttgaccacattttagcagattttcatcaaaaaaaatactaatttagtgggttttcggagaaatttaacgaacttttttggataattaggggtgaggtaggccttggagggggtgccaacaaagaaaacgaaaattttcaggaaaaatactattttttccttaaaaatttcggctgcgaggctgggaccgtccgtccctttacgcaatttgggaaatctttcggcttccatgcttaattccgtggtgtttgaattccgcctaatcccgccagatgacgacccaatcctggagaactttgcctgtctgcagctgtacaccacgcgtaacatgcggcccggcccgttcatcgattggctttggggtggtctgaactatcaaattgagcaccatttgttcccgacaatgccgcggcacaacctgaagaaggcaggcaaaaagagtgcccgttagcgttgaagcagaaattgccagcccttttaatttgctggcatgtatgtttaatgtttagcccatcccccttgtcaggtgatgccgttggtgaaggaattctgtgccgaaaatgacatcccttacatggtacgtatgtacgacatggcacggcaccgtgccaaaaataatttaaatcgttaaattgtttttttcttgagaaaaagatttctaaatcttttagggtgcaaaagtgcacccaattagcgggtctcgtcacatttgccttttatccaacttggtcagatcaccccttgattgtgatcgggacacccaaaaacacactgaaaatctagaaattttcggaaaaaaaacatttttttattaatttttcggtggacgattatttcacgggctttcgcctggtcatcgaacatttgcgccgagtggcggaagcggccacagaaacgctggtcagccatcac

SEQ ID NO: 45633 - DNA, 2663 bp, Heterodera glycines; identical to SEQ ID NO: 21256
  Genomic contig location: Contig_ID=SeqID_21256; Location=1..2663; Strand=+
  SCN-specific regions: Sequence locations=1-136,158-1177,1199 -1373,1395-1509,1531-1659,1681-2152,2176-2663
  Gene Ontology: Cellular component=PCAF complex; Biological process =signal transduction

SEQ ID NO: 45634 - DNA, 751 bp, Heterodera glycines
  Genomic contig location: Contig_ID=SeqID_21311; Location=566..1316; Strand=-
  SCN-specific regions: Sequence locations=1-647,669-751
  Gene Ontology: Mol. function=protein serine/threonine kinase activity; Biological process=protein amino acid phosphorylation
atggcacccgcaagaaaagtgccacggttgcacgacaaagcagtgcttgtcaaaagtggcaccaaatttgtggacggtcggaagcaggagttcgttgtgggcaaagagattggacagggcggattcggacggatatacgagggcgttcaggtgaggtcgttattcaattcgattccatggaaaggattatcattctactttttgtacctattattggcaaaagaaaaatgttcccattaatggcactgaaattcatagattttttcaaatatatttgtctcaattttctgtaaattcagagcggttctcgtcatgccgtggccatcaaaatggagccgccgtccaatgggccgttgttcaccgaaatgcacgtgtacatgcgcgtgctgaagcctgaacacttggacaaatggaagaaggacaaaggtggggttggccacagatttttgaggaaaattaaggtatttttagatttgtggaattttttgaaatttttaaaaattttccagcaaataatggaaatttttttcgaattccccccccccaaacgaaaattaaaaagtttaataggcaaatttcgtaacaagtagcactcaaatttccaaaaaaatttttccggcggcgcctatcggcaccgccggacctacattttccactatttttacaagtttttttccttaaaacggccaaaatttggtcatttttagtgaaaaaaaagtgcagttgttacccagcagtggaaaaaaagtaa

SEQ ID NO: 45635 - DNA, 2255 bp, Heterodera glycines
  Genomic contig location: Contig_ID=SeqID_3797; Location=563..2817; Strand=-
  SCN-specific regions: Sequence locations=1-317,339-804,839-898,920 -1469,1508-1519,1550-1783,1808-1860,1898-2255
  Gene Ontology: Mol. function=electron transporter, transferring electrons within CoQH2-cytochrome c reductase complex activity; Cellular component=mitochondrion; Biological process=positive regulation of embryonic development
atggcgaaaatttcaaaaaaaaaaactcattcccttcaggcactgatcccggacttggacgataatggtgtggaaattcttcgtcccgggctgctcaacgacacgttgccaagcccctacaaaaacaacaaagctgccgcggcggcgaacagtggcgcattgccacccgatttgtcactgattatgtgggcccgggaaggggccgaggactacgtgttccatctgttgaccgggtttgtttgttgttgtcagcatttttaaaaaagcgtagtgtacagtgacggaggtcccaagattctttagacccaccaaaaatcaaaaaaattaaaaaaaaatttccaacccaggactggaagagcagcgaaaaagttagtcgtacggtgaaaaatagagtagagcgggaccgggaccaaaacacggacaactgagtaccgaagtcccggttttgaccgggaccgggactagtcccggttttttcccggttttcccagccaaaaattcccgggttttcaacccgaaaagtcccggtcccggttttgcccaaaattcccggtcccgacctactctagtgaaaaatacgcgagatttttgaaaaaatttcaaacgaattttttagttttatgaagaattactgtttattgaataggtaaattttccaaaaattcgaccatttttttaaatttttgttttttgtacacctgtcagtgaatcaagaaatcaagatgcttacaatactcagattgtgatcagactcttgatgatttcattgtcagagagaatctacccccccccccccctcatttgttgaattgtttcttttcaaaatcctgtaaaattctcgcatttaaatagcatttgcggtgtttgtcggatacggacgaaatggggaagttggactttgatttccaataaaaatttaattcctcgttttttcaattccccaaaatttcccattgttgcattttgtttggttcagctatggctttgatgcaccggcgggcattgacgtggaggagggcaaggcgttcaacccgtacttccccaacggctgtgtgttggccatgccgcaacaactgtttgacgaaggcattgactatgaggatggcacaccggcaacaatgtcgcaacaggccaaggacatttgcaccttcttgcgctgggccggcgaacaatggcacgacacgcgcaaacgctgggcatggaaggtcagccaatttgccgttgtcatttgcggtggttggcacttaccccagagttatagtttcgtagacctctaggccccccaaataaaaaaaaaaacggaatctgcaattccgggggaacaacaagtccggaattcgtaccccggggggagggcaaagatgggatgctctgtttattggactgctctacatccacctaaattcccgagactcgagaaacgtttcaaactgaacaaaacgttgccgccgtagcgtcgccggcactcaaaaatttgttttgaaattttttgaaaacaaaaattcatggaacaaacttgttttttatttctttgaaattttctttccgaattaggcttggcaataaaaaaaaatgtttttcgcgaagttttgtcccgccacatttcagcggagccgtttcaggggtacaccgagtgcacccgttcaacggtgccggttagcactgccggaggatttttttttttgcaaaattgccaataaattgatagatttcaaaaagtgttatcccccatttttcttttttattgcctcgaaaatcggcaaatttataaccctacaaatccaaaaaaaaaaaaaaaattttttttcatcggcaccagatccttttgatggcttcgctggtgccttaccagccgggaaaatttcattttttcaaaaattttcacatatacacacacactcagttgatcacgctgttgccactgctcacgtttgtgctactgtacgccaagcgcaatgtgtgggcactgatgaagacggagaaggtgatcttccggcgactgcccggccgcgggtggacgcccgagtcgtcggcgccaaagccgcccaaggacgagccggagctgaaggtgatcgagccgccgcagaagccggtcgtctgatcggtccattcattttgatcagcgacggatgaggagggatgctttgatcaccaccacaaatatgcacacacattttgtgtacaatgaaatggaaatggtgttgctgctgctattgtgttgtttgttatttgattgagtatttaggttgaataaa

SEQ ID NO: 45636 - DNA, 360 bp, Heterodera glycines
  Genomic contig location: Contig_ID=SeqID_3799; Location=118..477; Strand=-
  SCN-specific regions: Sequence locations=1-230,252-360
  Gene Ontology: Mol. function=microtubule binding; Cellular component =spindle pole; Biological process=meiotic spindle assembly
atggcaaatgacgcaaatatctttgtcgccgcaagtgccaccaaatgtgtgatgcttttcgccaaaggatttggcgccaaatttactcctcaccattcgtttgttgtcccggtgatcttcgacaagttcaaagtggagaaacggttgctcagagatgctctcgtcgagtgcatcgatgtcatcgcagcattccgttctcttcgggccaaagacgttcccaagggtttgctgaaggatttggtggccattctgagcaaagtatgcattggggaaagggacttgcgctgtttcatttcgctcgaattggccaaagatgcgaacaaaatggccaagattgctgaaaaacgtgtcactgcttag

SEQ ID NO: 45637 - DNA, 3255 bp, Heterodera glycines
  Genomic contig location: Contig_ID=SeqID_3799; Location=1514..4768; Strand=+
  SCN-specific regions: Sequence locations=1-58,89-474,497-518,560 -631,653-714,737-821,851-1053,1108-1162,1184-1516,1538-2122,2162 -2397,2419-2442,2465-2547,2569-2756,2781-3255
  Gene Ontology: Cellular component=membrane
atggcaaaattaatcgctgttaactctgcaaaaggacagttttgtgacgggtattgttatcacaaacacaaaatgacaaaaaataaaacttggtggaagtgtgaactttaccaacaaggatgcaaaggttggggttttgagagtaatggtgagtttttcggaactcgaatgcataatcatcctccagaccaaattctacttcaaatcgagagagaacagtagatttgaagatgtcaaacatagaaatcagatttcaccttggaatttcaaaatatcacacgaactttatttttcctctcagctgcgtgattttgggtaacccaaaacttggaaaaaaggttaggtttcggttggcacacacccctcctataggctagggattgttggagtgagcaaggtttaatgaggaaaacgagatactcaagccttttaatccatgaaaatgtataatcttattaggtgtaatctaataaaatcattacattaaaatgaatttttggacaaaatttgcgattttaagctttttgtttttactaaaatattaattggggtttttacatgagtaatcaatatcttaatatcgtcccgatctttttcaatgccttaagcttggagattttaaaaggtctaagttgggaagtgttttcaattatctagacatattcaaaagctgtataccatcttatgtcacaaaaaaagcattttcaagggaagaaaaataatattataatttaaacattcaaaaatgtagaacggttaaaatatatacggccatggagaagtggcagacgcagaccaattgagcgaacctgaacaggaggaggaacatcaacaacaacaacaaagtatgggcaagtgaaaggaattcttggcctttctattcataaaagtgccaacaaatgaggaagggtcctggggatttgcataaaaaaaattcaaaaaaaaaatcgaaccatgattaactattaaaggaaattcacgggaaatttttgatcagaaacagagggcgagcgtcgcctggtaagattttatgacgtaaatggacaactcttgtataaaaaaaataataataatacctttacaatatatatatatttttgttttttacatggcttgccaattcctcaattaaggcctgaccgacaggttttctcatgccccatttgaatcacatttgttttagaattttaattcgccacttttcagatgatcaggttcaacagcagcgcgttcacttggacgacgagggacaaaatggcacattggaattggacgccgaccaatttgcgcattcttcgtcgaccaacactgacacggacagtgatgaaattgtcaatgtggcacgcaaaaagccgacagtgttcgaatacttttgtatggaagtgtcaaggtacgtgtgccattcaggtctgtaaccagaaaaatcggatttcatggcgggtcagaccccacgaatttttttgctgattttttttttttttgcctatttgtcaaccgattttggatcaaattaaacatcttggggaaattatattttgaaatcttggagccgaattttaagaaactcgctggtatcgttcaaagtttgccagtttttctcttaaaaactttttcaaattcgggcgctggaacatccacccaaatttttctaactaaaaaaaaaaatttcatttcggttacgggcctggtcccattctcatttttttgtaataaattccaatctttggcttatccccccatttttaaggcgctactcacttcagaatgagaaggaacaatatgcggagaagcggcgcaaagtctatgcatttcttcgaattccagtggaactggaaaagttcatttattacgggttccgtcagtgtttggacgccttttgccacacatttaccattctgccaatacgcgtattggtgagttattgggtcagggccaatttttcaaacactggaacattatccctgaaaccaggtaggtacctaaccgaaaaaaaagcatttcgtcgagaaatcccgaaaattttgtgctttcggcacctaaaattttttccatggttaattttttaaattatagggctctattaacgaaaaatagcgtttgtataagaaataactaattgtgcattttttgtcaaattttgaaattttcaagtgcatttattggccggcagtgccaatgggtaccgccttgattttttttttttttttttgcaacttttactcaatttgttgagaaatcttaaacaaatattcaaaaaaatttctgacctttatttaacttttttatgcggtgttctcatattagaatcaaaattccgttggatagatttctccccgaatttttaaatttcttggcaggcaacctgcctccgaagccttcagcagaatgggtactttttcaatacaaaatttctgattttttaaatattttttttggatgaatccctctgcagaatatatagctaatgtgttaattaattgccactgttttttcagttcaatttgtttgcttgctcagttcgattgaagcggtggtcggccgccgacacctgtgacattctcaaactaatcatcattttttgcgcttcttggttcatgcaatttgttgacacttccgtggtctatcacattgtccgtggtcagggcatcatcaaattgtacattttttacaacatggtgcgttaatgttttatcaaggaatggacggaaaaaattttattaaaaatccaaaaagagggggaaaaaaattttttttttgtcaaaagtcgtgacaatttgttcctggcttttttgagaccgctcgctgattatgagtttgaccattccttctggtaaattccgatacttaactcgaacaaaagatcgaaaaattcaaatttctcgaactatccgaattttgtttctcgaattcggttagacatttttcagaatttgttaaatgttaaatttgcgacccagaaaaactctggaggacgattttttaggactaaccaaaaaaaatttacaagccaaaagctccccccaatcctttcgaaaaatattacctttttcactatttaaatttagcttgaagttgccgacaaattgttcagcagttttggacaggtgcgtgcgtgttaaccgctgtttgcttataatataacgaaaatttttttcaaaatttaagagaaaaaaaattttgtgttttttaatttgtttaattctccgtaggatattttcgacgcgctcctttgaactgcctccgaacggggcacaa

SEQ ID NO: 45638 - DNA, 918 bp, Heterodera glycines
  Genomic contig location: Contig_ID=SeqID_21327; Location=17..934; Strand=-
  SCN-specific regions: Sequence locations=1-9,31-346,370-402,433 -514,538-789,813-918
  Gene Ontology: Mol. function=poly(A) binding; Cellular component =cytoplasm; Biological process=regulation of protein activity, epigenetic
atggcgcaggcagttgctgctgttgctcccgcaccaaatgctaacgcagcctcggctcaaacaacccaaccgcaggttatggcaccatcttatccgttggcttctctctatgtcggcgatcttcatccggatgtgagaaatcaaattaaaaatttttttttcaaacaccgattaatttttttggtattgccaggtcactgaggccatgctctttgagcggttcagcaatgctggtcctgtgctctccattcgtgtttgtcgtgatgcaattactcgtcgttcgcttggctatgcctatgtgaattttcaacaaccggcggatggtaagttaacacatttggactgcttttttttttaataattttttttgcttccatcataagccccttattctgttaagctgaacgtgctttggacaccatgaactttgacatgatcctgaacaagccaattcgcattatgtggtcgcaacgtgatccaagcattcgtcgctcgggtgctgggaacattttcatcaaaaacttgggcaaggaaatcgacacgaaggccatctacgacactttttccatgtttggaagcattctgagctgcaaggtgtgtttgcttaacttcaaacaatttcgtctttattgtccacaacaacttttgtagattgccactgacattgagggaggaagcaaagggtatgggttcatccattttgagactgaggaagcggcgaacagtgcaattgcgaaagtgaacgggatgcttttggatgggaagaaagtgtaaggatgatccccacttaaaattgtttttgtgctattaaatttatcccatcttttttgctttaggtttgttggaaaatttgtgccacgcactgctcgtgagaagcaaattggtgacccgtccaggaagtcaccaatgtttatgtga

SEQ ID NO: 45639 - DNA, 138 bp, Heterodera glycines
  Genomic contig location: Contig_ID=SeqID_21327; Location=1874..2011; Strand=-
  SCN-specific regions: Sequence locations=1-138
ggcggtggtcaattggcacacacaattctcggtgttgattataatgtgcggcttggcgattgccaatttttggttttggatccgcattacacgggaacagaaaatttatcggaaatactgaacggaggctggtgtgct

SEQ ID NO: 45640 - DNA, 650 bp, Heterodera glycines
  Genomic contig location: Contig_ID=SeqID_21368; Location=94..743; Strand=-
  SCN-specific regions: Sequence locations=1-278,300-333,355-650
atgcgcgaatcgtttcccaatttaaagtgcacaaaactgcgcaaggccgagtggcgtgaaattcgccgtttgatcggcaagccgcgccgctgttctcaaacatttttggacgaagagtgcgaagcgctggaggcaaaacggtttgtttccacttgaaaattttagaaattagtaagcccaatttgttaaggcaaaagattcgtgccatttacaatggcacttgcacttcgttggacgaagagttcatcgatttgcccactcatttgccgcgtccgccaattgtcggtcaaaaaatttacgcgagggtaatcctttacaattgtcttttgagagtatttatttattttttgtcaggtacgaaccccgagggacggaatttactccgcgactgttgatgcgatcaccgaagatggttaccgagttgtattcgatagagttaattgccgatgattctccataaattttcgagttttcattttcaggaagacattctccccgccgcttacattaaggtgcaattgtgatgagaaggacagaaactgaataaactcgaatgtttcttatttcaggattacgaagtgatgttcgaccagccttccgaattgctttccgtcaattactttcttgaacaaaaccgtgccaatggtgcg

SEQ ID NO: 45641 - DNA, 784 bp, Heterodera glycines
  Genomic contig location: Contig_ID=SeqID_3808; Location=57..840; Strand=-
  SCN-specific regions: Sequence locations=1-99,128-140,170-190,212 -221,245-784
  Gene Ontology: Cellular component=proton-transporting two-sector ATPase complex; Biological process=proton transport
atgggcatttccgacaacgatgtccaaaagcagcttcgccatatgatggcatttattgagcaggaagctaacgaaaaagcagaagaaatcgacgcaaaagcggaggaggagtttaacattgagaaggttcattaaattgcaaattatttaaattaattagttaataaaaggcaattaattaggggaaattggtgcaacagcaaaggcagaaaatcatggaatattacgagaagaaagagaagcaagtggagctgcagcgcaagattcagaggtcgaatatgcaaaatcagagtcggttgaaatgtttgaaggcgagggacgaccatttgaaaaatgtgttggaggaggcacgcgccaatctcagcaaaatttcggcggacagagagcgctatccggccattctcaaaggacttttgcttcaggttttcggccccatgcggcaaaaaaggcactttttgtccattggcagggccttttccaattgctcgaaagcaaagttgtgttgcgatgccgcaagaaagacgaggaaatggtggcgaggattttgcccgaatgtttggaggaatttcagcggacgtggggcaatcgaagcgaagtaattattgtggaaagggtccgccgaatacaaccttttcaggtgaaaattgacaatgagtactttttgtccccggaaagtgcgggcggcgtcgaattgttggccaaagacggcaaaatccgcgtctcgtccactttggaagcgcgtctcgacctcattgccgacaaagtcagtggaaaattggcgtaa

SEQ ID NO: 45642 - DNA, 1139 bp, Heterodera glycines
  Genomic contig location: Contig_ID=SeqID_3809; Location=220..1358; Strand=+
  SCN-specific regions: Sequence locations=1-100,123-683,705-1139
  Gene Ontology: Mol. function=protein tyrosine kinase activity; Cellular component=plasma membrane; Biological process=cell proliferation
atgtacaccgtggacctcaactccgacaagggtttccgaacaatcgaacgattcgtcgaccactaccttcgcaccggaacatcagtcaccagcgtaagtcaaaaatttaaattataaatttagtcatttccctttgttttcaggagcgattcgtcactctcaggaaggccgtgcaccgggcgaattgggagctgtcgcactcatccatcaccgtcagcgcagagttggggagaggggcattcggcgtggtcaaaaaagcagtgctcaccgaacgcaatgggaacaactcgcaggtcgccgtcaaggaggtgtctcagacgagcaccaaggagcaggtaaaggcggagtttgaagcattgagatcgcaaattacacatttttccttttcagatcaaagagttcatgaacgaggcgcgcatcatgcggcagctggaccatcccaacgtcatccgcttccatggcgtcgccgtcggacaggagcccctgatgatcgtcatcgaactcgcatctgacggcagcctcaccgactacttgaagactcaacggagaagtgcgcgcaccagactcttcatgtgcgtcggagcagctgccggactgacccacatccactccaagggcatcatccattgcgacatcgccgccagaaattgtctctactcgaacggcgtggtgagtcaaaactttgttgttttagtaactaatttcgctctgttcccacaggtaaaaatctcggacttcggcatggcgcacagaggaccagtgaagaaaatggagcccaacgcgcgcgtccccgtcaaatggctgtcaccggaagcactcgccgagcgctgcttcaccgcgaagagcgacacgtgggcctacggagtgatgtgctgggagatcttcaccaacggagaagtgccgtactcacaaatggtgggaagcgacgtggcggtatcggtgggtgaacacaactttttttttttgctttttttcaacttttccttccttttcagctgatcaacggacagaggctcgacttcccaagagatgcaccgtcaaaatttgtcgagttcatcttgcagcacatttgggatgcggagacgagcggcagatactcaatggcagcggtccacgactggctgaagcgacacacgtaa

SEQ ID NO: 45643 - DNA, 1495 bp, Heterodera glycines
  Genomic contig location: Contig_ID=SeqID_21370; Location=22..1516; Strand=+
  SCN-specific regions: Sequence locations=1-958,980-1107,1136 -1186,1209-1495
  Gene Ontology: Mol. function=transmembrane receptor protein tyrosine phosphatase activity; Cellular component=integral to plasma membrane; Biological process=protein amino acid dephosphorylation
gatttgcgcacgatccctctaggtcaaagttgcatcgctgccgatttgaccgccaacccttccaagaacagattcactaacattttaccgtacgaccactcgcgcgtgaagctaaagcccatcgacgatgacgacgggtccgattatgtcaatgcctcgtatattccggtacaactcgaaaaggaataattcctttttatctttttcatcttagggattcaattcacgtcgagaattcatcgctgcccaagggcctttgccgtcaagtaaatttattcataaatcattctaagtaatttgataatccttttgcagctcgcgatcacttctggcgcctcatttgggaacatcaagtgccggcagttgtcgcgttgacaaaatgtattgaaaagggacgagacaaatgccaccaatattggcccgacaataatgtacgttttctggcaaatccaaataaatatcagaaataggaaaaattgcagagtcgcagtgttctctacgccgacattgaggtgggcatcagcagaagtgaccacagttcgaatgtatcccatatatgcaggtgacactactgaccgaatccatcgaatatgacgaattcaccatccgcgaactgcggctgaccaacatggccgagccaaaccaaccggcccgaacggtgcagcacttgcactaccaggttgatcaacagccatatagtgatcctctgtttcctttacgcaggcatggcccgattttggcgtgcccgaccatccagccggcatcgttcacctcgcgcgactgttccgcaacaaattgcccccctcgtcttccaacaaaccgaccatagtgcactgttcagcaggtgtaggccgatctggcacgttcatcgcattggatcgactcgtgcaacacattgaatccggacgacccatcgatgtgttcggcactgtttacgaaatgcggctcgagcggtgccatatggtacaaaatgaagtaagggcgagaaaagttcggtgtgaaatagtacaatgctttctctgttcagcaacagtacatcttcattcaccactgtctgcagtatttgctggagaatttctacccctttctgttgtgtccctcctcccaacaactgcagcagcaacagcaacacacagtcggccaccgaccgctgtcctcgccaaatccacacgccccgttcggctcgtccatctcttctcccatctgtgccgactatttcggctgcggttcgtcgtcgtccgttttgtccaacgcaagcagaggggacggcggtggctggtcatcgaaggtgccgatgacttcgagcagtaacaacagcggagccggcatcaattgttattggccgcccacctccgctcaaaataagtcgacggactcttgcgacggaattgtcacgacaataaagcactcaccaccgaagattgaggtgcatcaccctcaaaggaatgacgggtttctggaggacgacgaaggcatcgccgaatctggcctctga

SEQ ID NO: 45644 - DNA, 603 bp, Heterodera glycines
  Genomic contig location: Contig_ID=SeqID_21378; Location=380..982; Strand=+
  SCN-specific regions: Sequence locations=1-289,311-603
  Gene Ontology: Biological process=positive regulation of embryonic development
gaatgatgccttcgaggagcaggacctcattaacgccttggagccatttttgatggcggaacgcgacagatcgtaagtgtgttgcaggcaattatcgcaccttcacttcaagaatcccggacgcggaggcgttgcacccaatcggattttgagagggcccatttgcccacaatttttagtaaaatggcggggatgtggcggcaatctgaaatggtcaacctccgttcccgcccctgaaaattttgaaaaaaaccccggctctgtcgaaaaagattaccccttcgccccgtcttttccatgctgtttttgggtgcttccgggttggtgaaactcatccccgaaattttttgaaaaatttttttttatgggtaaacatgcgttagcgtaaaacaaattggttaaataaattgatgtttcatttgtcggtgcctaaaaatgtattcctaattcggatgtttcttaagggtgttgcgcatcatgaaacgcaatcgggagctggagaacgaggtgatgaaggatgtgccgggatggaagaccggcacttggtacggcgagccggtctatttcacgttgggcgacaaatggattgaaccgaatgcaatg

SEQ ID NO: 45645 - DNA, 959 bp, Heterodera glycines
  Genomic contig location: Contig_ID=SeqID_3815; Location=1414..2372; Strand=+
  SCN-specific regions: Sequence locations=1-74,96-259,283-341,363 -424,446-491,513-570,592-839,921-959
atgtatgcggacgatgttaaattgtatattttccatcaaaatgattcaaatacaaatgatctatctgaagctataaaaattcttgaaaaatggtccaaatctaacggccttgaaatatcggtcgaaaagagtcaaacattgtatattggcaaaaataattcaaaaaaagagtattttctcaatggaaaaattattccaagcttagaaaaagtcaaagatttaggagtaataattgactctaaattatcttttgctgatcatataaataaaataataaaaaatgcttacttaaaggcataccatattttgagaataatgaagactagagagctaaaaactattataagaatgtataagacttatgtcagacctcaattagaatatgctgttgaaatttggaaccctaacttaaaaaaagatatagaaagaatagaaaaagtccagaaatttttcacgagaaaagcctttaaaaaatgcggacttttacatagatcatattcagaaagacttgaaatttgtcagcttatagaattagccaagcgaagaaatattgctgacttaactaccgcttttaaaattatgaagggttttacgagtcttgatgctagtaaactttttactttttctgatcgacccactcgtaggccattacttttgagaatgcggcgcacaaccacaaaaagtaagaataatttttttaaccgtatagccaagaattggaacaaattaccaattgttccaattcaggcagataaggcaaatcaattcagggcattgctaaaagctatgtatgagttctaagggatttcattgacatttgcattgacattatttattcattatttcattttattttattttactttacatttcatattgttgtatttttttttgacattatttattttgattttttttatgcgccacataagagcactaatgtgcctgtggtttgctca

SEQ ID NO: 45646 - DNA, 651 bp, Heterodera glycines
  Genomic contig location: Contig_ID=SeqID_3815; Location=1746..2396; Strand=-
  SCN-specific regions: Sequence locations=25-63,145-392,414-471,493 -538,560-621,643-651
aaaattgtttatatatatatttattgagcaaaccacaggcacattagtgctcttatgtggcgcataaaaaaaatcaaaataaataatgtcaaaaaaaaatacaacaatatgaaatgtaaagtaaaataaaataaaatgaaataatgaataaataatgtcaatgcaaatgtcaatgaaatcccttagaactcatacatagcttttagcaatgccctgaattgatttgccttatctgcctgaattggaacaattggtaatttgttccaattcttggctatacggttaaaaaaattattcttactttttgtggttgtgcgccgcattctcaaaagtaatggcctacgagtgggtcgatcagaaaaagtaaaaagtttactagcatcaagactcgtaaaacccttcataattttaaaagcggtagttaagtcagcaatatttcttcgcttggctaattctataagctgacaaatttcaagtctttctgaatatgatctatgtaaaagtccgcattttttaaaggcttttctcgtgaaaaatttctggactttttctattctttctatatctttttttaagttagggttccaaatttcaacagcatattctaattgaggtctgacataagtcttatacattcttataatagttttt

SEQ ID NO: 45647 - DNA, 2031 bp, Heterodera glycines
  misc_feature (1797)..(1797): n is a, c, g, or t
  misc_feature (1908)..(1908): n is a, c, g, or t
  Genomic contig location: Contig_ID=SeqID_3817; Location=2783..4813; Strand=-
  SCN-specific regions: Sequence locations=1-769,792-1427,1449 -1454,1483-1526,1548-1605,1627-1640,1662-1974,2000-2006,2029-2031
  Gene Ontology: Mol. function=structural constituent of ribosome; Cellular component=cytosolic small ribosomal subunit (sensu Eukarya); Biological process=locomotory behavior
atgcttatgccacaaggtgatcggaagaaaatttacgagcatttgtttgaggatggagtttgcatcgcgaagaaggactactgcttgaagtcgcatcccgaaattaagggagtgaagaacctttacgtcatcaaggcattgaaggttttttcttcactaattatttaatatgcatcttgaaatccgaggcttaatttacattcaatgactcatttcactgtttctcgcttaagagtcttgcatctcgtggacttgtcaaggagcagtatgcctggcaccactattatttctaccttcaacccgaagggattgtccatttgcgtgcttaccttggacttcctgacgatgtgttgccgaacacgcacaagcaaaggaccgacgctattcaaaaggcttttgcagacaaaggaggccgaggttataagcaatttaaaaaaaattaatcacaatgtcctttatttattttgcgaaatagagttttgagtattaaactatattgaatcttcggtatttaattgaatcaatgtttttctagacacaaatttgaatgtttttttaaattctctagccttttatcaggtccgattcgcgccgacaccgatcgtgggggttatcgcgctgccgcagataaacaagcggaggctgggcctggtgctgctccgattagtcatcgtcagggcttcggacgtggaggaggtgcccctgctccccaataagaacttcgggaatgcttgatctttgatttctggagattttttttgttgattttttggttataaagagttgatcagttgacatgaaatttttggtgcgatatgtggaccatttgaaattgcttatgtgtacacaaatctaaggctgcgaacaatgtgcgaatttttgagaaaacaattcaatacgttgccctcaattattttcaagcatcctatatgttaaaatcccaccgattcgtatcccataccatctccccgagtactactaagaattgcaaaaaactgcatatgggttttcggtaacttaaggacatcatattttcgaataggtgttgaaaaaatggttctcaattttgtttacgggttttattccatcatttacatgtgtacatagcatatgcgttacaacatcaaatataattattgataaggactccgaaaaacgtgcccaaagtgcaaagaccacatgccgatgcaaatcagagagaactcgtatcacgtaacaaacaacaaccaatgatttgacggatgataattgttttccccattttagctatccatcctaattacgggacgcttgtcaatttggacacggagattttcgcgaaggaacaacaggcgaaaggtgtggcagtggtgggcagaaaaaaggggaatggcgcaactttctgtgggccaactttttccccattttcagatgccaagcgaatgcctccaccagctccaccaaagccatctcctccacaaactgttgctgctgctcctggtgggcctcgtttcgtttcgagtgagtgtgttggacatgacatcattaacactgcaacaaaaatgattcccctgatcattttttagcgcaggatcccaattacgcaactcttggccaattggacccgaacatttttgagaaaaatgcgccaacaaaaccgccacaacaaaaacagcagcagacaaaggaaggacagatgatattcgtttcgagtaaaaccattttttgatcagagaatgttcaattcaaatgctttatctctttttcagcgcgcaatcccaattatccgacgctggccaagcttgacccggacatttntgtgaagaataatgcaccaacaaaaacagcgccaatcaaacagcaggcgaaaggagggggacggggttatgcgacaagtaaaaaatgatggataaattcgttggatttatntaataattctttttcttttcagcaactgatcctaattatgcgacgcctggccaagtggattcgaaaatctttgacaagaataatgagaagactggtaccgacgacgacagcgaaagcagctag

SEQ ID NO: 45648 - DNA, 2758 bp, Heterodera glycines
  Genomic contig location: Contig_ID=SeqID_3821; Location=165..2922; Strand=-
  SCN-specific regions: Sequence locations=1-120,142-301,328-459,488 -522,545-602,625-1123,1145-1356,1378-1455,1477-1764,1786-1944,1966 -2758
  Gene Ontology: Mol. function=transmembrane receptor activity; Cellular component=integral to membrane; Biological process =induction of apoptosis
ttggcgtagttgcggagacagtttcgtcctcacaaattcgactttcatgggctgacccaaatgagaatgcatttaaccaaatgtacaccatcaaatacggaataaggtacggctaattgcattttttattattattaatttggtgtttttttagcaattcagatgagtctcaacataagcagctgaacatcacagaaactgagcatatcttcgatggactgaggccggacactttgtacgaatttgctgtccgactggtccaatcttctcattggagtttgaacgcgctcaaccgaacccatccggcaccgccctcctcgccaccacgtgatttaaccgtcattggtccccagttcaacaaccaacacgagaatgctgatcccggcacgataacgcttacatggcaaccgccaaaatatgcaaatggagaaattcaaggtcctttattgtttgtgctgtttttgcaacattcaaatttttaatctttttagttttattacgtaatgattttgttagtgattttccttataataaattcctcttttaaactgtatttgaaatggcttaaaagccttaaatccggaaacataacatttgtacaaatttttattgcttttcagaatacattatgctcttttcggatcggccacatttgcctgacagggattggagtatggaaagtgtgaagggcgatcgactttcgattgaactgcgcaatcttcggccccgcctcacctaccatttcaagctgcaagcccgcaatgtgaagggttacggtccgtttacgcctgtgaccagcgtcaccaccgcggacactttcacttccaatccgacatcgaatggaccgagaaattccgtcaatgccggaagcaattcggaagcatttgagattttaatgggccaatttttaagtggattgaggtggtcaagcattgctcaaatgcatacaatttctcatttgcgctgcttacacaggtccaacttggtcttcgtgctcattggcattgttgttgccgtcgttgtgctgctgttattcattgctctgtgctcactttgtttctatcataacaaaaatagcgcttcttccaccgctgcagcggccaatcgaccgcagcagagaagcaaaaaagagcagcgtaacaaacggtccaaacaccaccaacaggcttacatccccggccgcaaaatgtccgtctccactccgtccgccgttgccgagttggacgacgatctttggctggtccatcagcagcgaaattcggcagcaaaccctggcggcgcacgttttgccaccattgtcaatgcgtccaatgttgacgtgagtatatttttttgccaaattttttggtccattagcttcatttttctaaacattttaaagggctatggatcgtccgttgatgatgagacgggcattcttctaattgacggacaacagagggccttctttgcgccggcaaatgcagctggtgggcctaactttcagtctgcccaaatggaatgtacgacgccaaaacactaccagcaaaatgcgtaccatgcggcgacgcaacgccatggtagtttagggtcatgacttattcattaattattttgaagtaatcatttcgtcttttctcttctaatgagtatctttttctttgtcctcgaattgttgacatgttgccccttggtgaagtatttaatcattacaaatattctgggaaatcgattaaaattggctgtttgtgatattataattgcatatcagggaggactgaagacagagagaaaggcatctctgtcggaggaggtgaattttatgggggcggctccctaatggagtcattccattcgatgacgaccgtcggcgactcgccaaaaagtagcaacaaaagtcgcaaattgcaccgcaattccttgccgccacacatttgtccgtccaattcgaccacgatgtcgccaccatttgccaccaacaacaaaagtccacaaccgaatcaacattggcaacacaattgccatgcttttggcaagcatgaccattttggtattaggggaggaacgcaaaatattgccgaaacgaaatttggacggcgaagtgactctccgtatggcactcgttttccatgccagcaaggagtggccggtattcgaacacattgttgtggacaccttagctcgttgaacgcattggatttgagcatttctcctcgtcttggccatacacttcggcaaacaaatgggcctaattctattgagcgaactgcggcccttttgaacgaacttgacgaaaaacacgaaaccgttctgccactgcaacgtttccgtgttggcattggccttccatcgatgccgttacaagtcaaacaagcaaagcggaaaacaaccgctcattatgaagcaacaacagcggtgacacgaaagcaagcagcacccacgaaaagcgtaaattttgcttccaaattggtcattgtctcgtcggacgatgacgacaacggcggctacaacaaatggagcaaaaaaacaaaacgccaatggaacggaagtaaagacgacaaagggatttcgttcattgacaattcgctggtcgatgacgttgatgaagattataaatatgccaatgcggacacggagaatcggcagcagaaggaaacggagattgaaaatgctaacacaacaatgaaaaagcagcagagaaatgccgccgatgaaaagctgaacggatgcgacgatggatcaaaaaatgtgccaccgccatcagtcgttgatttggcta

SEQ ID NO: 45649 - DNA, 1124 bp, Heterodera glycines
  Genomic contig location: Contig_ID=SeqID_21406; Location=301..1424; Strand=-
  SCN-specific regions: Sequence locations=1-50,72-512,534-609,631 -724,746-1124
tcaaatcgaacaattgcatcgctttttcttcaccactgccaatcgcttcgtacaaacgttggaaatgttcatcaacggtgactttcgcttctccgcccttttcggccaacttttcggccttggccctgcgccggagggaatgttaagcgacggacgattggagagggactgcttcaacatgcgcaaagtgatcgttgtcagcactcttccaggtcgtttttcttacaatccttcgaccatatgaaagtggtttgtcttaaggcactctcttcggcatttccaatgagaatggccacttgctttggtcgttgtatttgggcaatgactttgcgccttatcacaacgaacgccattctgttgaggcagcaagggaagggaaagtgccgttgctcatccaacggggcacggcattttaccaatggccgagtcaggcggccgccgtattcaatgcaaaggttggtttgaaatcgcagcgaataaaatcaattttttttgttttttaggattcggctgattctgttgttttgtttttcaacccaatcaccggcactcaaattgaacgggttcgggttagtatttttaccttttttctgatcataagaaattggaattgtattatttttattttcactgttatttctgaatttctcttttttcagatccctggcgggctttttcggattgaactttggccttttcccaactcagaacaactccatcccctgctgattttcaagaattctgacccaacagttgtggaatttttgccaaaatctatgccaaattccgagcctcttaaacagacttatttgttcaatgttgggcacgaaaagggcaccttggttggatttaattatatacaatacttttctctagccacgcaaatcccgttttcataaaatgtattaataaatattcagcctattttacttttatttacactttttaaaaacgctgaatcatttttttgtgttttttagctcggccataaggttgaattttctgccgatggaaatgctcgattatccgaacaatggatgacgcaattgccatggagtgactccgagtccatttatgccattgtgggaaagtctgctaatggtgaaccaaagtctacacattag

SEQ ID NO: 45650 - DNA, 1342 bp, Heterodera glycines
  Genomic contig location: Contig_ID=SeqID_3826; Location=142..1483; Strand=-
  SCN-specific regions: Sequence locations=1-208,257-517,569-713,735 -1007,1030-1176,1213-1342
atgaatttggcactttttgtcgcaatttgtcaattcctgcttctgttttttggcacttttcctcccacaaatggcactatttctacggcattttcacaatttctacgaaattacttcaatgatgaggtggagaagaacattgcacgcagagatttgggcactgacggaagttttggcggtggaaaagggcgaattaaggcaaagtatgtaaattataaattaattaattttttttcaaaattaaattcaataattagcctattgaagccaatttcaaatttttaagaaaacgtcctgtaatttttgtgcacggcttaacaaatttagcgggagagttggactacgttcggcgactgttccgcgaaaaaggcggctaccgtgacagcgaattgtactcgaccacttacggttacggtatgaagggatggaaatggctacgtgatgcaatgaaatgtgatcatgtgaaaatggttggtgtctgtctaaatacgcattaaaatagttaaattaatgacagtttaattttaaaataaaaatatattaatttaaataataaaaattaattttagagttgagcggtaatcggtaattgcaaaaaaaccggtaccggtactgatcggtactgcaaaaaccggtaccggtaccggtaccaactttttcaaccggtaccggtaccggtaccggtaaaaaccggtaattttagaacataaaaatttttggacaaaattttccaaatacaaaatttttattcagttttcgcgcgagtacctgttttttagcattagaattgttcagaagtatatgtatattcaggttgaccaagtttttttttttcaaattcaggacatagaacactaaaattcagatgtagacctcaaaattcagattattgcaaaacaaggggtcagcagccaattttccaattttgcgaaggggtctccggccatgtaaattaatgtaaatcaatgaccttttttttgctttcaacaccgctttttacgcggcacgttttttccaagacttttgggggacaaggagggccggcggtgccgataggcgccgccgggaaaaaatttgtgatttttaatgcgatttgttaacagaatttgtaaaaaaaatgaccaattgattaagttttgggtttttaggatgcttaacatgaaagaaaaaagttggaatattttttaaaattaaaattttaattaaaataatggtaaagaaaatgtgaggaatattctatccaagtggggaattgaacccaggcgaaaaattatgaaaggtagaaagtttaaccactacaccacatgtgcatgtgtgtactcccatgactaaatgaaataaa

SEQ ID NO: 45651 - DNA, 822 bp, Heterodera glycines
  Genomic contig location: Contig_ID=SeqID_21417; Location=393..1214; Strand=-
  SCN-specific regions: Sequence locations=1-29,57-80,102-105,132 -135,174-226,249-324,346-378,400-445,470-793,815-822
  Gene Ontology: Mol. function=calcium ion binding
tacactactggatgtatgcttttatccttttcagagttcaaagaggctttctcgctgttcgataaggacggggatggcacaattaccaccaaggaattgggcacggtcatgcggtcgctgggtcaaaaccccacggaggcggagttgcaggacatgatcaacgaagtggatgcagacggtcctaaaaggctttgaataagcgtaatgtatcggcaaacattcaggaaacgggaccattgactttcccgaattcctcacaatgatggcacgcaaaatgaaggacacggacagcgaagaagagattcgggaggcattcagagtaacacaaaatgtaaaatgaaattagatattgattataaatttcgaggtgttcgacaaagacggcaatggcttcatctctgcggccgaactgcgtcacgtgatgacaaatttaggagagaaactgacagacgaagaagtggacgaaatgtaagcgaatggaagggcggaaaggggaggactgagtttgaatggttgtttaggatcagggaagcggacattgacggggatgggcaagtcaactacgaaggtcagtgtttatggtagcattatcatgggctagttgtgtaaggtggttgtattggggtcttcctcctccttttatataaaatttttctctctttttagctacaccctgggagattggaattaaaaaagggcaataagaaaataagaacaaatggtctttagcaaaccgtactaatgaaatatcgtatcctttgtgattacaaacgaattgtgaagttgcccttttaagaattcgtaacgatgatgacgacgaaa

SEQ ID NO: 45652 - DNA, 1652 bp, Heterodera glycines
  Genomic contig location: Contig_ID=SeqID_21423; Location=180..1831; Strand=+
  SCN-specific regions: Sequence locations=1-512,535-1013,1035 -1389,1412-1612,1635-1652
atggcatttgggcagcacaaacaagttctcatcgatggcgacctgcatacattacgttttggcgcaccttctcgcgagctgtttatgggcaattttccgttcaaaggcgccttcggaggtccgccaatcattgcaacgatcaatcaacgaaggcacgaaattcgcctttgtggaccgccgcccgaagtgcgcattgacccggagccgagctacgaactgatgcggtacatgccggcagtgcgacaacaacagccgacgatggtgcaaccgacgaagactgatgggacagagggcgaccgcaagaggaagagaggtagagacaggaggctaacaaaacaggaattattgtttcagaatcgccgcccatcgacgtttcacgattgttaaagcgtctgaaggagaccggactgcttacacaaccgcccaacgaagcagagcggaaccaacgtaaaaaacaagtggagatagaggcgaatgcggcaccaattccttccaaccatcgcctagacaatatcgagcgcagggcaacgccgatgtccggcctggagcagttcagcatgagatcactgatcatgtcggtgtttggggtgtggtcagtcctttaaccaaggggtatctgttttgtgcgacatttgtggaccagtcacaattcagttttcaatatttaaggatattttattcatataaaatgacaagcagcctatttaacaaataacacaatgttaattattccaatcttacgattatgagacgaaggaaagaggaatattaattagcatgtttagaattaataattttgctccactctgatttttccggttacttttggcattgattgaatgttcatccccgatttcagtcgctacgattccgtaatcgacgccattcatcgtccacgcgttgtgtgtcagtattgtggaattgcgttccaaaaattatataatgaggcgtatcaacggcacgcggattggcacctgcaaaaaacaattcggatcgaggaccaaaaacttaacaaaggaccaaaagtggtgaagggtacaagctcacagccatggtatatggtggaggtcgggaatgcaactcgaaaatggcgataaacgacaaaatattattggaatttaggattggtttgatttttcggagacggaactggtcaacagaacgcagggaatgggtgagcaaagggggaaatggcaaataacgccaagaatcatttaaattatgccaaggtggtgctgacaaatctgccgtcgaagacgaaaagggcaccgccgcagtttcgcatcaacatacggcggggaccaatcgggacgcgccttcggaattgtcgaatcgaaggtaggccagaagcgcatttgccaatttgatgctaacattgcattctcatttcacaggaatgccaagtttgccatgaacaattcgaggagtattgggacgaggaggaggacgtgtggcgccttccgcactgcttactttcggatgggaaggtgtgccaaagagggaaagaatagatgtcattttgttgttttaggcatttcatattttttgcaaagaggacgtcatccaagaggaagctgacatggacttacgttgttgatttattttgctatgatctctcccccaccgcttttgtccaaattcattgaaggcga

SEQ ID NO: 45653 - DNA, 1471 bp, Heterodera glycines
  Genomic contig location: Contig_ID=SeqID_422; Location=1193..2663; Strand=-
  SCN-specific regions: Sequence locations=1-163,186-655,677-814,836 -1047,1127-1415,1437-1471
aattatatgctgatgatgttaaattgtatatatgctataaagcaagagcagatacagaaattatgcataaagcattgcataatttattcgaatgggcaaataaatggcaaataagagtttcagttcaaaaaacttttgtattatatttgggttcaaaaaacccaaaagaaacatataaatttgatggaaatacaataaatgctgtggatacaattagggatttaggagtaaacattgataataaattacaattttccgatcatgtaaacaaaataacaaggaatgcgtatttacgtatgcgttccttgtttcgaataattaaatccaaatcatctaagatttggattacgttatataaaacttatattaggcctttattggaatacgctccggaggtttggaatccgtctcttcaaaaaaatattaaaaaaatagaaaagtgtcaaaaatatttcaccaaacgggtattttttaaatgcagccttccaccaattccataccaaaatcgattagaatacctgcaactgccgacacttgagaataggcgaaagctatttgatctgttcatggcgcataaaattgtttatggccgaacagatctgaaactattttcaatttttaatccatcgacacgctttaacatccccttttacagatttaacacaaaatataaaataggcaaaaaattcattccctttgccgggagggtaacaaaattatggaatcaacttgataaagaactaataaaaacaaattctttaaatcaatttaaaacaaaacttaaaaattcattagggtaataaccggaaaagcaaaaacagaattaattttttaagtgatttgacatttgtgttatcgatctcaattgactttgacctcattttattcatatattttgattttattttttgatcatccatatatattatatcacttactctacgacatactatctgaacagtcgtcagagtaagtggtttttgcccttctgatgactttttattcacgaataaataaaagactaaaaaaaagactaactaaccattcataattaaattaagcaattataataaaaataagaaaattgttgaataataatatttaataattattttaacaaaaaaatgtgaaataaaatagaagaatatcacttaagagcattttcatagatcattcatatccccatggttaacacttcacataggttattgtagcatctaaaatgattaagatgaaaattaatgccaattttgtttttgctttttcacttttcgccactcccaccgatccgccgcccggctccaaccaattgaacgcctcctccgacaaatccacgtggtctttcgcgcactcggaacatttgttgttgatcggaacagtcaaactaattaagccaaattgagttaattgaacaattaattaaaccccaaatttcaatgtttacgtgttccctttgtattcgattttgacg

SEQ ID NO: 45654 - DNA, 2259 bp, Heterodera glycines
  Genomic contig location: Contig_ID=SeqID_3831; Location=338..2596; Strand=-
  SCN-specific regions: Sequence locations=1-96,121-232,272-354,376 -406,436-658,683-708,730-752,778-856,878-1002,1027-1119,1160 -1235,1261-1519,1541-1678,1700-2032,2054-2057,2090-2094,2116 -2199,2222-2259
  Gene Ontology: Mol. function=diphosphomevalonate decarboxylase activity; Cellular component=cytosol; Biological process =embryogenesis and morphogenesis
atgaacagaggcggtggcttccatattacgattcaagcaccagtgaacatcgcactgatcaaatattggggcaagaggaatgaggtaaacgttttgtttaaaaaattttaattttaaaatgccattagttgcttaatttacctttgtgatttgggccgttgggtttcatatctgttttttcctgttacaccgggcttaatcggttaggttaatcaaccacaaaaaaaaagttacaacaagaaaacaacaaaaaattcatattttcttttttatattggcgaaggaaaaagtgggatttgcttttattcacgggaccgtctctgtgactgacttcccaaaaatttggtcaatgttaataaatttttaaccctaaatctcggagacaaatgagcgtttattgtttgtctatttaaaacaaaataaaataaacattttaagacgagccacacctaaaatcttttttaaaaccacctaataatttgcctaattttgtccattgcccaggaactcgtccttccgctcaacgattccattgctatcacaattgatgagctgagcgccaccacacacatcacaattgggcccgatgtgagcacggactcggtgacattgaacggagtcggcattgacatcgccggcagttcgcggtttcgaaacgtttttcaggtttttatttttttttggggggggggtaccttttcaaatttacagaaatataaaaccatttagtatatgggtttattaccgctaactaattttataaaaacctaaaaatttcaaataattgatgaaagccatgacaaaaatcaatgggttttgctaaatctgctctcggattcgtgttagcgcattttaccctaaatatgtgcaaagaaaatttgttttttttttcttgttgggacaccaagtccgttggattaccaagtttacttgctgttgctgtttgtaacaaaaaaacaaaacaacagaagtgcctttcctatttttcatattttttcatccattttttaaaattattatttataactccttccccaattttaagcaaattcgtgaatactcaaacagaaagcgaaaactgaagggcgagcatgcttcaaagggttggcacaccaaggtgagagagagagagaaaaaaatggggagagaaagagtgaaatttgcaaattaaaaaaattaggcatttatatagagttaggagtcgtcgacaaaatcaaaataaaggtctagaaattaaaattttttgttgcaaaaaccagggaagggaggcaccaaaaatttaaaaaaattgcgaatcaaaagggtccacctttggtttcgcaaaatttttttttaatttttcgattcctactctgattttttgtcgacccccttcttaatagaagtgccaaaaatataatcgaattttccaaaataacggcaccatccttctataattcttcgttacagattgagtcgagcacaaattttccgacctcggcaggactcgcttcatccgtaagcgcttctcttcttttcccagcaaaaatttgttgcttttcaagctcaaaaagataatgttatcccaaaattaaaatgttttttttgatacctcttcctttggctacgattttttgggacaaaaaattggttagagccaatgctgtcgaaagcgacggtcaagagggaatttttgttaaatttttgagatttttgtttattaaagcatttcccttcactttgcttttcgtaaattccaacacaatttaccaacaaaaaaaaaaaaaagtaaaattttcctttttttcaggccgccggttttgccgccattgcgtttgggcttggcaaaattttccgcttgccggagcgagacattgtcagaatggcccgaatgggtacgtctcttacaattagcatctacactaaagcacatttttttcaagtgggataatttggtaaattttggtgtagaggacaaaacgacgtcggacgaatttttagccataacttttctaacaataaaccaaattaagcattttggcattgttcaaaagcactttacaaactttattaaccagaaaaatttaaatattttatttatgtaaaaaatgggacaaaaatttctttgaaaagttatatttctgagttcttctgcagcaaagtctttgtaatttgctctttttcccaggctcgggctccgcttgtcgcagcattcagggcggttttgttcactggaaggcgggcactcatcagcaaaacgactcggactgtctttgcgag

SEQ ID NO: 45655 - DNA, 2228 bp, Heterodera glycines
  Genomic contig location: Contig_ID=SeqID_3839; Location=726..2953; Strand=+
  SCN-specific regions: Sequence locations=1-282,304-569,591-1444,1466 -2109,2132-2228
atggcatttcacaaaattgacactgactccgtgaactcaatcaccaatgctttggactttttccgcattcccccgaccaatgtgagcgtctcttcgtccaaagtgtttgagcttttgcctagcaaccctctgaccgacacaccataccacttcaaactccactcatgccaaaactacattgatctttccaaatgctatttgctcaccgagtttcgaatccagaaggaaaatgctaatggacaacttgttaacctaaccattgatgatataaacattgcaccaatccaaatgattggccaaactttcatccgtaacataaaaatgagcatcaatgggcgcgaaattttcaatgccaatgcactgatggcttacaaaacatatttttcacatgagctttcctattcaacaacggcaaaggactcccatctgaatgccgcggggtactaccgagacacgggcgactcactggaaatgggagacggatgcacagcgcgacgtgatttgtttgcgaatagtaatgtagcccaattcattgccaaaattgacaccgacctgttcaatcagccgctgtatctgatcaacttttgtgagctggacattgaaatattgcccaacgacaacgaatttgtgttaatcgcgccgaccggtggtcggtaccgtttcgaggttgtgggactgaaattatatgtgaaaaaggtgtctctgatggacgggttggcattggacattgcacgaaagttggaggtgaagcctgcccgttatgcagtgaggaagacaatgatgaagtctgtgttcatcagtccgggcaggtatgagttcacagccaatctgttcatggaccaaattccccgtcgtgttacaatggggctggtggcgaatactgactatgtcggctcaattaggcgcagcccattcaactttcaaccatttaatgtgcgcgagatttccattgttgccaatggtcgatcttacccacaagcaccctatgacttagactacccgaacggaaagtatgttcgtccattcaatgatatgaacgaagcggtgggattcgcaaattcatctgagagcaatggcataacttttgcccaatacggtaaaacccattgcatttacgtgttcaatttgaccaacagcggggatgatcaagcggcactgtttgatttgataaagaatgggaccacagcggtgagcgtcaaatttaaccatccagtgcccgagggaggaataatgttggtggtgatgggcgaatgtgactctcttgtgatgttggacaaaaatcgatcgataagcaccgataccactatttaaacgcgcatcacattgtcccatttcatttgcataaaatgtattcaaaaaaattgggtatcattttgttcttgctccgcgtttctattcctgttgtttcaacattccatgaacaaccgcaaaagccaccgccagagaatacatattctgcttatttgaaaaatttgactttgtctcggcaacaacaccacccagaatattcctacactgaatatctgagaagattgtctttgtcaaagattgctacgacaacaacatttaaacccaacataacgaccaccccgaaaagcgacaagttaattgatgagcatttctctgctgttcttccaccgcttatccaactgtgtaaggatctaccagcggaaagcaactttgcgcagaaagccatttgcggggcattgttcgccctttatttaatgctcatcctcagtctgattcttcatcaactttgttcaattttttggctaaagaatggacgcctccaaattataaagatattgagcgaaaatcggcagaccgagccagtgtttcggggctgcttcgccagtgaccaattgccgcctcccttcacactacagtaccccgcagcgctcgtcgtgaacagggacgcccaccacaaggagggctctcattggtgcgccatttatgcgaagggaatggatacgccaggctctactatgacagtcttgctcaacccatccctccctccatcacatcatcatttttgtgccaattccccaagggattaacgaagaattcacacccatatcagtccccccttgtctccacttatgccgcccactgcattgtttttatttaccatttgtccctcggagacacatttaatcaatttctcaaccgacttgagtcttgttcaaacccagatttatatgccacggttgtactccataaaattttaa

SEQ ID NO: 45656 - DNA, 2177 bp, Heterodera glycines; identical to SEQ ID NO: 21499
  Genomic contig location: Contig_ID=SeqID_21499; Location=1..2177; Strand=+
  SCN-specific regions: Sequence locations=1-732,754-1165,1187 -1550,1576-2060,2082-2177
  Gene Ontology: Mol. function=ATP dependent RNA helicase activity; Cellular component=nucleolus; Biological process=nucleobase, nucleoside, nucleotide and nucleic acid metabolism

SEQ ID NO: 45657 - DNA, 1148 bp, Heterodera glycines
  Genomic contig location: Contig_ID=SeqID_21502; Location=127..1274; Strand=+
  SCN-specific regions: Sequence locations=1-126,148-625,657-864,887 -1148
  Gene Ontology: Mol. function=dihydropyridine-sensitive calcium channel activity; Cellular component=voltage-gated calcium channel complex
cctgtgtttgtcccacaggtcagccaggactccaatttttcccaccaccatgacaatgacttcgacttggagcagcgcaatcgcgaggccatcaaaagcaacgcggagcggcaggcggcgcaacagttggaaaatgccaaagtcagcgaagggggggggggcacggcacggagaagcaaaacccgacactctttaaaagggattttaattaactactctcaatcttgggccatttaatccgggttctcgattttgaggcattgaaaaatctcgatgggtagcactcccgacccgattctcgatattctccccaggcaaaaataacttattcattttccttaaacattgctcggggtaaaattttcgctcggtaatcgatcgttgtaattgatccataccaattaattatgcttgttgattgattgaactgactaattgtgccaattatccccgtccagtacaacccggtgctattcgccgtgcagaccaacgtcgactttgacggcaccattgacgacgacgcgccggtgcacggctgtgccgtgtcattcaaggcaaaggagtttctgcacattaaggcgagcaaaacaattaaaaccgaaattttaatcgggtgatttgttgcaggagaagtacaacaacgactggtggatcggcagattggtcaaggagagctgtgaactcggctttatcccgtcgcccgccaagttggaggcggtccgccaggcgcagcagggcggaaaaggcgccaaattgtgagcattttttaaaccccgcgacgggacaatggaaacacacaattatttccaaattcattcatatttgtgtagccagatggcctaataattatttgatttagctttgtgtttaatttggttatttttctgatcagagatttgcgtgacttttagttgatcagccagatgattaaaatctcgaacgaatttgggtatttctgatggtgattttagctatcggatctgctacttattgatccagctcttgctttgtcctttctgctgatcactaattagaaattctcaaaaattttacccacgactgataaaatgattagattcgatcaaatcaaccatggtttgaaaaattataattagtttatgctaacaaataaatgcactaattagtgc

SEQ ID NO: 45658 - DNA, 1174 bp, Heterodera glycines
  Genomic contig location: Contig_ID=SeqID_21509; Location=531..1704; Strand=+
  SCN-specific regions: Sequence locations=1-509,533-797,819-1174
  Gene Ontology: Mol. function=calcium-dependent cell adhesion molecule activity; Cellular component=integral to plasma membrane; Biological process=cell adhesion
atgcattttcgtcagggcaattcacccggcattgaactgctccaactccgtgcgtcggacggcgacttgggtaaaaatgggcgcgtcgagtttcgacttgcggttgagacggaccttctctcggtggaccccgattcgggactggtccgggcggagcgcacttttgaccgggaggagttgggcgaccgcgtcactgtgccggtgatggcattggaccggggaacgccctcccgcgcgacatttgccaatctgaccattcttctgacggaccaaaacgatgaagcgccccaatgcggcaaggaaacgcatcgcttttccgttgcggaagacgcgcctaatgggcaattagtgggcactttcaacaattttttggtcaattacattcccaaggtcggctgtttggatgcatatgattcggatgagtttggcacttcgaacagccaaatccgtttcgaattggcacaatccgatgccaacgggccgttccgagttcatgccgagactggctgcctctttttggacctccccggccttccacttgactttgagcagcgttcgacgtacaatttgagtgtccggctaaaagacatgggaaaaccgccgcttgaagccgttaagccttgccaagttcgtttttctactcccatttcgatttaattaaggtttaaggtccaaattctgctcgaagatgtggaagagaatgcgtttccgcctcaattcaacgccatggcacttgaggcgagcgtggaagagaacgcgccggcgcacaccgaagtgatccgagtgcatgccgaggaccccgaaggggccgctgttcggtaccgactggtcgccggcaacggactttgctgctttcaaatcgaccccaaatcgggagtgatcagcacgaaaaagggtgagtaacagacaaacccgagagagagtgatagcaaacaatatttgcagaacttgatcacgaactgcaacagcactattggctgactgtccgtgccgaagacactccgttcagtgccatcggccgaatgcttcgcgcccatcttcagctgtttatccgcgtgctgaaccaaaatgaccgactgccactgttttctcagccaatttatcggattggaattgcggagaattcggaggaaaataaggcaaaaacggcattaatgcagagatgccagatcat

SEQ ID NO: 45659 - DNA, 1092 bp, Heterodera glycines
  Genomic contig location: Contig_ID=SeqID_424; Location=303..1394; Strand=-
  SCN-specific regions: Sequence locations=1-1092
atgaagaatctgcttgcagcagatgatgtcagctgttgccagttgatcggacatactctatggaagaactgtcgcatgtcaatcaacggcactcaagtgttcgagggaaacgatttgatggcatacaagagcgtgatggactatgagctgacctaccctgacactgtgaagcgctcctatctgaacgttgccggttactacgcagacgatgaaaatagccagttggcaggcgacggctacactgcccggcgtcaactgttggcgttgagccgcaccgctcagttcatggctcgactggacgttgacccctgcaatcagccgcgctatatcgttaatcaatgcgaagtggacatcgaacttctgcccaactcctctcaatttgttctactggcaccgaatgctccacaagcgccaccggaccaggttcgtcgttatcatctggaggtaatcagctgtaagctgtatgtgaagaaggccgaggtgatggacagcctggcgcttgacatcagcaagcgtttggagctccgtccagcacgctatcctctgcgaaagacgtctttgaaggcgctgttcatcagtgaaaaccgtacagagttcactgccaacctttggtcagatcaggttcccaagcgtgtggtgctcggacttgtatccaatgaaagctacgtgggcaccattggcacctctccgttcaacttccaacccttcgatgtgcgcgacatcagcatttgcgcaaacggacggaactacccccaagcgccctattcattggactttcccaatggacgatttgctcgcgcctatcacgacatgcatgaggctatcggatatgctggtacggtggaaagcaatggaatttcggtgaagcgttacgctgaggggggccaatgctttttcgtattcaatctaacaccatcggcggagagttccgctgatacgttcgaccttatccgaaaaggcacaaccgcgatacgaatttctttcaacacaccagtgcctgcacgaggaatagtgctaatagcaatggcagaaatcgattcacttattatgctgtacaagaatcgttcggtcgctacagatgttcaagtataa

SEQ ID NO: 45660 - DNA, 1178 bp, Heterodera glycines
  misc_feature (18)..(18): n is a, c, g, or t
  Genomic contig location: Contig_ID=SeqID_21539; Location=81..1258; Strand=+
  SCN-specific regions: Sequence locations=1-489,511-1095,1127-1178
  Gene Ontology: Mol. function=casein kinase I activity; Biological process=signal transduction
atgactttggtaggacgnccgttggacaaacttcttcgagaggctggcgaccgtttcagtccgggaactacaattggcatatcgatccagatgctgaacgccatcaagaccctgcacaaagtcgggtttctccatcgcgatgtcaaaccgggaaactcagccattggattggtggagtcaaatgaacaacggctgctctatctcatcgacttcggaatggcgcgtagctacattcgatctgatgtgagagggcggcgggggacatcttggcgattcagaaataacccatccccattttccagggtcaacagcgacgtccacgagccacttcgcagttccgagggacgccaatttatgcaccaatttctgcgcacacaagacgcgactacagccgaaaggatgacgtcgaatcgtggttctacgtcatggtcaaattcttcaaaggaactttgccgtggaaacatattgcgggcggaagggacgaggtaagtaaaaagtgatttgatggaaatgcataatgttcactatttgatttagatcggagagatgaaatgtcgtcgcttggaagggcaaccaaccgaagttcgagaaaaggccatcaacgatctgctgggaggatgtccgcctgaattcaacctgatacttgagcacattgtgcgttgtttcggatgatttctacttcaaacaaattgtaattttttcaggatgccctgcagctggaggaccggccctgctatgagatgatcgagctgctgctgcgtggatatcttgcccaaaacaacatcgaggagcatccatatgactgggagatcggaagacgcaactcggatcgagaaaagacgcaaattgagaaaccagcagagaaacagtgaggaggatgagcgaagaatcacccgcgagatgatgaacaaacggagacacatattcgcgagcctagcatctgtctaatcacatttgctcataattgtatattattgtgatcggtatcaagtcgtctttcattgtatacttggcattgacgacacacggaatgtatgatcacatttgctcattattgtacactgtgatcggtattatcattcattatatacttgccatatgtacatatatatatgtataaaaaactgggtcgcaacaagaaaaaacttcgtttttgggtatttcttgaaaattcaata

SEQ ID NO: 45661 - DNA, 1036 bp, Heterodera glycines
  Genomic contig location: Contig_ID=SeqID_21542; Location=1360..2395; Strand=+
  SCN-specific regions: Sequence locations=1-303,353-471,493-497,519 -1036
  Gene Ontology: Mol. function=protein tyrosine kinase activity; Cellular component=plasma membrane; Biological process=cell proliferation
atgaaggaggtgcggatcatgcgacagctccaacaccccaatgtcgtccagttcatcggtgtggcggttggccaggagcccctgatgatcgtcatggagttggcgacggaccttcgacgctacttggacatgtcgaggcggcaccggctgaacatgcgcgccaaactcttcatgtgcctcggagcagccgccggactggaccacatccactcgaaggacatcatccattgcgacatcgctgcaaagaactgcctctacgcggaccgcatggtgggtgagaacatgatggacgagggaggggtcagaaaaattgggtaccaaaatttaaggaaattggaaaaacaaaaattttgatttttttttggcaaatgctcatttacgctgtttttcctctccaactactgcagattttgcttctcatttgctttgtccaattcattgagtatgtttaaccaaatgtcttcgttgtagacctttccccacccattttttcagaatttcttcttaaaacatagtcgtcctcgcctatgtgtccttcgccttgatgctgttcttcacactgaaaatgttccggcacaacaattccttgcttcagcaaggagccgtcttggagagagtgatcaatttggttcatcatgagtcatcgtctgaaaacgacaaccaacaaatcgcggcgcctttttcggcgtcctcgtcatcgtcaggcactgaaaatgctccgcaaaatgatcaattgttgctaattacgggaggagaaatgccaagccatggcagtgacagtggaagtgccacagcgggacaagtgccaagccatgtcagtgaaagtgccatcgctgagtagaaacaaaatgggatcgggggtctacgggaatacgaagtatatggatattgtgggggattgatgttgagccaagtatggtgtgttgtccaaatgttgtcaaatgttgggacaaatatttattaagaagtaaattgggaaattggcggaagaaaatggagaaacgatataaaattagaagagaactaaaggaggaga

SEQ ID NO: 45662 - DNA, 321 bp, Heterodera glycines
  misc_feature (282)..(283): n is a, c, g, or t
  Genomic contig location: Contig_ID=SeqID_21545; Location=1949..2269; Strand=+
  SCN-specific regions: Sequence locations=1-112,165-321
atggagaaattcttcaccgatgaaccgcaacgcgttgccgcactgcgcgatgtgttcaccggtctgtggggccttgagaatgacgacgcggtcaccaacgcggttattgaggtattaaatgaaattttttaaatttttaattaaatttttaaacaaatttttaaggatgccatccaaaggcccagggattatgtgctgaaggcgcaaatgggcgctggcaaaggcaatttctttgacgacgaaatggtggaaaagctgaagacaatgtcgctggaggagcgnngcgcgtacattttgatgaagaaaaattggcctgtcgct

SEQ ID NO: 45663 - DNA, 2421 bp, Heterodera glycines
  Genomic contig location: Contig_ID=SeqID_3854; Location=1904..4324; Strand=-
  SCN-specific regions: Sequence locations=1-278,300-357,379-511,538 -629,658-771,793-835,857-1047,1083-1269,1291-1678,1700-1754,1781 -2186,2208-2421
  Gene Ontology: Mol. function=UDP-N-acetylgalactosamine transporter activity; Cellular component=Golgi membrane; Biological process =galactose transport
ataaaattcgctgtgctcatttggctcactgttcagaacgccgtccatgcgctattgcttagatattcgagagtaaaaagacaatttactccgactgccgtcccaactttcccttgccgttttaaggttagggatgtgccggccatgtatttctcaacggtggctgtcttttggactgaagtcatcaaattgtctgtttgtcttattatggtgtgccatcattcaaatggtggaattttcgagtgggttttgttgaaaggggtgcactcaatttagcgttttaaaacaatttcatttgaaattcactcgctgagactatcgcaccccaactcccaaatatgcgatttggttggtgattggaattcttttagggcttttggtctgataagacgacaagtctttgaccagccgagggacactctcaaagtgtgtcttccctcgatgctttacatcctccaaaacaaccttttttataccgccgcttctcatcttaacgccgcaactttcatggaaatattcttttttctttcttttattggtacttatgtagtttaggggacagatttcacatacctttttaggcgctactgtaaaagtggtcccttttgaaaatttttttcacttttttcatatattttttttataaatgatttttttcatgcaattttagcaaatggttaaagtttcaagatattccattaatgattccaacaatctgccgctcatcgcttttccaacattggacgatataaatttgagatggcttttttccaaaaactctgaagagattttacaatttttggcacacaacggacttttccaaaacaaattattgtgccaaaaacaccaacaaatgtgaaggattatgggcccagttgaagcagaaaacaaaaagaattcatgacaccagtatgaaattggcagaatcatatatgcatgaacaaattttccgattgaatgctagggctaaaggattgtctgtttttaaggcttttgtcaatttattacatcgtaattataattttttgtgattaataatgctaattgtaataaaaaataataataaaaatatatgaaaaaaagtgaaaaaaattttcaaaagggaccacttttacagtagcgcccttatggccattaatttctaaaacatatttatatgaatctaaaaatgtatgtgaaatctgtcccctaaactacataagtacccttttatttatccctctaatggttcgtttcttcttcagattgtctcccaattgaaaatcttttctgccgccattttctccatccttttgctcaatcgttcgttggctcgtgcccaatgggtttcgctatgcgttctcttcgttggcgtttgttttgtgcaatttcagccggaagagcctcgcaaatcggagaaccgaaaacacttagcaattgagcaggatgtgttgacgggtggggagaaggggcgatggaatggaatgggaggggtcactcacttttttactcaaatttaccaatggcaccggcgggcgactcgccgagaaaccgttgagattcatttggcatttgctgacttgttctggcctaataataacaaagcgaacatttttcagtctctgatttttctattgttcaggtttcattgctgcgtcaatcgcttgtggtctttcggggttttcgggtgtttttttcgaaaaaattttgaagggctctgcgcctgtgtctctttggatgcgtgtaagctttagcaattgatgtcctcggggagggagtcattttggcttctaacaagggaggggggagggtaaagcttttggcaattattagcccccaactcctccctttgtacatcaatcggttggcaccttttcgctcgaatgacccccccattcgttaagaatgtacaaatgtcggtcttcgcaattcctgccagtttctttgctgccattgttcaagtcgcactttctgtcctttggctccctttcattgccactcttttgtaggatggatccaaaattagagagcatggctttatgtacggttgggactccgttgtttggctgacttcgttttggtacgccgtcggtggtctttcggtggccgtttgcataaaatacgcggataatatcgccaagaacttcgctacttctgtggctataattttggccacacttggctctattcagttcttcgggtttcagccaaacctacttttcacacttggtgctttgctcgtcattatggtaattggactgctctcagttttggcttttgaagagcatttgcctttttggctatttttttccatttttaaatttctattgtccctttcctttactttagagcatcttcctctactcatcttcttccatttttcttcgccacttcaacatttacgggtcttcctctgcttcacgtccttcttacttttcgtca

SEQ ID NO: 45664 - DNA, 1333 bp, Heterodera glycines
  Genomic contig location: Contig_ID=SeqID_21572; Location=340..1672; Strand=+
  SCN-specific regions: Sequence locations=1-174,205-240,262-486,508 -986,1008-1333
  Gene Ontology: Mol. function=transcriptional repressor activity; Cellular component=cytoplasm; Biological process=regulation of transcription, DNA-dependent
aaaatgtcaagcgatgatcaatcagacaaggaggtcgtattaattgactttaattgcttttctctacaaagttttttagtgccctctttgcatggaggccttcgacattgatgacatcaacttttacccatgcaattgtcagtatcaaatttgcagattctgttggcacaggatcaggtttcttttttaaaaagttatggaaaaagaaccagacaatgggaggaacgaaacctgttacattttaaagagacatgaaatttgtcagcaaaataattaagggcatcgctccaaatatggtctcaaattcaatttgctcattcttcggtcaattgatcaggaattttgaatatattcggtcacatttttgtcctggttctgtcttatttcacctatctatttaaattgttcggattttttttacgaaaattgcttaaaatataagacgaaattggatgacaaccaacttattgttactcttaaaattccaaccccaaaatctcccccattaaggacaaatgaaaacgggttgtgcccggcttgccgccagtcgtaccccgaggacccggtcaattttcagccgttgtccagcgccgatgtgcggaagatcaaaagtgagaagaagcagaaggtgcagcagcagaagaacaaagtggtggagagcaggaagcacttggccgagtttcgggtgctccaaaagaatttggtgtacgcggtagggctcagccatcggatggcggacccggagctcttgaagaagtacgggtggcactttaagcatttattgtttgtaaagaaatttgccaatgatgtgctttttgcccggttttgcctagaagattcgacatacgtttacaattagactttttgtccaactatggttaggggtgttcgaaatgaaccaaaaatttattccatattgtggtcaggttccaaaattcatttatggtcctttttcggtaatgatattttttggaaaatgcgtgttatcaagttattttcattaaaaattaagttttcttctctaaactttcaaggactttgttatattgtaataatccaagtttcagacccgaattctttggcaagtttggcaaaatcatcaaaattgcggtcggcgctgccccggccatcaacagtgctcagcccgcggtgcacaccgcgtacattacttacacacggagcgaggacgcattgcgcgcaattcacgcggtcaccaacatgatggtggagggccgctttctgaaggcgtcgcttggcaccaccaaatactgctctaatttcttgaagggacaagcgtgccataagccggcaagcttttcaattaagcacattt

SEQ ID NO: 45665 - DNA, 1386 bp, Heterodera glycines
  Genomic contig location: Contig_ID=SeqID_3861; Location=6..1391; Strand=-
  SCN-specific regions: Sequence locations=1-498,520-1171,1194-1386
atgacatttcataaaatcgacaatgactccgtgaactcaatcaccaatgcgctggactttttccgcattccgccgacaaatgtcagtgtcttttcatcaaaggtgtttgaactgcttcccagcaaccctctgaccgacaccccctaccatttcaaacttcattcaagtcagaattacattgacctctccaaatgctatttgctcaccgagttccgaatccggaaggaaaatgtgaatggtcaacttatggacctgaccattgacgacgaaaacattgcgccaatccagatgattgggcaaacattcatccgaaacatcaaaatgagcatcaacgggcgtgaagtgttcaacgcaaatgcactgatggcctacaaaacctatttttcacatgaactctcctactcaacaacagcaaaggactcgcacttgaatgctgcaggatattaccgggatatgggcgagacactggagacggggccgggctgcattcaacgcagggatttgtttgccgaaagcaaaacagcccaatttattgccaaaattgataccgacctattcaatcagccgctgtacttgattaacttttgtgaattggatgtcgaaatttggccaaatgacaacgattttgtgctaattgcacccgccatcggcggtgttgttcctcgttaccgtttcgaggtgatgggactcaaaatgtatgtgaagaaggtgtcattaatggacggattagcgctggacattgcgcgaaagcttgagataaagcctgcacgttatgcagtaaggaaaactatgatgaaatcgatgttcatcagtcagggccggttcgagtttaccgccaatctgttcatggaccaaattccccgccgcatcacaatggggcttgtttcaaatgccgactactcgggcacaatcacgcggagcccgttcaattttcaaccgtttaatgtgcgggaaattgcgatcatcgccaacggccgttcctacccccaggccccttacgatttggactacccgcatggtaaatatgtgcgcgctttcaacgatatgaatgaggcggtcgggttcgcaaactcgtcggaaagcaacggaataacctttccccaattcgggaaaacgcattgtatctatgtgttcaacttgacaagcagcggtgacgaccaagccgcgctctttgatctgataaagaacggaacaaccgcggtgagcataaaattcaatcgtgcggtaccagtggggggactgatgctggtcgtaatgggcgaatgcgactcgctggtaatgctggacaagaaccgatcgataagcaccgataccactatataaaaggcgccgatttagtgtatttctctcaacatttgttacattcactgttcacctaaaaataaa

SEQ ID NO: 45666 - DNA, 742 bp, Heterodera glycines
  Genomic contig location: Contig_ID=SeqID_21619; Location=311..1052; Strand=-
  SCN-specific regions: Sequence locations=1-96,118-169,191-231,272 -617,639-742
tacagctttgtgacactcggattggctttgttttgtggccatgttcgaaccgaggaccgtgccgaggtggacattcgggtttccggcgcgtgtagtccaagtgagcaattatcttcttttaatgtaaaagcttcatttatgagtttgcaaagcttaggtgctgaaaaggtagtgaagaaaaatctttagcttcaaatttttgatagcaaaataagtctttgaaaaactcggaaaattatttatttaaaaaagccataattattttaattttcttgatcaaatccaaaattttcgtatcttttaacggctcttacttaacaagctctatttgctcactaaaactcagaaaggtttgcaaagatgcaaaacccaaataaaattgtgccttttttacatttttcaagcactaatctagctaaaacagtgatcagatgcttcacctcatcacctcccatcgttcagtttacctctctagaaggggcattgagctgagcaaataccggccgttgatacggtttaatccggagaaaattcgactggtgccaaaaaatccggtgatcccgggctgtgtgaaaatcaaggcggagggcgtcgaaattctgcggcccatccgcaatctgttggccgaagtggaaatgcgcattggcggcactcccgacccgaacaatccgacattgccatgcacaaaaaaaattgacgacaaagtgaaccagtgcccatgcgcaaaggcggaaggaacttg

SEQ ID NO: 45667 - DNA, 1749 bp, Heterodera glycines
  Genomic contig location: Contig_ID=SeqID_21629; Location=149..1897; Strand=-
  SCN-specific regions: Sequence locations=1-76,98-425,449-1039,1061 -1626,1648-1749
  Gene Ontology: Biological process=protein biosynthesis
atggcttcttccgaaggtgaagccgatcacaatgttgagctctggaaaatcaagcgtcttataaagtcacttgaaatggccaaagggtattacctaataccatttaggccttactaattttattttatcttacagaaatggtacttcgatgatttccctgatcattccgccaagagaccaaattgctcgtatccagaaaatgcttggagacgaatttggaacagcgtccaacataaagtcgcgagtcaacagactctctgttttgggggcaatcacttcagtccaggcgaggttaaagctttatacaagaggtaactttggattaggaagaattctctggattttttttttgttttgtttaacaaattcgttaagtgcccgagaatggattggttgtttattgtggaacgattgtcacagaggacggaaaggaaaagaaagtgaacatcgattttgaacccttcaaagcagtgaacacatcactttatctatgcgacaacaaattccacactgaagcattgaatggcaattcaaattcctcctaaaccaatattaatataaagtttagcactactcgctgacgacaacaaattcgggtttattgtgatggacggaaacggatcactttttgtgactttgcaaggaaatgccagggaggtgctacacaaattctctgtcgaattacctaagaagcatggaaggggagggcaatctgcactgcgatttgcaaggttgcgcatggaaaagcgacacaattacgtcagaaaagtggcggagacggccgttgaaatgttcatcaaaaacgacaaaagtcgcggtggtgggcctcgtcctggccggaagtgctgattttaagaatgaactcgccccagtccgacaatgtttgaccaacgattacaggtaaaatttgggataatttgtttccaatttgtttaattacaggcaaaaataatcaaaactgtcgacatatcatacggtggtgaaaacgggttcaaccaagcgatagatttggcagccgatgctttggcggatgttaaattcatcaaggagaagaaactgatcagcgcctttttcgacgagatttcccaagacactaacaaggcaatttacggggtaaaagaaacactgacagccattggaaatgggcgccatcgaaactctgatttgttgggagaatttggatctgataaggtaggttctgtcaatgagaagtgcaagtagaatagcgtaacaaacccataaacagatacgcattccgaacaaccaatggtgaaaaagtcgttaatctgaagcccgacgagaaggaccggtcgaactttgtggacccggaggtaattcacccatccaaatttatattctcatttagcagaaaaataaaaaacaatctattgttactgttgaatgtcacctgtttcagactggaactgactacgagattgagtccagcacgccattattggaatggctcgctaacaattacaaacgattcggtgcggcacttgaaattgtcaccgacaaatcgcaggaaggagcgcagtttgtacgcggttttggaggacttggaggttagttgaaacttgaaactgcaaattatggccagcaaaaacaacgacgattatcacttaatgaattgaaattatttaaattactcttttctttgtccaaggtgtccttcgttattcggtggacattccgcagttggatgagctcgagaacggagtagacgagatcgacctcagcgagtactga

SEQ ID NO: 45668 - DNA, 1139 bp, Heterodera glycines
  Genomic contig location: Contig_ID=SeqID_3875; Location=919..2057; Strand=+
  SCN-specific regions: Sequence locations=1-49,72-104,129-614,643 -673,695-873,896-1139
  Gene Ontology: Mol. function=transmembrane receptor protein tyrosine kinase activity; Cellular component=integral to plasma membrane; Biological process=signal transduction
atgtacgtggacccaacggcgtatgctgaccccaccgaagtcttggccgaattcaccaatgaaatttgtgcttcgaacatcgaggtaaatgcaaaaacagcggtcattttctttccttccttcctctcattgttttgttatttgaactcaaaggtcactcggacaattggcaccggtgaatttggcgaagtttgctgtggtcggctgacggtggaggaccattacgggcataagcaggtggctctaagggaatgcaggcttttcgtaataaatttcaatttaagcagcaaattgttgcagtcaaaacgcttttgccgggcagtgatccgaaagcaaaagccaattttctcatggaagcatcgataatggggcagtttgagcatgaaaatgtcattcatttaataggcgttgtgacaaagaccgaaccggtacttgtcgctgtcagtttgtcaaattccatcaccactttcaggtgatgatcttgacggagtacatgttgtacgggtccttggaccagttcctgcgttccaacagcaatgggaggctgagcatttgtcagatgaccaaactgctccagggcgttgcctcgggcatgaaatacctcaacgacaaaggctatgtccatcgtgacttggctgctcgcaatgtgctggtcgacgatcggctgacctgcaaaattgcggactttggtctgtcgcgcgggttgcggaaattcgtgtcgggcaacgattgcgatggctgtgcaccattcgagcagcagggcgagtacaccacgcagcagggagggaaaataccaattaggtgagggcgggagggaaacctgacaatgacacttgccaattcaggtggacggcacccgaggcgattatgcagcacaaatacaccaccgcctccgatgtttggtcattcggtgtcgtaatgtgggaagtaagtgacacacgaatagcaaacggtccttggcattcgctgatacgcgcctttcattcccaggtcatgtcctttggcgaacgcccttattgggattggaccaaccacaaagtcatccatgaagtcgttcagaatggattccgactcccgcctcctcaagacacaccaaaaaggctctacgagatgatgctcgcttgttggcaggctgaaag

SEQ ID NO: 45669 - DNA, 2218 bp, Heterodera glycines
  Genomic contig location: Contig_ID=SeqID_21663; Location=1..2218; Strand=+
  SCN-specific regions: Sequence locations=1-403,425-516,539-1018,1041 -2162,2184-2218
  Gene Ontology: Mol. function=structural constituent of cytoskeleton; Cellular component=spectrin; Biological process=neuromuscular synaptic transmission
ctactgcagaaacatgcactgcttgagtccgacttgaacattgtggcagaccaaattcaattggtcagccgcgaggcggaacacttcacgcgcgaggaagggccggacggaaaaggttggcacggcaaagccatgggtccggcaaaaatgccaagtcaacaacggcaattcccatcagcagggtacaagcctgtggagccagccgtggtgcaggaacgggtccaattcctggatcaacgctaccaggaactgctcgaactcgccgcccgtcgcaaggcgaacctcgaggcgaacaagcgattgtgccagttcaactgggacctgaccgacttggacacgcacttccgggagcaggaacaagtgttggcacagaaggacaaaggacgagacattgtgtcggtgagagaagcaaaggaaatggaaggccgaaacgaatccgccaaaaggtcaaccgactgttggccaagcacaaaaatgcggagaacaacttggccgacctgggcagaggcttggaccaattgcagcagcagggccaacagctggtggacgagcaaatccccgggtcgggaccggtgccgttgcggttggccgagacgaggacgtattacgaccatttgagacgattggcggacgaacggcgcaaggaattggagggggcggtggagtactaccaggtcaaagggatgccgccgaatgacctcggttcaacgacggaccgtttagttcttccacgacgcggacgacgtggaggcgtaccttttggacactctccgcgtggtcagcaccgacgacgtgggccatgacgagtcgtcggtgaatttgctgatcaaaaagcacgacggagtgtcggacgaattggtcagtcaatgagcgaattggtacataactcggactgatcggagtgatttggcaaaatttgaaggaacgatttgaccggcagattcaacagttggagacacaggcagacgcactgccggaagaggcacgagcgcacccggtaaaggaaatgggaggacggcattttttaaatccatccggcaatctttctcaccgctaagaacattgcgtcacggatcaacggcacgcagcagcggaagtccgatttggtggaggtggcgcggctgcgcaagcaaagactgctcgacgcactcagtttttacaaagtgaggacagagggacaaaggtttttcagtcaaatgatcaattaattaattgtgttgttaagctggtggccgacatcgaatcggtggagtcgtggattgatgagaagggcaaactgctgaagacgttgatcccggggccggacttggaggaggtggagataatgaagcatcggttcgagacgttgcagaacgacatgcacaaccaaaaggccaaagtggacacaatcaacacaatggcacgggacatgcagaaggcaatttacactcagcagatgattagtaaaaccatgaacacaattatttagcaggaacatccgaactctgatgacattttggccagacaaaacggtaattcagaaatggaagtgtcgtcgcaatttgtcagtttgacaccccccccccccactaattacccctaacaacctccacccatcactttaaagctttgaacgcccgctgggcacaactgagcgacatggtctcccagaagaaggaggagctgaacaaagctcatcgcatggaaacgttcagaatcgactgccaagaaacgatcacatggattgaggaaaagacgagggttggcattggcacaaaggcaaaaactatcactaattaccataattaggtgttggaagacaccgacgaaatgaccggcgaccttaccggagcgatgaaatagccccgaccactttccatgatggagagggacctcgccgccattcaagccaagcatgccacgtgtttgggactccaaatattttccatatctttgcattctcagactccactcattgcccacccaatcgaatgccattgagcggcaaaagccgcaagaaacggcaccaaatcctcagaacatgacgcgcattccactccctcgctgactgattatgacggaatccgactttgtttctcgcggtcggttagggtgaagatatattgctgaatccactggtgcgcgagcaggagtgtaaactgatctacgcaggcgacttgtcgcgatctctgctccactcgtagcatatcaaagcgaagattcttatgttccgccctta

SEQ ID NO: 45670 - DNA, 1491 bp, Heterodera glycines
  Genomic contig location: Contig_ID=SeqID_3897; Location=1523..3013; Strand=-
  SCN-specific regions: Sequence locations=1-3,34-219,248-464,486 -1371,1393-1467,1489-1491
  Gene Ontology: Biological process=gametogenesis
atgactttcccctcctccccctccgctgtctttttgctgctgcccgttcatcttctgttgatgctcgtcagcgctgttgtgttcatcatcttcagccaatgctgcggttgctgtaagaaaaaggccagtttttgatgccacacccacacaatcagcagaattagccttttaattaattaccattttcacaaaatgattatcactttttttcagcagaatggggaagcactgccgccgccgccaacgcaatttacaatggtcggaggggtacccgtggcactgtcacctgcacaaactgctgctggggttcaatttgttccgagtgagtgttgcgtggattttgaacatcattaacattgaatacacccgtcatttcccattttcagagaacgattcaaagtatgagacgttggccagtttggatgcgaacatctttgtgaagtccggatcaccacaaccagcgccaaatgatttccagtcaaaggtggccggctccaaattcgcaccgagtaagagcaatcaaaatgttcattgtcagcaaatgttctaaccaaattcatttttcagatccaaatccgcagcaggcaaaggctgggggatcgcaatttgctccgagtaagagcaatgttcagctgcagatggtccaaccaaataattcgtgtcctctgtcccccttcagaacatgatccgaagtatgagacgctggcccgtgtggatccgaacatctttgccaagaatgcaccaccagcagcgccaaaaccgcagcagtcaaaggcaccgcaacaactcggtcagggcaaagagcaatgtttttgtgttccatccaaatgcatttctgtccccattttcagtaaaagattcaaagtatcagacgcttgccggtttggatgcgaacatctttgtgaagaatgcaccaccagcagcagcgccaaaaccgcagcaatcaaaggcaccgcaacaactcggtcagggcaagagaaaccgttcaaattttaaccaaattctcatgtctgtggtcccctctttttcagtaaaagattcaaagtaccagacgcttgccggtttggatgcgaacatctttgtgaagaatgcaccagcaacaccagcgaaagcggcaccacaagccccgggtaagagcaatggttttttgtgtttcaatctccaaatgacatttctatcctccccttttcagtaaaggattcaaagtatcagacgcttgccggcttggaccataacatctttgtgaagaaatagttgccgaagtgcgtatatgatgagaattggatgattgaccgatgttatagatatatatatattatatatgtcttatgatgttattgtctctgttttttgttgtatatttgctgttctacagtaccatgtatatacatatgtgttcctaactcataaatattattttcaagtgtacaatgtgcatttttgtttactaaacacggtaattttctctttttgtttctaaaatagattaaa

SEQ ID NO: 45671 - DNA, 885 bp, Heterodera glycines
  Genomic contig location: Contig_ID=SeqID_21743; Location=539..1423; Strand=-
  SCN-specific regions: Sequence locations=1-124,151-637,660-682,706 -726,748-759,781-885
  Gene Ontology: Mol. function=signal transducer activity; Cellular component=heterotrimeric G-protein complex; Biological process=G -protein coupled receptor protein signaling pathway
atgcttaatcgggttcaggaagcgcggaaacaagccaaggatacgacattggcattggcagccgctaatttagagtccaacgggcgcattcagctgcggaaccgacgaattctcaggggacacatggccaaaatctacgccatgcattgggcgtccgactcgcggaatttagtttcggcttctcaggacggcaaattaattgtgtgggactcgtacaccacgaacaaagtgagccgagttcaagcagtacatgctgatatgtcaattttcttcaggtacatgccattccgctgctgtcttcctgggtgatgacttgcgcgtacgcccccagcggatcgttcgtcgcatgcggcggattggacaacatttgcagcatttactcgctgaagacgcgcgagggaaatgtgcgagtgtcgcgcgagttgcctggtcacaccgggtatttgtcctgctgccgcttcttggacgacaaccaaatcgtcacctcctccggcgacatgacttggtcagtcagtcagcagacggccaattgagtcccctcgggccatttgccaaattgaaaaacgatcattttggcatttcccattgaattcactcaaaaaccaattaattcgtccatttcctttgtcccattttagtgccctttgggacattgaaacgggacagcaagtgaccgcgttcaccggccacaccggtgacgtcatgtctctgtcgctttcgcccgacatgcgcacgttcatctccggcgcgtgcgacgcatccgccaaactgtgggacatccgcgaagggatgtgcaagcagacattccccgggcacgagtcggacataaacgccgtttcggtacggacaattagcaatgaaaatgcagtcgattgggaaacatga

SEQ ID NO: 45672 - DNA, 1379 bp, Heterodera glycines
  Genomic contig location: Contig_ID=SeqID_429; Location=5391..6769; Strand=+
  SCN-specific regions: Sequence locations=1-665,687-1379
atgacttgtgcgaagcgcatcagtcagcagagtgcgttagcgttcaacagtgcgctcaacatttttgcggtaccacccaccaacgtgtcggtggcgcgctcattttttcgcgaactccttccattgtcaacgatcagccaggagggaccgtacctattccgcatgtacaatgatagcctgtgggccgacctgtcccgtgtgtacctgtacctcgaactgtccgttgagaaggcaaatgcgcagggcatcatggagccaattgacagtgtggtggacaaggaagtcggcgtatgccagagcatcggtcaaacatttgtacaacaactaaaggtgggtaacagcagaagccctcgcagacgcacacatcagtattcaggttgaagtgcaaaacacggagctgtacgacagcgggacactgtacccgttcaaagcgtacatctccaacgagctgtcatttcccgcaaatgcaaagagccatttcatggcttccaacggctactacgtaagccggacacacgatgacgccaatgatgatgggttcaagaaacggtgtgcacgattttcgggcggttgtaaggcggagtttatctcgcgcctcgactttgacttgggcaaccaagaactgtacctgctcaacaacatggacgtcctgttcaccatctaccgttccaaggacgcattcctggtccacagtctgggcgccggggctgccgccacttcgtacgcactccgagtgcacgacatcaaactgtacgtgaaggtcatcgaggtgcagccgtcgctcaacatctccatctacaagaccctcgaaaaacagccggccacctatgctgtacgacgcacggaggttcaaatcctgctttctgaccgctggtcgcacggaaatggaccacaacatattctcggcagccatcccacgccgactcaccatcgcccttgtggcgaaccgagccttcaacggcgcctacgcccacacaccgttcaacttccgtccatacgacatacgtgcaatcagtgtacatgctggtggaaacacgtatcccgccatccctcaccgtatgaacttcgtcggagctgcctacgtacgcccgtttgtcgacatgtacgaggcgttgggcatggcaaactcggaacgctccatggacatcacgctggagcagttccgagacggatggaccttctttgtcgtaccgatgacctcgacgctggacgacagctgtggctttgaactgctccgctcgggcaccacaagtgtacgccttcagttcaacagagagataccgcaaggcggcgttgaaatgatttgtcttggcgaattcgatcaactaatcatgattgattacaaccgtcatattgtgaccgattcaaaaattgcataa

SEQ ID NO: 45673 - DNA, 1057 bp, Heterodera glycines
  Genomic contig location: Contig_ID=SeqID_21782; Location=767..1823; Strand=-
  SCN-specific regions: Sequence locations=1-542,566-623,649-922,946 -1057
  Gene Ontology: Biological process=regulation of protein activity, epigenetic
atgcaaatggagcacagtgccggggttggctcacccgacgacgagtccattcatttggcggcacttttccacacgcgtcgtccgcaatcggaaaaggcccaccggcaacaattttttaatggggacggactgctcgaagaggatgagctagtggacctacaggaattgggcacactgagtgatggagacttgtgtatgggcagacaattggtggccaattcgatggcattggccaacgaaagggccgaaaacgaagggacaaaaaagtcggaaagtgttgcggaacagcagcgacacctaatcagcgaacaattacaacatcaacaacggtctgaaagagtgccgaatattgcggcggaagattgcctcgggagatttgtgccggtggtgaaggcggaattcctgccgacagaagcggtggaacagttcctacttgggatgaacagcaatggctacggcgaagagggccaagcgatggccgcaggggcggcgagtgcaatgagcgaagaaacgccccagggggaacaaagtgagcagcagccgaaggagaagaagcagaagagggcgagcagttcggaggaaaggtgatcatttgtttgtcggtttggcatttcgtctcttattttttcctcctttccctccccaccgctttagtcgcaccgccgcccgctctccgtcttccgaattttccgcccctccgccgcctccgattatcatctctccgcaggacgtggacaacctcagcatcacgctggagaagaaccaacagtgcgcctgcaaagactgcggaaaactgttcaattcggtgtggtatttgaagcagcacgcggttaagcacagcaacgaccgtccttttaagtgtcgcttttgcatgaaagtgagtgggggcaattagcaaggtcaattaatgagaaatagcagcacctgttaaacaaaaattaattaaatgatttcaatttagacatacaaattccgttccaatctgtaccagcacaaatgcccggagagaagcagactgcttttgaccggggaattcaacatggtcggtcacccgtaa

SEQ ID NO: 45674 - DNA, 2292 bp, Heterodera glycines
  Genomic contig location: Contig_ID=SeqID_3910; Location=2233..4524; Strand=-
  SCN-specific regions: Sequence locations=1-24,83-83,131-568,590 -937,1020-1048,1071-1363,1388-1407,1442-1664,1686-2292
atgccttccgctcgaacttttgttcgaaattgtgcctctcatccctgccgaaaatgccacaccgaatgcgctctcgtcctgttggctgctgcacaaacttttgctgccacgtgtcatcaaatggaaagaggtatgccgtgccatattagggccaaggaattgggcttgaaatgcacttttgtaacgtcagtcacccaatttactcattctatgggccctaactctgccagttgatcaaaaggaaagtgcaacaatgtggcactttttgtaagccggtcatactgtcagtaagacaacaagtacagtagtactaagggcaaaaacttattttaagggcgaacatcaaaaataaggatttctaaggtcgaataagggcgtgaaaacgcaaaattttcagacaaaaaatgtgtttttcgtgtatttctcgttgagttaaagccgcagaaaaaataagtaaaaacttagaaatcccatccctagtaattaaacacaaaaaattttggagacaaatttttcatttcttaggagtgcatttttgaaaagtttcggatcgattcttaggggtgtattttttgagaaaatttttgggtcgattctttggggtatattttattttttattgctagggatgcgatttttagttaaatacctaaaatttttgcgcacttgtaacgttgagataagcataaaaaacgagtttttagcttggtttggagcttctacacccacttttataatacctatttttacctatttcgggatttttctacctattacctaggtacctatttttatacctatttcggcattttggttacctattttaaggattttcaaaaaattcttaacaaaaatgcaataaaatcaaaaaatatacccataagaatcgaccaaaaaaattttcaaaaatgcaccctaagaattggaaaaatttctcaaaaatttattttttctattgacaaaatttttaatttaaaatgtcaatattatctaagaaaatattaatatatttaaattttcgtttacaaagagatatgtagaaccaaaattttccctctttgtttgcttttttccactaaaaaatcgttaataaaaatttttatttacctattttggtacctattttggaatttttgtacctatttatttaatacctattttgagatttttttttacctatttaagtacctattctgggatttttcttacctaaaaatcgcggctctactgcattttacgcgtccaatcgacttttacgcgtccaatcaaaagtttacgcgtccaatcaaaagtttacgcgtccaatcaaaattttcctaattcgaacatccttttgacataaggtaccaaccattgcaaaaagaaataataatttaaatattaaaaacgtaacaccaagagaaatagaaaattactaattaatttttaataaaatttaaatccgtcattgatcacttattaccaaagtatcgataggtatatacgcattcaatcaattgttataaaatttaataatagagagactaatgcaatcgttgtcgcagtcgtgacggggttgaaacatcaaatcgtatttctgttcgttttggctcattcttcgacaaatcacacttgtcgatgaatcaagtgctacggcttgcgtatttttgggcggaacatccgacttccacttttggggcaataaaaagagagatgaatatcaacaccgatcataccgtagtggacttttacaattttatgagagatttatgtcagggttgggcagatcgaattcaaactaatgaactgcttgggggggttgggcgtgttgtagaaatagatgaaactaaatattttcgtgctaagtacaacaggggacgaatgctaaaccgtaaccacgactggattttcggcattctcgagagaaatactaacaaagtccgtttgtttcctgtggcaaaacgggatgctaacactttgctcccaatcatttctgcaaatgtagcgccaggaactctgattataagcgacggatgggctgcttatgggggtatacgtaatttgcagcagcaatttgagcatcgttgggttaaccatcgcttgttttttgtcgatcctcaagacccacaagttcacacacagggcattgaggcaacttggcgtgcagtgaaaaatggtcttcgtcatctccacggcactaaccccgagcctttacaatcttatttgtatcagtatatgtttcggagatctaacaataacgaaaaaatttttcagcaaattctcgaagaaatacgtattcaataccctgtctaa

SEQ ID NO: 45675 - DNA, 1082 bp, Heterodera glycines
  Genomic contig location: Contig_ID=SeqID_21824; Location=749..1830; Strand=+
  SCN-specific regions: Sequence locations=1-245,267-796,818-1082
  Gene Ontology: Mol. function=actin binding; Cellular component=F -actin capping protein complex; Biological process=cell motility
atgattggggaagagcttacggatgttgacaaggttttgccaagacaaaatttcattaattttccaattccattttcaaatttttaggctcgcattgcgtcagacattctgcttcagtcgccgccgggcgagttcaacgaggtgttcaacgacgtgcgcactttgttgcagaacgacgcacttttggaaaagggcgtctgtctggaggcggtccggcgctacaacaaggcacagtttgtgccggtcaaccccgagccgggcgctgaacacccggcacgttttaggccgaataaaaggggggagggacggccaaaccggtgaaaacacgaaaaaattaatataaaattgaaatttcaatgtttttgccgactatcactttttaaaaatgccaactaatattaataattggttttttttggcagactttgatcaccgaacacaacgaattgccggacggacgtttcgtggacccaaaaacgggccgtgttttcaaatacgaccatttgcgaaaggaggcggccgatgcgcagccgtcggggcccaaggaaattgacgaaaaattggagccatggcgaaaggcactgcaaaaagtttgctttttggtactttctccaatttaggacactttttgacgaattttagtattatttaatgagaaaaaattgcggaaaatccaacgcgaatgatttgtccagttcatccacaatcaatctcaattgtgctttttgaggagttggacgagtacatttacgagcatttccatctgaccggcgtcgccactgttttcacgccgttgcagcaccaaaaagagccgaaactcattctatgcattgagtcccatcagttccagccaaaaaactattggtttgcatcaatgtaaaatatctgttgaattttcaaattgctttaggaacggtcgttggcgttccgaatggcattttcccaactttgacggctcttcaaaaacggcggggactctccaaaaatgcacgggcaaattgcgtttgcaggtgcactattatgaagacggaaatgtgcagctgatttcggagaaagaggcgacggtggaagtgaaaatgacg

SEQ ID NO: 45676 - DNA, 527 bp, Heterodera glycines
  Genomic contig location: Contig_ID=SeqID_3922; Location=32..558; Strand=+
  SCN-specific regions: Sequence locations=1-480,502-527
  Gene Ontology: Mol. function=structural constituent of bone; Cellular component=collagen type I; Biological process=morphogenesis of an epithelium
atgctgatcctctatcatcatagcttcaattgcccggctggcccgcaaggacaaccgggcccaatcggacggacgggcccaaagggacacccgggagcaaagggacagcccggacacggaggacgggacgggaaccctgggccacccggcgaatcgggtgcccctgggcctgctggccaagtgggacctcccggactgcccggagagaaagggcgtgacacagagcagcaaatcgggcgccaaggacctcgtggtccgcgcgggttgcaaggcgcagaaggaatagccggagagtccgggctaaacgccccgccgggactgcccggacccgcgggggaggcggggacgcaaggagtgccgggagtgcagggagcacaaggaaggcccggcgaggaaggaccgacgggacggccggggccagacgcagagtattgcccgtgcccacagcgatcgggctgagagaaatgggagagaaaggaaaacgaacggacgaacgaacgatcagatcatgtgccaaccaacatcaa

SEQ ID NO: 45677 - DNA, 1218 bp, Heterodera glycines
  Genomic contig location: Contig_ID=SeqID_21847; Location=1146..2363; Strand=+
  SCN-specific regions: Sequence locations=1-411,446-701,723-827,849 -868,904-1115,1141-1218
atgagcgaggaggaacggtcaagactgctcactgaaattgcaatgcaagaatcgcgcgtttccgaaatgcgattcgaagttaaggtgcgttggtgttaattggtcaaatcattaaaatgttaattcaccaaatgttagtccatgatacctatttgcatttcttacaatgagaaaatttaaatattgtataatttggtctgaaactaagcacagtacaactattgtgccaattcttttcgaaaataaatttttcccataaatggacatagaacaaaacggatgagatgaacaaactgaaggcggaggttgaaagtgggaagacaactgcacacatttacaacccgggcaatggtcatttgccgaccgaattcaatgacccggacgatctgacaaacgcccacattggtgggcattttttaaaattaataattgaatttaataaattcgacctggtccttcatctacatctatatttaatattttttgttttttctttaatagaattgagtacattccacgagggagacgtcaacaatgtgatgccacagcgtgaattggatcggaccaacttcactgatcaggacatgtcgttgaagaacaaactcgagggcccgtaattaggggattatactataaaatgatcgctctttcggttacggataggaaggagtcaatttacgaaatttattcattaaattcgaagcatgtgtttatctccgtttgaagcaccgaaaggttcattcgtagaaataaacttagaatctacgaaaacaagaaaaaatttcggaggatgtgataaattaaaaatttcaagaaaaatgggcaaattttttaaaatttggcaccaaattggttgccacaatgatgctaattaaattaattaattatacattattttttaatgttattgtaaaaacacgctcaataaatttcattgttgttttagttgcttacaaaggagttggacaatgcgcgagacgagcgggcgatcactgactttgatgtgctgcacatggaaaacaaggtgttttcctgaacagtgttataatcgctgaattgtttttcatgtgaattttcaaaagtcggtttttcaaattaaaattccaaaaaaattgtagcaaaaattattgattgtttttaaatatggtaataatatatttgttattttgcagaaacaaggccgtgacagatataagactttgcgtcaaattcgcagcg

SEQ ID NO: 45678 - DNA, 372 bp, Heterodera glycines
  Genomic contig location: Contig_ID=SeqID_21857; Location=213..584; Strand=+
  SCN-specific regions: Sequence locations=1-12,42-372
  Gene Ontology: Mol. function=structural constituent of ribosome; Cellular component=cytosolic large ribosomal subunit (sensu Eukarya); Biological process=protein biosynthesis
accattcgtcgtaacccggacacccaatggatcaccaaacccgtgcagaagcatcgcgagcagcgtggactcacctcggccggccgcaaaagccgtggcctcggcaaagggtggggcaatttttacatttgaaaaaattttcagcgattttttttaatttttgaaaaatttctaggttttaaaacctataatattaataggggattgtgcaataattcatggcataattttgattttttggcattccatttttccctaaatgtatttgatttgccccatttttgcagaatgaagcacacgaagaccattggaggctcgcgcaaaaagtgttggaaacgccaaaacaccgtcgaattccatcgcaagcgttga

SEQ ID NO: 45679 - DNA, 2092 bp, Heterodera glycines
  Genomic contig location: Contig_ID=SeqID_431; Location=1..2092; Strand=-
  SCN-specific regions: Sequence locations=1-233,257-370,403-529,560 -615,653-852,878-1226,1248-1307,1342-1401,1423-1791,1815-1914,1936 -2092
  Gene Ontology: Mol. function=ATPase activity; Cellular component =nucleolus; Biological process=mRNA splicing
caaagtctgcccgttgaccagcacagatctgaattcatctctgctctcgaaaaacacaaatttgtttgtgtgatcgggtcaacaggatgtggaaaatctacacgcatccctgcattttgcgtcaattggctacgaaaccggaacgaaaaacgctacgttgtctgcacaatgccaagaagaattgccgctacaacggtggccagcaggtagacattagtaaatagcagaaaggcatttttaaaattatgttaattttcgggtacagcgggaaacgtcgtcacagaagaaaagtagtcgaatttctcgcttcggaaaaatattggccaaaataaattctcgaccaaagtctttgaaaccatttttataagcttttgtttaagcaacaaaaaagttcaatataataattaggttccggtaaaaaaacttccgtgaacgggaattcataaaaagcggaagggaaacgggaacgatattcccgcctttttcccctacgaaaattccgtcaattttaaatggaattccactgggaaatgggaaaatttttaaaatttgtttttaacataaaagtcatttttgagagacatatttttaatataacgcattttaagggcgcgctaaaaatttaatttattatttaattgattttataaaagtaatcgataaaagacaacatgtggctggtatttccgacactaagtaatttcgacacggagaaagttcgacactgaactatttcacaaacttttactattcactaaaaaaatccaaaaataccctcctaaatatggaaactaaaattaatcaaaataatccactacagtagaacgataaaaatgcaaataccgtttttcacagaaacaactactggtcataaattgtcaaatttgaagggggaagtcttattaaacaatgaattgctttaattttgggattcttatttcacagcgacttattaggggctcattctcataacagtgagaaatatattaagggtgcgccatgaaatcggcatgcagagaactgttgaatttggcaacgcgctcaatgtgggctactccgtccgcttcgattcaaggggcatgaaaaatgcggaattattctactgcaccgacggaattttgctcaatatgatccgggaggattattatttggggaaatttgctgtggtcatcgtggatgagattcacgagcggtcaataaacagtgatctgctcattgctctgcttaaggttcgaaatttcttttttagttccataaaaatttagcaaaaaaaaatacagtgaaattaccaaaataaatgttttctcttgttaaaaagtcaataaattaattttaacagaaatttctttgaactatcaaattgttgtcttttcctctccacttttcctctgattggtagcgtatttttaagaaaattaaggaattttagggtcaggcgcctaaagagtgccgtcagacataaatcgtaaaattctgagcgagtattcttgaatatttttctcaacaaaacctttttttgttgaaaggggtgggtgatcattagagaccggcgcgggacgggatccctcgcgggattttgaggaatcccagttagtaatttcttatcttgggaattaagagtcggattaataaataaagggtattttggaactgcggcggtgacgagaggcgccgccagggaaaattgttgaaactttctgcgcactttgtgaacaaatttagtccaaaaatgacaatattttatgattttaattgctaaaaattgattagattcccttgaaaaaggaataattttgaaagattagaagaaaaaattactcttggaggggtactgatccaactcataaatgaagaacttaaccaagagcacaacccgctacaccatgcacatgactaagggtatgaagcataaagtaaccaaaagtatatttatttctaactttacaaaagccgatcattacgggtgtaaagaatactcggtctcgaaagtctcagagaccgagtccgatactgaaaacccgagactcaataccgataccaaatgaacccgagacttttctcgaggcgagaacgagactctcaagcatcacta

SEQ ID NO: 45680 - DNA, 2627 bp, Heterodera glycines
  Genomic contig location: Contig_ID=SeqID_3939; Location=2964..5590; Strand=-
  SCN-specific regions: Sequence locations=1-493,515-1076,1098-2627
ggcaccatatacagaattcatttcttctgttttccacgtcgagaagaggtgaagcattgaaggaactgattaaaaaaacacaaaatgaacctttgcataaatcctctgcaaaaacgcgaggagaaattttaaagttgatgttggaacatatgaagttttccagggaggaagaggtaagttttgaaaaacttgtcgccaagcagcaaaaagagtcaaccgctgccgagtttgtgttcaacgatcttgcacaacgatttgttctgataaccggtgcaggcgtcgttcatgtggatgtaagtaagcatcttgcatatgtgctcggctttgacaacactcgtctgtttcatggggaacaggcacgctatatgccagatctgtctggtggtgttaaacaattgtatgtttatgctccaaagcttattgaggagtgtatcataggtgaccgaatggcgcctctgcttagggtggtcaatgtttcggccgcacctgccagtgggggagggacggacgtgcctgaggttatatatactaatgaaatttttcattcacttcaaaacaaacgcatttccgaaatttgcatagaaattcagaacgcttttggacgctacgtcaaatttaattggggaactagcattgtcacactgcattttagacgaaaattattttaataacaacaacaacaacaattgcgcaatatgactcacgtcgcgtttaacccggacaccattaattgggcgcctcttcttgctctacaacaagagggaaggggagaaatgcaatattttgttggtacacggcatcagcgtggtgctggcctattgaaaaatgttgcccggttcctgatgccggtagcttctaacatgctaaaagcgatgtcacgcgagggagtgagtgccgggagccgcataatggaggatctttcgcagggaaaggcacttaaggaatccattcaggcacacacaaagcaggggatggaaaatttggccgaaaaattgaaacagtgtggaaagggtgcgcccgcaaggaagaggaagagaccggtgaaaagggttaagacggcagtgccaatgcatttgctgagaggcaacaaaagacaggcaatagaccaactcacatttgcaccataaattacacggtggcaagcacgcacgcccgttatagtgagcccacacacaaaaatctataaataggtgtcgaaattaattttctgtctacttaccgcacacagttcgcataattttagtccaaacaacactaatgagcgtaatcaaaaaaattgacaaagacagtgttgaaggcgttgagggtagcctttcgttgttttctcttccgccaacgaatgtggcgatcaataagacaaatgtccgcgagttgttgccactgtcagcacttaatcagaccggtccgtacctgttccgtttgttttcggacagtcagtactgcgacttgagcaaaacatacttgtacttgctcagctctattgagcgcaagaatggggcaggtgaatggtttcaatcagtgatgcagagccggaggataagcgcgtgggtgtaatccaaaactttggcagcagttttgtgcgctcgttgaagatcaacatttcgggcattgaggtgttcgacagctccatctattaccattatcgggattacataatgaaggagctgggctactcccatgaaattcgcaaagctttccatgaggcggcgtgttattatacagatgaggatgatggccaagacagtggcaccaatgatggcttcatcgcccgtgcatcgcgcttttccaacggaaaacagtgcgaaacgatggtgaaactgaattttgatcttgcacaccaaaatgcactgatgctgaacaaccaggacgtgatattcactattcatcgtaacaacgattctttcctcctgcttacacctccttggaagaaagcggacggaacattgcaggaaaacagtaaggaataccgtattcgtgtgcacgatttgcgtgtttatgttcgcaccgtggacgttacgcctagccttaacctggcaatcagtcgtcagttggagtccacctcggccaaataccctcttcgtaagattgagatgcgctccattttcctgggcaaaggcaggactgagttggctcacaacgtgttcacttcaaccttgccccgtcgtctgatttgctgctttgtctctacagacgcttattctggcaatcgacggttgtcgccctttaaatttgaacatgcaaacgtgcgatcgatctgtgcggaggcaaacggtcaagcttttccgagcacgccatatttgttgtcgtttgacgatgcgcagcaacgttttgtgcgcgcttttgtcgacatgtacgccggtctcggtctggatgactcagacacaaaaacagtgtccattgggatgcaacgcttcctcagcggatgggctttcttcgtaattccgatgacctccacgctagacgatacgcccgggtttgagttgatccgtcagggcacttgcacgcttaaggtccaactcgaaaagcctataaaagaggatggttacgaaatgttgattcttggtgagttcgattctgtcctttccatcaacgctgaccgagtgttgagcaccgacggaagtgtttaa

SEQ ID NO: 45681 - DNA, 1212 bp, Heterodera glycines
  Genomic contig location: Contig_ID=SeqID_21899; Location=204..1415; Strand=+
  SCN-specific regions: Sequence locations=1-235,257-1008,1033-1212
  Gene Ontology: Mol. function=protein binding; Cellular component =dystrophin-associated glycoprotein complex; Biological process =muscle contraction
gtatcaggtgttcgtctgccactgaagcggacgcttggttcgaggccatccattcgtgtgccgacactctgctcactcaggcgttggcacaagtcaatttgatcctcggacaaagtccgcaagtgctccgcatgggttggatggcggagcaggtcgtgccaaatggccagtgaatgaatgtgtctgctttatgcttggcttttcctaccgtcttcctttattttaggacgccgccattggttggagggccgtttttgtggcattgactgtcaacgaccttctcctctacgagtccgtccctgcggtcaaacaagtcagcacaaaaacaaattgcacactttatacacattaattgttgtgccaattccaccgctttttaggaatgggccaacccatcgttcactcggccgctcatcgccacgcgagtggtgaaaaccctcccgttctgaactgtttttataccaatttcaggtgcagaccactgcccgcagtttccctgtcatcatgggtctctccgacattatctctttctcgacccgaaccggcacccaagagggcgtacggacgcatttgttccgtttagaaacgcaccgggaattggcctcgtgggtcaaagtaatgccaatgccgttgacacttcgtgtcgaaattacggcgagttaaacgctctgatttaggccatcatccaaaacacttacgtcgcttgcgaagcgattcagcaggtgagtgcgccgtgcgtttggaatgaccagcagtgcgagctgagcatccaactcgaccggggcatcaaactgagcaccaccggcgacggccaaatgctgtggcagtaccctttcgaggccattcgcgcgaccggcgacgatgggcagcaatttttgtggatggattttggggaaccaattggtgaacaggtgagcgaacgaacggaacagcacgagaccctaaccaaaacgaagaaattgaaaattgtttttatggaatgatcatcctcaaaaactattaactaacaaaaaaaaatttttttttttttttgcttttccttggcaattttcgtactgctgaacaattgaaattcaaaataatgagttgaggggaatgaaatgcattcatttaatccttaaggaggtcgatttgctttgttcccccaaggcggtggtgttcatccttcacagttttcttgccacaaaagtctaccaattgtgtctgtacgca

SEQ ID NO: 45682 - DNA, 443 bp, Heterodera glycines
  Genomic contig location: Contig_ID=SeqID_21899; Location=1557..1999; Strand=-
  SCN-specific regions: Sequence locations=22-241,271-443
  Gene Ontology: Biological process=gametogenesis
atggactgtctgtatgctaaagtggtgccgtatatttcggactgtgtgctgggcgaattggagaaaatgggacgacggttcaaacttgcgctaaaaatcataaaggacaaccgcttccagcgactccaatgcacccacaagggcatttatgccgacgattgcatcgttcaacgcgtaacacaggtaatcatctgacaatgagtttcattgttttgactgtcgttaaattatactcatatattttcagcacaagtgttacattgtggccacttgcgacaaggatttgcgtcaaaggattcgcaaaatacccggcgttccgataatggtaagtcccaaactatttttgtcccattaaccgggacaaccattttcagtatgttcgtgaccatcggtacacaatagaacgaatgccagatgcatacggagccccgaagttgggttga

SEQ ID NO: 45683 - DNA, 1742 bp, Heterodera glycines; identical to SEQ ID NO: 21909
  Genomic contig location: Contig_ID=SeqID_21909; Location=1..1742; Strand=+
  SCN-specific regions: Sequence locations=1-2,24-334,356-438,466 -556,609-666,690-746,779-814,864-888,911-1014,1036-1170,1192 -1376,1398-1409,1431-1453,1497-1742
  Gene Ontology: Mol. function=carbamoyl-phosphate synthase (ammonia) activity; Cellular component=mitochondrion; Biological process =arginine metabolism

SEQ ID NO: 45684 - DNA, 873 bp, Heterodera glycines
  Genomic contig location: Contig_ID=SeqID_3947; Location=1987..2859; Strand=+
  SCN-specific regions: Sequence locations=1-873
  Gene Ontology: Mol. function=transketolase activity; Cellular component=cytoplasm; Biological process=positive regulation of growth rate
atgaccatttctgcgaccgctgacgttgacaagctccaggatgcggccaaccgaatgcgcatttcgtccattgagcagacgtgcgccgccaactcgggccacccgaccagcagttgcagcgcagcggaaattgtggccactctgttctttgccgaaatgcgttatgacgtgaaggacccgcgcagcgcatccgccgaccgtttcattctgtccaaggtttgcaaaaagtcgcgggaactcgctgatcgcgcgaaattcggttgtgtccggcacgggtcgtacgactatttttattggaattgggtattccagttagtggatgccattatcggggagtgatttaatattccaattcgttgcttctactatatttccacaattcggactttcctccaatattcccatcccacatcaattggccatacaatttcaatttccagggtcacgcttgcccaattctgtacgccgcttgggaagaggcgggcctgctcagccgtgaccaagtgctctccctgcgcaagattgactccgacattgaaggacatccgaccccgcggctcaacttcatcgacgtggccaccggctcgctgggccagggtctgtcatgcgctgccggcatggcgtacactggcaaatatgtggaccattcgtcctaccgcgtgtactgtttgatgggcgacggagagagtgcggaaggctccgtgtgggaggcagcaggtgaactcaaaatccacggatagaggagacgtagtcaaagcctgggaacctacgggaaaatattttttcatgaccgttagtttctgttgaaactacatttaaaaattaatcataatttgacataagccggaatcgggattgcatggtttaggagaa

SEQ ID NO: 45685 - DNA, 703 bp, Heterodera glycines
  Genomic contig location: Contig_ID=SeqID_21936; Location=77..779; Strand=+
  SCN-specific regions: Sequence locations=1-44,66-283,305-505,550-703
atggcaccttacactcaagttctttattttaactcaaacgtaacttataaaaataataataaaatccaagtgattttccactgttttagattatatacgtttgcgcggaagaaaagtccgatttatccgtgttcagaattttttcgttggatggaacaaatgaacatgaacatattattgacgggaaagttcaaagtgtggcgatcagtcagaatggcgacttgtacatgacgaaacagccgacccacgggacggaagagtccgccatttggaggtaattgcgtgggttttgttttcactgttctattactcttaattcagatcacacatcgatcatccaatagtctaagaatttgcaaatattatataataaaaacattggtttttaggcatgggaggaattttgctcgacattcgacgaatgtttccaatcactttgtgtttacggtaagcttattcttctcataataattcacacatttttaacattccttttgtttgctactaattaagaaaatttaattaaatgaataaaattctattaaatttgctttttgttagataatgaaacccttgcagtcgccgttgtttcatcgcctgttaatttatattcaaagtgcatcgaataacttcatccttttttatattaattttccagacagtgcattaaatgggttgctacaaaagactgtcgaatcattgg

SEQ ID NO: 45686 - DNA, 974 bp, Heterodera glycines
  Genomic contig location: Contig_ID=SeqID_3965; Location=2467..3440; Strand=-
  SCN-specific regions: Sequence locations=1-98,120-125,147-276,298-974
  Gene Ontology: Mol. function=protein binding; Cellular component =nuclear exosome (RNase complex); Biological process=rRNA processing
atggaaatgtcgacttcatttcttgactctttgcctggattttctgttgtagattttaatggaagtcatgagaaaagaacttgtgttcctggttagtgtaaaaaatttaaaaagttgtgattcgcttttctttaggtgaacaattattttcagtctcaagtggatatcatgcgggaaatggctgttatgaatttcatggttcaatatgtgcttctcttgcaggatttttgcacgtttattcacttagagattcggtactacctattaatgtaaagcatttttccaattattttttcaaagcaagacaccgagacaaacattgtcgaagtgagacgcaacattgacgagagaagcaatgtgctgccgtcacagggaaagatagtcactgcaagggtgaatttgaaattttaatatacatagttctaatttcgattttgtattacttagcatatcgatttaccaacaaaaatatgaggaggggactttagttttttttacaagaaactcactggttctgtggtccgactctgaattctattgaatacatgtcgtaaaaggttgagcgtattacgacaacatttgcaaaatgtgcaattatctgtgtagaagacacacccctcgccaacgaatttaactcgactttgcgcaaggaggacatacgtgataaagagcgcgataaggtattaataccaccccctcggggggcaaaggcacactccaattactctcattatcaggtggaactgcacaaatttgttcaacctggtgacatcattttggctcgtgttttgggctatggcgaggcgcacacttcttatttgctcacaatcgctgaagctgaattgggagtagtgattggccggagccaaaacggcgaacggcttttaccggagaattccgaaataatgaaagtgccgggaagcgaataccgagaaacaagaaaagttgcacagcttcccattgttaacaaataa

SEQ ID NO: 45687 - DNA, 507 bp, Heterodera glycines
  Genomic contig location: Contig_ID=SeqID_3966; Location=236..742; Strand=+
  SCN-specific regions: Sequence locations=1-56,78-507
gtcattgacacggctggacgagtgcttgagattgctcatttgttggaccaactttggcaaaagtttgttttgttttgtggtactatacagtgacattcgttttggtgttaagcaaagaagcggggctgatgacctacaatttggtcatgatgagtgcagttgcatcgtccgtcattgaatcggccaagtcacaagtcgaatggatgtccgacaaaattttacgcattttcgagactggacgacacaacccttttcagtttaaacatgtcaaattctgccatacattaaccgacctgaatagagttcgctcacctaaggtacataatcagagacatcccttttatctttgatattatccatttcattaaggttgttttggtcagtgggttggacatggagagcggtttttcgagagaactctttttggagtggtgcaccgacaccaaaaacatggtaattgtctcagagtgtggcttacgagaaattttgtggttaattattactttt

SEQ ID NO: 45688 - DNA, 1972 bp, Heterodera glycines
  Genomic contig location: Contig_ID=SeqID_3974; Location=810..2781; Strand=+
  SCN-specific regions: Sequence locations=1-266,288-435,458-491,513 -920,982-1473,1499-1574,1597-1657,1679-1875,1897-1916,1938-1972
  Gene Ontology: Mol. function=GTPase activity; Cellular component =eukaryotic translation initiation factor 2B complex; Biological process=translational initiation
atgcctcgcattttggcaaaagttgaaggcaagggcaacggaataaagactgttattgcgaacatgcccgaaattgcaaaggcactgtcccgtccaccgacctgtatgttaaagaaactggttcccctgtatagtatgagtcgtgttgctttcccttgaccacaatttttctgaccaatttaagcctctcgatctaaaccaataatataggcattacaaacaaacaaaaaaagttcgggtcaaaagcgttagttgaataaactcccaaggagtgaagttaagactatgcatttaatgcgtttagatccgacaaaatattttggctgtgagctgggagcgcagactaactttgacctgaagaatgagcgttatattgtcaatggggaacacgatgccaacaaactccaggatattttagacggatttatcagaaaatttgtgctttgtccgagctgtgacaacccggagactgtgctggtatgtatatttactaggcaaaacatataatttttgtttagaccgtaaagcgtcaagtgatcaatggaaagtgtaaggcttgtggacacgcttttattgtggatccaaaacagaagctgtcgacattcattctgaaaaatccaccgcctcctgacaacatagagagcgaaaaggaagtgaaaagcgacggcggattgccagctgaggagagtaacgatgtaccagtagtcgacaactcgggtggctgtgatgccgggtcgaacggcgaagatgacgaggattgggcgcctgaacccgttgaagacgaggaaaaactttcgggacaaatcggcaaattggtcattgacaaggacttggacaaatctgtggatgagcgccttgacttgttgcatcagttcttcctcaaggcggtcaagaacaacacgattcaggtatagtctaccataattatacaaataaataaaattgtataactttcttaattaactatttaataataaaattcgtttaggacagcaagatgatgttaaacgaagctgaacgtctggaacttaaatcgaaggcaccgctgttgctggccgatgttttgttcgacaccaatgtcatcactcagatcaaacaacatcgcaatctgctgctccgcttttgcttgaaggacgagaaggctagttcttgttcaaaggagcttaattaaaccatttctccaattttaggcgcagcgcatccttttgggaggcattgaacaacttgtgcaaaacaacaaggacattctcatgtcgaagactgcccacatcataaaagcgctttatgacaacgacatttgcgaggaggacgtcattttagcttgggggagcaaggcgagtcttttctttgttgggctatattttttagtaattgttaattgagtgtaaaaatgatcttcgtatttagccgagcaagaaatttgcggataaggaagtggtgaaagagatgatcaaagttgcccagcccgtgcttaaatggctcaaggaggcggaagaagggtcggacgagtcggaggacgacgatttggacgttgcatttgacgatcgaagccgcaacattgggatgacagtggaggtggaaaagggagcaaaggatggggtcacccgtgtacagaacggccaaattgcaaccaatggcaaaatggacgatgggaatgcagacgacattgacattgacaatatctgattgtgagtggcatggcgcggtggacggtaattcagtgatgttgcaagaatttgtgatcgtatgccgaagactttcacccaccccttttgttcattgcgataccaccacatttttgttcgcttttatcgtaaatgtttttttttaatttactcgcatcggattttttcgaaattagatggggttttttcttgatttgatgataatttcatgacaaatatttttgctagtgatttaatttatttactttaatttgctttcataaatttgtttgtgctataagcatcca

SEQ ID NO: 45689 - DNA, 1338 bp, Heterodera glycines
  misc_feature (1338)..(1338): n is a, c, g, or t
  Genomic contig location: Contig_ID=SeqID_22013; Location=88..1425; Strand=-
  SCN-specific regions: Sequence locations=1-207,231-317,339-903,926 -1080,1120-1122,1144-1338
  Gene Ontology: Mol. function=SUMO activating enzyme activity; Cellular component=cytoplasm; Biological process=signal transduction
atggataatgaaacttctttgatggatcagcaacaaaaaagatatgacaggcaaattcgcctttggggcgatgatggtcaattgtcaatccaacaagcgcgtgtttgtgtgtttggctccaactcattggctgcagaaacgctcaagagtctcgtccttgctggcatcggttctttccatataattgacaaggcgttggtggaccacgctgattttgggcagaacttttttgttgaagagggttctttgggttcgagccgtgccgaatgtctcgtcaaggctttgaaggtgcttattttttggataaatataatccatttaagtgtttgtttttaaaggaattaaaccattctgtgcacggtcagcatcatccaatttctttcggggaattcaaacgacaggacttccaaatgcttctgcaattttcgctggtgattggcaccagtctaactgctaacgaagcgcgtcagctggaccaatttctttttgagcatgccattccttttgtatatgccaacgtttgtggaatgatgggtcatttgcgactgtcctttcgggaacattacatttttgaaaatcatgcagaaaatgctgcttatgacttgcggtaagcataatgctatggggagtgggaaggtacggttgccccttctcatcgtttacttcgatttttagataaattttctaaagtttggggaggggtattttttgcaactctcgaccactaattattaacataccttcctttcactaggttggacttcccatttcccgaactgcttcaattggccaatgaaactaacctcgaatcgatgacccatgagcagcactcacacactccctttttgcttctttatcttaaagcgattgacatatggcgaaaaaggtcaaaatttcactaaatgttaaaaagttctcccttttttgacaaaaaaaattatatgttttcttgcggtttctgtgtcgctgcttatgcaaatactaaatcgaaaaagcgaaactaccggaaacgaatttcaagacttataaacgaaaaaaattgcaaaaatggagggatgcacaaatttaattatcgcttccaaaaatcctttaattgtaaaaaataatgcattttttgtagccagacaaaagccaatgacaaagctttgtttcctgatattacttcattcaaaactcggaaggaatttgaacagattttaatgaagatgcggcaaccggacgataaggggtcgttggacgagcaaaatttcactgaagcaaagcaaaatttgttgaaaggaatgcggaaatccaacgtaagaatcaatgaaagctatggaaactatcgaaatatgagtn

SEQ ID NO: 45690 - DNA, 617 bp, Heterodera glycines
  Genomic contig location: Contig_ID=SeqID_3995; Location=540..1156; Strand=+
  SCN-specific regions: Sequence locations=1-244,271-410,504-617
  Gene Ontology: Mol. function=ATPase activity; Cellular component =extrinsic to plasma membrane; Biological process=synaptic vesicle priming
atgcgcaaattgttctccgacgctgaggaggaatggcgccggtgcgggcccaactcgggactgcacataatcatttttgacgaaattgacgccatctgcaaacagagagggtccatggtaaataatgcagggctattcggttgtaacgttcattcaatgatttttggtgtaaatttcttaggctggatcatcgactggagtccatgatacggtggtcaaccaactgctgaccaaaatggacggggtggagcagctgaacaacatcctcgtcattggaatgaccaatcggaaagacatgatcgacgaagcgttgctgagaccgggacggatggaagtgcaattggaaatatcattgccagatgagtacgggcgcgtccaaattctgaagatacacacggcacggatgaggtgagaagagaaagcatagagaaaacgagagagagaaaaggggagaagttgtagacagagagagagagaggaagggaagagggaaaaagaagagaatgccaacaatccattcccattaaattaagagaatataacaaattggacaccggcgtgaacgttgaggacatcgcaaagaggaccaagaacttctcgggtgccgagttggaagg

SEQ ID NO: 45691 - DNA, 3414 bp, Heterodera glycines
  Genomic contig location: Contig_ID=SeqID_3997; Location=23..3436; Strand=-
  SCN-specific regions: Sequence locations=1-154,177-359,465-493,515 -577,599-913,1038-1181,1203-1381,1404-1595,1618-1686,1709-1745,1767 -1767,1789-1811,1834-1935,1957-1984,2006-2226,2248-2266,2289 -2561,2639-3170,3192-3414
  Gene Ontology: Mol. function=DNA binding; Cellular component=nucleus; Biological process=protein targeting
aattggatctgatccgcaaaaatgtgccaaaggccgtgttggaaacaagcggactgatcagccaaagcacgtcgcacgcgaaggatttggccgcgcgagtccaattcgcacttgagagagtgctgcccgaggtgagaaaagtgcccaatgattaattgtgttatttcttattttttgcttaaatagagcaaaaaatgccgagttgttctccttgaacatttcgccaaggaggaagtgctgctaatgcaaattcaatggtttggcatggagccggcggagaaaatgataacgaattcaaagcaacaaaatgacaatgggaacaaaaggccaaaatggcactcgggcaaatgggaaaaggtgagagagtagagtgtagagagggaggcagagaaagagagaaacgaggaggacgagggaaagtgggagagcaagagattagacagatagagagaagagagagagaggagaaaatggaagagcaaaagataagtagacatatggagtgaaaagagatcggtctacgtcagttgggcccccacgtttgggccccagcatatttttccactataactttctataactttttcctttgtcatccaaatcctataaacttggtatcattcaaaagcttaacatgtttagaagctttttctaaggtattgcttcgcggttagacaattaccaaaaaggttatacatgaaaattgcaaataagtcaaaatttttgaaattttttctaataaattttttccaggcttgaaaatcttttcgctttttgtaagctaatagagcatgtgaagggctttcgaatgataccaagattgttggatttggatgccaaagaaaaaaagctatagtggaaaaacatgctggggcccaaacgtatgggggcccaactgacgggttccgagtgaagagatagagacagaggaggagacaaagagtgagagaggaggagagaggagaagtcgaagcgccacagattgacacatagagagaagagagagcgggggcgacaagagagtaggagagagagaggagggggcagaaaagaaattttttagcttaatatgccaactttcttgactctagcaaaaagtcatcgccgtctcattttttcttagttatgtgctccctttgtgcacgagttggagctcacctttcttttggagcgtgccgaccgttaccagctgttgctgtccaccattaagcaaatccgcgtgatcgatttgctcgggggtttgccaccggcggcagctttatcctctgccacttctgcagcgacaacagagaaagcgtccaatttgttcgtccgtttattattggcgcattgggtgcttttctttataccaatttgttcataaaatttattccgcttattgttgtttcatttcacacatttattgctaattaatataatattttatgggctcagctttacaacaaaaaaaataataattccgatttacgacatttttttggttaaaaattcggaaattctcggacatttttttacttgctaatacaaggaatcacatcttaaaatacacttttgcgagctcataactagggcagcaacttttagtgacgaaaaatcccgaaatagttaactaaaatagtgagtaaaaatcccaaaatagtgacaaaaagtccgaaatagtgacgaatagtgacataattttcagccaaaaattgagcaaaaataatttttattcactggttgcagttgcaaatgagctacatttcctttataaaattctcttagcaaatattgacattttttaaatcaaaaattttgtcaagaaaaaaatttttggggagaatttttgaaaaaattttccaattcttagtggtgtatttaaaaaaaatttttggtcgattcttaggggtgtatttttttgaaatttttttagatcgattcttaggggtgtattttttgattttattgcatttttgctaataaaatctctgaaaaatgtcgaaatagttaaaaaatagtgacaaaacgccaaaatagtgaattttcactattttagtgacgaagcgtgaaaatagtgatttctagtgatcgatagtgagatccaaatcgaaaaatttcaacgcagaaatgcgttttttgagctcctttcttcaaaacaatcgagcaaaaaaaatagttaaatcactaaaagttgctgccctactcataactaacaaaaagactaaaaatcacgggtttacacaaattagaagaaagaagaaaaatcaatgatttaacaacagcttttaaaataatcaaagggttcaccagcctcgatgctgggaaaagtttctttttctcagaaaggcccaggaggcctttacttttacgggtaaagcgcccgccacacggccaaaactcaaaataattttttcaatagaatagtaaaaagctggaataatcttccagtggtagcggtgcaaattaataaggcaaaggaattcaggggtttactaaaagcaatgagttctgagtaggattttccatgttgccatatttacactatatttttatcacctgtgaatttttaacatttgattgaattatttttattcatttttagtacggtattcattttgtatttttattttgatcaaatttatttgttgttttcttttttggcaccatataagagcactcatgtgcctttggtttgctcgataaattaaattaaatctatgcttatgaaaaattggaacgcttcaacgacatggtcgacgcagtgaaaaaggtgacaatttgattttggatacattcagcagcttctaatgcttttccttccttttcagttggtcagcatttgctccgaattgtcttataacaaaagagttgctgtgggtggctttcaaaggtgcgatttcgtcagccgtggcgtgccctctgcgccatcgaacaacgcttctattcggatactgaggggcaacggctggtgcgcaacacattttttttagtgttttatcttttcattttcaggggttcaagtcctatcgcgaggagttggaatctgagctgcttgtcaattgccgtggagttttggtccgtttcgtgccttcattttagatatcaatccaaataccatcgcttttcaggagttcctcgactcaactctgattccaaatgcgacgaccaacctggaggccaaggtgttctacctcaagatgaagggcgactacagccgctacatttccgaaattgcgctgggcgaggacagaacgagtagggaatttgttttgatgttgctaacaaataattcgccattttttcatttcagccgccatcgaagaggcgaagcagtcctacaaccaagcggcagaacacgcagcgcagctgaccccgtccgacccgactcgtcttgctgtcgcactcaacatgtccgtgttctaccacagctcctga

SEQ ID NO: 45692 - DNA, 473 bp, Heterodera glycines
  Genomic contig location: Contig_ID=SeqID_22102; Location=29..501; Strand=-
  SCN-specific regions: Sequence locations=1-19,42-63,90-100,153 -261,305-473
  Gene Ontology: Mol. function=non-chaperonin molecular chaperone ATPase activity; Cellular component=intracellular; Biological process=reproduction
atggcgtcttgcaaagcaattggcattgatctgggcacaacatattcatgtgttggcgtttatcagcatggaaaggtggagattattgctaacgatcaggtaaaatatattttattaaatttggaataaataaatggaaataatattatttacatttgttaagcaacgaggtgcagacatagtttttacagtgttaataaaaatgaaaagctgccgacaaaaataaatttaaaagtcaataaaactttgtggaattagtttttaaatatgtaattaaaaattaggatttttagggcaataaaaccactccgtcggtggtcgccttcacggacaccgagcgactgatcggcgacccggccaaggaccaaatggcccggaacccgaccaacacaatttttgaggccaaaagactgatcggacggccctgggacgacccgatggtgcagcgcgacattcgccagtggcccttcaaa

SEQ ID NO: 45693 - DNA, 770 bp, Heterodera glycines
  Genomic contig location: Contig_ID=SeqID_3998; Location=696..1465; Strand=+
  SCN-specific regions: Sequence locations=1-611,633-708,730-770
atggccaaaggtgtgaagttcgatcacgacaacgcgttcgtgcgattctgccgctactatctatggcattactgttggagtgggcgtcagtacggtgggtggactcaacaattgccgaggctgttaacttcaaagcattgagtcaatccgttcacaggtcttcaattctacgaccaggcattcgaaccgcatcccgtagtccaagaggcactgcgccggctccgtcttaaggacccctaccaggtggggatagagaacccaattttatttggtaattcaattcagtacgaccttcgtctgcagcgtattcttttggccagtcaattgggctcaaagaatgagcgactgccgaagaacatgtggacaaaatgggacgacgagacattctatctgaacccgtattttaacgaaattgaggaggaaaagctggagcgtgaagccagcacgggcatgaagccgggataccaactcaaagagcagatttaggggacaggttgcgttttacacatttttaagtgtaatcgttcgtgcaattttgtgtgatgtgaaaagggctgcctttaatactccgaaatttttccgcggggctttttctcatttactaatcgaattaaaattgtatatatttttagacattgtgttgtgaacgattaggcgcggaggaaaagcacattgcgtttgttggtactgtggccggagagaaattgattgatgagtgattgttcacaacttttaggacgacatgtgttatgttcatttaacgtgaagta

SEQ ID NO: 45694 - DNA, 1092 bp, Heterodera glycines
  Genomic contig location: Contig_ID=SeqID_22114; Location=52..1143; Strand=+
  SCN-specific regions: Sequence locations=1-885,907-1092
cagtcggcgtggcgaagttttgccgaaacggcgatgacaaatggaaacatcgaactcggtcagtgagtccattggttaaatgcatttccaattgcaattggaactgtgcccaaaaagctgtgcgaatatttcggcacctcggtgacgtggcgatggtttgggcacttgagcaacttctgaacatcgaagaccaacaaacgctcagtggccatgtggccgcactgctcggcaacttcgacgaggccgacgattttttctccaattcgtcccaaccaaaacttgccctggaggtgctggggcactcgtcaacaattatttcaaattactttcaaattttccaatgattggtcttttgattctgatcagtctattaatttttgctccataattacttatgatttttcggctttatttgctgttagatgcgccgcgacgttcaacattgggaaagggcgttggaattggcgcgacaaacggcgcccgacgaattgccgggcatcgccaaggaatacgcggtacagctcgaatttgcggggcaacacgcggaagcatttcgctattacgaagaggcattgatcacttcatccagcggaaacgcatcgaaaatgagcgaagaacagagggaggaacacaattgggtgtgctcggcggggtgagcaatgggaaaatggacggagacggggcgggggggacactgaatgggatatatcgtaaaggatttacggcgatcagcaaagatggaaagctgatcggaatgcatctggatgactatggggaggactaattggatggaattcactgtttagactagccagaatggcacttcatatgggcgatctgaagaggtaagtttaagaaaactaaaatgattaattaacccagcaattgtccctctcccccaaaaggggcgtggaaatcgctttaaaattgccgagtcgattggccaagagagattgtggcattgtgcttgaacagcttagagtaattttgtgattgctattctaaatttagcttttcatttgttagcaattcgacgaggcgggaagtgtttacgaagcgggtcaattttatgatcgtgccgcggtttgacta

SEQ ID NO: 45695 - DNA, 1232 bp, Heterodera glycines; identical to SEQ ID NO: 22128
  Genomic contig location: Contig_ID=SeqID_22128; Location=1..1232; Strand=+
  SCN-specific regions: Sequence locations=1-295,317-396,419-782,810 -870,910-1007,1058-1108,1150-1232
  Gene Ontology: Mol. function=ubiquitin-protein ligase activity; Cellular component=endoplasmic reticulum; Biological process=signal transduction

SEQ ID NO: 45696 - DNA, 464 bp, Heterodera glycines
  Genomic contig location: Contig_ID=SeqID_22176; Location=616..1079; Strand=-
  SCN-specific regions: Sequence locations=1-280,302-464
atggctacttacaatcccaactatgaatccattgggcaggcctttgtccaacacttttacaccaaatttgatgtgcccgatggtccgactcgcaccgtcggccttcatgatttgtatgatgctgaacactcttttatgacttttgaggggaaccaagtgaaaggtcgacaggccattttggacaaatatggagtaagtgtttgttttttgctttatgtttacttaatcgttaattttttttatatttaggcgctacctttccgaacgattcaacatgggattacaaaggttttctccaaattagtcttttgcctttcattcttttcggtttggaaatttattaaccaataaaacttcagactgacagtcagccgcttccggatgggtcaattttggtgacggtgattggtcagcttaaggtgtcctttacagtggtttatttattcaactgttctttgctttag

SEQ ID NO: 45697 - DNA, 1616 bp, Heterodera glycines
  misc_feature (1553)..(1553): n is a, c, g, or t
  Genomic contig location: Contig_ID=SeqID_22189; Location=1..1616; Strand=-
  SCN-specific regions: Sequence locations=1-272,301-324,346-584,612 -807,830-1058,1142-1351,1380-1616
  Gene Ontology: Mol. function=Hsp70/Hsp90 organizing protein activity; Cellular component=cytoplasm; Biological process=protein folding
cggttggcacaacgacggacggccgcgtgttcctcgacgcttctttggactatgtgctgggcgaaggccttgaccatggactgccggacggagtggacaagtgggggaggagggcaagagaaaacgccaaatttggaaatttctaacactcccagttttgactgtccacatattccgattctccggtgcgaatttgtgcctttttcgattcgggattgatttgaaacggggacattcaagccaagagcatatacaccccaaatcgtcgccggaaaaaaaaattcaaattttttaaaaaatgaggggcactcaactcccggccatttccatgacccacttttaaatttcttattttatttattagccgaattttaaatttctcattcatccggcagggcgttgaaacggatggaccgcggtgaaaagagtcgtgtgacgctgaagggcaaattcggctacggcaaatgtccgcccgcggaactcggcctgggcatttacgaagagattgtgttcatgctgcacctcaaggattatgaaaaggtgagcataaacaaaggccttttttccgctccaggccttactaatttattttaaagaaaaacgccagcgggcaaaagcatgcaaaaaatccccagttttgccaacggagagctaacctgggatttttcgttataattttgttaaaagtaccaaattcctccatctttaatcgaaaaacgagttcattctctgctttttccaaaacgggggaatttccctgacaaattttcccgtgcgaacacaattaataattagctaaaattgcactaattaatttgtatttatttgtacaattatgttatttttgggggttttcacactttcaggtcaaggccacttgggaattgactgacgaggaaaagttggaccgtgtgaaggcatacaaagaccgtggcaccgactttttgcaccagggcaaattcgcattggcactggccaaatacgacacagtgatttatatgatggaatttgcaaagccaaccaaagcgccacaggaaggtcaaatttgatgggtgcactaaattttaaaaaattaaaaaacgttttctttaaatttcaaaaaaaaaattccaaaacatttttttgaattttttataaaaaacccaagattttaaaatttgtcaagtactactgtaatcggtggaaatatggttggtggtaaccgctcttcctttccaaatttaggcggagatgaaattgcggcaaaatttgaacagatgttcattgcggcacaggtctgctttttgtttggcattaaataaattaaatcttgacggtgtcagacacaaaagtacagtatgatatcgggcacttttttaatatttacaaataaaaaaattctacaaaatttccgcatgcatattgtcacagttgaacagtgcgttggcccacttgcgaatgggcgacccaattgagacgatcaaacattgtgaaaaagtgttggagcggcagccaaacaatgtgaaggccatctaccgtaaggcacaggtgtgtcgttcatacattttttaggnggaagggggtcgacccccccccccccccccctcgctcgcaaagggggccagcgaggggggggg

SEQ ID NO: 45698 - DNA, 2132 bp, Heterodera glycines
  Genomic contig location: Contig_ID=SeqID_22208; Location=1..2132; Strand=-
  SCN-specific regions: Sequence locations=1-134,156-250,272-455,477 -608,630-700,767-879,901-906,928-1144,1182-1182,1266-1308,1372 -1408,1439-1439,1522-1774,1798-1994,2016-2132
  Gene Ontology: Mol. function=Ran GTPase activator activity; Cellular component=cytoplasm; Biological process=signal transduction
attggcaatgagcagatatacgttgaaaggacggtaattgaaaaaccatacttttgattgtttatggactatataagtttagttcctcgaattccattcaaccattttgcctgcacttataaatggaggaaagggaacgtcaaagcaaaatcccattcgccttgaaagtcgcttcaaaccttcgctcgttaagttggcgtttcgcgtcgttggcttaaaatcggcattttatggtaattaaattagtaatggattgtgtgtttttcctttttggatcataaaacatttaatgttagttacattagccggtattattacaacacaatatttagtgtcaaacattcccgaattgttggactttgcgacaacttacggcttccactcacttcttcagatggtcgaacaaaggctggttaccaaaacctgcgcaaagttacaaatagggacgaaacttgatttggcttacaaacaccatatgaatgggctaatcgtacgttttatcttgagaatatttaattaggcacataattaccattcgctggaagatgcttacacagactctatttaggtggcaattgcaaagcgaataaataagccgaccgaaattgaacatcacctgaaaatgaaaaatgtgccggcgcagttcaaaacaatgctccggagaaagatggaagcgattagggcgcgggttttcgaaatcggagcgaagagcaaagagaaaagagagcgaaaaaaggaaaagagagaaaagaaagagcaaaaaagacgcagggaacgccgaagtcaaaaatgtcctcaaaaagcttaaactttcagactgattgtgagattaaacgccttattcaattgtttaaattgtgcagattcattcttaatttgttatttttgaattaggtttataaatcatttctttatgataagttatttaacttttgatgttcatttaatttttttttacaaacatattttctatatatactattagtgggtgtaatgcgtgttctgtcatttgctggattacaactcaaattggacacaatcggagatggtaatatttggacaaaaaaatattatatgggggacttttacgaaattaacaagtttaattttttgttccctataaagggctgattttgtttcaggtgagaagatagcggccaaaatccgcgagtgtgccggcttggaggtgttggaaatgcgcggcaatacgcttggtgtgggtgcgaccgctccgatcgccgaagcattggagtgccagagcaacttgaaggtagcaattgtcgcattccatttgtcaccctgttgattaagagagccctttggagtgacatgttcaccggacgactcaaagaagagattcccaggacattggtacgctgtcgccccacaacttcttgtattaattttagaaaactttgtgcgacgcaatgattctgagtggagcgaggctgaccgagcttgacctgagtgacaatgccattggtcctatggctgtgccggggataaaagaatttcttgctggcgaggcggcctttgccttaaagacgctgaagcttaacaactgcggccttggaattgcgggaaaggtccatccttacccttctcttcaattgttgcaattttccacagacaattgctcactgtttgatagaatgccatcggcgatcagttagccatggcactccgctttgtctgaaaatctttgtcgccggaaggaatcgcttggagtacacgtcaacggctgcgctagctgaagcatttcaggcactagatgaataatttaatttaaaagaatttagtctttccattcgtttatcaacaaacgcattttgttaattttacagataattggcacccttgaggaaatctccatgccacaaaacggaattagcgctgaagggatactcaaattatcggaatccgtgcggcaaaatgcatcgctaaaaatactcaatcttggcgacaacacattcggagaatcgggagcgagtgccatggccagcgcactggaaaagctggccaggttggaaatagtcgacttcagcgattgcttgtgcagagaccgcggttcggttctgatagctcgcagcatggctgcttcgaaaagccccctgacggagcttaacttgtct

SEQ ID NO: 45699 - DNA, 1835 bp, Heterodera glycines
  Genomic contig location: Contig_ID=SeqID_22213; Location=302..2136; Strand=-
  SCN-specific regions: Sequence locations=1-1429,1451-1835
  Gene Ontology: Mol. function=dynamine GTPase activity; Cellular component=mitochondrial intermembrane space; Biological process =mitochondrial fusion
atgcgcaattcggtgcgggatggaaaaacggtgtccaacgaagtcatttctttgactgtaaaaggtgacttcattccaacgccaatttccgtcattgtttctattttaggtccgtctttgccccgaatggttcttgtcgatttgcccggagtgatttcgactgttaccacagacatggccagggagacgaaggaggacatcgcgaagatgtgcaagcagcacatggagaatccaaacgccataattctttgcatccaaggcatcgcagcaaatttgtctcattcttttccgtttctttcagatggttcagtggacgcagaacgaagcaatgtgaccgatttggtgaccaacgtcgacccggacggtcagcgcacgattttggtgctgacaaaggttgtccttcaaccgcaggacggcatttgcagtcattttgcaattctgtaggttgatttggcggagaaaaacttgagcaacccgcatcggataaagaagatcctcgacgggaaactatttccgatgaaagcgctcggctatttcggcgttgtcaccggcatggacaagcgggacgcgagcattgcggagatccgcaaatacgaggaggacttcttcgagagttccaaactctttagggatggcgttttgaaggccacccaaatgacgacgcggaatatgtcattggcggtaaaaacttttttaagctaatgaaacgtttcccgtccatttgtttaggtttcggactgtttttggcggatggttcgcgaatccatcgaagcgcaggcggacgctttccgcgccaatcgcttcaatttggagacggaatggaaaaacacttttgcgcaccaacgcgacttgaccagggacgaactcttcgacaaagttccgtcggtttccctcccccacggttttttcatttttaggcccgtggcgaagtgctcgacgaagtggtcaatttgtcgcttgtctctgccgacgaatgggaagtgcttcttcgtgcgcatttgtggaatgccatctgtccccaagtgttcgaccaaattctgatgcccgcgtcaacggtaaaaatggacgaattatggtggtgtttacgttaaatgaccctattttaaggttgaaagtacaagttctttcaacactgtggtggacattaaactgaaacattgggcggaaaaggaattggccaaccgatcagtgcaggtccgacaattataatctcaattacctaatcagtaccaaaatttaaaggtcggatgggaaacactttcacaaatctttcggcgtcaagtgagcggcgaggaaaggggcggacagacgctgaagtccaatcggacgcacggcagccaaaaatcgccggatggtggaaatttgttgaaagcactgaaggctgcggtggtcagtgccgtgttggagcagcacagatgggattcaaaagcgttggattatttggtgattggtcatcgtttgtctttacaaataattctggtgggtgttcagcgtgttatccaattgaatgccgtcgctgaccaagtggtgcccgaccgaagggcgtgggaccaatcgtgcgctttccttgccaacgcggcctctgaccgaattcgtgaacttaaaaagacattggaaggtgtgtcgggaaatccgtttggcattgccattctctgctcgtacagaatctcgcggtccttcgggatggtcacgttggtttggttggggttcgccgacgcctgagcaactcgtcaaccaaacggttcaagacgaacttcgagctttgctcgtcaataatccggtagccagtttaaatccgagtccaaaattaattgtgaatgaaagcgtcaccaaat

SEQ ID NO: 45700 - DNA, 978 bp, Heterodera glycines
  misc_feature (945)..(945): n is a, c, g, or t
  Genomic contig location: Contig_ID=SeqID_4028; Location=169..1146; Strand=+
  SCN-specific regions: Sequence locations=1-978
  Gene Ontology: Biological process=protein folding
tcaaaaaggcctattatcgccagtcaattctgtggcatcccgacagatttgcatcggcacagcatgacgaaacgacgcgcgagttggccaagcagaaattccaagtgatcggcagagcatatgtaattttgggggatagtgagaagcgcaaagcgtacgacgaaacgggtgagaaaacattggaattttagtcagcgaatccgactttatctccaatttgttggcacaggttcgctcgacgatgagaacgaattttacgaaggcaaagattggtcggccgtgtggcgaggcgttttcaaaaaagtcactccggaagagatcgaagcgtacctggccaaattcagaggtccgtatggaaagaacaatagttcaaggatgaaaatgtataaatgaatctaccgcttctcgttaattggattgatttagagaaattagttttaaggattgtttaagcaattggtattatatggttcatatgggtttgtattaaattgaacttgtactatcaaatatatttaacgacgtggagaggaagtcggataacgaaactttcaaaattacatttccaaattattttttaccttttaaggttcacaggaggaaattgacgaggttaaggaggcgtatcagaagcacaaaggcaacatggacaagatcatgcaaagtgtggtcggcgccgagcatccggacgaggaccgaatccgcgagatcgtccgccatggcatcgagcggggcgaactgcgtgcatatgctcgcttcgtcaacgagcccgcctccgctcggactcggcgtgccgcgcgcgcacaacgcgaggaggtggaagcgcagcaggcgctggaggagttgcgccagagggaagacgtcagcaaagggacggacggcgacgactctttgggcgcattgataagggcaaagcagcgcaaacgcgccgaaaagaatggttcngtgtgctgtttccggacattagaacgtttttga

SEQ ID NO: 45701 - DNA, 940 bp, Heterodera glycines
  Genomic contig location: Contig_ID=SeqID_22219; Location=312..1251; Strand=-
  SCN-specific regions: Sequence locations=1-109,131-940
  Gene Ontology: Mol. function=endopeptidase activity; Cellular component=cytosol; Biological process=protein modification
atggagcgttatgatcgtgcaattacgattttttctccggatggcagactttttcaagttgactatgcgcaagaagcagtgaagaagggctcaacagcggtgcgttttattgctttttaaaaatattaatgtgcattgctttaggttgccgtgaaaggaaaaaattgtgttgtaattggagtcgaaaaagtaaattatttttagctagtgtattcacagacataaaaattgcttaaactgttctggtgaacttttattttgcagaaatctatcccgactctgcaagacgaacgtaccattcgtaaaatacatgcattggattcggtaaattccttattcctcttcaatgcacgcctatgtttagcatgttatggtcgcattcgccggactcagcgccgatgcacgcgtccttatcgaccgtgctcgagttgaatgcgaaaattacaaattgacgcttgaggaccgcgtatctgtcatgcatatctctcgcatcatagctgatataaaacaggtcaattgacttacaacatctgagtaactttttgtttgtttagagatacactcaaaccactggccgtcggccttttggaatttcaatgcttgtcggaggcttcgattctgatgggacccctcatcttttcaagacggaaccgtccggagtttactacgaattgttggccggttcaatagggcgaaatgaaaagattgtgaaggagtatctggagaaagaatacggcaacgacaacacagctgatgaggagtctacgcttaaactgatgctcaagtctttagccccagtggtccaatcgggggcgcagaatatcgaaattgcggtgaatacaaaaatacacgttaatttactagcaattcatttttaaggtgctcaaatgggtggatggcaccaatggggaggcaagttcatttttagaaagctaataaa

SEQ ID NO: 45702 - DNA, 1557 bp, Heterodera glycines; identical to SEQ ID NO: 22247
  Genomic contig location: Contig_ID=SeqID_22247; Location=1..1557; Strand=+
  SCN-specific regions: Sequence locations=1-570,593-593,615-814,858 -1102,1124-1155,1177-1557
  Gene Ontology: Mol. function=snoRNA binding; Cellular component=small nucleolar ribonucleoprotein complex; Biological process=processing of 20S pre-rRNA

SEQ ID NO: 45703 - DNA, 1783 bp, Heterodera glycines
  Genomic contig location: Contig_ID=SeqID_4037; Location=1175..2957; Strand=+
  SCN-specific regions: Sequence locations=1-576,599-776,798-1516,1539 -1783
  Gene Ontology: Mol. function=transcription factor activity; Cellular component=transcription factor TFIIIB complex; Biological process =transcription
atgactaaggaagagagcgaagatcctcccgccttccgcgagtccaaaagaaaacagcacgaagaaaagcgtagaaaggaggaggaaattgttgcggaatcggctttgaaggaagtgcgttaggtgaaatcgcagaacggcacccattgactcgtcacccggaaatatataacttttttgggtgggtgagatgggcataattggattgcaaccgatttgcaggcaaattcagattaactcatttcataccggacccttcctatattaattgaataatataaatggcttttagtttgaaccagttcgtctcgaggttgagcaggcactcctaaaaaggttcaaacgctcaccttatgccaaaatgattgcgaatggtttggtggacgacactgtgccggaattgtcacaggcaagtgatatgctgcaggaagaagtgatcgacacggtgtatcaactggcagaggaacaccaacagcagcctggcgcaatatcaaacaggtgccgtacaatcttacaattagggggcggaaattaatgacaaagccaataggctagtaagttacttttctcgttttggcacttccccctgcccaaaaaaccttcgccgaccttgacatacatgtgcaaggggtgtctcaggccaagggtcgtacgacggacgattgagacaggggggggtgtacgaaaaaggtccacttttttccccgatgacgaccttttttctttcctttttttgctatattttttggcaaccttttgctattaagaaatctgagtataatttgttgacagatttacaccaaaaaaggtccattttggaattttgagtcaggtgacgaccagttcatacttttaacaacacttttcggccgcttttgatcaaattttaaattttcccccgtcgtcgacgatccccccccccccgttcccacgacgacccctttcctcttttacagccgccccccttacgacgaacgaagggagggtgtccgaggcggcctcttacgacgagaggggggggggggtgtcgagacaccccttgcacatgtatggtcttgagtggtggtggatggagcaggagagggttttttaaattttaataaagcactttttcatttattttcagcgggcattatgccctttatgggccatctttggcttcgttgggcatttccaaggatcaaaaccagcagcgaactcagcaacaccaacagatttcttcctttccctcctctgattcaccagccatttgtccaccgactgttgggaaccaatcaaatgatacaattatctcaaacgaagacctcgacttgacaggtcctttttagtggtggccttgacattttacaatatttaggcatcgatgacaatgaaattaactcgtacattttgacagacgtagagacgaccatcaaagagaagtattggatgaagcaaaactccaaacatttagaagtgatggaggaaaggttggaattcggtttaaaacaatatcaatctaataaaaccatttttcaaattcctatttttagaaaacgacaacgccaggaggagcaagaacaacggcaaaataaagaaagcggcccaaagaggagaaaacgtgccccgaatgttcggaagagggaagtcaacgcggttacgcacaatgacgcgatgctccatgtcattcaggtggagggggccaatgccgaattcattccttcactgttataaattttaggaaagaaatttgtccagcaaaattaactacgatatactgaagcaactcgatgatgaaagctga

SEQ ID NO: 45704 - DNA, 285 bp, Heterodera glycines
  Genomic contig location: Contig_ID=SeqID_22255; Location=972..1256; Strand=-
  SCN-specific regions: Sequence locations=1-122,144-285
gggatcaaccctgggaggaagcgcatcggttacgccttcaagtccaccaaccggaagcgcatcaacatgaacccgccgaacggagtgctcggcccaaaggagtccgtcaacgtggccgtctcctgcgacgccttcgaccccggcagcgaggacaccaagggcgaccgtgtgaccgtggagtggaccaacacgccggacccagccgccaccgcgttcaagctcgagtggttccagggagacgggatggtgcgccgcaagaacttgccgatcgagtacaacgtctga

SEQ ID NO: 45705 - DNA, 2356 bp, Heterodera glycines
  Genomic contig location: Contig_ID=SeqID_4041; Location=1402..3757; Strand=-
  SCN-specific regions: Sequence locations=1-832,854-1423,1446 -1496,1518-1574,1596-2094,2123-2356
  Gene Ontology: Mol. function=ubiquinol-cytochrome c reductase activity; Cellular component=mitochondrion; Biological process =reproduction
atgttgcccaactcgtcgtcaatgctgctgtttcacaaccttcgaaaacagtcggtcaacgcgcttccgcttggtcgtcaagcagtgcacaacgatgtccaattccccaactttgacgcgtatcgcaacgaattgaccaaagacccagctcaaccgtcccatgtgactgaggacaggcgcaaaggcgtgtcaagcttcatcttttatggaggtttgccattttttgccgagtttggtttcgattaaccaagggttgtcccaccagagtggtctaaacctccttggagactattggacatttatccgttgaaattttgaaaaaataacggattatccgttttcgttcgggatatgaaacaaaatgttttgcactgctaaagtttacgtatttactttgtcaccccaaaaaaggatgtctttttattgaatgtgaccctgactttcgaatttatatttaattcaattgattggttctcaaattaaatattaaattttgtatacatttcagtgggcggtgccattacgttgatgacagcaaagttcgccgtccgaaaagcggtcacttacaaatggatgccacgggaccaagccgcaatggcagcaaccgaaatcgacctcagcttggtttatttttcataatcaaatgaattaatctaacaaatcttttttttacatagctccttatcaagaaaaaccattgctaagattttttttctcagatttttgtaccgaattttagtcagtagttccgaaattcataaaatgcatttcgctttgaccaaggacctccaaaaaaccttgggaataaaagagtagtgaacccaaaacaatgccattttccgcccaaattttccaatttcaattttttttttccaggtgccattgggcaagacaaagacatttgagtggcgtggtaagcccgtgtttgtcaagcatcggacggccaaggaaattgagcgcgaacgtgcggtggaagtgggcaaactgcgtcacccggaacgggacgaggaccgtgtgctgaagccggaatggtccgtgctgatcggcgtgtgcacccacctcggctgcatcccattgtgtaagcgatattttagagaaaaaaattgttggatttcgaggcattgtaatttgggcaagtcgaaacgttgtcgaagaattgttgttggaccataacttttttttcattattaatcaaatatgacatttctgatactgtcagaaagcacttgacgaaaactctattaacacgtaaaaaaaattttagttcatctacaaaaaaattcaatgacgaaacactcaaaaaaatgatggtctttatggttatttgggcatacattttttatagttataaaattttttgaatttttgctgaataacagtataccacagagccagcgaacagtacaagaccataatgcttaaatttggctaacaacaacaacaacaaaaaaagttgtccaaaaaaacgtacggcgacctttttgtgtggacagacattttttagcaacaaaaaattaggcatttgctaattgtaagaacatttttttagcaaattttaccaacaaatcaatcatggaactcaaattccaccaatttcagctggcaaaggtgaattcggcggttacttttgtccgtgccatggctcacattatgacgcttctggtcgcattcgtaaagggccggcaccgctcaatttgggtacgtctttttaatgcctaaaatatgcttaatcaacaaataaatggcagttttcctactatttaattgctaatatatttagtaataagattttgtgtgtagaaaaaaaggaaatgggacaaattctcgccgccgatttttttttaattttggcggcgagatcttgtctcggcgagattttggggtgcaccctcagtcgcggatggatttttattcgatacgatggctggaatttgtgtttgctgcaaaatagcaatttattctggaaacatgagcagagttttactacaaaggcacactttgcgcgaactacttatttttcgtcagatttttatgggcctcgattttcttgaattttattccctcctgggccagtcttttctcaaaatgctgtactatttaaattaatattttcatttttgttgtacatttcagaagtgcccaagtacgagtttttgtcggacaccctgatcaaagtgggctccgactgatggcacaataatcggatgagaatggatgtgtttttgattttggagtcgatcgattgactgactgaatgtctctatctttttttttgttcatttgatcggcatcaatttcattgtcattaatttaggagggttgcctggcttaaatcacacagtgtcgttttaataaa

SEQ ID NO: 45706 - DNA, 2162 bp, Heterodera glycines
  Genomic contig location: Contig_ID=SeqID_22263; Location=1..2162; Strand=-
  SCN-specific regions: Sequence locations=1-59,81-339,365-832,855 -867,890-936,958-962,991-996,1018-1132,1164-1316,1347-1568,1643-2162
  Gene Ontology: Mol. function=DNA binding; Cellular component=nucleus; Biological process=negative regulation of cell proliferation
tgtttagactgtcagcgatttgttccaaccccaaattttggctgccatccaacaatattacatccagcagcacacacagcagaacattcaacgtgaaaatgttagttcaatactccgtgccatctttttcaccatttttggcattttcaggcggctgccgtcggcgcccttttgcaagcggtgacaacgaaaagtgccggcgccgcctcctccagcggaaacgcgacgccaattccgttccttccgcccgcgtcatcaacaacgtccgcggccgctgccgcttccaccgcctttctgtccaatttgatggctgccgcggtggccaaacgcaacggaacgccaaaaggggtgagaaaaacaaatttgaaattcttattgtcgtcatctattcgcaataaacaggatgttgtttccgccgagttgccctcttctaaatcgctgctcggctcgcccccgccgcccctttcgctgacgcccattccgtcgcaccaacgcgcgacaccgaccaccgcttcgtcaatggtgcgcgtagtcgccggtggctccgcggtaacgcccagccccggggcgttgaggcgacggtcgccgctgctgcaccacacgacggcggcgagcagttcaatggtcagtccagtgttattcgttggcattaccatgccattttgtgttgtccgttcagacttcgcccaacactctttcctcctccgcctttgtgtcgcccgtccccggcggagtttgctcgcgtcttctgactccgtccggtcgaagtcgttcggccgcgaatgttttgcacggcgtctcggcctccgctttgactccgcgctcttcgcttggcgccgccgccgcgggcgccgtttttccgggtgagaaaaagcattttattaaaattaattgactttgctatttgcagacgatgctgacacaccgggcacaccacctgaagatgaggaggcacagagattggacgaacaggaggaggaggaaggacaacagacagtggaaggcgagggggacggagacgagctgagcgatcggttgatcgtcgtcgacggggacgaagagccgccgtgcgaaccggcggcgaagcgagacccgaaagcgcggaaggaccggtgagcaaagcggggggaacggagcggaaggggagaggagggcagggcaggtgatcggacctaaaactgacggaatggagtgatcggaaggggcatttcgaactgatcgaaaaaggcagacaaaaggcatcacaaacaaacttttttttaggtgtacgttttgccaaaaagtgttcaccaaccgttccaatctcatcgttcacttgcgctcgcacaccggcgaaaagccgtacaagtgaggaggggggggggggagaaggagattggcaaaagactgaattatttatcctctccacaggtgccaactttgtccctacgcttgcgcgcagagcagcaaattgacacggcacatgcgcacccacggacagcagggcaaggaggtgtacaactgcaacatttgccaaatgccattctctgtccattcgacattggaaaaacatgtgaggaaaagcatttgagagagagagcggagagagagaaaaaacattggggagaggggggaaatagtgtgtgagagagagagaaaaaaatcactaggagaggagcaaataccatttctaaattttagtgttttgacatgacaggaacattttcagatgcgcaaatgcgttgtgcagaatggcggcttccaatcacacgaaaaaaggggcggtgctctttcgccgcacgaagaaaaaggcgccgttagcaatggcatttccaattttcggagatgttcgttgtgccgtttttgcgcagttaccttcgagttttaagccgcttcacttaaacacacgccggatgcggccagttcagttgccgcccttttggagctgtccaaagggcctgtttcggtcggtggtgcggcaattggggaggaggaggacggcgcggaaggcgactgcgaccggacggcgccgctggcgaccgcttccgcgacggcgggcgcgccacttccggcaaatattgcgcaaagcaatcggctggtgctcaattggcttcaggtagtgataccatatgatcggaagcggcagtattatttccaaaattggcaggcatgaacgctcaaaa

SEQ ID NO: 45707 - DNA, 769 bp, Heterodera glycines
  Genomic contig location: Contig_ID=SeqID_22271; Location=184..952; Strand=-
  SCN-specific regions: Sequence locations=1-121,144-581,604-769
atggccaacaccaactacggtatccgaatcggtggagcattacggtccgttgtccgtccaaataaatgggggtgctgcagatgaacaccactgggtgcccgtggtccgacaaccgccatacaaggcggaaatgcgcgattttgtgccagacgaacccgagcagcaaatcaaggggcacggtaccgtaatttgccggactctcggctctgtcatactgtaaggctgggatttgagattttccaggcactggcccccttgaggatgtggcgcgacgacaaactaccggtgtcattatgccatcgcctgacggttcgcatcgtccacgtactgaatttgacggcgcccggaagccgcccgcgggcggttttgtcccacacgcgcccaatgttgtacgacgcgcacgaacgcgtgcgccacatgcggatgaggcagcaatgatccattacgaaacggacacggtcacgccaaggcggcggcgacacgctgccgcgtccgattccgcacgcgtgcggcacgcttctgccgcgccgagcaccgcgcgaggcgccgtaatgcagcgtcgtcatgatgtacattcggaagatgatgattatgatcatgatcactatcaacgactacaacaacaacagcatccgccggcggatgattgggacgcggcaccggaaatgccacgacgccatccacgacggcagcacacgtccaccattgtcacgctgggcccactgccgtgcgctgatgtgcggcgaaagattcgtgccattgaaggcga

SEQ ID NO: 45708 - DNA, 1561 bp, Heterodera glycines
  Genomic contig location: Contig_ID=SeqID_22274; Location=686..2246; Strand=-
  SCN-specific regions: Sequence locations=1-137,230-273,302-354,380 -780,803-842,864-902,924-967,991-1561
  Gene Ontology: Mol. function=organic anion transporter activity; Cellular component=integral to plasma membrane; Biological process =anion transport
aagcgctgtccgatcagtcggcgcccggccgtgtgctgttcagcggcaacttctttctgaacaacgccgttgcgggtgccattgaactgcccacactgatcttctgtgtctatttgatgaagtaaattcgttggtccaaaaattttaacaaaaaaaaaatacaaaaatttttttttgccaatttttcattttaaaaatattttattttaagaaataattaaaaattattgtatgcgttgccatagaccctcttttacggtagttttttgtttgatttaattaaattaaaaaaaaattatttgggtttttagcgccacattttcaaattcttaatattttttgtttttgggaattaccttacaatatattttttaattctttaatttgtccataaatctttgagaaaatttcataatatgagcgaacttgtttccaattctttaatgaggtctcaaatttaccccaaaaaaacaatttattgtcttttgtctccaaaaaggtacggacggaaacggtcccaaatcttcacgctggtcgccgccgccattttcattctgtgcgccatggcttcgatgagtgccaaccgttccatgctgtcgctggggctgatgttgctcggcaaaatcttcatccagggcggcttcaacatcctgtacatcttcacctccgagctgtacccgaccgtcatccggaacaggtacgcccggccggtgcccatggtcaaatcactggggcagggggggggggtgtaaaagaggtgggtgggggtcgccccggcgaaggggaaaaagagggaaatttctgaaaaatttggctattttcccaacaaaattacttcattaaaaattctcaaaattttcctcccggcggcgcctatcggcaccgccggcccccaaaaagtcctattcattttttctttaaaaaattggcctaaaatctcaacatttggtcattttttagacaaaatcaaaaatgtttttaaaatgtttgtcatggtaccaatttttgccacacttaataatgtttaattgccttttctaatcattttccctccgttcagtgccgtcggattttgctccatggtaagcgccgttttgcattttctacatcaaaatcatagcgccgatcacaaaaatttgaaaatacactcatccgagcctagaaaagcgtcatttggcatgaaacatcgaaattcattttggccaaaaatgccaatttttgagtgatttagtcaaaatgttcaaatccccattttcaaaaattcaacaccaactaaacttttggagaaaataatccgtccaaggaccggtatccagaaaaaatttgggaaataacggactaaaaaaaattcatttttttggttgtaattttttggcgaatgcccttaaattcacagattgcccggttcggctccggcgtctcttcgtacattgccattctgtccgacgtcacgctgtccatcgtgccgatgatcatttttgccaccttttcactgtttgccggcactttggtgatgttgttgccggagacgcgcgaccagccgctgcccgacacgctgcag

SEQ ID NO: 45709 - DNA, 1277 bp, Heterodera glycines
  Genomic contig location: Contig_ID=SeqID_22300; Location=709..1985; Strand=-
  SCN-specific regions: Sequence locations=1-159,189-450,472-1024,1046 -1277
  Gene Ontology: Mol. function=GTPase activator activity; Cellular component=membrane; Biological process=vesicle-mediated transport
gtacaaagatttggagattaccacaaagaagaccctgcttcactgaaacttaccgacaaattttctctgttcccccaatttatgtttcatttgcgccgttcccaatttctgcaagtgtttaacaattctcctgatgaaactgtatactaccggtttgtgttttatttttattaatgtattttatatatctttttcagccatattttgatgggtgaaaatgtttttgaaagtacgacgatgatacagcctcagctgttctcctattctttcaatggacctcctgaacccgtccttttggactcgtcgagtattttgcctgaccgcattttgctaatggacgatttcttccatgtgttaatttaccatggacaggtcctttcttcttttgcaagtgattccaatgagtaaaataccttttttaagacaattgctgcttggcgaaaagccaattaccaaaatgacccccaatatgcttcgttcaagcagctgctcgacgcccccgtgcaggatgccacggccatcatccaagaccgttttccagtgcctcgatacattgtgacggaatatgaaggctcacaggttttcagaagcggatacagctgcatccatcttcatccaatcttccttttaggctcgctttttgctttccaaagtgaaccccgtcgttgacacacaacaacccgtattctcaggtgaatgaatgaataatattcagcccatttgaagaaattacaatttcaggagggcggtgcccccgtgttcacggacgacgtttccatgcaagtgttcatggaacacctgcgaaagttggcagtttccgcttcgtcatgagtgttgcattgtgcgtggcaaatttatgcgtaaaacaaccataattatgaccatggctgactgaatgtttcccttcgtgacacattgtttcgttgttttttccatcatttcgattgattccatgtgattttgttattgtaataattatattttaacgggatttgaatgatcgaaaatagtaatcaaaaactgagttatttgtttagtattttttatcctcaaatttcattaattaaacctctaattgtaagacgtttaaaatgcatggccaatcgaacaatgcaatagagagatttttaaggacagtggaagtaatgctggacgtccttaaattcatggattattaccagaactgcaaaatggaactgacatcgattggtttcagatcggtaatcgaccgctacagaaacgaattggcattgtgccaattcttccaaattcaactc

SEQ ID NO: 45710 - DNA, 290 bp, Heterodera glycines
  Genomic contig location: Contig_ID=SeqID_446; Location=1854..2143; Strand=-
  SCN-specific regions: Sequence locations=1-140,162-290
gtcttcaattctacgaccaggcattcgaaccgcatcccgaagtccaggaggcattgcgccggcgccggcttcgtcttaaggacccctaccaggtcggaatggggaagaacagccaaataaaatttcccgaacaattatatatcataattcattgaaaatattcggtctgtccctaatttcagtacgatcttcgtctgcagcgtattcttttggccagtcaattgggctcaaagaatgagcgactgccgaagaacatgtggacaaaatgggacgacgagacatttacctga

SEQ ID NO: 45711 - DNA, 4231 bp, Heterodera glycines
  Genomic contig location: Contig_ID=SeqID_4056; Location=3057..7287; Strand=+
  SCN-specific regions: Sequence locations=1-204,237-585,607-1320,1362 -1502,1524-1722,1778-2032,2061-2783,2811-2964,2995-3468,3492 -3882,3907-4152,4183-4201
  Gene Ontology: Mol. function=chaperone activity; Cellular component =ribosome; Biological process=protein folding
atggccttggcccattacggctttttggcacccaaacgacgcattgaaccggccggcatttcttatgaattctcgttgatcaaagatcggctgatcctcggcctttccacacttcccgtccttcaaattgtctttcaaaacagcaggacgacggatggcgacgacattgacggagccgctgttagtggaacaaaaaatggcatatattggccgctttattttcttgatcaaattttttgtttggatttcaatgcgttaaaatcataatcaacgcggggaaggctcaacaaattggttaaaattaagggtactttccagttctggggccccaattcattcgaatatttgtcttacattcaaccatatcttctaggacagtgtcgattggcttgaccgagatgactccaagttccgcaaatacatttcccggttggaccccaacgagtggaaaaagcaagaccagtaagttatgcactgttcgctttagcaattaaaattcaaatgcttttcagctacaaagtgctcggcttgtcaaagttgcgctaccaagcgacggcggcacaacttaaaacggcgtgtgagtgcaataaatttgtaaaaatagaattcgacttggacccggaccaaggcctggattttctctgtccatgtcaaggcttttttcaaataatcgaaccttaataaaaaaaaatctagaaaagtaaaaaaatgttttagacagacgcaaagtgttgaaatatcatccggacaaaggcaaagcgacggagactgaggacaagttgcttcgcaatgaagcagtttttgcgtgcattcaaaaagtagggaattggaaaacattttaaaaaagtttagccatttaattttttaaaccatagtatgacaaaatgttgcccgattcgtacaaaaatgtgatttttcagaaaaaattaattagtccaaatggttgtcagattactcggctccaatatcatagccttttatttcgttcaaaaagggcccgccatttgcggtactcccccaattttgattgtcttcaatttttaggcctacgaacaattgggcctttctgaggagcgtcgccgtgccttcgactcggtggacccccaatttgacgactcaatgccggacagtgtggacactgccaatttctttgaactgcttggacccgtttttgaacggaatgccaggcaaaacattgctttttattcaatttaatactcaattccggtgggttttcccttaaaatccccgatttgcttaggttttccgtcaatcagcccgtccctttgctgggcgatgaacacaggtaaattttcattctgtcccaaaataccaaaacaaaacatttggcatttatttgtttgcgctgccccttttctagcgatcgcctccacgtggaacatttctacgaattttggttcgattggcgttcctggcgagaattttcctatttggattcagaggacaaagccaagggggaggaccgatgggagaggcgggaaattgacaaattaaacaaagtgcgaatgtggtggggtgggggcggaccaggaaaaaacgtcgccgccgaacttaatacgaaaaatattctagaaaaattcaaaaaaaaatgttatcaagaaaattcaaggaaattttaaaaattttaaagtttttggtttttttccgaaaattcagcaaatttagtttttattaacacttagattttcaaaaaactaattgtaaaatacttttaagtttttttgaaattttgaaaattttttaatttattttaaatgaaagagcattttagggccaaaaatagaggattttccctggtcttccgagtctgtacgagagggaattagcaataaaacatttcttgtattaataatcgcttcattgttcaggccgaacgggaaaagcgacggaagcgcgacctgagacgcatttcggcactcgtcgaattggcctactccaaggacccgcgcgtggcccgttttaaagtcggattctgacgcgtctataaatattgcatttacaaattaacaatttctttttaaatcattttcaaaatgtcttttttatattctttaggaggaggacaaacggtcaaaaaatgcgcaaaaagagcggcggcggatggagcgcgaggcgcgcgagcgggcggaggcggacgaacggcgtcgcgcggaggccgaggcggcgcgggagagcgaagcgcgggcggaggagcagcggagggaggcgcaggtcgagattcaaaataacagagaaaatgccgcggcatttgtggactgattactgacaatttgcaatcatttccattcagattcaaaatttttgcgattttttcaaaaaacccattcaaataaaagtattgggtgtgatcaatgctttagttttccaacatcttttttgattaccgtacgagaacttgaggttactgtatgctattcaaaaaaatctttttttgttttaatttatgtaaattttcattttaagaaatatttgtccccgttttcaggtcaaacagcaacggaagaaggcaatggcagcacaacggcgccaacttcggacgatggcgtccaatgcaaattattggatggaaaacggcacggcattggacaaccgacggatggcatcaattgctgagcaaattgaaaggtggagaaagtttccaaaaatatcacccaattatgtcaaaatagcatgccaaaggttgtgactgatttccgattttttaaatattgttcgtgtgaaaaagccggcatttccatcgtctaactgaattcaggagtttcttgtgcccctcttttcccaccccttggctcattcccaaataattttttagaatttgtctgtccgctgaattcgacgaattgacggcactctgtgaggggttggccatcgtccaaacatttgacgaggcacagaaactgctggtggaatgtgtatgttgtgtttctcaattctttttcaatgaattttattaaatttaatttttaaattttaggcaattaaaaaagatttcgccgatggaaaggccggcggcgaagggccgtcgacaaatgcgcagaacaaagcgccggttgcatcgaaaatttggtcaatgaacgaattgcaacttttgatcaaagccgtaaatttgtttccgccgggaaccaacgaacgatggaaggtgaacggaacggacgaaactgaattggaaggggggaagataaatgggtagtaaatgattaccagacccggaaaatttggtccaccgattaattggtcggatttacactcccaaccccctgaatcataaaagccctagaaaatttcataggaattttatctatttttcttgagatttcaatgtaaaaattcaaaaaaaaatttcgggggaatgaaacgggagaaaatgacggatgggcgcacgaacagcttccaaatgaaatgcaattagaaaggaatttcggaactgttaattttaccaaaaaacggacaaaacattttttaaagcaagtggccgagtacgtcagcagccatggtgaccaacagcgcactgaacgggaagtgatcagtcaggtaacagtttaattgcactattttagttaattgattacccattttcatcgacaaacttttcaggttaaactgctcaaatcaaatccatcctcaaatttggcgccgccgccgaccgtagtgactaaaaatgccgaaacgaatgcctcggcgacattgacggcaccgtccgctgcatcggatgaccaggaatggagtgccgaacagcaaaagtgcgtcgagtttatttttggaaattctcggaaaggcttgaccacgataatttacaataaataataaacaaatagtgacatggagggaaattttcaaaaaatatttcgcaaattgattttgaatttattattttttaattttatagaaggggaaccctctagatcaacatagcctgatttttggtggggcgtacaccgttccaatttttccgtgcgctctttcgttcatacatattgggtcccaattttggcattttgtccgttcattaaatttttttaggcaattagagcgcgcattgaaggcgacaatttctgtcgatgcgaaagagcgctgggacaaaattgctacgatggtcgacgggaaggacaaaaaggagtgcatccgacggtacaaaatggtggcccaactggtgaagaaggcaaagatggacggtggtggtggccaacaacagcagcagcagcagaaataa

SEQ ID NO: 45712 - DNA, 3874 bp, Heterodera glycines
  Genomic contig location: Contig_ID=SeqID_4058; Location=272..4145; Strand=+
  SCN-specific regions: Sequence locations=1-303,325-421,443-1214,1236 -1509,1531-1627,1649-2426,2448-2835,2857-3634,3656-3874
  Gene Ontology: Biological process=gametogenesis
atggacggccacccggtggatggccgtgtttccgcctatcaccatgtgagctccaacatagggaccccatcaggacctaaagacactatcacaacaaagctcacttcaattttcaagaagacaaccgctcatgaagacgagtacccgcccaagactgagcctttcctgggaccggtggcacaaacggatcgccaacgggagttggaagccgttccggtggtggacaggattgaacggatacccaaagggttggtgaagtgcgaaaatagtcataataaaaaaagaaaaccttttttggtttatccatgttggggtggggtggtctcgacaactaacacgggaaaaagccggccaacttttatgttaaaaatgcaaatgttctggcataatagacttcgactaatggggaatgttagagccatagaattttgaaaaattttttgatcacggatttccagcttctacgaggaaggcgaactgcatccagtggtggtccatgaggagaaggaattgactccgtctgaggcggagaaaaggccaggaacattggagcgaattacgcacttgttcaagcggacagccacagagggagagtggccaatggtcaccgagccgttcactggaccgcatgctgagacatcccgaaagggggagcttgaagcacgcccgcttggcgaactcgtggctgcctatgcttccggccgttctgacgaagtcggtccaatgcaaacgattgagacgcaggctgcgacgacaactgcgcgtgaacattacccggcaacagtttcctatgaaggaccgctgagcgcaacaacacggaaatgggagctggaaggcgctccgctgaactcacatgtgactgtgtaccatcatggccgctctgatttggcagcagctgagcaacaacaaccagtcgctgagaaagtcacaacgaagataagctcattgttcaagaggaagccacaccatgaggacttcccagtctcggagcccttcactggccaattggaagagacggcaagggtttcggagctgttccacgaaccaatcgacgcaagggtcagcgtctactcggccggaagatctgatgagcatgtcgttgtccagccaacaacaattgctgaggcggagcccgtaccgctcgttgagtacccgcgcacgacagcatatgatggtccactgcaaagcacatcgaaaggagcagaaatggaggggcagccgttggatgcacatgtttccgcctatcaccatgggcgctccgacatggcacccccagcagcaccgaaggagacaatcacaacaaagctcacttcaattttcaagaagacaaccgctcatgaagacgagtacccgcccaagactgagcctttcctgggaccggtggcacaaacggatcgccaacgggagttggaagccgttccggtggtggacaggattgaacggatacccaaagggttggtgaagtgcgaaaatagtcataataaaaaaagaaaaccttttttggtttatccatgttggggtggggtggtctcgacaactaacacgggaaaaagccggccagcttttatgttaaaaatgcaaatgttctggcataatagacttcgactaatggggaatgttagagccatagaattttgaaaaattttttgatcacgacaatcgatttccagcttctacgaggaaggcgaactgcatccagtggtggtccatgaggagaaggaattgactccgtctgaggcggagaaaaggccaggaacattggagcgaattacgcacttgttcaagcggacagccacagagggagagtggccaatggtcaccgagccgttcactggaccgcatgctgagacatcccgaaagggggagcttgaagcacgcccgcttggcgaactcgtggctgcctatgcttccggccgttctgacgaagtcggtccaatgcaaacgattgagacgcaggctgcgacgacaactgcgcgtgaacattacccggcaacagtttcctatgaaggaccgctgagcgcaacaacacggaaatgggagctggaaggcgctccgctgaactcacatgtgactgtgtaccatcatggccgctctgatttggcagcacctgagcaacaacaaccagtcgctgagaaagtcacaacgaagataagctcattgttcaagaggaagccacaccatgaggacttcccagtctcggagcccttcactggccaattggatgagacggcaagggtttcggagctgttccacgaaccaatcgacgcaagggtcagcgtctactcggccggaagatctgatgagcatgtcgttgtccagccaacaacaattgctgaggcggagcccgtaccgctcgttgagtacccacgcacgacagcatatgatggtccactgcaaagcacatcgaaaggagcagaaatggaggggcagccgttggatgcacatgtttccgcctatcaccatgggcgctccgacatggcacccccagcagcaccgaaggagacaatcacaacaaagctcacttcaattttcaagaagacaaccgctcatgaagacgagtacccgcccaagactgagcctttcctgggaccggtggcacaaacggatcgccaacgggagttggaagccgttccggtggtggacaggattgaacggatacccaaagggttggtgaagtgcgaaaatagtcataataaaaaaagaaaacctttttttggtttatccatgttggggtggtctcgacaactaacacgggaaaaagccggccagcttttatgttaaaaatgcaaatgttctggcaaaatagacttcgactaatggggaatgttagagccatagaattttgaaaaattttttgatcacgacaatcaatttccagcttctacgaggaaggcgaactgcatccagtggtggtccatgaggagaaggaattgactccgtctgaggcggagaaaaggccaggaacattggagcgaattacgcacttgttcaagcggacagccacagagggagagtggccaatggtcaccgagccgttcactggaccgcatgctgagacatcccgaaagggggagcttgaagcacgcccgcttggcgaactcgtggctgcctatgcttccggccgttctgacgaagtcggtccaatgcaaacgattgagacgcaggctgcgacaacaactgcgcgtgaacattacccggcaacagtttcctatgaaggaccgctgagcgcaacaacacggaaatgggagctggaaggcgctccgctgaactcacatgtgactgtgtaccatcatggccgctctgatttggcagcacctgagcaacaacaaccagtcgctgagaaagtcacaacgaagataagctcattgttcaagaggaagccacaccatgaggacttcccagtctcggagcccttcactggccaattggatgagacggcaagggttacggagctgttccacgaaccaatcgacgcaagtgtcagcgtctactcggccggaagatctgatgagcatgtcgttgtccagccaacaacaattgctgaggcggagcccgtaccgctcgttgagtacccgcgcacgacagcatatgatggtccactgcaaagcacatcgaaaggagcagaaatggaggggcagccgttggatgcacatgtttccgcctatcaccatgggcgctccgacatggcacccccagcagcaccgaaggagacaatcacaacaaagctcacttcaattttcaagaagacaaccgctcatgaagacgagtacccgcccaagactcagcctttcctgggaccggtggcacaaacgaatcgccaacgggagttggaaaccgttccggtggtggacaggattgaacggatacccaaagg

SEQ ID NO: 45713 - DNA, 1627 bp, Heterodera glycines
  Genomic contig location: Contig_ID=SeqID_22356; Location=472..2098; Strand=+
  SCN-specific regions: Sequence locations=1-1,24-130,153-317,351 -703,732-834,878-996,1019-1201,1228-1337,1363-1606
  Gene Ontology: Mol. function=ATP binding; Cellular component=membrane fraction; Biological process=signal transduction
ttggtcgtcgtcggtgacggcggtgttggcaaatcggtggatggaattttttggcattttttactggaaaacattgacccccacttttaggcgctgaccatccaattaatccagggccaattcattgaggagtacgacccgaccattgaagactcgtatcgaaaacaggtttattttttcgctccgcgaaattagctaactcgaaaaaagaattttgacaattccttagtaaatggtttttttttctttgaaaattcactgattttatggacccattctaagcctttttaggcaatggtaaagaattgtgggcccggatttatttttaaaaaaaatttattttttattttgctcgaaaccaattttaagaggttttcgagggtgctgattacgaatctcaactcgttttttggggggtaaatgcttctaattcatttaacaattatttttttgatgtaaaacaatgcttcaactgttaattggataaaaatgcgcaattttcgccaaaatttgaccggttataacttatattttggaaaaaaaattttcaactttttgttcgaattcgggtccggggttcggaattgggcaaatccgagttcagattcataatcagcaccctcgaaaacccccggaaactgaattttagtccaaaataaaaaagttaaaatagggggcactatatggaaagtgacagtttttgaaaagtttttcaaaaggggggaccctttttgtgatagtcataaaaatttattctctggggtttttggggtccccgatcacgaatccttcaattattttgatcaattccgatttcctaatctaaatttgaacaaaaaatcataattttaaaaattcaaaatttcaatttttatttgagttcgggttagggattagaaattagtcaaaatacatgtcagattcgtgattagcaacctttaaaaccccggataaaaaattatcatggttttttatcttaaaaaaattttgcaaaacaaaagggtccccccttttgtttcaaaaactgtcaatttgaacaaaaaattgtcgtaaacattcgaattttcgagtcctcttttttccaaagattgttatatgacttcaaccaaatagcgcccacccgtaaaactataattttatctaaagagtttgaattttcgacaattttttagtgacgtaaatccttactctttgtcgccgcaataaaaaaaatatttaaaaaattttgcattaaaatttcagaaatttctttaggtacttattgacggtgagacttgtttgctggacattttggacaccgcaggacaggtatactgaactcttccgtctaacttagcaaaaaaaaaaaaaaattttttttttggcgaccatcaaaataccgaggctttcttggttttttttttgagatgcattgacaatctgcaaaaagccacttccaatccccctgtcctccataggtggacaagggggggggtcaatttcgtaaatcgtacgattggttagccaaaatgcgtaaagacgcgaccaaaaaaaaaattttttttttcagttttggctttttttaaatttatttccatccttttgcaggaagagtattcagcgatgcgggatcagtacatgcgcacgg

SEQ ID NO: 45714 - DNA, 1177 bp, Heterodera glycines
  misc_feature (1023)..(1023): n is a, c, g, or t
  misc_feature (1053)..(1053): n is a, c, g, or t
  Genomic contig location: Contig_ID=SeqID_22383; Location=165..1341; Strand=+
  SCN-specific regions: Sequence locations=1-148,206-214,238-522,545 -922,945-1177
  Gene Ontology: Mol. function=phosphatidylinositol 3-kinase activity; Cellular component=plasma membrane; Biological process =phosphatidylinositol biosynthesis
atgagcgatatttggctgagtgagcagctcgaccttcgcatggtgctcttccgctgcttgccaaccggcagcaaaaagggattggttggtcacggcaatttgcctaattattgcaactattttgatatactggtttccattttagctgtttataattaaattaaaattagtctttttgaatgtttttctaatatttttaatttttcttctggcgctttaaaataatttttaaactttgtctcgtcaatttaaatgactatcataacatttttaacagattgagcttgtgcccagctgtaaaacattgcgcgagattcaaattgtcagctcgggtgccgctggcgtgttcaaagacgaagtgctcaacgaatggttggcccggcagaatccgtccgaattccaatataaggcggtcagtaattaagcaattttttcaggttttcaaattgattttcaaggctttggaaaatttccggcgttcgtgtgccggttggtgtgtggccacttatgtcctgggcattggcgaccggcacaacgacaacattttggtcactaccaatggccacgtgttccacatcgactttggcaaatacatgggcgactggcaaatggctgccggcttcaaacggtgtgcaatcattgtgattaaaatccattctctcaaatttaagaattcgaaaatggaactaatctattctattggattataaaatgaattgaaatttcaacgaaattttctttaaatcttgctggggaacagaatttggtagcctaatagaagacctaattttggttagatttctcttggtttatgtggtaattgttgtcaaaaatgtgaaaaattttataggccctaaaaatgcctaatttcttcgccattcccttaaagtgctcttttaaacgctgtttcacccttcagctaattaattaccaccccctccctaaattcgcttgcagagaccgtgtcccatttgtgttcactcccgaaatggcctatgtgatcaatgggggccaaagctcgancgaacacttccagcgatttgtggatgagtngtgccatgcgctgaatctcttgcgaaaaagtgcgccgaccgtactgaacataatgcgctttctgagctgctcggacatccggggaatgtccatggaatcagtagtaagctgaattataataata

SEQ ID NO: 45715 - DNA, 1010 bp, Heterodera glycines
  Genomic contig location: Contig_ID=SeqID_22384; Location=20..1029; Strand=+
  SCN-specific regions: Sequence locations=1-395,419-1010
atgcttttcacccaaatgatcatggattcgctgcagagcaaattccctcggctgaatttcctcgcccacacattggcccaatttcggggaaatcccctcgggggccgaagcgaggacatgaacaggctcagcttcatctccgaactttacaagtgagccaggaaagtgatatcaatcagcagcataaggcacagcaagattcaaggacacaaaattgattaataacttaaaaggacattgaaacaatgcccaatcgggattcgggatttgagatggggttgccaattgaaatccaatgccaatgacgatcattagagctttgaccaaattgcatttgaagtgcacgactttgtcctaaataattcactccctctccaattactttaaatttaattgctaaattttaaatttttagcgaaaagaatgaaggtcgtcttgagtcggtgcatgtcaattcgtacgaaaaatggaaaaacccggagaaaatttatgtaagttttgttcatccgccatattccttaagcttaagcaatgacataagataaacggataataatggctcattttgcccccgccctttctcagatgtacaaattgttggtgaaacggcagcaggaaaatgtgaccacggtgatattccggtaataattaaaaccggaggaatgcagtaaaacaacccgtaatcagtgacttggaaatcaaaaatttaaaatcccgaaaattcttttccttacacaatgcccatgtgcgcaggtcctttgccgagttccaagagttgcactggaagctgtgctaccgcttctccagccgtgccattccccaactgtgccaaacggtgaccttcggccgcacaaacattcgcacggtcgccgtgcggcgtcaggtggacctgcagtacttcttgcagcgcttgttcgccctgtccgacgaggtggcacactcagagttggtctacacgttcatgcactccatctaccgcgacacggagcccgaggcacacaaacagagcg

SEQ ID NO: 45716 - DNA, 2849 bp, Heterodera glycines
  Genomic contig location: Contig_ID=SeqID_22415; Location=1..2849; Strand=-
  SCN-specific regions: Sequence locations=1-18,60-257,279-316,338 -360,397-624,708-834,880-902,946-1028,1090-1125,1148-1201,1227 -1227,1316-1316,1375-1475,1506-1536,1582-2299,2321-2760,2782-2849
  Gene Ontology: Mol. function=DNA ligase activity; Cellular component =nucleus; Biological process=DNA replication
caaaacccgggaccgggaaccgggacctcggatgaccgggaattcccggcccggtcccgtggcactctagttttatcttataacttttcaaaacaatttttcgtgcttttcaagtaaatgtaaaaaaaaaatcataaaaacccgaatgattgatcgattcgaatccggttttttgggttcgacgtgaaaaaagctcagcaatacgacagttctaaaaaacaatgggtttctgggccacagaccggtttaaaactggaaaaacaagttttggccgtttcgacccaaaccggttcaagaatttttttctccacactcctgaaagttggccaaaattttttgatgctattttgtagaaaacagataaatttattaaaatgatacaaaaaaaaaatttttctcagctaaactttaagttttttttggtttaaacaaaaaaacgacaataattatgcgccaacccaataacatgcagaaaaaaatttaaacgtcacgaagcaaatgctgtctttctattataaagagatagtacgctaaagtcagaaaaaattataaagaaaaagaaaacgggagatagtactaggcaataaaaaatgggatgtaaaaaagggagggatgcgagacaaatttccctctgtatctcccttccctttcttttactctcgtttcttttcctttgccatttactctccctttttcccactcactccaaaaacccgaattctagaaaggataacgacttcgcttgaattcttctgaaaatcaattgtttgttttgtcgtttgtcgtcttcaatatattcgtcaacaatttttcatcccttgcctttgcatttgctcgcggcgtcccttttttgccgaattttcgacgctttcaatttataaaaattaacagaatggcatccattgaagagattattgagacgaccaaatggaaggacggacagaagttggtttttagaatttcatattgttaccaattgggcatttgcattcatgccaatttctgctcatgactttctcttcttccagaattccttatcttgcacttgctaaaacattggagcgcattgaggcgacctcctctcggttggaaaatgtctgttgtgtttaagtcaagcttttatcgatagaaattgccctgaataatttattcttgaatctttcgtccgggcgcaccctttttactttcttctcatcttcagattcgcattctcagtggttttttcggcgctgctattcgcctttctccgtccgatttgagtcccgcagttcatttatgtctcaacaaactcgggccgagctatgagggacttgagctgggtatcgccgaggcgtaccttatcaaagcgttggccggggccaccgggcgaacggttagtggtcaaatgcatagactttggcgatttatcgctattaaaaaaaattagttcaaattccttagattttcaatattgttatcaatttgaatgagttttaggtagacatgatcaaaaaggacctcaaagtgaagggtgaccttggcattgtggcccaacaaagtcggtccacgcagcgaatgttggccaaaccgccgccactgactgtgccgcttgtcttcaatcggttgcgtgaaattgccaaaatggctggcatttcggtcggtaatttgaagagtagttcaggttaataagcaaattcaaaactttcttaagtttccggattccctgattacaaatatgaaattttgactaaatatgaatctgaaatccaacaaatagtcgaaattttaaaatttcgatttcaagaaaatgtgccagtattaccatccccatttttatgatcctttaaattaaaaagtcaatggaccgaatccttcgttttgcgcttacttagtctatggacaagaaagtgaaggcaatccaagctttgctcgtcccgtgcatcgaatgcgaggcgcgcttcctcgtccgctgtttgcaagccaaactgcgcatcggattggccgaacagtctttgatcgtcgcgttggccaatgcatttactaagacagaacttagagaaaaaagtgatttattgagtcaaatgaaatgcacaaagttcaatttccagagaaaaaattaagcgacgaaaaactcaaagatcggatggctgaagatgcgcaaacattgaaaacagtttacaggtgggagagttgaatatatttttttcgggatttgtcatgggtacgtccgtttcgttaatctcagcgagttgaggcactgttttcctaaagatttaagcatagctcatgttttctgaattttctatagtctcagttttcgtaaaatattacattttttatatccctgttttcgaatcgttctcttttttcagtgagtgtcccaacttcgaccgtatcattgaggtggctctccgttccggcatttcttcattggcggatgaatgccgtctgacccctggcattccgctgaagccaatgttggcgcacccgaccaaaggcattcaagagttgttggaccgttttggcactgctgaatttgcatgcgaatggaaatatgacggcgaacggtgtcaggtgaaccctttgaaatgctggggaatagtgaaatttatatcactattgcatttaaaaagttgcagattcatcttttgtcggatggcacctttaaaatattcagtagaaaccaggaggaccacaccggcaaattcccggatgttgcgcgacgctttccggacgcactgaaaaggggtgaagtgactgatttcattgccgacggagaggtggaagcaaatgaaactgaaaatgctttattttgttttccgttcgtttaggtagtcgcttgggatccaaaacagaagcaaattctgccg

SEQ ID NO: 45717 - DNA, 1045 bp, Heterodera glycines
  misc_feature (793)..(793): n is a, c, g, or t
  misc_feature (800)..(800): n is a, c, g, or t
  Genomic contig location: Contig_ID=SeqID_22482; Location=1374..2418; Strand=-
  SCN-specific regions: Sequence locations=1-211,233-675,699-763,790 -829,852-1045
  Gene Ontology: Mol. function=protein kinase activity; Cellular component=transcription factor complex; Biological process=G1 phase of mitotic cell cycle
atgcggccacccgttgacgaggattatcgcccgatccgcgtacttggccaaggcgcgtacggcgaagtttggttggtgaccagcaaagaaaatgagagagagcaggtggggaagggcgggggagaagtcgttctgctgattgttcaactgaacgtgtttaagttcgccatgaaaaaaattcccgttaaagcgacggaggagggaattccgcagagtgtcgtcagagaggtaaaaaggcagtgaatccgtttttgcttctttcggatggcatttccactaaaccgctttggcatggcaaaatcaccgaaacaaattcaggtcgcttctctcgtcgcactcaaacagatgaaacacccaaatattctcaggcaaatttctgtttttgcagtttaattattcacacatccaaattattaaaagtaaaagattaaaagtctgtgttcttttctaaggctccacgacgcattcattcgccgaaagggcggcaccatcagtttgaacatcgtctgcgaaaagtgcgactgggacttgtgcgactttttgcgaaaaattccgaaaaatatgtgcgacgcgcagtgcaaatattttgcacgtcaaataatgacgggcattgtgaggaattgatttgtttttgacaattaagaaagcaattacttaattgccttttccgacattttcatttatgtcagtttttgtttaggatttccttcatgccaacagtattattcaccgtgaccttaagggtttcatggcgtcctttttgacacttttttcccccaatttttagcctcanaacattntggtgaacaagacacactttgcgggtgagtaaatttatttatttttttattctgctcaaatttcgaaaagctttgtaaatgattaattcgcttacctctctgttttcagatcgccgatttcggactgtctcggaactacggtctgcatgccaccttcaccaccgaggtggtcaccctgtggtaccgtagccctgagctgctgctccagtgcaagtacggtactgcggtcgatctttggtccgccg

SEQ ID NO: 45718 - DNA, 1157 bp, Heterodera glycines
  Genomic contig location: Contig_ID=SeqID_4104; Location=1..1157; Strand=-
  SCN-specific regions: Sequence locations=1-570,606-959,983-988,1010 -1013,1035-1157
  Gene Ontology: Mol. function=Rab GTPase activator activity; Cellular component=membrane; Biological process=positive regulation of cell proliferation
cagtaattattattaatgattcatcaaatgaatggcattcagcatgagaagagagtgaagaaactgctgcaaaaggcgcgcgagtcgagtccgactttgcccacctttgaaaggtgtgctgttccgtcccctcttcactttactgtccgctttagtgttgtccgaagcggctctttccacgtcgatgagtacggttttcgccattctttcgcagaaattccgttggccgtccatttcatcgccactcagctgaaccagcactatcagtccaagtcgaccggtcatgctcagctgaaggccaattggcgtgtgctgctccgggaacaaccagaacgccttgagcgatcggtcggtctttcgaatgccattcgaccattcgtcgcccccccccgcccatttcagcgtgaaattcgcctcctctgccgccgtggcattccgcgcgctcttcgaccccgcgtttggcgtcttctgatcaatcagcaagtggccgatctgaaggaaaagcacggccaatattattacaaaaatttgtgcagttcgcagggaacggcggcggaaaaacacgtgagcaaagcttagaattcaaaacaaaaagagaaaaagattgacttctccgcttcagtacagcagcgcccatcaaaagcaagtgaatttggacttgctgaggacgatgccgagcaacgttcactttatgtccgcctcttgcaaaggcgtcactcaccttcagtccgtcctccgtgccttttgtctgcacaatccgagcatcggttattgtcagggaatgaactttttggtggccactgcccttcttttcatgggccccgaagacgcattttggtacatttggccaaggattttctcaaaagctttgcctttcttaggtttcttgtggcggtcactgaaagatacttcgactcgtcctattttgaccagacactcaccggggcacaagctgatcaagtgattggaaggagaagggcaacggaacaaagcttttgtcccccaggaagtgctgaaggaaattgtggagcagaagttcccccgtctcgcgcagcatttggacgagtgcgaaatcgatttgaccacggtttttcaaaatggcgtttctttggcatttttgctccctaaggtgactctgaattggttcatcgctctgt

SEQ ID NO: 45719 - DNA, 1478 bp, Heterodera glycines
  Genomic contig location: Contig_ID=SeqID_457; Location=5717..7194; Strand=+
  SCN-specific regions: Sequence locations=1-499,521-601,623-650,674 -1220,1259-1478
  Gene Ontology: Mol. function=casein kinase I activity; Cellular component=bud neck; Biological process=signal transduction
atggaagaactcgtggcgctctcccctggaatccgcgtcggccgctggacgatcacaaagaagctgggcgccggagcattcggagccgtctacctgtgcgtgaacgaccaaggagagcaggccgcgctgaagacggagccggtcaacacgccacatccgctgctcgtcatggaggtaggcgggggaggaggggcggaaaattggcaattcaatttaaatttttttttcaccacccaggctcacgtgatgaccaagctggacgcccttcgagacggagacgggaagcacttctgccgctgcttggacctcgggcgcgatgagcaaagggaccaacaatcgggacaaatgaagaagttcaactacatcgtcatgtcactcgtcggtcgtggcctggacggagtcgtcaaggatgccggtggccgcctcagccttggaagcgcagtcggcgtctcgatccagatgctcgccgctctcagaggactccacaccgtcggctacctccaccgcgacatcaagccgggcaactcgaccatcggacgtccggaatcaaacgaaatccgcctgctctacctgatcgacttcggaatggcgcgcaaatacaccagggacgacgtgagtttgagtgaagcgctttgaaaaaacaaaaataatttgttccctttcccccctttttcaggggagccaacaccgcccgcgcgctgtcaccaacttccgcggaagcccccgttacgctgcgatcagcgctcatctcggacgcgaatacagccgcaaggacgacatcgaatcgtggttctactgcatgatcgagctcttaaaaggcgcacttccatgggccaacgtgggggaaatgaaagcggtgagcgaatggggggggagggataatcagaattctgatttcattgtttcttttttacagataggcgaggcaaagatcaaacgccagaagaaacaaccggaagccgttcgacgccaggcaatcgccgacttgctctccggatgcccgaacgagttcggccaggtcctcaaatacatcgtgagttcgttcgttcgttttttccaaaattaataaactaacaaattaaattttgcaggacgacatgaagtacaccgacaagcccgactacgactggatcatcgcgacattgcgcagcagcctcagcaacgccggcgtccaggaattcccctacgactgggagacgggcaagcgcaacgcggcaccgggcgctggaggcggcggaggaggagggggaggagacagctacttcaactgatgagccgtgcagcagcagcagcagcagaagaatcgccaagaagcgtcaccgtgctgaattgatcatatgaccactattactgtattgtatgtattattttgtgtccatgctgccatccccgatatacacatgtattgtattgttgacatatgtattgattgaaattgttgttgcataactgtgtttgtacatatgacttttggcgaa

SEQ ID NO: 45720 - DNA, 1672 bp, Heterodera glycines
  Genomic contig location: Contig_ID=SeqID_22544; Location=1..1672; Strand=-
  SCN-specific regions: Sequence locations=1-259,285-420,448-543,565 -727,749-800,822-1446,1480-1508,1532-1672
  Gene Ontology: Mol. function=protein binding; Cellular component =basement membrane; Biological process=cell-cell signaling
agctgagggtaaacttaccagttactcgattcttttagtgcgggttaaaagttacccgcagctgatttgtgagggtaactttacccttacctcgttcttttggtacgggccctcaaattgttctccaatttctcatcaaaattggctccattcgccgtatttgcataatccataacgttggccattggactcccataatttggcacttcgtttggttttttccatttggtccgatcagtctgatcatcgtctaatctgccctcctcctcctccttctcctcctctttcatgccttccccgactttcgtttcagtttctgtgtgttggcaaactccgctgaaggccttctccgggaaaagtgcgaattgtgcgacccatcggtggcccaattggcccatccggcggcactgctcactgatctgaacaatgccaacaatttgacttgttgggtcagcgaaccgaccaccgcatttccccacaatgtttcgttgactttgtcattgggcaaaaaatttgaagtgattaattttcctaagtttcgttgtgtaattaatgatgtcattaagatcacttatgtatcgctgcatttttgcggccgtttggccgattcattggccattttcaaatcggcaaataggggtcgaacttggacaccgatgcaattttattcgaccgaatgtgaaaaagtgtatcaaaggacgaaggaagtgccaataagcaaagagaatgagcaggtgggagggatgagacagatcagacaaaatcaaagtgatcagaccaaatgagagtgatcaaaacttaaagtgatcagacaaaaggaaagtgatcaaattgaccgtatcagctgaaacacccaattagacagacagctcttacaaattgaggtcgcccgttgcaccgattcgcacattttgtcgcctctttccgatcgcatcgctttcgcaaccctcgaagggcgtccatctgcgatggaattcgaacagtcgcccgtccttcaggcacggcatttttccattttgttggaatttcttttttttaggattgggttacggccactgacattcgcgtggtgttcaacagactgagcatggatcaggcaattctcaatgtaaagtggcggacactgaaattgatcaaagtttgtaggccgaattatatggattggctgaatccgacaaaatggccgagcgaatccgaagggacaacggatcggtgttggaactgccggagcctgacagagtccgggaaaggtatttttatgcaatggccgagttggcagtgggcggacggtgcaaatgcaatggacacgccagcagatgtgtgatcgaccgaatgggacggtgagcgggggcgggggactgatcagaaaggaggaatttgggaaaaataaataacggaagggggggggagggtgaaaagaacccattgaattgcatcattagcaagaaaaataatttttttttttaaataaaaaaaaaacattcttttcgtgttacactttttgttcgacattctttctttctcttcttctgatcagtgccttttatccatcccatccgttcagatattcctgtgactgtaaacacgcaaccaccggattggactgcgagaaatgccgtccctttcacttcgatcgcccttgggcacgtgccactgccgatgatgcgaatgc

SEQ ID NO: 45721 - DNA, 1293 bp, Heterodera glycines
  Genomic contig location: Contig_ID=SeqID_4120; Location=1..1293; Strand=-
  SCN-specific regions: Sequence locations=1-291,313-329,351-818,841 -960,995-998,1026-1293
  Gene Ontology: Mol. function=pre-mRNA splicing factor activity; Cellular component=spliceosome complex; Biological process=RNA splicing
cacttcatgtgaaatactctatgagcgcatgaaaaagttgggttccgatgtgcccgagttgatcattctcccggtttacggcgcattgccaagtgaaatgcagaccagaattttcgagcctgctccccccggcacgagaaaggtatgtgccgtagtttgtcgatattacaaattttgatggtttttatttttgggttgtcattgcgacaaatattgcggaaacgtcacttaccatcgacggcatttactatgtggtcgacccgggttttgttaagcaaaagatttacaacccaaaatcgggcatggactcgctggtggtgacgcccatttcccaagctcaagcagcacaacgcgccggacgagctgggcgaaccgggcccggcaaatgttacagactgtacacggaacgagcatacaggcaagaagcaataatttaacaaaattcggaattaaaatattttaatggaaaattttgcacattcagagacgaaatgttgcccacgccggttccagagatacagcgaactaatttggccagtactttgcttcaactgaaggccatgggcattaacaatcttttggagttcgatttcatggatgcgccgccggccgaggcaatgataacggcgctttaccagctctaccaattgtcagcgcttgacgaggacggcttgcttaccaggcttggccgacgggtgggaaaaagttacagcaaatcgaccactaactcaccaattcacagatggccgaattccctttggaaccctcgttggctaaaatgctgattatgtctgttgaacttggctgcgctgacgacattttgacaattgtttccatgctttctgtgcaaaatgttttctatcggcccaaagaaaagcaagaattagcggatgagaagaaatcgaagttccaccaacctgaaggtgggagacagtggaacgtttaaaaaaatttttcatctttttacaatttcaaaaaattaaattccatgttttcagaaaaaatttatttttttatattttttagtggaaaaccccttaaaagatcagaaactagaaaactgagtttaaaaaaaaatcggaaaggtatgcagggcgggggggggggcccgtagtgtactcgaagatgtgatggattatttgggtcgtcgccctttatatttcaaaaacattgaaataattcgaattccgcttgactttttttattaggagatcattgcacgctgttggcagtttataatgcatggaaacaccatcactattcgccacaactggtgtcaagagcactttgttc

SEQ ID NO: 45722 - DNA, 1849 bp, Heterodera glycines
  Genomic contig location: Contig_ID=SeqID_4122; Location=20..1868; Strand=-
  SCN-specific regions: Sequence locations=1-52,88-228,250-821,853 -874,909-1261,1283-1849
  Gene Ontology: Mol. function=protein tyrosine phosphatase activity; Cellular component=nucleus; Biological process=RNA processing
atggtcagaacatctcggaaaatacccacagagtaaattatgaggatataccttttgaatataataaaatcaagcattttctaatttggtaaattcttaattttattactttagttggataaaataccaaccacttggtgcaagcattgagggatcgaggatttttgcatttaaaacaccacttttgcccgagttgcaaacatcaatcccaaaggagtgtcgtttttcaactttaactttattacaacaggttttatcacaaattttgacaattaattgattaatttcagttggctttctctaatcgttcattgggacttgtgattaactgcaataatactaaaagatatttttgtcgaagagacatcgaagggcttgggatttgctacaaagaaataccatgtccaggccgcggctttctgtatcgtactgatgccgtaaaaactttcataaaaacaatagacgactttttggaacttaacagtgacaatggttggttctatacaaatttctgacaatccatgtattcagcttctccatttcctttagatttgctaattgcggtttgttgtagcaatggaattaaccgttctggctatttgatttgtaactatctcatcaatcgacttggctggagttctcatgatgcattgaatggttggaaatttttgatcattttataatagtgctactattaataacaatctttttgcttttttcttctggtcgaatcccctacaatcttattgttagtcaaaaaacataaaagtaaatggattgagtcacactgaaatttagtctgtaaaagagctctttggactcgacattgtttattactaaaatctaacttaagtcgtcacccctttgttggatgatttattttttctaataaattaaataatatttttgcttttttcagcatttgaaagtgccagaggttattccatcgagagaggttcatatgttcaagcattacacaaagtcgacagagaacgtcgttctaaaacgtattggttttcagctaacaattcaattgagtatggattatttgtttgttttttttgaggatgccgttcggtttggacagaagtgagcatgaaatgggaaatgacgaagcacttcccgcgaagactgaccaattattgcctggcattagcgacttcaacccacaattgacagcgcaaatgatgcaacaattcttcaacatggaacaagtgaatttttgaaaacaaaacaacggggggttgctaatatgctccaatttttcttgcaggaatttaaacaagttgccgaaacagcggcccattcgtcggctaattcttcgcctgcgcttgtcgcttcgactgcgcctcagcagcagaacacggcccttcccagccaaaagagtggcgctgcaaactccacaatatctgctcgacaatcgctcaaaatcactgcgaaaaagcgcgaaaagacactcaatcaaagtgtgtcgtcgtcatccgccattttgaatcagccggacattggcgttgaacaagccgaaattggtgacacggaatgcgtttctgacgaggaatatgacgaggacaactcgtcttcgccgaacattgtaaatacattgcaaatgcatagttttgtgttcttagtgacttttacctaacttaattataaatttatttgcctttcaatttaggacttcgactcaatgggccgtattgacacggcagcagcaattacgaaatcgcaaatgcgaagacagcggcgccagaagcgcgagaaaatgtttgctgtgatgaagaggggtcacttctgggaaataaatgagatgagaaaagaaatgcaagaataactgcatatatgtacaaca

SEQ ID NO: 45723 - DNA, 2225 bp, Heterodera glycines
  Genomic contig location: Contig_ID=SeqID_4122; Location=1225..3449; Strand=+
  SCN-specific regions: Sequence locations=1-395,417-557,593-894,933 -1031,1054-1218,1253-1352,1402-1601,1625-1712,1735-1960,1983-2225
  Gene Ontology: Mol. function=ATP binding; Cellular component=DNA replication factor C complex; Biological process=mitotic chromosome condensation
atgagaactccagccaagtcgattgatgagatagttacaaatcaaatagccagaacggttaattccattgctacaacaaaccgcaattagcaaatctaaaggaaatggagaagctgaatacatggattgtcagaaatttgtatagaaccaaccattgtcactgttaagttccaaaaagtcgtctattgtttttatgaaagtttttacggcatcagtacgatacagaaagccgcggcctggacatggtatttctttgtagcaaatcccaagcccttcgatgtctcttcgacaaaaatatcttttagtattattgcagttaatcacaagtcccaatgaacgattagagaaagccaactgaaattaatcaattaattgtcaaaatttgtgataaaacctgttgtaataaagttaaagttgaaaaacgacactcctttgggattgatgtttgcaactcgggcaaaagtggtgttttaaatgcaaaaatcctcgatccctcaatgcttgcaccaagtggttggtattttatccaactaaagtaataaaattaagaatttaccaaattagaaaatgcttgattttattatattcaaaaggtatatcctcataatttactctgtgggtattttccgagatgttctgaccattaaaactaattggaagatgaccaagcaattctaattagaaaaagactgaaaaagtcagcaacggcacaatggctgggtcaacgcctccgcctttgttagacaaaatgatccataacgccaagttgcgtaattttatgcgcgttaattcaaaaaactagtcagattcaaaaaaactggtcgtttttttttgatcacccaacgcatcccaaacaaaaccttatacagaatatcactcgatagttttagaaagaaataaatacttttttttaattttattttttaaattaagataggaaaacgctaaaactctaattttaagggtaatacgctaaaaactaatttgtaagagaggatgtcaataccatggtaaataaatacctatattatatttgaaatttccatattttactctcacagggttgagaaatacaggcctaagacattgggagatgtcattgggaattcggaaataattgaacgtttgattgaaatctcaaaagtgggaaatatgccaaatttagtcatttctgtgagtcattttcactaatacttacttaattacccaattaatttccttataatcgataattaaagggtccgccaggctgtggaaagactacgagtgtttgggcattggcacgggacatgctcggagaaaaagttagggatgcttgtttggagctgaacgccagcgatgagcggtagtggaaaataaataatttaattgatataatatttaaaaaattttattatttaagaggaatcgacgtggtgcgcgaccgtataaaacgttttgcatcgacgaaagtgactttgccggagaacacgcacaaaattgttattttggacgaagcggacagcatgaccgaaggtgcacagcaagcattgcgtcgaataatggaggtaggtttatatttccagaagctctgatagtacttttttgattttcattctataaaacaattttatataacaattatgctcaggtattcagttccacaactcgttttgcgttcgcgtgtaatcagtcggacaaaattattggtgtattttccaaccataatctactgaatgggaaaaccttttagaaccccttcagtcccgctgtgccatcataaaatacggaaaattgacagaccaacaaatattggaaagacttgtttgcgtctgcaaaaaagagagtgtccaatataacgcggagggcctcaatgcgatactttacacagcacaaggggacatgcgacaggtgcttggggttgtcatatagccacttataaacagtgtttaaacatcgtatctaatgaattacgaaaagcaagtttattattaattaaatttcaactacaaaatttaaaccttttcaaggcactcaacaatctccaatgcaccgctgcgggctatggaactatcacaaaagactatgtgtacagagtgtgcgacgaaccacaccccgagaaaatgtgtaatattttcgactgttgcatcaacggtcgtacccaagaggcgttcgatttaattgacgagctttgctgtttggggtattctgtcgatgaccttgttggcgttatgttcaaaacggcg

SEQ ID NO: 45724 - DNA, 184 bp, Heterodera glycines
  Genomic contig location: Contig_ID=SeqID_4123; Location=1125..1308; Strand=-
  SCN-specific regions: Sequence locations=1-160,182-184
  Gene Ontology: Mol. function=sulfite oxidase activity; Cellular component=mitochondrial intermembrane space; Biological process =protein catabolism
acatagaacaatgtggggttggactttgtggagtgtggaactgcccatttccgaggcaacaattcggaatggtcggatggaattggtgtgcaaggcgacggaccgttcttataacacacagcccgagacggggatcgcactttggaatgtccgtgggctgctgcacaatgcatggcacagagtt

SEQ ID NO: 45725 - DNA, 731 bp, Heterodera glycines
  Genomic contig location: Contig_ID=SeqID_22609; Location=154..884; Strand=-
  SCN-specific regions: Sequence locations=1-2,34-80,103-353,375-731
aaatttattgaattcacttttttatttggtttcgtccgacaacaagaaatggtaagttgtaacggaatagcattactgataactcaattaattcatattcaattgcttaggcaaagcgcacaaaaaaggtcggcattgtcgggaagtacggcactcggtacggcgcctcgttgcggaagacagtcaaaaagatggaggtgtctcaacatgccaaatacacatgtgcattctgcggcaaggtttgcataccgcacattatgttgcaatttgctagcgacaagaagacggatacaataaaacactaatcaaaagatggtaaattccatgggattgtcattctgtttttagcggttttgcgatgtgctcagagttattcgaaaatgactatcattcatctgacattaattttggaccctaaatttgtgaaataatttgcttattctcaaaattaccatccaaattgcttattgcatttaatacattgtcaaagcgtgagttgtttttcgataacctgaaattacattgcagaactgctcaaaacatcatttttatatttttttgtgttgacgattggaattacccttgaaaaagtcaatgggataagaggcacttattatgtgcaaaaagacactaaatctgtgggttgcaaacgtccaagcccagaaaactatcattttgtttaatcattgcatcgggaactcaaatatttcatgaccaatcttcaaaataaa

SEQ ID NO: 45726 - DNA, 1013 bp, Heterodera glycines
  Genomic contig location: Contig_ID=SeqID_4130; Location=1897..2909; Strand=-
  SCN-specific regions: Sequence locations=1-153,176-376,399-1013
atgtcccttttgcagacccaacaagtgaacagcactgcagtgactacaacaacaaccgcaaatgccaattgtccaacatggacagcagcaacgacaacgatgtcgacagttgcgaacattagtggcacaacaatggcaattgccgccaaaccgggggctctgaaaagtgggctgttgggcattggtggtgcatccgttcgtggccagctgacgagcggttcgacaatggtattcagtggcgcaaaaactgtaccaacagcaacaaatgcggtgcaacagcacaaccagaaaagtgcggcaggagggcattttcggctgttctgattgctaattgcttttgaatttcagttcttgctaatggcaccattagttcggcaacaacaaaatttgctgctgttgtaccacaacgggtcggcagtgttgttgcaccattgacaccacccattgaagcgaaggagccgcagagggaatacacgacaagtacaagcagtatcacctgtacaactttcaccacaaccacagaaatgtcggcatcgtcgctggacaaatttgccgacacggtgaacagagtggcagccggaacggaaatttccccaccgcatccgtcgatgcaacagcaaattgttgttgcctattcgtcggcagcaaccgcgacgacattggcgagcagtacggcaatactaacaacgacgacaacggcaagcagtacagcagcagcaatacaaccaccaattgcaacaatggcaaaagggcaaccgccgcaactcggcacggagaggggccaacaaatgttgaagccgaaggcgcccaagaagaagaaggcaccagcagcgccaaaagcgaagaatggcgcgacgaacggaattgacgagggggcggagcaacggaacacaacgaccatttcagttgtcgatatgcagcagcagcaacaacttcaacaggcaagcaaagggaattgtagtgcaagagcaacaagaaaactattgggataaaactggaaacaacggaataaa

SEQ ID NO: 45727 - DNA, 1913 bp, Heterodera glycines
  misc_feature (633)..(633): n is a, c, g, or t
  misc_feature (727)..(727): n is a, c, g, or t
  misc_feature (732)..(732): n is a, c, g, or t
  Genomic contig location: Contig_ID=SeqID_22633; Location=396..2308; Strand=+
  SCN-specific regions: Sequence locations=1-74,107-164,196-330,428 -609,785-813,993-1094,1153-1416,1589-1766,1803-1844,1873-1913
  Gene Ontology: Biological process=body morphogenesis (sensu Nematoda)
atggcatataatttcatgaaacgaaattcggacgacagtgacaatttgggattgacatatgtatggaaaagtgcaaaaattattttaaaaatgaaatttttaattaggatattggctcgacaatgcattaccctagcaaaggctttagcaaagatcgtaaaaggtttttataataaaaaaataaataaaaattttgggaaaaataattttccaatatttagttatacaatcctaacaaaagacccaaactttcaacaaacaatgggcaaccgtgctggactttcattcaaagatgctcgaataataaataaacgttattgtaaaagtaggaaaattttgataaatttaaatttaaaataattaaaacgattccaaaaattttaaatttttttaaaatataattacaaaaaataattaatattttttacaaaaaagattcatgcagtgaaaaattggaatgctcaaatgacggttacacagatccaaacaattgcaacaaatgtcggtgtccagatgtaattcaaattttattaatttgaaaagaatgtttatcgaacaaatttagggatattcgggcgccttctgtcaagaaacaccgttaagcggtaataattagttataatgatgaattanaattaatgcagtaataattaattataaagattattaaagttaattaatttaattaatcagacagtccattttgtgtcattaaaataaattaatntaatntaattagacaattcgttttgtgtcattaaaataaattaatttaatttaattagacaattcgttttgtgtcattaaaataaattaatttaatttaatcagacagtctgttttgtgttattaaaataaattaatttaatttaattagacagttagttttgtgttattaaaataaattaatttaatttaattagacagtttgttttgtgttattaaaataaattaatttaatttaattagacagtccattttttaatttaattagacagtccgttttgttcaaatgtcggatttttgatggctgggaaatgggccggaacaatcacaactggtcaacttcaaccgaacactgaatgctattggagaattattgtaaaaaattattattttttttataaaattaattaaatttttaattaatttgcatttatttagccacataaacacgagcaacgaatcaaaattacaatcacaaaattggagttcccgtgctccgatgcttgttcaagttatttggaagtgaaagcaaaaaagaaaaaaatttcgacaggttagagaatgaaattacaaacgaaaaatttagaccattattttctgagagatttttctttatgttgggttagctaaaaataatgttataaaaataataatgaaatttctgttatttttgtcatgaaattactccccaataattaaaaataataattgtaaactgttattacaaagtaataattgaaaaaatctatttcattttatttttctaattttatatgtatttatttttaaaaaatgttccaaatttttataattaaattaaaatcaaattttaacaaaagcaattaattaaataattttttatgcgcttttgatctatttaaatttttaggggctcgactttgctgcggcacaccaacaacaatatttagtgatgttgacacagacgttattttgatattgaaagtttcaaataacttaaatggcacttttcatggcgctaattttgaatataaaagcggtaatttttattataagaaagaaaatactgtaaaatataatacaaatttacagtaaaagcatcgattacggtaccacaaacaattcaggtaatgtacaagtttaattttgaaaatttattatttttttgaagccaatccgattattctttacttttttaaagaatacaa

SEQ ID NO: 45728 - DNA, 952 bp, Heterodera glycines
  misc_feature (56)..(56): n is a, c, g, or t
  Genomic contig location: Contig_ID=SeqID_4136; Location=20..971; Strand=+
  SCN-specific regions: Sequence locations=1-176,198-240,262-952
  Gene Ontology: Mol. function=translation initiation factor activity; Cellular component=eukaryotic 48S initiation complex; Biological process=translational initiation
ggttttgctttttgagtaccaaacaaaggaggcggccaacgcagttttgcccattngcgatggacatcgccttgacaaaaaccacactttctcagcgtatccattcaccgctattcgaagcatgaaggagccggaaaaggactggaagaaaccggagagacaaccttatgtcgatttggtaaattaaagtgaattagaggaatttggccgacgacatttattgcccttcataatattaatgctaatttgttaagggtgacccatggtcttggctgcaaaaccccaagtgtttggatcagttcggtctcctctatgaatcgggccagggtggcactctccgtttggatgtgttttggaacgtcagaaatggcgagccaacgcccgtggacaatgcttctcgagaagtaattctgagtttcaaaattttcgagggccaattatgttcagaattggtccaatgaccttttcaaatggtctccccatgggacttatttggccacgatgaacaatgacaagcggaatcagcgactcggagccgtaatttggggcggcgaaaagttcgacagatttcaacgcttttcccacgagggcgtcaattaccttgacttttcgccaaatgagaagtgagtaattagttgtttcttttttgcgttatcgttcctttaatcgaatgtttttttcgatttgttttacccttttattttgcttttcttcagatttcttgttacttatgcttgcgatcagaacagcactcgtgataatgagaattgcttgcgcattttcgaggtgttcactggcgaactgaagaaggccttttcgccctctctgcgctccgctggccgtctccatgattggccctttctgaaatggtcacacgacgagaaattctttgcattttgccgtctccgtggcaattgcgtgaataactgtagcacggatgacttcatgcttt

SEQ ID NO: 45729 - DNA, 4222 bp, Heterodera glycines
  Genomic contig location: Contig_ID=SeqID_38; Location=3553..7774; Strand=+
  SCN-specific regions: Sequence locations=1-826,849-994,1016-1367,1391- 1625,1657-1707,1729-4222
atggaagatttttacattgtacttccctcaaacacacctggtccaggaaatactgcctcaaattttacggttagacttccgcacaccttagagcttgactccaaatggtccgtcgcgttatcagcaataatctatccatattcattcccgtcgatcagtgtggacgaggatgactctatctctgtcaaactggttaatcctaactacagagaagatgctggaaattctgacgaggaatcgcaaaagtttatcaatttatcagtgaagattccaaatgtacaattccaaagtgtacaaagtttacaaaaaacactgaatcagataatccagaatgcttacgatacaaagtttggcggctcatcatcattaaatgatggtacaaccaacaaaagagccaaacgacaaaccgaattgtcagaaacaggcgctggagttatcgaagtagagaatttcttcactcgaaatccctttgactattggcaacagattggagaactgagaaaaaagcactatcagctcagagaaagggttgaaaaaatggcaaaggagtacaattcaacagcggatggcgaacgaaaaacatttctctcaacggaacttggggtttttcaggggcgagaaacttttctgaaagaacatttgcatttgattgaagaagaggcgaagagaagggacggtgagcagcaagaagccaatgaacaaagactcattgaccgtttctttgcccgataccccgacaattatagagagcagctggacgaatggaggtcaagttacctccgagatgtgctagatctacaaacaaagatgggagagtatgaaggagttaaagatttgaaaaggcttgaagagctcaattcgcaaaccgaacgaatgagaaattccatacacgtttttggaagaaagatggaaatattaaacaacgcagcattgcaacgtgaccagaaaaggtctcaagaggagtttgaacggacaagccatgaacaaaacctgaccttcgtccaagaattcttccaagccaatcccgtgaattattggcaagcaatccagaaaaattatgaagcgcttcagcttgagtacaccaagaagagggaattgagggaaaagcttgaatttgaaactgacgcaacggaaagggagtcgctgcagcgacaaatagagagcattcaacgtctgattgactacaggcgtaaacggtttgccgctttggaatacgaggctaaaaaaagagatgcgcagacagggaaaactaactcaggcctcagtgctgtagctgaggggtcaaatagtactagttccaccccaatagactccttttcaccagcagatgagcccgcaaacccagacgaagaaaatgctaccaatagtaaaaacaaccaccaacaaaacatcactactactgccaccgctactttatcatccgagacaccagctgagcaaattttagcagatcaagataatagtattgatgagaaagacgaagcaggtacgccgccatcaagtgggttaggacagtccggtgatgcttctgctacatcagtgactcaagttgaagatggtcgaaatttacctcaagcagccgcgttgacctccaataacccaaaaattgttgctaaacaatcaacggtagcgacagagagaaggaaggagaaaataattgaaaagctgatcgacgaacaagtggaccgaatggtcgacggaacacatgcacagcagaagatgctacaggaagaaggtaaagacaacgagagtcaacaccgcatttcaacatataaactcatcgaagaagtgctacatggtgagcatggacagctaatgtcgcaacagcgtgaatccaaaatggcagctgaatttgcatacaatgaaataactcagcgattcggcattagaatgggccccggagtaatgcacgttgatttgagcaaacagctgtcctatgtgttggggtttgatcgcaaaacacgcatttacaacaatcagtcggcaaaatatccacctgatctgtctggtggtgtccgtcagctgtacgtttacgcgcctaaactggtggaggattccattataggtgaccgcatggcaccgttgctgcgagttgtcaacgtgtcagggacaccagggttggacatgccagaggttatatataccaatgaaatttttcattctctccaaaataaacgcatttctgaaattaacattgaaattcagacagcatttggacgttacgtaaaatttggttggggaactaccgtaatcacattacattttagacaaaaactattttagcaaaaaaaacgatagttatgacgcacgttgtttttaacccggacaacgtgaattggtccgcgttccttgcgttacagcagcagcaggagggaagcggtgagctgcagtattttgtaggcaataaatttcagcgtggtggcggtctgttacaaaatatttcgcggttcctgatgcctgtagccacaaacctgctaaagtctgcctcaaaagagggcatttccgcagggacacggatgcttgacgatctcgcgcagggaaaggcgtttaaagagtctctcaaaactcaggcaaagcaaggatttgagaatctggccgaaaagctcaaccaatgcggaaagggtgggcggcaacggcacaagacaatcactcatagaaaaaataaaaaaactggtacaatgagagggaaacggcagatcatcgatcaactaacacttgcacattaacattcggcaccacacgaagcctataaataggtaggataattttaatttttttcactaacgactacactctcaacaacatacattaaatattttgagagaaacatactaaccaaaaaactcagtggaaaatgagcgtaattaaaaagattgacaaagacagtgttgagggtctggaaggaagtctgtcattattctctttgccgccaaccaatgtggccataaataagacaaacgtccgtgaattgctgcctctttctgcacttaatcagacaggtccctatttgtttcgcctgttctcggacagtcaattttgtgacttgagcaaaacctatatgtacctgctcagctcaattgaacggaagaatgacgcgggagaatgggtagcactcagtgacacggacccaaacgataaacatgttggcgtcattcaaaactttgctagcagctttgtccgctcgctgaaggtcaatatttcaggcattgaggtgtttgacagttcaatttattatcactaccgcgactacataatgaaggagttgggttattcacaggaaattcgcaaggctttccatgaggcatcgtgctactacgcagacgatgatgaccagaacagcgcaacaaacccaggttttaccgcacgtgcggcacgcttttcaggtggtaaacagtgtgagacaatggtaaaactgaattttgatttggcacgtcaaagtgcattgatgttgaacaatcaggatgtaatattcaccattcaccgcaacaatgattcattcctcctgcttacacccccatacaaaaaaccagatggtacacagcaggaaaataagaaagagtaccgcatccgtgtgcatgatatgcgtctctatgtgcgcactgtggacgtaacaccaagccttaaccttgccattagccgacaattagagtcgacttcagcaaaatatccgctgcgtaaaattgagatgaggtccatttttcttggcacaggccggaccgagctggcacacaatgtgttcacttctacgttacctcgtcgtttaatttgcactttcgtttcaaccgatgcatattccggtaaccgaaaaatgtcaccctacaagtttgaacacgccaatgtacgttcgattagtgtcgaggcgaacgggcagacctttcccagcaccccgtatttgctgtccttcgatggtgtacagccccgctttgtccgtgcttttgtcgacatgtacgcaggcctgggtttggatgactccgacaccaaaacggtctcaattgggatgcagcgttttcttaacggttgggcctttttcgtcattccgctgacttccactctggaggacacacctggttttgagctgatcaggcaaggcacatgcacgataaaggtgcaatttgagcagcctataaaaacggatggatatgagatgcttgtccttggcgaattcgattctgtgttgtccattaacgcagaccgggttctgagtacagacggaagtgtgtaa

SEQ ID NO: 45730 - DNA, 572 bp, Heterodera glycines
  Genomic contig location: Contig_ID=SeqID_22656; Location=14..585; Strand=-
  SCN-specific regions: Sequence locations=1-72,99-230,253-572
atgggccacagttttggcgccgcctcgtcgctgtccgcatgtgccgaatatccgtcgctgttcaacgcctgtgtgctgctcgacgcctggctgtacccggtggaacgacgaatgtatccggcgactgtgcaggtgtgtgaaatgcgattttttggaaaaaaaattttgaggaacggcggaagggtgccgataggcgccactggaaatttttaaatttgttcaaattcaaaatttgtcttctttccccccttcatcggcacatacacccaatgggattcgaacccgcgccaataaaacccattttgtgcaaaaaataaatttggcccgtttccagaaaatttcggaagtttttttttttgctcatcgcctttccccacttttttagcccgtgctgatgctcaacgccagcaaatggcaatggccacgcaatgtgcgacgaatgcagcgactgttagcgaaagcgaccacttccaccaatgacgacaaaacagcaacggagacgacaacaacgacggcaccgcagcaacagtcgcaggacggcgccgcaacgacagcagcactgccacagccga

SEQ ID NO: 45731 - DNA, 1311 bp, Heterodera glycines
  Genomic contig location: Contig_ID=SeqID_22687; Location=910..2220; Strand=-
  SCN-specific regions: Sequence locations=1-1311
atggctttccataaaatcgacaacgactccgtgaactcaatcaccaatgcattggactttttccgtataccccctacaaatgtgagcgtttcatcttcaaaggtattcgagcttctgcccagcaatccgcttacagacacaccttaccatttcaaacttcattccagccaaaattatattgatctgtccaaatgttatttgctcaccgagtttcgaatccgtaaggaaaacgctaatggtcaactcattaacctagacattgatgacataaatattgcaccaattcaaatgatcggacaaaccttcatccgcaacataaaaatgagtatcaatgggcgcgaaatttttaatgccaatgccctaatggcctacaaatcatatttctcacatgaactctcttattcaacgacagcaaaagactcccatttgaatgctgctgggtattatagggacacgggcgatactctggagatgggaggcggatgcacagcgcgacgtaatttgtttgcgggtagtaacgtagctcaattcatcgtcaaaattgacaccgacctattcaaccaaccgctatacctgatcaatttctgtgaattggacattgaaattctacccaatgacaatgactttgtgttaattgcgccgaccgggggtcggtaccgtttcgaggttgtgggactgaaaatgtatgtgaaaaaggtgtctctgatggatgggttggcgctagacattgcgcgaaagctagagttgaaacctgcccgttatgctgtgcggaagacaatgatgaaatcgatgttcatcagtcagggtcgatatgagtttacagctaacctgtttatggaccaaatcccgcgtcgtgtgacaatgggtctggtggctaatactgactatgctggaacaattttgcgcagtccattcaactttcaaccatttaatgtgcgcgaaatttctattagtgcaaatgggcgaccgtacccccaagcgccctatgatttggattacagaaatggaaaatatgttcgcccattcaatgacatgaacgaagcggtgggtttcgccaactcaacagagagcaacgggattacttttgctcaatacggaaaaactcattgcatttatgtgttcaatttgaccaacagcggggatgatcaagcggcactgtttgatttgataaagaatgggaccacagcggttagcatcaaattcaatcaaccagtacccgtcggaggaataatgctagtggtgatgggagaatgcgattcccttgtaatgttggacaaaaaccgatcaataagcacagataccactatttaa

SEQ ID NO: 45732 - DNA, 7001 bp, Heterodera glycines
  Genomic contig location: Contig_ID=SeqID_4153; Location=1..7001; Strand=-
  SCN-specific regions: Sequence locations=1-672,694-842,865-1152,1174 -1701,1724-2131,2155-2802,2824-3303,3325-3371,3393-3687,3709 -4187,4209-4276,4299-4401,4423-4432,4454-4771,4793-4990,5012 -5925,5948-5964,5987-6046,...
  SCN-specific regions: Sequence locations=...6068-6426,6449-6514,6540 -6589,6611-6671,6693-7001
  Gene Ontology: Mol. function=translation initiation factor activity; Cellular component=ribosome; Biological process=regulation of translational initiation
atgcggccaaatttccaaggtcagaaaccggaggcagcgttgcaacgtgcttatgaatttttgtcagttgggaagcaaaaggatgctcttcaggcgctgcatgacttaataaaagttgttaccatatcttgaactttttccaatgaaattttaggaccgtcgtcacaaacaatggacccaaacatatgagcaaataatgatgctttacattgagctttgtgtgatcttacgtaattcgccacttgcaaaggatggtctttaccaatacaaaattatcactcagcaggtttcctttgtgtaaattcatggtaatcttgactaaaaaagaataaacaaccgctttttggattttacataccacttgagtgttattagggccgttttccatgaatttgacggaacggaaaaccatagttaacaaagaagttacagattagactatgtcatatgacacttccaataaccacgagtggtatatagaaacgtaaaaaactggctgtttacttcttttttatgagaccaataaaagtcaggataaccaatgttttggtaatccttcggaattggtgttccggcggaatagtttgtttaggataaaaaataggctgataaagatccgactgaacaattccagaggattaccatttcttatgtttcgtcattttgatttaaattgttttatttgtttttcttaaggtttctgtgaagtcgctcgaaagtgtgctcgagaagtttttgcagcttgctgaacaaaaggctgtggaagctcaaaagcactcgatcgaaaaaatagaagaaattgacgacctcgatgttgctgatgtgccagaaaagtgagtcttcaatttgtttctatttacacattactcaaaaaagatcgatagatgaagttgaaatttggtatttccgtgttttgctccccccccccccccccttgaaaatataaaaattcatattttgggagatttttgcggtgtctgtccacgcagatgttgtttgtttcgacctttggtgatactttgtttgtgatagtgacttagaaagccccgaaatatgaatttttaaggggggtaacaaaacacggaagaccccgaaattttagggttttattaataagttgtgaaaaatttccattaaggttttgggcactgtttcaaccaattccaaatccctaacatcgaaacaaatagaattagaatttttagacttgttttgaaacattcaaaataaattgctttcactttttttcagtctattgctctccgtttccggtgctgttgcacaagaccgaatggaccgtaccgttctgagcccgtggcttcgctttctttgggatgcctatcgaaactgtttggatttgctgcgcaacaatgtttatgtggagaatttgtaccaccaaattgcccgtcaatcattcgccttctgtaccaaatatcagcgtcgcaatgaatttcgaaaattgtgtgaaatgctgcgtcaacatttggtccaaattcagaaagcccagcagtcgactgccttgcatccgtatgacctccacaacctctcgggggaacttatacttttcttttgagaattcgcctgagcaacaccgaatcgttgggtcatatgctggagacgcgacttatccaattggacaccgcgattaacatggacttgtggcaggaagcgttcaaaagtgcggaagatttgcacagttttatgcaacttggtaaagagaaggacaaaaaaatcatccgaccgactagctatgccaattattacgagaaggcatgccattcattgcataagtcgtgccatgctttgattatctcaacttggttttagatttctttggttttttggaagggcggcaacattcttttccacgccgcttcgctgcttcaacggttttgcattttcaaagacatgcgccgccaatttggcggtgaagaggcgatggatcaagcaacccgcgtgttgttggcaactttgagcattccggagggggcggagagtgcgtcgatgttgacgaaacacttggacattgaggagcaacactcggccaatattcggtaatgattcaaagcaataaaaaagttgaagtgaatcatataatgaaaattattctcaaacaaaccattgattgtttaagcattctttcgtctcttttacgtttgccaattacgccaagccgaagcggaatcctcaaagaaattgtccgactgaacatccccgagttggcctcgcccgccgcctacgcactttacaaatgtgtggagatggagttaaacccattgcgtacagcagtgaatgttcaaatgcatttgtcggacatcgagaaacttggacatttggagtataatcagtatgccgagccagtgaaggatgttgtgacggcacgtgtttttaaacaagttggggatatccaatcgtaaatcaactaatccgctcctccctccctttgagttgtctgcgctgtacgaaacactttctctcactcgtcttcataagctgattcccttttacgaagtgattgaactcgagcatcggctggtgaacgtgtgcaagcagcaatcgttgaaagctcgggttgaccatcgaactaaatgcgttcgttttggccatattgaaaatggatttgcgaacgatttggagagtgaggtggacacaaacacatcggaggtgggtaaatgacgaatttcaatcacatttgttgttcattaatgtaacactgtcgattgcattttttttaggttttgaaggcacgaagccatttggaggaaatgtacaaggagttgagccaatttaatacaaaggaacgcagtattatgcaagaaaaggtacattctaaacgacttgaaaagcgatttgtcaggcgcgctgacaaaatcactactgacaaaatcactactgacaaaatccctacatgacaaaatccctactcagcaaaaaatgacaaaatccctactaaccttgaaagtgacaaaatccctaccaaaaacaccgacagttaaaaaagttcttttttcgaatatatttttaaaccaaaaaaaaagtgaaatggtaacaacgggataatgtgatgggaaaaatagggtttaatattaaaaaggcgcatcaccttatcaatttgcttaatcatcttccgaatcgacatcgctttcattgttcgtaacatggagaccaccaacgaagcctaaagaaaattttaaacaacaaacttttgaatggctgaacaccatttgccgcgctcatccaccgcatgaccctttagaaattcgaaagtgccgaaacgaaacgcggacttggggatggaaccgtagctgaacagaaagagggcaaaaaatggaaatagtttggcaaaacgtacagcagaacggacagtccgcggtaaaagccggaaagtccgtgaaatcatcaccttaaattttggagttgtcgacctttcatccaactgaagttgtgttttgacgtactcagtggggtaagtgatgcaaatttcgatgcctcccgtaatccctccgattacaactcctttcattgtcctctctgaaggagcaaatctaaaaggaaatgtgaaaacaaattcccctttaacacaccttcgccatggtcgtcagtggcagcagctcgcatttctgccacctgcacaactgctcgctcctcaactacaatgctgtcgtctgttgatgcaatgcgtggccgtttactcaaatttaaattcttttcaaggtgttcatggcaattcatttcaagaaattgactcttgctctaaatacgtaatgaatcataaaataaatcttaagataaaaaaatatgttgctcccgtgcaagactatcagagctggcaagttttgaaacttgtcattttatctgagtagggattttatcgggtagggattttgtcatttttttgctgggtagggattttgtcatgtagggattttgtcatttttggctgagtagggattttgtcggcacacgatttgtcattttcacatttttcagttaaagcgccaaaatattcatttaccaaaaccaaaaggacgccgattttgagcgaattttggcgagaaggaagcgaattgagctgtacaaagagaccaatgagcaagtgaagcgggaaaaattgcagaaggaacaggcacaggcgaacaaacaggaggaacagcgcagaagggaggagttgaagaagttgcaggaggagaacaaagagaacgagcggaggcgcaaactgaacgaacaggcaaaaaacaaacaaacggaaggggcaaaaagatgagtaaaatgggcatccctttcaggaggagattcagcgaaagttgcaatccgagaagttgaagaagtaccaggcgcaccctttcttccaacagttggtcaaagagcatggggaggcgatattcgacaaagttgaccctgacaaactcatcagagagaaggcatttccaagcaatttatttttataattcatgaaataacattttcagcgaattcgttttgacgctgagcgacgcgagcagcagaccaaattgcaaaacttggagaagaaatatgaccacaccgtccgggcatttcatttggaggaaatggcactgtggaaacatttgtcggacgaacgccagagaatttacccgggacttcatgaggcttacgaaacaaaacgaattgaaaaagcggtgtgagtgatttggttaacccaatttcatgcctaatcaagcaataatcattcattgttttgaagaaaggagcgcgaattgtcattcgaaaaatatgcttatttggtgagcgccaaagagggggccaaggaatttatgcgttccgttattcaatctcatgccgaagagttcaaagaacagcaggcggcgtggaaacagcgtgttgaggaagctcggaacaaaacattgaaggtgggaggagagtagttaattgaaaagaggcacatttgaagagcaatacaatggcttttggctataaatttattcaaaattcgacggaatttttttggaatttagaaagttattattgtaaaacacttgggctattgacaatattgagaattaaaatttatttgcttttgcaatggcactggctattgtgtccatcacattttcgctgttaaactccatttttaaaaggaccgagcggagcgcaggaaggaacaacgcaaaaaagaggcgcgggaggccgaacagcaacaggcagcacaggcgcagacgcaaaaggcgaaggagcaaagacagacgcaacagccacaaaagccgagggaagtcgagcagcagcaaacgccacagacacagcaacagcccaagaaggcgaaggaggacgaacaacagcaacaggcagcacagtcgcagcagcagcctcagaagtccaagtacgtgccaccgtcgatgagaaaatagcggagcgatttgtttgatgaaaatttagtatttaatgtgtgcttaattggtgttgcaaagtattgttgatgagacatttaagcgttttggagttgtaataaattgttgttggtttttgcacatgtttttccgaaataatgacttaaagttttgttgacagttcgtgaatttgaattacttttgtcgcataaatatgaattttgtcgaaaatttagtttttgaatccgggttcgaagtgggccgaaataggtgttgaaatcagtttttctgacccaaaagcctctaaaaagaattatcaattttgaaaatttttcaaaaagcaatttaaaaatgctaatagttttattgttaacagactttttatcgtatcacatcggtaataaaatctgacataatgttctaaacacaatttcaatttttggcatcattttattcgactggcagacaaaaaaaaaatgcatatccgtgagcaaaaattatatacatttttatagacacataaattcagtaaaatttgccctgtttcttacagtataggtaattatcattattattgtcatgcccttgactttttacaattggcccatcaaccgccaccgctcttccgtgtcatgaactttcgcagtgcgttttggcactcctcggacaaccatcgcgacttgagcagcgcgcactcgcgcgtgttgaccgccagcaatgcgtcgcggtgcacgtcccgcaacagcgatttgttcagtcgcagcgactcgggcggaagggacgccagcgaatttaccttaattagatgggggtggggcagttagagattagtgaaactcgagttatggtttcgagattaatgaatttttcagaaatattccaaaaagttaaaagaaaaatggctctcatcatcaagtgctgtaccatccgttcagtttcggtgccaaaactgttgttgggaatgacgcgggagaccaaattgcgctccaatgcttcttcggcggacatttttttgtcgaacaaaaggagttcagatgcctaacaaattaaggaattaatggaaattaaacggaatggcattaaaaagtgcagcaaaattattgcaattcaattcaacaaaactcactttcgacgtgcccataatcagaggaaaagtgtaggaggagcagccctcgggggattggccaagcgaagagaagggcgcgtggaaagtggcctaaagcgagtgaaaaaggagaaaaatgccatattttgattcgatcgccggcattttttgttaccttatccgaagcgatgaccaaatcgaacagaggcaaaacagtgacagaaattctgaaagattcggggcatgtaatgtcgtataaagtcgaatttaattttgctcgaaaaataatatttttcctccacccaatcgctggcccattgatcagtccgatcagcggcttttcatgctcaatgaacgcgcgcacgtaacgctccaacacgcgctccccacggtcggccatagcacgcaaatcgtcgctcgttttgacgccgcgcgtaaaattggacaaatcattgccggcacagaaataggaaccaacgcctgccaaaatggaccaaaatttggtccggctttctatcagctctctgcattct

SEQ ID NO: 45733 - DNA, 1548 bp, Heterodera glycines
  Genomic contig location: Contig_ID=SeqID_4166; Location=317..1864; Strand=-
  SCN-specific regions: Sequence locations=1-232,273-304,326-415,442 -1024,1048-1090,1112-1393,1424-1496,1519-1548
  Gene Ontology: Mol. function=enzyme regulator activity; Cellular component=mitochondrial inner membrane; Biological process =mitochondrial translocation
atgttcttcagaaaagttgtgccgtacaaaattgtgaaggcgtctaatggcgatgcttggcttgaagctcaaggaaagttgtattcgccttctcagatcggcgcttttgttttgatgaagatgaaggagacggctgaaagttttttgggcacttccgttgcgaattctgtcgtcacagtcccggcgtatttcaatgactcacaaagacaggttttcaaattaattgatcgtttactttcttttttgtttctaggcaacgaaagatgctggaaaaattgctggactgcatgttcttcgcgtgataaatgaaccgactgcagctgccttggcttatggtcttgataaggcggaagacaaagtgtaagcatttaccaaatttcaagtactgaaaggagatgtctcaagaggcttttactgacacaaattaatatcaaagaaaaagttgactattctatattttagcattgccgtttatgacctcggaggcgggacgttcgatatttcgattttggagatccaaaaaggcgtctttgaagttaaatccaccaacggcgacactttccttggcggggaggactttgacaatgtgcttgtgcatcaccttgtcgccgaattcaaacgcgaacaaggaattgacctcaccaaagacccaatggccatgcaacgcgttcgagaagcagccgaaaaggcaaaatgcgaactgtccagcactacgcaaacggatatcaatttgccatatgtcactgtggactcatcaggaccaaaacacatgaacgtgaagctgtcgagagccaaatttgagcaactcaccgccgaccttatcaaacggacgattgaaccgtgcaagaaagctatgcacgatgcggaagttaagccctcagacattaaggagattttgttggttggaggaatgactcgcatgcccaaagtttgttctttatattattaccaagtttaggcatttgtgtttttcaggtgcaacaaactgtacaggaagtttttggcaaacagccaagtaaagctgtcaaccctgacgaggctgttgctatcggggccgcaattcaaggaggtgttcttgctggacatgtgacggacctgttgctgctggacgtaacgccactgtcacttggaattgaaacgcttggtggtgtgttcaccaaactgattacgcgtaatacgaccattcctacgaagaagagccaagttggttgctgtcaacacttgatttctactttcttaaataaaggtcttctcaacggctgctgacgggcagactcaagtggagatcaaagttttccaaggcgaacgcgacatggcattggacaacaaaatgctgggccagttttctctcgttggtattccgcctgcccctcgaggtgttccacaaattgaggtcgcttttgacattgatgccaacggaattgtgaatgtgtcggcacgagaccgtggaactggcaaagaacagcaaagtttgactcttcgatatgaagaattgtaaatttttggtttgttccagttattatccaatcgtccgggggactcaataaa

SEQ ID NO: 45734 - DNA, 1391 bp, Heterodera glycines
  misc_feature (458)..(458): n is a, c, g, or t
  misc_feature (463)..(463): n is a, c, g, or t
  Genomic contig location: Contig_ID=SeqID_4167; Location=1876..3266; Strand=-
  SCN-specific regions: Sequence locations=28-151,174-1391
  Gene Ontology: Mol. function=GTPase activity; Cellular component =cytosol; Biological process=G1/S transition of mitotic cell cycle
atgtatttgactggaatggttgataaacggacattggaaaagtatgaaaaagaagcgaaagagaagggccgtgagagttggtacttatcctgggcactggacacaagtaagatattattggtagttttttcgatagagaattaattattcattttgtcagttttatgatgtaatgttttttagatgaagaggaacgggaaaagggtaaaacagttgaagtcggcagagcattcttcgagacggatcagaaacattttaccattttggatgcccctggtcataggtcttttgtgccgaatatgatcgctggtgctgcacaagccgatttggcagtattggtcggtagtattttgattatttcaaaatggagagcatttagcattaatttttgagttgaaaattatagcgaattaaatatcctaatatttaagaaattgttacatacttttagggtttcnaaatntattaatgaatatttcgcctgttattctccctgacccgagtttaccattttaggttattagtgctcgaaagggagaatttgagacgggttttgaccgtggcggacagacaagagaacacgtcatgttggcaaaaacaaccggagtgaagcacatgataatacttgttaacaaaatggacgacccaacggtcaattgggatgttggccgttacagccaaatccaggaggagctgacgcctttcttgaggaagtgcggcttcaacccgaagaatgacatcatgtttatgccatgctccggactcacaggcgccttccttaaggaacggccttcttccgacttatgcccttggtacaccgggatgtgcttcttggaatacatcgactccctccctttgatcgcgagggatttcaatggcccagtgcgcggcataatagcgaacaaattctctgtataattttactttcttatttattagagccgattttacaggacatgggcacagtcgtttctggaaaactcgagtccggttcaatttcaaaaggacaaacgctgacattaatgccaaatcgagtgtctgtgcaagttctaaattcctttgtaaacgatgttgagaccgaacttgtttatgctggtgatagtttccaactgaaaataaaaggagtcgaggacacggaaataatgtccggctttgtgctttgtacttccgattctccgtgtccaattggtcgcatattcgacgcggaggtaaaaaataaataaactgatagcttacgctgcttttgtatttcatgttttactatattttaggtgcttattttggactataagtcaataataacttcgggttttggctgtgtgctgcacattcacgaagctgtggaggaagtcacagtgaaggtgaccgaccaattcgtttggcctttgtaa

SEQ ID NO: 45735 - DNA, 557 bp, Heterodera glycines
  Genomic contig location: Contig_ID=SeqID_4167; Location=3956..4512; Strand=+
  SCN-specific regions: Sequence locations=1-158,181-445,467-529,551-557
atgtcaaaaacatcgaagaaaaattttgtgacaaagcaactcgttaaagaaattgttattccagccgacaatgaatttgttgggaaaattttagcttcacgaggcaacaacctccatgaagtagaaaccgatgaaggggaaaacttccttgtgtaatttaaaatttgttttaaaatacttttcaattttttaggagtatgcccacaagatttcgaaagaaattatgggttcgtcgcggcacttatgtgattttacagtcaattgaagaaggagacaaagtgcgagctgaaattgttcatgttttggacccggaaaacattgcgtttttgatggaaaaagaagtttggccggagagatttattgtagaagctgcgcaattgaccaagcgagggcagcgaactgaagaaaatgacgattcggacctattccccgcaacttcggaatctgaaaattcggctgaagagagttcttccctcgtttctgaagatgtagctttgaatggacagacaaatgccaaagatgaaacaacgatttaaaagaaatttaattttgttgca

SEQ ID NO: 45736 - DNA, 2206 bp, Heterodera glycines
  misc_feature (577)..(577): n is a, c, g, or t
  Genomic contig location: Contig_ID=SeqID_4177; Location=40..2245; Strand=+
  SCN-specific regions: Sequence locations=1-133,158-236,258-266,288 -364,387-572,597-626,651-771,793-798,820-1069,1102-1335,1381 -1847,1881-1928,2033-2099,2121-2135,2157-2206
  Gene Ontology: Mol. function=cysteine-type peptidase activity; Cellular component=extracellular space; Biological process =embryogenesis and morphogenesis
atgtcaacggaatcaactacgcgtccactgatcgcaaccagcacatcccacaatgtgagaaaagagttggaaaccgaagaaaataggggaaaaaagactaaattaagaaaaaaatattcagataaatttaatctttttgcctttttgttcaaaaatgtcaggaatttttgggttcaagttttcattcaaaaggattggcgtgccgatgccgacgctgtcaaaaggcgctaccgggataaatttttgaaatttttggctcttttattaatagagatttcacatcaaaaattgccaattaaaccaggggcgtaggtctaaacaaatgcgtccgtttcttgccaagattgtggctcatgctgggcaatgggtgccacttcttcgctggctgatcggatcaacatcaagcgcaaaaacgcgtggcctcccgcctatttgtcggtgcaggaagtgatcgactgcagcgaggccggctcatgcgaaggcggcacgccggacaaagtgttcgagtacgcgcacaaaaatggcattccgcacgaaacgtgcaacaattaccaggcgcgagacggaagtgaggggncggggggggggggggggggaaattggcattttgtaaaaaggaaataaggaaatttaattaaaattttattttacttaaaacatttagcattttgagaaaaatgtgggcataaacgaaatcatttgaatatttgttagtgatttataacttaattagatttaaaattaatgtgtaaaatagttatttatcttggttaaatatttttggaatttatcaaatgatttttggaattattttatttccgaaataggtctatttcatttttggtcttcggcatcatccaattttgacttgccgagagacccaatccgttcaaattcaagctgatcattggctttataatttgcattatgcaacagaatgtgacccgtacaaccgttgtggttcgtgttggcccgacaaatgtttcaccgtccaaaattacactttgtacaaagtcggcgacttcggctcggccaatggaatccaaaagatgaagtaaagcaagcatacataaattaaaataatttttaaacatatttttagggccgaaatttaccaccacgggcccatcgcttgtggggtggcggcaacgccgcggtttgacaattattcgggcggaatttacaaagagcgaacgaatgaggtgatcagaggagagactgatcactggccagaataactaattttaaattttaggatattaaccacgtcatcagtgtgagtttattaaaaatttattagagtctttcaatggcggtatttttggccaacggctcaatttttgttttttataattatttatttaattctaaataaataatgaaaggttgtcggatggggcaaagatgcggcttcgggtgtgccgtactggatcggccgcaacagttggggcaccgcgtggggagaacagggtaattaattcgttaatatgactaatttgcataattgaaccctggacaataatttaaagctaagatcattttttcattttccagggtggtttcgtgtcgtgacgtcggagtaccgcgacgcgggaaacaaatacaatctgaaaattgaggaggattgcacctggggcgagccaattatcatctgaatgaggagcgaacaatccgagcactgttcaaacccgatgccaaaattttttccatttttgtccaagcatttttaagccaaaataattacggaatttgacaaattaggcaaatatcaatcgcctttctgctgttgccttatttaatccaatttttaaataattacaacgacaatttattttagtttatttcgctaaaatatttttttataatgtttatattattatcgttagaaaaatcagatcagtaaaaatttttagaaggatgggagacacaaaaagaaacggaaaatgaaagttgaaaaggaaagaacaaaacagaaaaaatcaaaaataatttaaaaataatattaaaaaaaagaattaagcaaatagtaaaacatcatctaaagaaagggtgccagcgtgtttcttaatccaccacccaacaaatataaataaccattttttcattgaattttaattaatatacttttgaaaagataaattaaaagcaaaacttttgttcgaaagaattcagatttttcataaagacaaaaacaaaaaaaaaagaa

SEQ ID NO: 45737 - DNA, 1807 bp, Heterodera glycines; identical to SEQ ID NO: 4184
  misc_feature (15)..(15): n is a, c, g, or t
  misc_feature (1767)..(1767): n is a, c, g, or t
  Genomic contig location: Contig_ID=SeqID_4184; Location=1..1807; Strand=+
  SCN-specific regions: Sequence locations=1-227,249-705,729-1807
  Gene Ontology: Biological process=positive regulation of growth rate

SEQ ID NO: 45738 - DNA, 2293 bp, Heterodera glycines
  misc_feature (1794)..(1794): n is a, c, g, or t
  misc_feature (1828)..(1829): n is a, c, g, or t
  misc_feature (1838)..(1838): n is a, c, g, or t
  misc_feature (1840)..(1840): n is a, c, g, or t
  misc_feature (1875)..(1875): n is a, c, g, or t
  misc_feature (1887)..(1887): n is a, c, g, or t
  misc_feature (1893)..(1893): n is a, c, g, or t
  misc_feature (1937)..(1937): n is a, c, g, or t
  Genomic contig location: Contig_ID=SeqID_22844; Location=1..2293; Strand=-
  SCN-specific regions: Sequence locations=1-82,105-1300,1330-1360,1391- 1641,1663-1908,1930-2267,2292-2293
  Gene Ontology: Mol. function=transcription factor activity; Cellular component=nucleus; Biological process=limb morphogenesis
gtggaagggctgcgaaaggggccggacgccccttcccccgctatttatatgcttgttcaacactttcggggtacacaccggcgagaagccatacaaatgcgaggcaaatttaaaagtttgaaatgtttcctaaaaatcgtgggacgaacaattaaaagaatagaggggaatagttggattggtcgaacattctttctgatcattctaatgtccgatcattcccttattgatcactctattttcttccgatcattcctttctctgatcattctaatgtccgatcattctaatgtccaatcattcccttattgatcactctattttcttccgatcattcctttctctgatcactctaatgtccgatcattcccttatttgatcactctaatgtccgatcattcccttctctgatcactctaatgtccgatcattcccttatttgatcactctaatgtccgatcattcctttctctgatcactctaatgtccgatcattcccttatttgatcactctaatgtccgatcattcccttctctgatcactctaatgtccgatcattcccttatttgatcactctaatgtccgatcattcccttatttgatcactctaatgtccgatcattcctttctctgatcactctaatgtccgatcattccctttccggcgttctgttccttaatagccatctttttgtttaacattcagtgggcaagttgtgaaaagcgctacgcgcggttggaaaatctgaaaacgcaccagcgaacgcacactggagaacgtccgtttcagtgtacgatctgtggacggtcatttacaaacatttcggacaaaatgaaggttcagtgaatgaaaggacaaacattaaaaggaaagcaaatgattgatcagctcttttcagcatgagaaacgcgtgcacaaaaagaaggtcagcaaagtttgagagagaatgggggacggaatgccaaacggacgaatgccaaattgggactcactttaatttactaatgaggagtgccaatttggactcactttaagccccgcccctaattgtcggctcttttgattgggcttgcctttgcagaaacaatactcttgcgtggttttgggctgtgccaacgcctacacggacccatcatcactgcgcaagcacactttgagaagccacgggaccaatccgtggatggaatacaaagcaagacgaagcaaagtgcgaaggattaatgccaaaggaaaacggacgaaaagagacgaaaaattataaaaaggaggagaaaaagcatattaagcagacgacactcattggttgattaattaattaattaattaacgactgattattgtactgtactcatattttatcattactttaaaatgcatgaggtaatagccaaacgaacaaaagaagaagctgattgatcagtcagtgatcgtctaaaatgccaattctctcgcctttttcctcaatgtttttgggtcgcttttctccgatggatttccattgtgtaaacattgccatcgtcgaaaacaatcaccgaatcggattcctgctgattagacaattatttcccagcaaatgctttgactttttgcatcgcttttatttgtttcctttttaccgcgtcgtattgcacattcgaaatggaattgggccccgctgcagcccaacccggtgccgaaattggaagtgccgtccccgcgagcatttggccgtttcggaagtcgaacagcgacacaatttgcagaggaggcgaattggaatctgttgggtggggagaagaattagcaacccggnaccggcccccgacaacgccgaagggccaagaccnncacgcaggnangggagccgcaccacaccgaacagaagcccacaacncacaaaagcgangaccanacgaacggccgacgaccccccaaaaacccagagggccaacgccnacagacggacagaggacaaaaagagcacagacagacgagaaagaggaaggccggaaggaccggaaaggacggggcgacggaacagagcccaaagggcggactgagcgaactccaaatcgacggaggagaaaaaggaagaaggtccaccgaagcgaatggaaggattagcgaaagagaaaccgtacaaagggaactgaaggggcaggaaaaagggaaaaggaaatgcaaaaggaaagaatgcaaaaggaaaaggcttaggcaataggccaaatccgtcggagaagccaacttttgatttttttttagttgatccagtctctggcccctcccccctcttccctgcctctctctctact

SEQ ID NO: 45739 - DNA, 674 bp, Heterodera glycines
  Genomic contig location: Contig_ID=SeqID_4197; Location=1980..2653; Strand=-
  SCN-specific regions: Sequence locations=1-499,522-623,645-650
atggcgccgtacgtcaaaaccatcgccatttccgaaatactatcccgcactcccgagctcatattcctcaacattgtcactttggaaagtgagtttcattttggaaatattttggctgaaaatatgcaaatgcatttggtcagatgagagttattgcgtggaactcactcaacgaggctggcgggtgagttccgaccgtctcgactgtatgaacggagacattcaaaaggtgaccaaccatttgcaagggaattgcttttatttgtgacagttttcgcttttcagttggaaatgcacgtcacttactacgacgccattgagcagctgttggacagcttaagcgagcagtaccgcgagaattttggcgccgcactctcttcaaaactggccgctctgcagacggaacagaagcaaagacagcaggacggagaatcagagggaaatggcggaggggcggcagagagaagcgacgcggggcaaaggacggacgacgagccgaactgacaatgagcggagcaaagaaaagcacagaatgtttgtccattttgattgacccacccttcgttggtctgttactcatttacacttctccgaggcgagtgtcccatttctcttccattcccttcagtttcattttgaccgtaatcatatttaaaaattttttgtaaaataaa

SEQ ID NO: 45740 - DNA, 986 bp, Heterodera glycines
  Genomic contig location: Contig_ID=SeqID_22855; Location=1..986; Strand=-
  SCN-specific regions: Sequence locations=1-83,111-146,168-356,383 -407,429-475,497-986
  Gene Ontology: Cellular component=Golgi trans face; Biological process=embryogenesis and morphogenesis
tccgagcgatcggacgttgtgccataaaagtggagcacagtgcggaacgatgtgtgaacacgctgttggaactgatccagacgaaagtgaattatgtggtccaagaggcagtggtcgtcataaaagtgatttggccgaccatcggcgagagatgggagagacaacaatttctaattttatcccttttaggatatcttccgaaaatatccaaatcgatatgagggcatcatttccacgctgtgtgaaaacctcgacacgttggacgagcccgaggcacgcgcgtcgatgatttgggtgacagcgtaaatcctatcgataaaacaactatttctttattcaataaacagattattggtgaatatgccgaacgcattgacaatgcggacgaattgttggaatcgttcgtcgaaggatttcatgacgaaaatacccaagttcaactgcagctcctcacggccgtactcatcaattagaatttaatttttggtcttattttccatccgttaaggtggtcaaattgtttttaaagcgtcccactgacacgcaacaattggtccaacgtgtgctcacattggcgacgcaggtggatacagaccacctctattctgggtggtggggtacccgttatttcggggagtatctcaatggtcaatgattgccttttctattttgaaataggattctgacaatcccgatcttcgggaccgcggctacatttactggcgccttttaagtgccgacccacaagcggcaaaagaagttgttctggcggagaagccattgatttcggaggaaactgatctcctggaaccgtcgcttcttaaccaactggtgaaatgcattaaaatgcatatttcaggacattaattagacttttcgttgctcttacccctccctcccggcttttcaggtctgtcacattggttcgctggcttcagtttatcataagccgcccagctcttttgtcgactccaccattatcctgt

SEQ ID NO: 45741 - DNA, 781 bp, Heterodera glycines
  misc_feature (136)..(136): n is a, c, g, or t
  Genomic contig location: Contig_ID=SeqID_22856; Location=1204..1984; Strand=-
  SCN-specific regions: Sequence locations=1-250,272-632,655-704,726 -746,769-781
ctatacacgttggacgtcttcgtgccctgctcctcagccgtttgtcacatttcgccatcaaccgactattcaaatggcacttccaaattcaatgccctcatcgagaaaggcgtcgatgttgtcccggacttgcganagctcattttccgtgccgtaggctctacaaatgatgaaaaaatcattgctgcattgaaaaatttgatggagacatcgggctacgcacaagtggagttgtcatgtgtattaggtatgagatattaggcaaatgtgaggtggtcccttatgacaaaccttttaaggacttggccagtgttcggacttgaaaatgctcgaggacattttcaattatggtgttattcaaggcaaaatccgcgaccaggacctttatcttttgttcgcggcaacggaaatggcaccgatggcgtgctgtggacatttcgcatgggactttttcaaaaacaatttcgcacttttgatcgagaagtacggcagcgtcaacagcaacgtgttcttgcattgctttgactgcgtgacttcgggtttctgttcgaatgccatggccgaggacattatggtgggttaatgcacaatcagtggcaaaagcggagattttagacccatttaaatttaggagttttttaaaaaagaattggacgaacattctctgaaaacattggagcggcctcttcgtcaagccgtcgaatccattaaagtcaaagagagtttgctgaagaataacgtgcccgatttggacaaatatttgcagaacgtgggatattaa

SEQ ID NO: 45742 - DNA, 880 bp, Heterodera glycines
  Genomic contig location: Contig_ID=SeqID_22859; Location=1..880; Strand=-
  SCN-specific regions: Sequence locations=1-19,42-109,131-213,236 -275,297-418,440-880
aaaaatatgaaatttaagaatttcttatttttaatgggttataaaaggtgttttaccccaattttcaggtgtttctcaacattttccaagtcaacgagtattggttcaactggtcccagctgttgtttctgatttggaatgccatcaatgacccactttttggctatttgcaggtagcgagcgaatctcccgcttttaacaaaaactcttaaccaaattcatgaagttttaaatcgcaaaaatttttaagcgtgctttttttacctagactcactcaatttttgagtctaatttttgaaaatttagcgaagaaatacaaccattttctgtttgttttggtgtgatttttaacgaaatttttgtaaattcaaatataaatttggctaacaaaatccgacatggtttagccatcgttggggaatttatgggaaatttctttcagaattatcttaaggcctagctttacaacaaaaaaaaaatgcgcatttttttattccaaattttcccatatttttttaggacgtcggtggcacttggatgaaagaccgtggcaaaattttcacctattttggcccctttctcgtcctctcctttctgatcacttggttcccgtggcgaagtgcgcccaattcgccgccgtacgtcgagggattgcatttgatcgtctcactgtttctctacgacgcatttttcaggttacaatggccaggccaataaaattggtgaaattttaaatttttaggcgccagggaggggtttaatgggtagaaaatttatattttgactaatttgggcggttttatgagaattttcacctaccccccccccccccctcatcgtttcacaatttttcggcattttttcttgcgaaatttgactc

SEQ ID NO: 45743 - DNA, 1106 bp, Heterodera glycines
  Genomic contig location: Contig_ID=SeqID_4203; Location=1900..3005; Strand=-
  SCN-specific regions: Sequence locations=1-671,702-1106
  Gene Ontology: Mol. function=glucosamine-phosphate N -acetyltransferase activity; Cellular component=Golgi apparatus
atgacttcttccgttcacaattcccccaattccgttgtgctcccccaacttccttctgattacgttctccgtcctctgtcgttgaatgacgtcaattttggtttcattgagcttctggaacaactgacttctgtaagttcccccaattgtacgttaaaatgttttattaaaagattaacaaattgcattttgcaggttaaaccgttaagcgttgaacagtttaaagaacgattcaaccaattaaacgaacaaaaaccacgggcttaccatatttatgttatcgaaaaggaaaggtaaccgaatggaaataataaaaaattgtaatgcttgaatttattttttagtactaagaaaattgtggccactgcgactttggtgttggagtggaaattcatccacagttgtggagcccgaggacgtattgaagatgttgtggtggacagtgaagagagaggaaaacactttggccacattctcaacgaatatttggtaagtgattcataatttaacaaggtaatggttgttggatttaccaattgatgttggttgatttgttctttttttttgttaccattccctttttatggaaaggaatgattgggtttttacgattgtttatcccttccctgagcggcgaccttttcaggcagttcttccatgttttcatggataatcccaaaaatttcccctttttaaatcggtcataggtccctcaaagctattcaaaaactgtcagaagcaatcaagtgcgattaaacgaagagaaaaatataatttatgagcgcttgcttttttcacaagaaaaattcggtataacttttgtgcatccaatcaatttattcctaaaatttgaaatctcagaattataagtcatatacacgtaggagtgttatgaataaataatccaattaaacattcttggtatcatttggtagcaccgagagttctctattagcctacgattgttgaacaaattaactaatgattcaaaaaattatggtcaaaaaagtatttttttggatctaatttttctgaaaccaaacaaattttcaatgaaaaaattggttatactgaactagagcccattattctccgcctgaaataaa

SEQ ID NO: 45744 - DNA, 288 bp, Heterodera glycines
  Genomic contig location: Contig_ID=SeqID_22962; Location=943..1230; Strand=+
  SCN-specific regions: Sequence locations=1-105,127-288
  Gene Ontology: Biological process=reproduction
atgcctgagttacttttcaagaccatcacgcagcaatcgttcacaattgaagttgaggaaactgcaacggtgagatgtttagacatccttttcttgtgcctaaatacctaacgatccattccttttcagatcggcgaagtcaaacgaaagatccaacaggtcaaaggcgcagaatacccagcggagaaccaaaagctgatcttcaacgggaggatgctcgaggatgccatgttggtctctgagctgaactttgcggcgccgaaattcattgtcatcatggtcatgcga

SEQ ID NO: 45745 - DNA, 1697 bp, Heterodera glycines
  Genomic contig location: Contig_ID=SeqID_22966; Location=1..1697; Strand=-
  SCN-specific regions: Sequence locations=1-169,191-284,311-712,734 -1192,1215-1347,1373-1396,1418-1493,1515-1697
  Gene Ontology: Mol. function=xylosylprotein 4-beta -galactosyltransferase activity; Cellular component=Golgi apparatus; Biological process=sphingolipid biosynthesis
ttttgcacaatttcttggtcaccacccaggccatcgtcccaccaccccgttacatcttcggtcaaccaatcggaggaggacgcgccgcgcttcaaccgcgccgcgtcgataaacatcggagcgttggaggcggaacgcgtcggttgcgattacatggcaatccacgacgtggacattggtgttgcatttggatggggatggacggcagaaaattgggcaaaaaattgagtgaaaatggaattgaaattgtaaattacccattttttagcaaatttgattacgccaaaaaaattttttttttttttaatttcttttttctgaaaatttttttgtttcgatacgggttttcggggctcttacaattgggaatatgtatgaaccgaaccacctttgtacaatgaataaggggaatggatcagttttgaaaaaaaagtcaccaaatgattccgaaatttttccaatttaagttccgcttaatccgaacttgagctaccattacccggaggatgggcacataatgcacgttgcagctggtcaataccatcccatccgaaggtggagtttcaaattttactttgtcattttcaccaattaaatatgacaaaaaatttcgactccctttaaaaaactgcttttttaaattgttttttgacttttttgtccgagttgggttagggtttctgagttggtccacaggcctatttataaccatgggggggggggggggggggggaatgactaaaagttggcgaaattgggctaaaaattcccattttttccacggagcttaaaaaaaattttgggccgggagagcaaaaaaaaaaaaaaacctccaaaaaaaatttttctgatctggtaacgggcctgagttggttgaaatggatgttgtcagatttgtgtgacaaatgggggaccccagaaaatccgggaaaatgtttcagaacttaaaacatttacacaccgtcaaaattcgaaacgaaataccaatttttaaatgaaaaatatacgaattcgagaaataaattaaaaaatttccccattttttaggtatgactacaaaaatttcatcggcagtgtgctcgtgatcactttggccgattttaaaaaggtttaatttgtttcgtggcatttttgttgaacgaacgcatattttctcatttttaggtggacggaatgtccaacgaattttggggctggggcctggaggacgacgacttttacctctgaatgtttcccaaattcaaaaaacgatcaaaattttctgacgacttttcaccccttttttcgcggcgtcttttccccaaaaaaaaaaaattttttgtttgggggaggcccggcggtgccgataggggccgcagagaagggagcaggacaaaacgtcgccagccgaaacgtcgccgggacatgtaccccgcagagaacaatcttaagaaattttttcataaaaattttcacgaaatgcaattcaatatcgttaaattgtttgagttttgaaacaaaaattatgattttttccattttcaattttcggattttgggaccgacaattttaggggggcgggaatggccaacaaaatcaggcgaccgtccaatttgagcaccaatcggtccaacacatttctgcatttgcacacgcggagccgacaaagggatttctcagtggacgaatacagaaaaaaggtaaacggaaaggcaaa

SEQ ID NO: 45746 - DNA, 1044 bp, Heterodera glycines
  Genomic contig location: Contig_ID=SeqID_22992; Location=1..1044; Strand=+
  SCN-specific regions: Sequence locations=1-90,115-330,502-646,668 -860,884-1044
  Gene Ontology: Cellular component=integral peroxisomal membrane
tgttcacactttccgtgcggttgctggggttgcccaacagtttagggcattcaaaatttatgtaattattaaaattaactgggaactgcacttacatatattatttatttttctaaatattgccacttttcttcaacccgccccctttttttgcaggttttctcgtctcttttcgtgccaattttccgttggtgccgttttctttggcgccatttgttgtcccttttgcgggttcgccctcgcaattacgcgaattcggaggcaatttggacgaacattcatcagcagcaacaaagcaggggttcatttttttccttttgcattttccactttctttctatttccttttttttccatttgtttctcttcctctgaccatttctctcttttctttctttttctcctctcttttccttcacatttttgcactttctttttctcctttccgcttttctttttcttatttttcctccccctctttcttcagtccctttttcttctcccaatttcgcttcacttttcttttggctgatcgctctcggcggccctttccttctttttaaatgtgtccttcggcttgccgaaagagaggccgaggcgaacaaatggaccaccggacagacggagcattacacggcacaggcaatttttatgattttgttattatttgttcttgctcattcttctcaattgatcctctttttccttctcttatgttaggcattgttcgacttttgcgctgccaatgccaatgaattgtcccttacggcgtttgatgtgattcgcatcgcgccaaagtcggcgcagccgaatgtcaaagattggcttttggccaggtgttataactttgaaatttgacagaccaaaaaattttattttttaagcacattagacggctcaaaagttggccttgtgccgataaattacataaaactgattggaaaatgcaacgacagaaatgcgcaaatcatatgaccagtccgaacattgggttaacggacaattcaattctctttcattttgtcatttcatttaaatgtttcc

SEQ ID NO: 45747 - DNA, 2225 bp, Heterodera glycines
  Genomic contig location: Contig_ID=SeqID_4235; Location=40..2264; Strand=+
  SCN-specific regions: Sequence locations=1-37,62-138,160-455,478 -674,696-776,799-1009,1031-1424,1494-1719,1741-2225
  Gene Ontology: Mol. function=ATP dependent RNA helicase activity; Biological process=nucleobase, nucleoside, nucleotide and nucleic acid metabolism
atgaccgagtgttgttcatctgctgtttctgacaatggcactgctccctcctcctcctcttgggctgagttgggtctttctgctgcgactctcaacgctcttggcacaatgaagtcgcgtcgcttctcaatcaacaatttcttaaattacttattttcttcatttagctttccttttccaactccaattcaaaatgctgtgattcctatcgctgttaaattgaaaaaagacataattggagcagccgaaacggttgatatccaattaataccatttgattgaatccaatttgtcaacatttagggcagtgggaagactctcgcatttgccattccgattctcgagcattggctgaccaatgccattgccacaaatgcccaacattctccggccaaaggctcactttttgcgcttataatttcgcccacgagggaattggctgttcaggtggacagttgcatttgtttctctttacaaattgcctttttaacccaattttcccttttttgtcagataaaagaggtgctcattgccctttccgttcaaattgttccacgcgctccgaaaattgttgcaattgttggaggaatgagtgagcagaagcagcaacggttgttgaaggcaaagtatgcgcactttcttcacatttaatgcccttttgttatggcgattgaggccccgttttttgctgtttgagaaaactggcaatttttttatcttgttgaaaaaaagaattttttcccgtggaactagccacaacgtcgggtccctggttttatttcagttttgttcttgaaagcaatatgcataatgaatcaatcgccttttgatctctccgccatttttagaccagaagtgatcgtcgccactcccggccgtttttgggcattgcgtcaaaccgtgcgattttcccattttaagaatttatctcgtctaactaattcctcgcttcgctttattttagtcccaaaatgccttttagggcgaccaacatttggcggatttgtccgcacttcggtttttggttgttgatgagattgaccggatgttggagcaaggccattttgaggagctccgacacattgtccaggacattcacaggccagacaaattgtcttcggaatttaatttaagtgtttatttttcagggataaaaaggagcaaaaaatacggataagcattgcttccgaccaaacggccgacccttccgatggcattgctttgccaccgcttcaaacgctgattttttccgcaacgctcacttttactcatcacattccgttgcggaggggcaaaaaagaggcgcagcaaatggcgacggacccaaagcaaaaagtgaatactatcacattatgtttaagagaaaagtcacttttcggggtctttctaaatttatttaaaagggaatttcaagaaaaagaaagaaatttaagaattttaaaatttatttttttaattgttaaaaatattttcatttttaatcatttaattaacgatctgctaattgtaagcattttgttttggcgttttaatccaattcaatttgtttggtctctcttttgaggtgcgtcggattgccctttcgatgtccatgcgaaagggcgcagcgaatctttctgtgattgatctgacgccaccgcagaaaacgccacagactctgaccgaatgtcgcatgaattgtgccgatttactccaaaaggcacaaaacatttatatttcccaatctcattacaaaaaattcattttgcttattttttatacattttcaggattcaaatttgctgtatttgttgaagcggcacggcgggcgcactttggtatttgccaattcgatttcggccatccggcgaatgcattcgctgctcaaaaaattggcacttccgaacacggcactgctgcacggacggatgaaggaaaaggaacggctgaagagtgtggacaaattcaaaggcaaaggaacacggggacaacagagggaacgacgaattaaaacaaaaataaacacccatttcaaaattaaagaattatcagaaaagagcgtcgtatttcctgatatattttccctccaatttccatgcctttcagcgtcggatgattccgttctcctcgccaccgatgtcgccgcccggggcctggacttttatggagtgcaaaatatcgttcattaccaatgcccaaaaactacggaagtgagaaagaattggatatgttcttttccggtttga

SEQ ID NO: 45748 - DNA, 1414 bp, Heterodera glycines; identical to SEQ ID NO: 23003
  Genomic contig location: Contig_ID=SeqID_23003; Location=1..1414; Strand=+
  SCN-specific regions: Sequence locations=1-3,38-104,126-212,238 -290,312-763,785-1169,1213-1414
  Gene Ontology: Mol. function=CDP-diacylglycerol-glycerol-3-phosphate 3-phosphatidyltransferase activity; Cellular component =mitochondrion; Biological process=gametogenesis

SEQ ID NO: 45749 - DNA, 2620 bp, Heterodera glycines
  Genomic contig location: Contig_ID=SeqID_23006; Location=1..2620; Strand=-
  SCN-specific regions: Sequence locations=1-200,232-389,412-560,635 -1071,1094-1236,1260-1267,1308-1514,1537-2119,2142-2192,2214 -2492,2515-2620
tccaaaatgcgatgttcggcaacagcagcagtgagcccctcaaaagttgaacgacggcagcgaactgctgataccatttacacagacggcggtgcagagggaagtgcacgaagtcaaattgggtaagaaaatggggaaaatggggagaggggggaaggggaaacgagagggattgattcgaattaggaaaacaattggaagggcaaaaagagggacgagggaggggagcagtgcgaccagatcagaaccaatcaccaacaaactctcctcttttggccaaatttggttaatttaatgccacagatctgtctatgctggacaatgccttggactgcttcaaatcctttctgactgttctgtacggcggtgtttcgtcttgtgcctccggcgccttttcccttcccccgggggtcgacccttcttcggtttgatctcctcgattggcatgctcaattgttgtcagtttcagctgctatttttggccaaactgcttgaactcaccgacctggaggtttcggcactctttggcaaatttctctcctcggcgccgtcccttccgacctctctttccctctcctccgccgtatcctcctccacttcttcgtcctccccttcctcttccatttattcttccgggtccgtcaactttcgtccgatgccaaacaacgaaaatcagttgccattgtatttgggtaggtcttttgtcctgattggttcccccggcgttggcattccctcctttttttgtgccataattttttgccattttcctttttaccgtttattcctttggctttgtcccaatgggttgttcctttcttacttccggtcccacttttaagcctatctccaactccaatcgttgctccaccaacagcaacagcacttcgctcatcccatgccaccagatttggcccattttgcccaccatcctcaaatttcggctccctttggtgccgccccttccgccgttggctttgccgccccaatgtcagccttattggcccaaatgttcagcaaaaggtgagcagccgaagtcaaccaatagtcatttgtcataatcctccgctgcttttgcccaattaaccaaaaagggatgagaaaatgggcgaaaagtgagggaaagttcaattgcgtttgtgtgctgctctaatccccgctcacttttcgcctctcatcatcaattagaagggatttgagcaaagttgtggatgacaacgaaggtatgtggtgatgaacagcagaagaagaagaacatgagatcattgggaaggggagaaaggggggggagggggggggggggaaggaccaaccaattcaaagaatgccaattcggacaatccattcattcgtcgcccttttaatcatttggctctaaaaaagaatttaatgcttttcacttaatttcccctcttttagagcctctccttcggttggccaatcgaccgccgtttcggattcgtctctttcgtcctccaccgcaattggcgtccattcgacagagagtggggccccctcctccctgtcctcatcctccgtgtccatggaccatccgctggaaaacagcacggaatcgttggacagcataacccaatcatcagcgggtggtgccaacaatatgctggtgccatccaacgacaaagaaggcaagtgatcggtggcaaatgatcagaccaatgaatgaatgtgcttttccccacttaagggtggtgccgcaacaaaaagtacatacaaatagtcaaaaaaggtgccattgcaatgccaatttaaatattgccatcaaattcgccatcgttcccttaggctatcggtgtttggtgtgcaacaaagtgtacggtcgctacaactcggtcagttaccacgtgaccatttaccatcggaacccgcccatccgttgcgaggaggagggatgtcagttcaccaccaggcaagccaagcccagcggaatactgccaaaagagtgtctttccgtttagagaagcgcggtacattcactttcacaaatattaccgtcaccaaatcgcactgccggaatccatcgacttgggcaagtttaacaaccaatgggagacggacgaacaaattttaagacagaataggaaaaggggtcaaaattaagtgaacaaaacccaaaaagaatcgaatagagcgggcgaactctgttcaaagacattatatgtacatataccgtattacttaaattttttccaatttacatttcgggcgggaggggggggggcaattggatggcactccgttttgatatgttcgtcaattggtagaatattttgccaatttctgatttgaattgactcctccttctgctgttcagcttctcgcaaatgccctctgttaggctgtaaacacgtgtccaaaagcccggccatgttggacaaacacatccaccgacacgtggccgactgtttgaaggacggcgcgctttatgtgtgcacaatgccagcaaaaggaggcgaatcggaggcggaagtgcaggcggatgaggagcaggaacagtgccaattcagagcgaattcgcacgaagtgagaagcaaaaagggaaagggggggggcaaagggacaacaactaatgagtgatcggaaaaatgatcaggtagggggg

SEQ ID NO: 45750 - DNA, 807 bp, Heterodera glycines
  Genomic contig location: Contig_ID=SeqID_23009; Location=174..980; Strand=-
  SCN-specific regions: Sequence locations=1-807
  Gene Ontology: Mol. function=structural constituent of cytoskeleton; Cellular component=lamin filament; Biological process=nuclear envelope reassembly
atggagccccccagcgtggcgagcagcgactaccgaagcgccatttcctctcgcccgtacttctcccgccctcggccgttgtcgcccactcgctactcatccgacgggggtggcactcgtgtgctgaagatggtcagcgagtcgtcctccatcagcagtcgccccttgtcgccttatcccgcgtccaccacagccaccgcaattcgggatgcgcgagagcgagaaaagaaggaaatgagcgaactgaacgatcggttggccacttacatagagaaggtgagtgggtaattaagataattaacaggccaattaggtatcaatcggttggttttaggtacgttttctggaggcacaaaaccgaaaattggcaacggatttggactttttgaacaaacgatggggaaaagacacgtccaatgtgcgcgaaatgtacgagacggacttaagacaagcaaaaaaactgttggaagagacacaacgccaaaaagacgaattggaaaagaaagcgaaagcgatggaggaggaaatggacacactgaagaagaagtgggccattagagatgagcaaatgatacatgcattaatgctaattataaaaaatgttaaaggaatgccaacgcagtgacagcgcacgaaggggacaaaaaactgatggaagaacttttgcagagtctttcctcgttggaagccgaattggcaatgcttaagcgacggctggaaattttggacgaagaccttaaagcattgagacgggaaaaccaacatttgaatggcgaaatgcaaaaagcccggaccgatttggaccag

SEQ ID NO: 45751 - DNA, 1210 bp, Heterodera glycines
  Genomic contig location: Contig_ID=SeqID_4243; Location=632..1841; Strand=+
  SCN-specific regions: Sequence locations=1-340,362-662,699-1210
  Gene Ontology: Biological process=positive regulation of embryonic development
ctccaaatttgtgccctcctcagtttcgttgcgtccccccgtccgatttgccggcatttccctcccttttggcattgcggagcgtccgaagccggccaaaattcagttgccgcccccgggcaacgaaaaaggccattggcactacgagcgcgaatattcgcgagacactcgctacacaaaaccgcttcgagggggagccttcaatttgatagggtaaaatgcaatcaatgtccatttgcactattaatgttacttgattttttaatgaattctgacctaaaaattgtgaattgttagatctgataagaaattttgcacaaaatttttcgtgaccaaaacaataaattcatttgtaaaataatttctttaaaactaatttaattaaagctattttctcgatgggattgtctcttcctcttaatcaattcacttccacttgaattcccccgtagcattctcctcgagcccatcaaacacaaagaattgtatccgatgttcgcgctgcccattttcgccgtcactttgggctccgttgtcctcctcatcagcgccttcaaaatcgaagtttggctcgaccgaaccggcaaaaattcgtacacgcccccgtgggattgggcacgcgttcgcgacaaatattggaagctgcctacacaaatgtggacatttaaccatttttattttaacacttttctagactttggactttcgagagcagaaagacatgggaaatgcccagcggcacttccgtgctcaaagtttcttgacactattgaccagggcttaactaaaaaagcttcttgccctttaagatttgttaggccaattatcgcttgtcaaaattgtcaggttccaattagtgtttttttgttcgctaccacagtgataaatacccaaaataattccccttcagttttatcaatgccaaattctggccaattgccattcttttgtcttgtgtattagtttgagttcctttaccgtcattggattctgttggggttcccccgccgggcatggaaattgccaaatcgatcggtagggctaaaaatgatgaacattttgcccttcccttaacccatttgaagggttactttgcctctcaaatttgctaattaggtatgacccgaccggtgtgacgcacgaacgccttttggtaatggaacagttggaggacgagttggtggaggcggcgcagaagcgcggcacccgc

SEQ ID NO: 45752 - DNA, 406 bp, Heterodera glycines
  Genomic contig location: Contig_ID=SeqID_4244; Location=2403..2808; Strand=-
  SCN-specific regions: Sequence locations=1-138,160-270,292-406
  Gene Ontology: Mol. function=structural constituent of ribosome; Cellular component=cytosolic small ribosomal subunit (sensu Eukarya); Biological process=protein biosynthesis
atgaagcggattgagcgaggccctgtccgcggcatttccatcaaattgcaggaggaggagcgggaacgtcgggacaattacatgccggaaatttcctaccttgacgcacagaatcaccagacgatcagcacagaccaagagacgaaggacatgatcgagtatttggtcagttaatgagaaaatgcgtgcgatattctacgggatttttctttttttgaaattgagaaaacaaacctactaattaacattaacaatgaagggattcgaaaggacattccttcttttgtcatattaatttgcaattttttgtttctaacctatgcatagtgcattttcatattttcagggacttggtctcaacttggaggtgaaggggcctgtgccgactggcgcaggacgtcgttga

SEQ ID NO: 45753 - DNA, 916 bp, Heterodera glycines
  Genomic contig location: Contig_ID=SeqID_4246; Location=308..1223; Strand=-
  SCN-specific regions: Sequence locations=1-94,122-179,222-230,279 -293,320-478,500-629,656-700,722-836,858-916
atgtccggacgaggaaagggaggcaaaggactcgggaagggaggcgcaaagcgccaccgaaaagtgagtgggcggaattaggactaattttgtgattttaattaataatttttttaatattgctttgtttaggcgtgtttttcaaggtctaattggtctccccattttctcaggtgctccgtgacaacatccagggcatcaccaagccggccatccgccgtttggctcgtcgtgggggcgtcaagcgcatttccggcctgatctacgaggagactcgctcagtgctgaaggtgttcttggagaatgtcatccgtgacgcggtgaatatcttttttttgttagggattggtccaattaggtgtctgagtgtggttgaatcccggaaattctatgaaatgctttttgtgactaaatttctcgaaaaatagggatgggatggagcaaaccctaacttaagtacatattttaccaatttttcttttcttaggttacttactgcgagcacgcgaagcggaagacagtcactgcgatggatgtcgtttacgcgctgaaacgtcagggccgaactttgtacggttttggtggctgagcagaacggtgacggaagagaacttcaaccaaaaaacaatcccaaacggccctctttagggccacaaacatccaaatggacgcaaatgatattttgaaaatctttttcaatggtttttgctgatgactatatttactcctgtttttgtgtatgaatattcggtttataaaattgattttttaacacgagggctaaatgcggtgcaaacgacaaaaaaggcctgcgatgcgacaggcgtcagttgttagtgttgtttttgttactctctcccatttgtctgctgccacagtccgacatgtgagcaaagcgccccgaggggttaataaa

SEQ ID NO: 45754 - DNA, 784 bp, Heterodera glycines
  Genomic contig location: Contig_ID=SeqID_23046; Location=88..871; Strand=-
  SCN-specific regions: Sequence locations=1-784
  Gene Ontology: Mol. function=cleavage/polyadenylation specificity factor activity; Cellular component=mRNA cleavage and polyadenylation specificity factor complex; Biological process=mRNA cleavage
atggggccttatatttctgatgataattctgaaatacaacaaccgctcaccatggacatggcacttgcggagccaccaaaacatttgacagatgttgaagagatgctaatcgaacagcgaggagttagggaggttaagttcgtttgttgtctaattgtaagaaaatgaatactgccgaccttttaagttgccctttcccggcatggataagagtggacgcggtgtctgccttaaaaacgaagtcaaagcgtgcatgtttggcgcattatgtcctctccgacacatcatcaaggacaaacaagttgtgtgcaagcattggttacgcggactttgcaaaaaaggcgaccaatgcgaatttctccacgaatacgatctgagtcgaatgcccgaatgcttttttttctcaaaatactgtttgtttattctcagcgaaaattatcggatagtttcattttagtggcttgcagcaacagggaatgcccatttagacacattgacccggagagcaaaatcaaggattgtccatggtacgaccgcggtttttgcagacatggtatgatttcggttccgctacatctttttagcacttattttttaggaccgttttgcaaaaacaggcatcgtcgacgtgttctatgccaattctacttgcttggcttttgcaccgatggcccagtctgcaaattctcacatccgtccttcaatttgccaatgccagaacctgctcccaagttgaattttcgtccaaactatgcggtcacttgtcataattgccacgaaagag

SEQ ID NO: 45755 - DNA, 1231 bp, Heterodera glycines
  Genomic contig location: Contig_ID=SeqID_4248; Location=801..2031; Strand=+
  SCN-specific regions: Sequence locations=1-50,72-1231
  Gene Ontology: Mol. function=translation elongation factor activity; Cellular component=mitochondrion; Biological process=translational elongation
tctctttcgtagggcgtttttacgtgtcctacgcgcaacctcagcagaaagtgcaaagtgaggaaaatgcttggaactcattcatttggccatgatttccacaattagcatataaacgggagaagccgcatttgaacgtcggtacaattggccacgtcgaccatgggaagacgacacttagtgcggccattacgaaaggtggcgcatttgctgaccaattccaatcaatgttttgaatttgagaattgtactttgttttagtaatttgttcgttccttaacattcaccgttttaagtgctctcacggcagaaaaaagcgcgctttgtcagttacgaggacatcgacaagggcgcggaggaaagggcacgcggagtcaccataaacatagcgcacattgaatacggtcagtgggagtcatgggaaacgtacaaaaggcgaatgtcgtgatacccttgcccaatggggcgtaaataatctgacgatgagacaacgaaatactgaattttggccacaaaaacgaagtgccaaacttttgcatgtattttgtgccgtttcttttttgtacgattgctatttttgcctgatcaattgcgccgatcactcccacattttgtttctgttaatgccatcttttcactgtttccagaatccgacaatcgtcattatgcgcacacggactgtcccgggcacatcgatttcatgtaatgttcatagttttaaacataatacggaacttatacagaaagaatatgatcaccggcactgcccaaatggactccgccgttttggtcatcgcagcggacgacggagtgatgccgcagacgcgggaacatttactgttggccaaacaaatcggactgcgcgagatcatcgtgttcgtcaacaaaaccgacttggtggacacggatgtaatggaattagttgaagttagtgtgggcaaaagtgtaaatgcaattgcgataagcgaatgcctttgacagatcgaagctcgcgaactgctcaccgcctacggcttcgatggtctttgattttgcgataatatttatttttcatgacagtttaaattcttttgtattatttattttttaggagagaatgccaaaattgtgtttggttctgcccttcgggcactcgctgatgacgacgacaagtgcattttggagttgatcaatgcgctggacggactggaggagcccgtgcgtacagaggtactgcttggacttcgcatgc

SEQ ID NO: 45756 - DNA, 1317 bp, Heterodera glycines
  Genomic contig location: Contig_ID=SeqID_4249; Location=1066..2382; Strand=+
  SCN-specific regions: Sequence locations=1-379,402-566,589-1317
atggcaacgaattcggcatttgaacggttggatgattacatttggggtcgcgctgacgagggcgaatttctgcggggagtggtcgcagatgagcgattagacaccgagaaactgttgtcgcgagtgcaaaacattcaacgggaaatgaactcgcgtcttcgccaaggggtgaaaaaaatagaaaaatcattgaaggaaatgccaatttcaggtggaagagaattacccaagtctattggagcaggtcagcaccatcgaacagttggacagtgcccattcgcacgtccaacgcgaaatggacgcggtggtgaggcgggccgacgcattggccaaaacgatggaggaacaggtcaacaacggagaagcggcaattgggtgggaggaggggagcggagagaagggagggattggtgctatgacatcactcaaaaactaatcaaaatagaaatcccttaaatcttcaaacccaaacatttttgtttttatgcacaggtgggtaaaatccgtaaggatgtgcgtgcaatcgcttctctgacccaactgagtcggatgcaaggcgatgcgatcaggtcaagaaatttttaaaaagatgtgattaatttgtttgatttaaaatgtgggattttaaggtgcgaagaattggtggacgcatggcgcgcggagacggatttgatcagacggacggaacacatcacagaagtgaacgcaattgtgaaggccaacgacaaactcagacatgtgcggtggcattccattgcatttaattgcccaaaaaaccctcagaaaagccgaaataatgggtgcaccccaaaatttcgccgccgaaattttgtcccgtccccgaaataattgctcattgtcacatattttatgtacattttcagttgaaatggctccagtaccgttgtctgttcagtctttccgagatgaactcgcgcactcgtcaggatttggtcgttcagttgcgttccgcgctccgttcgctgaacgcgagcggagtgagtgccgttgtgaaggcattgcaacaacttttgggtgagtcgcgagcgcaatttggcgacattttactttattagtaaacgaattgaatgaatttgtaccattttgtgcgttgtttcaaacaaaaaacttttcgccagacggtgtccacgcgtgtcagaaggaactgaatgctgtgatggacgagtccgtctcggagttggacgcgctgttccttcagttggacgctcactcggcaccggagaagacagccaaactgttgccgcagttgggcaacaaattgcacacgcaattggaacagtttcaattgttgggtga

SEQ ID NO: 45757 - DNA, 935 bp, Heterodera glycines
  Genomic contig location: Contig_ID=SeqID_23063; Location=43..977; Strand=-
  SCN-specific regions: Sequence locations=1-60,82-626,677-707,730-935
atggatgggttggcgctggacattgcgagaaagttggaggtgaagcctgcccgttatgcagtaaggaagacaatgatgaaatcaatgtttatcagtcagggccgttatgagtttacatccaatctgttcatggaccaaatcccccgtcgtgtgacaatgggtctggtggccaatgctgactatgttgggacaattaggcgcagcccgttcaactttcaaccatttaatgtgcgcgaaatttccattgttgctaatggacgatcgtacgcccaagcgccctatgacctggattacccaagtaggaaatatgttcgcccgttcaatgacatgaacgaagcggttgggttcgctatctcatcggagagcaacgggataacttttgcccaatacggtaaaacacattgcatttacgttttcaatttgaccaatagcggggacgatcaggcggcattgtttgatctgataaagaatgggaccacagcggtgagcataaaatttaatcacccagtgcccgacggaggaataatgcttgttgtgatgggagaatgtgactcactggtgatgctggacaaaaaccgatcaataagcacagacaccactatttaaagtccgcttgtcatatcattttgttccataaaataaataaaatgttctctaaaaaattgggtcttattttattcttgctccgagtttctcttcccattgtttcatcatcatcatcatcatcattgcgagaacaacataccgaaaacatatactctgattatctaaaaaatttgactctatctcgacatcaacacgagccagattattcatactcggaatatttaagaagattgtctttattcaaacgtaccactgccattgtcagtacaacacctgcaccattaacaaatagctcaccaaaaagcgacaaattaattgatgaacgcggg

SEQ ID NO: 45758 - DNA, 1664 bp, Heterodera glycines
  misc_feature (1638)..(1638): n is a, c, g, or t
  Genomic contig location: Contig_ID=SeqID_4256; Location=1..1664; Strand=-
  SCN-specific regions: Sequence locations=1-1354,1377-1426,1448-1664
  Gene Ontology: Mol. function=protein binding; Cellular component =extracellular space; Biological process=endoderm development
gaatttgcggcccaacctgccgaaaaaactcccagtgttgatcctcaccattataagcctagtcagagttcctgctacgatgaacgtactcagccccagcggtgtgtgcctgactttattaacgttgccttcaatttggaagtcgaggttggacttcgccacttttaaaattgtcgacttcgattgtgcttgatttgccagtattttctttaggttaccaatacttgcggagtccgccagccaactcgtttttgtgtacagactggacacatcggaaagggccaaacgtcgaaagtgtgtgatgtatgcgatgcgcgcgtgccggtcagttttctaatttggcgcataccttacaacttttaaggcttttgctcacccggcttcgtacctgaccgatttcaacatcaaagacaatgaaacatggtaattgaaactcgcttattatacgctaatgcaccttttcttcaggtggcaatctgaaacaatggcggtctgttttaggggtgatatgggcatgaagtttaattttaggaaggtattcaatatccacagacagtcaatctcacattgcacatgcacaaacgttacgatattacgtatattcggttgaaatttgccagtcctcgtcctgagagtttcgtcgtttacaaaaagaacagagccgaagacgactggattccctggcaatattataggtggttttgaccagtttgcgttttagcatttcaattgttccgtttattgctctttagcgggtcctgccgttccactttcaaattgcaagacaaagcgccgattctgccgggaaatgaagcggttgcgcaatgcacacgtgagttctctgacatttctccactgactggaggcgatattgccttctccacgctcgacggacgcccttctgctgagaattttgaggagagcgaagtgctccaggcaatgcctttgatttttattgtcctttttgggttggttatttcctgtccaaacgttctcaacttcgaccccgacactcaaattttttttgcacaattttcttatatattaaaatcttcaaatttttcccggcaccgccggacccccattttaccttacttagttttgaaaaacgtcttcggattccctccgaaatatttttgacaacggccttgtcggagtctgggtcataaatgtcagggtcgagccctatcaaaaaataattcacgtatttaccatcccttaggaatgggtggctgcagaacaaatacgcatttcattggttcgaatgaacacatttggtgacgaaatattcggagacagtcgtgtgcttcgctcgtattattacggaatttccgactttgcggttggcggacgatgcaaatgcaatggtcacgccaaccaatgcgtgaagtccacaggacggggagaggtttagggatgggatggtaggacaaagaagggaaagacaatgcgtgtgccatcaaggaacaattggtgtgcgactgtcagcacaacaccgccggcgtggactgtcagcagtgcgcccccttcttcgtggatagaccgtggcgacccgccacctccatggaagccaacgaatgcctccgtcggtttgggttgagaattctgacggcaaatttgattcatttgtttttccgntttcattctgcacccacttctgtgct

SEQ ID NO: 45759 - DNA, 331 bp, Heterodera glycines
  Genomic contig location: Contig_ID=SeqID_4257; Location=1..331; Strand=-
  SCN-specific regions: Sequence locations=1-232,262-331
aacaccaacgccgttttcatcccaacgacaaaacagcaccacatggaggcgagttgcagcacttgtgttctcattcatttaattcaaaatccgaatttaatcattcgaatattgtgtatacaggatttgctattttgatatataaattacgtttcaggaataactgcatttcctggcgaaggtggcaaagtgctaggcttacgtaacaaacggctgttacgcgaatacaggcaaaatttaaaaaaatatattcaaaaaattgacattaaaacattttttgttataggcctaagaagcattggtacgaatttgaggatgttgtgtttgatta

SEQ ID NO: 45760 - DNA, 1033 bp, Heterodera glycines
  Genomic contig location: Contig_ID=SeqID_477; Location=111..1143; Strand=-
  SCN-specific regions: Sequence locations=1-45,67-123,145-198,231 -284,313-332,363-1033
  Gene Ontology: Mol. function=protein serine/threonine phosphatase activity; Cellular component=cytoplasm; Biological process=cell cycle
atgcagccgacgctcgtcagaatccacccgccggccgtcatcgtgggcgacatccatggacaattcgcggacctgaagaagatcttctcaacgcatggcctgccgccggagcagcagtacgtcttcctgggcgactacgtcgacagagggccccaatcgatggagacgatcatcctcctcttctgctacaaggtgtggtttttgcgggatggggggagggaacccccaaaaaatgaaattcatttccccccatttttcaggtgaagtacccgtccaacttcatgctgctgcgcgggaaccacgagtgcgccaacatcaacagagtgtaagtgaaaaagttttttgtgtgtttttttgtgattaatcattcccccccccatttttaggtatggcttctacgatgagatcgaccgccgttacccgcgaccgggcgctcgtcgactcttcgacctcttcaatcaagtcttcgcctggatgccattcgtcggactggtcggcgagaagatcctctgtaagttttgggggagggcaatttttggggttcaataactgttttccaactgactttcaggcatgcacggtggcatctccaatcagatccgcagcctggaccagctcagcaacttgcttcgcccgcagaccgagccactgcttcgttcgctggaaattgacctcctctgggccgacccgtcgacgagcatcacaggcgtcgccccgaacaacagaggagccggcgtcatgttcggcgcggacgtggtcgagagcgtgcgcaacctgctcggcatcgactacatcgttcgagcgcatcaagtgagtttatttttttttttggcttttcatttcacttttgctttaataattttccccttcccttctttttcagctcgtcatggacggcgtggaatacttcgcgaatcgccacctgatcaccctgttctcggccccccgctacaccggcaagaacaacacgggcgccacgctgctgatcgcgccggacctgagccacacaatcacgcgcttcccgcctgcctga

SEQ ID NO: 45761 - DNA, 1471 bp, Heterodera glycines
  Genomic contig location: Contig_ID=SeqID_478; Location=316..1786; Strand=+
  SCN-specific regions: Sequence locations=1-199,221-499,521-601,623 -650,674-1212,1255-1266,1298-1471
  Gene Ontology: Mol. function=casein kinase activity; Cellular component=nucleus; Biological process=signal transduction
atggaagaactcgtggcgctctcccctggaatccgcgtcggccgctggacgatcacaaagaagctgggcgccggagcattcggagccgtctacctgtgcgtgaacgaccaaggagagcaggccgcgctgaagacggagccggtcaacacgccacatccgctgctcgtcatggaggtaggcgggggaggaagggcggaaaattggcaattcaattttaaaatttttttcaccacccaggctcacgtgatgaccaagctggacacccttcgagacggagacgggaagcacttctgccgctgcttggacctcgggcgcgatgagcaaaaggaccaacaatcgggacaaatgaagaagttcaactacatcgtcatgtcactcgtcggtcgtggcctggacggagtcgtcaaggatgccggcggccgcctcagccttggaagcgcagtcggcgtctcgatccagatgctcgccgctctcagaggactccacaccgtcggctacctccaccgcgacatcaagccgggcaacgcaaccatcggacgtccggaatcaaacgaaatccgcctgctctacctgatcgacttcggaatggcgcgcaaatacaccagggacgacgtgagtttgagtgaagcgctttgaaaaaacaaaaatgatttgttccctttcccccctttttcaggggagccatcaccgcccgcgcactgccaccaacttccgcggaagcccccgttacgctgcgatcagcgctcatctcggacgcgaatacagccgcaaggacgacatcgaatcgtggttctactgcatgatcgagctcttcaaaggcgcacttccatgggccagcgtggtgggcatgaacgaggtgagcaaatgggggagggagggataatcagaattctgatttcattgttttttcagatcggcgaggcaaaggtcaaacgccagaagaaacaaccggaagccgttcgacgccaggcaatcgccgacttgctctccggatgcccgaacgagttcggccaggtcctcaaatacatcgtgagttcgttcgttcgttttttccaaaattagtaaactaacaaattaaattttgcaggacgacatgaagtacaccgacaagcccgactacgactggatcatcgcgacattgcgcagcagcctcagcaacgccggcgtccaggaattcccctacgactgggagacgggcaagcgcaacgcggcaccgggcggcggaggcggcggaggaggagggggaggagacagctacttcaactgatgagccgtgcagcagcagcagcagaagaatcgccaagaagcgtcaccgtgcagaattgatcatatgaccactattactgtattgtatgtattattttgtgtccatgctgccatccccgatatacacatgtattgtattgttgacacatgtattgattgaaattgttgttgcataactgtgtttgtacatatgacttttggcgaa

SEQ ID NO: 45762 - DNA, 1226 bp, Heterodera glycines; identical to SEQ ID NO: 23107
  Genomic contig location: Contig_ID=SeqID_23107; Location=1..1226; Strand=+
  SCN-specific regions: Sequence locations=1-665,688-689,727-783,821 -1137,1159-1226
  Gene Ontology: Mol. function=proteasome endopeptidase activity; Cellular component=proteasome regulatory particle (sensu Eukarya); Biological process=proteolysis and peptidolysis

SEQ ID NO: 45763 - DNA, 1182 bp, Heterodera glycines
  Genomic contig location: Contig_ID=SeqID_23121; Location=928..2109; Strand=-
  SCN-specific regions: Sequence locations=1-452,474-712,734-1182
atccacccaatcaccagctatgtagaccttagcaaggtgtttgtgtgcacagagttcaagctcaaaaaagtggcagatgatggggttgtggttgatgtgccggcaaacgcagcggtcggccttatccaaatgcccggcgcaacgttcatccggaacctgaaagtgcacatcaaccagcgggaggtgtacgactcaaaccagctgtacagctacaaggtgttcctggacaccgagctcagctaccctgtaacggcaaaggattcatactttggcgtggcaggctatttccgtgacagtgacccgaccaaagtaaacgatcgaaggaaaaaggcggtggaggagagcaagggctttcaagcgataagcaagctgagcgccgacatattcaaccaggacttgtacatgatcagcaatgttgagattgatattgagctcgccctgcagtcggacgattttatgatacatcaggaagccgcaaatagggacaagtacacgcttgagattgtcgactgcaggctgatcgtgaagacggttgatctgatggacggtctcagccttgacattgcaaagaagttggacctggagcccgccagatacggcatccgaaaaacgctgatgaagtcgctgttcatcaccggagggagatacgatttttctgccaatctgttcaccgaggaagtgccacggagggtcatcattgggctggtgccaaaccaaaactacattgggcacaatcagaagaaccccttttacttcaaccaccacaacgtaagtgccgctttgacatgtatttctggcagaaaaaatgttcaggtgcgggatattgaactgaccgcctctggcaggacgtacccacagtttccgtacaacttggactacaagaacaacaggtacgcaagggcgtaccatgacacccaggagcaccttggcatggcctgtacaactgagagcaacgggatcagctacagcatgttcaagactgcctactgcctctatgtcttccaaatgaccaatgcgcaggaggactcgccgggctttgagctgatcaaggagggctgtacagcggtgaacattcggtttgccgaagcggttccgaacgagggggtcactttaatagcctatgccgaggctgacgggctcattctgattgaccggaacagatcaatcactagtgaccttaca

SEQ ID NO: 45764 - DNA, 2182 bp, Heterodera glycines
  Genomic contig location: Contig_ID=SeqID_4274; Location=3428..5609; Strand=+
  SCN-specific regions: Sequence locations=1-608,630-898,920-1121,1143 -1805,1827-2182
  Gene Ontology: Mol. function=metallopeptidase activity; Cellular component=membrane; Biological process=cell-cell adhesion
atgtccgactattttgaaggtgcaaaacctgcggacgaacagtgctttctgcacaactctcgtggcttggaatacgggcactgtgggagggacgtggagggacggtttgtggagtgtgcgcgggaaaacgcgcggtgcggcgttttgcactgtcgcgggggcggcgcgagtccgctggggacgaacgcgagctcattcaacttgcaatttgctaaggagcaacggcatttgcaatgcaagtgagccaaaaggcggggaggtagaggtaattaccactaattgcaatacaatagtgctatacccaaaggggaagatgactgctcaccatttggcaattgcttgacacacattggccttgcccacctcaaaaagccttttccccttagggtggttgtcaattcagccaacggaatggtcaaagatggcaccagctgcggttcgggtcgcatttgcgtacgttctgtttgtgtaccgttaacgcaagtgtcgccgccagtgccatgtccgagcagtaatttggcactttcttgcagtggtcacggggtatgaaatggacgggaactttttcgccgggttttgtggttccgtcttccttccccaatacggggcctgtactcccccggccttaggactgcaccaccggtgcgcattgcgtgtgttttgacggatggacaggtccctcctgcgccctgcgaattccgtctaccgtttacaataaaaagattggcttgacatccgctgaagacggcagagaatccatcgaatttgtggtgccgccatcaattcgaggtgtttttcaatggctccaaaaaccttcaaaatcccccccccccccggattcagtgaatggtcgtgcgttggacactgccacactgctcggcattctgttgctggtcggcttcctcctcctcttgctgctcatttgtctgctcctcttttacaggtaaaagggaaagaccgagcctggcccggtatctggtttttgccgggcccgtaagccggctcggcaatttttgaaaaaatccggtttgaccggggttttaagaagctggaaccggtcattttttaaaatgacagccgggcccggcagattcggaaatctcggtttataatattttcatggtttttaggcgcaaaagttcggtcagagcgtacggaagagaacagaacggacaggcgaaagtggcagatgaggaggactgtgggaaggacgaagggactgcggggagagcgatcaaatttggacaaatgccgagctatcgggaggagaaaatgaagcggaaagcgaacaaaagtgaggagcaaagcgcgacccttggaataatttggcacagagtgccaaaactgttgttaagcatttaccaattcagaaatatatggtgccttgcagagaattacggaagcgaatgaggtgagaagaagccaaggaagcaaaaaactcagaaattttcaagaaaaaatcttagaaaaatttaaaacagtaattcatcataaaatttaaaaaaaacgtgaaaatttaagattttgtcccatccccggaaaagggggaccttaccatcttccatcataggccgactcactttcactcaaatcgcgcgagtcctcctgcgccggtgccgttctctccgtggacggacgaattcagacagcaaacggacagagcattttggcggaggtgccgtctttgtccccgcaccaaccgatggaacgaaggttaaattcggcaccgccttccattgtgccgaatggagaaataggcacgggttgcagaagtcggccgatcagtgacgacgaaatggggaaaaatgccacagaaatggtcagaagaatgcttaacattgagtcgaacattggcaaatattaccgctctttccaggcacatttcggtgcttttgcccaccacttgagaatgaacaatacatccccttcgtttggccctctcccttctcattttgagggagttggcacttttgctgcaccgcctccccggttgccacacattcaaatgctaatgcgacgattggagggatctatgggcgaagaatttgacgtggatgaggagggacacatttcgtcgaggacaccgtcggtgggcggcaacattccatgccccgcggcatccaccgactcgggccatcctggcagcaactttgacgtgagcggaatggaaagggtcccctaa

SEQ ID NO: 45765 - DNA, 955 bp, Heterodera glycines
  Genomic contig location: Contig_ID=SeqID_4275; Location=217..1171; Strand=+
  SCN-specific regions: Sequence locations=1-232,255-955
  Gene Ontology: Biological process=embryogenesis and morphogenesis
atgttcaaaacgtacgggccaaggcccgagtcgttcacgcttgacgatggggagcgttattatgtcggtaagtgtgtgtttgaagcggttttatgcgttcggtactctgtttcaattggtttacgagtgttaaattggtctgtgttcaggtgccgacgttggccaatacttgaaataccatcgtggtacgctgtacaaacgctatcctcaactgtggaagcgaatggcatcggtggaggagaagaagaagatccaggagttgggctgtgccacctcctacatcaactcgaacattatgctggtcaaagcgaacgaggtgatgatgatgcgaatttggtttcattttttgaagtgggaaatgaaaattgtatttttaaggaagccttttttaaaacaaatgcctttccaggtggaggacatttttgacgggcaagaggagaaatatcgcgcgtcggtcagcggcggcagtgcgtacggacgcgcggagggtgcgcaaacgctgcgaagtcggggcagtgctccgtggctgaaccagcaggtggcccaaaaaacaaatgtttgtcagggagaatgccaacgcttttttgcactgattttggaaaatctacgcattccaaaaaaaatacagactccttcaattaagcgtattcatatttgaaatcccagttttttttattattcatcccagggacggtcccagggtttttccttggaggtggtaccgccgcactaggcgacgaccttctttttttacttttaaatttgcatgaggaaggtcttggagggcgtaccaataaggaaaatcggaaagttttggtcagaagccgttttgttctttcttaggtgaccagcggttcccaccacctcgagtccgtgccctgctccaccccttcggcgcacgggcgaggccatttcaaaaatcgcgactaccccaaagtgtgatgagtacggcgaa

SEQ ID NO: 45766 - DNA, 1380 bp, Heterodera glycines
  Genomic contig location: Contig_ID=SeqID_4278; Location=237..1616; Strand=+
  SCN-specific regions: Sequence locations=1-317,361-418,440-623,645 -1245,1270-1380
  Gene Ontology: Mol. function=histone-lysine N-methyltransferase activity; Cellular component=chromatin; Biological process =establishment and/or maintenance of chromatin architecture
acacaattcgctacctgtccctgtacgacaacaaatacttgcgctattttggagggcacagcaaaaagtggggccgccatttaaatgccttttattcatatgtttgtttgttcgtccatctgttgttctccagggtggtcactctgtgcatgtctccgttggacgacctgttcctgtccggctccatggacaaaaccattaggctatgggacctgaagagctccaattgtcagggcctcatgcaactcgtgtcccgtcccatcgccgcatttggtcagttttttttttggacggtcggtgaggaatactttgtctcctaattttatttaaatttaaatgtaatttaaaaaagtttttaatgctttttgattttcgaatttttaaaaattctctaattaccttcgtcgaccattgtccacttccccgctgggtttttcttattacgaaaattggattatgtcttacaaattgtggttttacagatccggaaggtctgattttcggcgctggcattggcaacgacgtcatcaaattgtacgacttgcgctcttttgacaaagtgactaacaatggaataataaatatggggattttgaaatttaaatttgtaatttaatatttggaaatttccaggggcctttcaacacattcaaaatcaacgacaccggactgaattgcaattggacaggcatgaaattctcgcccgacggaaagtctattttgatcatgacggacggtggtatgctgcgacttgtggacgcctattacggcaatgtgacgcacacgctgtcccacgaaaacccaaaggtagcgagcggttcaaaaaatgaaaaataacgggagaatctgatcaaattatcattccctctcccccgtttcaaaattggaatattaaatcgaaaaagggactggatttttgcggtagtcacccgcctaactccccaaaaggcgtaaaattattgttttttcgaatttagatttttttaaatttcagttagactaaataccttctaaaaatactcctacttgcactcaagttttcgaaaaaaaattccaattccagtccatgaatttgaccaaaaataacaaatagaagaatgctatgaaaattttccccccctttctctcgaaaacagaatgtgaatttcgtggccactttttcgcccgacgccaaatacattttctgcggctcgagcaacgggaagatcatttgctggtcgacggtgggtgttttgtccgacacaaatttaattatttatttttgttttgaaggaatctggtcgaaaaatccgcgaaattcccacaagtcactccggcaacatcgagcaggtggcgttcaaccccaagtacttcatgttggcatccgcctgcacgcaattg

SEQ ID NO: 45767 - DNA, 692 bp, Heterodera glycines
  Genomic contig location: Contig_ID=SeqID_23194; Location=785..1476; Strand=-
  SCN-specific regions: Sequence locations=1-35,57-88,112-418,443-692
  Gene Ontology: Mol. function=ribonuclease III activity; Cellular component=intracellular; Biological process=RNA interference, targeting of mRNA for destruction
atgatcgagaaatttgtcaatttctgcaagcagaaggattttctgcactgtgcaaattttgatgatgaggtcttcccattttcattagatattaaacaaacaaaaaattcacaatttatttcacattcagatatttatggtcacagaggatgagattgatgaagggcatgaggaagacgtcgaagttccaaaggcaatgggtgacatttttgaatcagtcgcgggcgccgtttacttggactgtggcatggacttggacattgtgtggagggtcttttacggactgatgcacgaagtaatagaaaagtgctgtaccaacccgccccagtcgcccgtcagggaactcttcgagcgcaaaaattgcaaagccaaatttgcgtaagcgcacatagcaatttacaattaattgtcctttcatttcagaaaattggaaaggaaattggagacgggcaaagttcgagtgacggtaaggacaaaaactgtttaaaacgggctgttctctataatggtctgggcacaaagctttaaatttccaggtaacggtcaatgacaatttgcaattcacgggaatgggcaggggctatcgcatcgccaaatgcacagcagcaaagagagcgcttcaacacttgcgcaagttggacgcggaaaaaatcaagaaagaagctgataagaatgttccgagcacaatttga

SEQ ID NO: 45768 - DNA, 2092 bp, Heterodera glycines
  Genomic contig location: Contig_ID=SeqID_23197; Location=261..2352; Strand=-
  SCN-specific regions: Sequence locations=1-24,55-104,128-326,350 -580,604-1218,1240-1348,1371-2092
  Gene Ontology: Mol. function=pre-mRNA splicing factor activity; Cellular component=nucleoplasm; Biological process=reproduction
tttaggatgaaattcttaaagctgctattatgaaatatggcaaaaaccaatggagtcggatcgcttcattgcttcacagaaaatcggctaaacagtgcaaagcacgatggtacgaatggttggacccgcgaattaagaagacggaatggtcacgtgaagaggacgagaaactacttcatttggcaaagattatgccaacgcaatggcgaaccatcgcgccaattgtcggtcggacggcggcgcaatgtttggaaaggtaaaaaaaaggcctttcaaaacaaattaattatgccattaccattcatttatgaacagcttttgaaatactaaatattaagatatgagcatcttttggacgaggctcaacgacgtgccgaaggcattgacgaggctgataccatgaaagaagccaaaaagctgaagccgggagacgtggacccgactcccgagacgaagccggcccgtcccgacccaattgacatggacgaagacggttgtcttatcgtctcctaatttatgtgatttggctttgtctttaagagttggaaatgctttccgaagctcgcgctcgtctcgccaacacacagggaaagaaggcaaagcgcaaagcacgcgagaaacaattgggcgaagcgcgtcgattggcgtcactgcagaagagacgcgagttgcgcgctgcagggataatgataggctcgggatttgcgtacaaaatgcgaaggcatcgcctgttggattacaacgcggaagtgccttttgagaaggaagtgcccgcgggattccacgacccgggcgaagacaaattcgacaaacgccagcggacgatggtggaggacagacggagagactggcaggagagagacgaccgtcgcaaagacaaggacaaactgcgcaagagaaagtactgcttgacggggatagcattaatacaaacaaaaagccaaacggtcattgggtaggggaaagttccgtgaagaaaagccaaggcttcaagcccgtagccagaaaaaaaaaattcagaggtgagaatccggacttttttttattcttcgggccaaatttcagctccggagagcaaaaataaaaatttgtagtcgttttccgcaaaaaaagactattttttctattttggggtcaaaatttaaaaaaaaagtaaaatgtgggggtctggcggtgccgataagcgctgccgggaatttttttttaattttaatgtagtttaagaaaaaattttgtttagatttttaaggattgtcaatttttcctgaaaattttttatttttctgttagttgaaaaacccattaagacaagaagatgcaccacagtcaattttctccgaaaagcacgagaagaagcggagcaaattgctgttgccggagcctcaaatatctgacaaagaattggacgacataatcaaaattggacacgcctcggactccgtcagagaattggtagatgacaatccgaccaggttgtgttatcctttcagtggccatttcctctttatgcctttcttcagcacccttttgcacgattacaacgaatcttcgcgtgtcagtgccatttctgcgcgcacccaaagaacacccgcgggcgcaattgactcagtggcacgggtaaaagcacatcaaaagggatttggcaaatattggctaattgcaaggctgcggacgatttgctggcactgaccaatgtggagactccgctgaagggcggtctgaacacgccgctgcacactttggactttagcgcccccggaaccacgcgtcagccaatcgccacgccaaacaccgttttgtcatccgtcgcggcgacaccgaaaaacatcgaagaccgtaggcacttgcattttcgtcaaaaattctcaacagcgtttttgattagaaactccgggctctcagcgcagtttggactccgccgcaacccccgcccattcttcgaccgttgccgggacgcccttccgcgaccaattgaacatcaacccgagcgaagggcgcatgaacagaaaggaattgcaaaaacaattcgagactcttccaaaaccacgcaacgaattcgaattggcaccaattgccgaagacgaagaagaga

SEQ ID NO: 45769 - DNA, 2596 bp, Heterodera glycines
  Genomic contig location: Contig_ID=SeqID_480; Location=6103..8698; Strand=+
  SCN-specific regions: Sequence locations=1-88,110-252,281-362,385 -1117,1151-1346,1368-1497,1520-1917,1939-2596
  Gene Ontology: Cellular component=mitochondrion
atgctttcattgtacacgatgctcgagttttccctgttggtgctgaacggcattgcaattataaaccgtgaacgagttctgaacaaggttaacaaacacattgttttttatccaatcgttttccccttattttaagtatttgaagaatcggcagcacagtttcggagcagaaagtgaacaatcggttgtattcaggctcgtcaatttaatttttgcagttcaaactgttcttagaggttccgtttaattaacttttttgctttattaaaagtttgactcttttagtgcctctcatcgtcatgaatattattgttatcatcataaagctgttgtttggatgaaaatatgccttggccataatcatatatttatttgcagtttattcgttcgttccttcggttgtcattaaattttttcttgttactgactgataatcttttccgaattttctatatgccaatgaaaaattgacttaatcattccaactattttttctcacatttgaatatgtaatttgcttttttcgtggtcatgtttgtcagtattggtgctgcgctgtcttcgagtcgtttttttcgatgttcaacagttgcgaaagcattgtcttgcagaagatcatcccattttaccttttaccccacagcaaacacggaatttccaaacgacaccggaaaaggtcataagatttgctcgaattttgaaatgtcaaaacattgtaccccccgcccccccatcgttcctctttttaaaaaaaattgacgtttatattgctaaacaacgaaataaatttaagttactgaacgtctcaatttgtgccagtcgatcaacaaagctatgcacatcgcaatggaagaggacaagaacacaatatgttttggcgaagacgtggctttcggcggtgttttcaggtgttccgttggtcttcaacaaaaatttggtaacaattttctgggtcgattgtttatgcgaatttaacctgctgaatcatttagatacttattgtttaaatgttacaggcagagaacgtgtgttcaacacgcctctctgcgagcagggcattgtcggttttggcattggctacgcggttgccggacatcgggcgatcgccgagatacaatttgccgactacattttccccgcatttgatcaggttccatgcaggcaaatgtgatttctgggtcattaaattcaattttgtattccagaattttgatacattttaattcgagatatttgactataaaatgtccgttcccacagattgtgaacgaagcggccaaatttcgctaccgaagcggcaatcaatgggcatgcggaggactgacaattcgtgccacttggggcgctgttggtcatggtgccctttatcattcgcagagccccgaggcatactttggccacacgcccggactgaaggtgagatgtcacttattgttaacctcagtgttttgataccacgaaaccatttttggcataggcgcaaatgagtgaacacggaaaaaataaattaattttttatccgtttctttatttctcgaacaccgccaatttccattaattgggtgcttccgtaaatgtccaagtgaagtgcacattatttaaattggcaaaaaaagagaaaagcgtttgcacttaggtgcgaagtgccatttggcatcatttggtgccaatgtttaaaagctttgcatcagtacaactcacgcacatttatcataatgtttcaccaacttcaacctatgattttcatgataaaaattgactaaacgactcgaaattctttaggttgtcataccccggggtccaatccaagccaagggtttgcttctgtcgtgcatcgaatctcccgacccgtgcattttctttgaacctaaaattctctacaggcaagaattatgcaaaaaaaaagttattcattactggaaattttacagaaatgccgttgaagaagtgccgatcgacaaatatttgctgccgcttggcaaggctgaggttgtcaaactgggtcagtgcattttaagtacaattagacgtaaattacgaggcaaataatccttaatttagggactgacgtcactttggttgggtggggcactcaattgcatgtactgcttgaaaccgcagaattggcacaacaacggttgggcgtttcgtgtgaagtcatcgatttgcaaacaattttgccgtgggatgtggaaacggtggccgaagtgcgaaaggacaaatctctagaaacagtcaaattatagtcctagtttcagttaaaaataatttcgactcaattaaattaaacgctcttcacagatggatcaattttaggatttgccttttcaagaaaattttccgagattttcccgcttttgcttttcagagtgtggctaagtgtggacgactgttggtttcgcatgaagcgccgatcacttccggcttcgcggccgaaatcgcgtccaccattcagcagcgctgcttcctcagcctcgaggcacccattgcgcgcgtctgcggctgggacacgcccttcccacacgtgtacgagcccttctatctgccctcaaaatggcgatgtctggaggcaatccgcggattgatcgattactga

SEQ ID NO: 45770 - DNA, 4330 bp, Heterodera glycines
  Genomic contig location: Contig_ID=SeqID_4298; Location=295..4624; Strand=+
  SCN-specific regions: Sequence locations=1-480,502-598,620-864,888 -2272,2294-2671,2694-3418,3440-3517,3540-3573,3595-4103,4125 -4195,4217-4267,4290-4330
  Gene Ontology: Mol. function=translation initiation factor activity; Biological process=gametogenesis
atggcgacaacaacagcagcagaaatccccagaaaatcaccacaacaacggaagcgcgaagaaatggcgcagcttctagagtcacgaaaagtgggctaaatgtgaacgaagctgatggtttacatgatccatgtttaggtggatcaaggtgctaccttcgtcgagccaagaaaaccttcaggaacagccggacaaaaggggaggatgaaactcatcacaaacgtttgtcttttctgtagtgttcaaaagagccaatactgtgattttaggcacacattctcaaactactgggtacgcaagccatctaccactacgaggtgaccatcaacgcagtgagcagtcgttcggaccggaagttttgcgtttcagagccgagcggtccacgggatagggacgagtaagtatgacgttgatgttaggtctaacatcttctgtttagtttcccattactcaaccgtcgtgacaaatgccgtgaggtcttctcggcattctacaggaccatggaacagtcactgaaagataccgggaacttactctactacgatttatcgaaaacaatattcacattgaagaagctacagatcgaggtttatgggctttggatggcattttaataataacacatcgtttagtcggaaggaaaattcatgtttaacatcggcacggtgccaaccgctgaacgcccagacgcggcacggttcaaacattatgaattcatcatcaggccagcgactggcttcgaggttaacgacttgtccttcatcacgaacgacgtgtcgaaaatggaacgatcacttgagcaattccttgacattgcaacggcgcagaaggccaacatggacgggtatggatttaatcgaaaacaataaatatataattttaatatacctaatcatttgaattggactgctgtcagtggatttgggaaattcagagttatagaacaaaaccaaatttcccgacagaaattttgaagtcatgaattcagggccaaattttaaatatttgattcacctaactgttaagaactcaaaagtctattttcaggaagcaatttatcgggtttacttcgtctcgtgtttacttattggcgccaaccgactatggcttcggagccaacgagtgtcctgtcttcgattccaaccactcattcttaggtgtcggagtgaacaagggatgtcgaattgttgaaggtttgttcgttttcgttcaattaactcattagaaaatcaggagatcaaggccctggccaaatgacaccagccatcgtcatccaaacgaaaaaggtttatttttatgggttccatcagtcgtcccataattattttttaccatgttccattcattgtccttagtccgctttccacattccggacatgtgcattttggacaaggcaaaaacgctccttttccgagagaatcagggaaggttcgagacaggtgactttactcaaagtgactacgaggcgctttgcaatggccttgtcggtatgttaatataatgcgtttgaaacgaattgttttatacccattctctaggaatttatgctgaaccgcgctatggaacgtcgggacgatttttccgcatcagtgacattacaaaaccaaacactggaaatggtcttaactcggagaacacatacatcacacaccaagtcagcgggaaaatcagcgtcaaacaatatttcgaggatacctatcagaaaacgcttcagtgagtttatccaattcgattgttttcttaaaagaaacattttagtaattatttctccatttcaggtaccctaaagcaccactcctcgtcaattatcgcagaattggggacccggcgtattatcccatggaggtaaaacggacagcaatttattgtccctttttaaatttaattaaaacacttaggtttgctttgttttggatggtcaacgcgtcaaaagttctcaacaaaatcccgagcaaattcgtgtaggtgtttagcgatttaatttataatcatcattctattccaacattaacaatatgtgtttaggaaatgatcaaagagactgccattccgcccaccgttttgcgagtgcacaacgaaagggtgaaggagtcgcttcagttggtcaacaacgaatacttgacaaaagcgtccgttcactttgacacaacgccactccatgtcgattaccgtgttcttggtccgccagcaactctctatcggaacaaccatcgtgtcactcctgccgcgtcaaactgtgaatggcgtccgggtgacgctttggtgaatgcgcaaattggcaactgggtagcctatgcgtttgggaaccctgcgggtgactcggtgcgacgattaggcttaaccgaaacgatgtggaggtaattagcgctgaaattcctgattggttttaatgtaccaaaaaaatttatagtaatatctgtcaactttaaacaggaatttcgtggacaagtatgcaggtgaaatgcgtaacaagggcattgtttgtgtgcctccggtgcgtgtctctttttgctggtttacgtccgtgaacgaggtcttgaatgttttgcacaaggaagccctgaacggcgttgagttctgtctcattggtcatgcgaaaggctttgagggtgatgacgtgcatggtaccatttattagccgttgtaaaatttaggctcctgattgtgagttatttatttagttacgatcaaggcgtttgaacaacagactgaaattgtcactcaagcaatcacatttgacgttctcaaggatgtgctcgataaaggcagcccattgactgttgcgaattgcattcacaaaacgaacgtgaaaatgggcggtctaaattatgctcttcatatggatgatccatcgtacgtctttttttcctttttccatatagccaatacaattggtttcagtgtggcccaattgttcgacggtcaaacactgtttcttggttttgcaatgaacttcccgggtggattcgctccttccgaatctgctgcccctatcaacggtgcgaacggttctgtgccttcaggaagtaaagctggaccaactctgcagaatggtgctaacggcgtcgccgctactggagcaaacaccattcctctcggctcaaatggaaatgtggttccgagtgcgcccgtgccacgagttggctcctcattgcctcctccttcgtgcattggggtaatacaaaaaggagaagagctcattaatcaattttaaaggtgtaagtcaatttctaaaattccagtgggccgcgacaatcggaaaacgacacaaggacgaatacattggtgactttgtctaccaggctccgcgacgtgaggagaaaattgatgtcattgcaagcgttgtcaggagatgcattgagtccttcaaaaagaacaggaacaaactaccgtaagttttggacaatttgcaatttatttgttcgcaatgattgctcagactacgcgtggtcattttgcgcaacggatgtaccgagggacaattcgaatatgtcatgaagtaatttttcaaattgatgaaattatttgaaaatgaaaatttctattaaaatagtgacactctggctcttcgaaaataaataatgtgccctactttaagatatgaaattccgctggtcaagaaggaactggaggaattgggttgcaccgcaaaacttactgtgattgttccaaaccgacttcaggtgcactttcccacacatcaaaacggcaccgcctcatgtaatttaacgtttttatttatttcaggatgtacgctttctgcgtcaagatgccaagccggaggacaagagcaatgagcaaaacatccccccagggactgttgtcgacactggtgaatattttactaatttattgccctaacgagttacaattttcagtcgttgttcaccccaaacgctccgagttcttccttaacagtcacgtggcgatcaagggcactgcttgtacgccacattacactgttctgcgggacgagaacgatatgtcgatggacacacttcaaacaatggtccattacctctgctttgggcatcaaattgtcacaaagccgacctcattgccctcgccggtgtacatcgccgatgaatatgtgagccaattcaaataacaataagaaaacatagacagagaatcgaaatcatttaggcgaaacgcggtcgaaacatctactcacactacgccaagaacggtattgacaacagcaaaaatttgcagctcttcgcaaagaacaaaggggtggaatggccgctgcgcacttatgcggacatgaccaaagtcctttctttcctcaacaccacctacctgagggagctgcgcatcaacgcctga

SEQ ID NO: 45771 - DNA, 2138 bp, Heterodera glycines
  Genomic contig location: Contig_ID=SeqID_23268; Location=514..2651; Strand=-
  SCN-specific regions: Sequence locations=1-1113,1139-1551,1577 -2026,2050-2050,2072-2138
  Gene Ontology: Mol. function=thioredoxin peroxidase activity; Cellular component=cytoplasm; Biological process=response to oxidative stress
atgtcatccagctcgaaagctttcattggtaagccggcgccaaatttcatggcggacgccgttgtgaacggcgactttcaaacccaatttcgctggaacagttcaaagggcaatatgtggtgctgttcttctacccactcgatttgtacggggcaacagcgttggatgataatatgctcaatgttgccaagtttttaaatgggcacaaaggctccgaaatctgaaattttaccctaatcccataaattcgcccagacgaacgtcctttttttttgccggtagcgctttatttttgccttattttttcaaaaaaagattgtaggcgacagggaaaaaacgcaattttttgcggttttgagtcctttttttaaaaaaaaaatttgtcagaaattttgaaatcagtacaaatcttagagaaataagcctacttggcaacagtgcatttgatggattcactcttttactataatttctcccatttagcactttcgtttgcccaaccgaaataattgccttttcggacaaggcgggagagttcaaaaagatcggtgtccaactcatcgcgtgttctaccgactctaaattttggtatgtatgggcatggacaatcattggacccgtttccgaaacggattcccggggtccattcccgacccaaacttcccggcatgtggaccggaactaacgggattaaatttacactgatatacccaatgcagggagggagtgtggtttttgggagtttgctcgagttcgattccttccctggaaattgttaggaaacggataaatttttaaaattttgcacgaatttttcactaaatcttcccatatccattcagccatcttgaatggatcaacaagccgcgaaagcagggaggacttggcgagatgaacatcccggtgctggcggacaccagccacaaaatcagccgtgactacggcgtgctgatggaggaggcgggcattgcttatcggtctgtgctgctcgactaattcaatgcttttaacggcaatctcgtttcgaaaatattcattttttaacgggagggggggggggccggatggtataagaattttccataaattttttcaaatatttatcaaaacgggcccccttcctccctccccttttcataaaattttttagggtaaagagtagtaaccctaacgcaactttcaaattttgcgggattgaaattcaattttttttttccggtttggatttgcgggatcaacccgaaattttcaacagatgcggtattacggattattaacattccgtaaactccggcccgggggatccgatccataacatattattatagtcatctgaacaaacgcgagactaaagttttatcaattgactctgtttttttttaaatatccaattcggctccagtaggcattggaatgggcgtcaaatttgtgcgtgaatccatggaaaattctcaaaattgtttttccgcataaacacagagaaactctgacaatgagaggaggactggggtcgtctgtctcttcattaatttcctgccttttccagcggattgttcatcatcgatgacaagggcgttcttcgtcagatcaccatcaacgatttgcctgttggtcgctcggttgacgaggcaattgtttttgttttgtttttttaatttgaatgctcaaaaaagctattttctccattgttgctttcattaaaaaaaaattgggaaaaaaatttttttttgattccgaagagaaaaaaaggtcttcctccttcggacggacaggctcttcaatcactttttcttgtctaggactggttgtccaccaattataaaacgaggcattaatgaacggtttaccacaaccagggctaaaagcacgtgcatttttatcccaccgttctcttacgcaattccccccccccccccccctctaactgaagaaaagcgtttggtttcataataatttttgaaactaaaatttacacaaattctaaatcgcatcacgcattttcaagacgcttcgtctcgtgcaagcgttccaatacacggacaagcatggcgaggtgtgcccggccaactggcagcccggcaccgacaccattaagccggacccgaaagggctcgcaggcgtactttgacaagaagggc

SEQ ID NO: 45772 - DNA, 380 bp, Heterodera glycines
  Genomic contig location: Contig_ID=SeqID_23285; Location=1675..2054; Strand=+
  SCN-specific regions: Sequence locations=1-380
atggctgatgaagcacaatctccgcccaaagatggtggtggtaaaaacatgcaatggatgtacgagggtgccaaatcggtggtcaatcgggaggactatttgctgggcaaaaaggtccgtctgtcacacatttattcattcgacattttgcgtgtccaagttcatatgtggttcagatcgacaagaatttcgagatgttctctgatgttgttgtccatgaccaggaggaggagaagcgggatgcattcttccagcagagccttctcaagccgtccacttccgcccatactgctgctcctttcgtcgctcgtaatcagcacaaagtgtccgctttggacacgcgtgttgtacgaactgaagacccattggtggccctgaaa

SEQ ID NO: 45773 - DNA, 1942 bp, Heterodera glycines
  Genomic contig location: Contig_ID=SeqID_23295; Location=15..1956; Strand=+
  SCN-specific regions: Sequence locations=1-174,196-412,445-1328,1350 -1942
  Gene Ontology: Mol. function=insulin-like growth factor binding; Cellular component=soluble fraction; Biological process=signal transduction
acactgatcaatccgcctatgactccgatcactccgctgcatatcgaccacgaaccaagcggaccgcctttggcaacaattttgaagttcggatcctttctgacaattcgttggccaacattggcacgaaagcaatgccaaaattgaaagcgtttaatgaatgccgatttatggcattaatttttaaaaaatattctgcccattttcagcccggtggcatttgccaattgcgaaacatgcgcaaattgtacttaaacaaaaacggaattggccaactttcaccccaatttttcaactctttggccagcaggtgacaattggaattttatggtgatatatagtatctgagaatgcgattttgtgtatcgcaaaagataaaaaccgataattaccaaagttcaaaagggtaaagtttttaaattatgtatttaaaaaatattttaactccatttattgaatttattagcatttatttcgtaagacacgatggattttcccaaaaaaaaaaaaaatttctgtaggttgtttttaccgaaaatcactaaattatcagtatttcttccgttttttcaaaccgaagtgccaattcccttcaagggaagtgctgcaaaagttggaatttcgtggcaataaattgaccgatcagtcgctgaacgaaggcggcgcagcaggcgaaggcggccaacagcagggaatgttcggggcactgaaaaatttgcaggaattgagcctggagacgaacggactcagtgcggtgccgagcgtcgcactgagcgcacagcgcggaacactgaccaatctgaacttgggactgaatcaggtggtgatcagcagggaatagcgggcaaaagtaggcgtataaagcattgatcagagcagttgatcagaaagagaacgactgatcagaaaggcagcaactgatcagaacggaattagatcagctgatgataaaaagaataacttatcagggttagagcaactgatcagaaaaaaattagctgaccagaaagaaagtgagagggcaataggccagaaagagagcagaaagagaccagatcacatgagaaggcaagtgaacagacttagagaagctgattagaaagagagcgactgatcataaagaaaacaactgatcagaattagagggaaattgaccaaaaagagagtagaaagggaaaagtgatcagaaaagagaaacatccgatcaaagaggcaaggaattctgaatagaaaggatctgtcctcgaatgattcaaaattgaatgcctttcattcgttgtccatttgcagatcaaagaggtccccgtcggtgctctgaactttcccgagctcacttccctctccttggagttcaacggacttccgatgattgtgccgcacgcttttcagcacgtgccacgcctccaatacctttatttgacgggcaacaaattccccgcctggtcccccgacatgttccgcttcgtccccgacttgcgaacgctcggcatcggcgaaactccgatttcagtgattccggcaaacgcattcattgtctgtctgtttggccttattttgaaggatggtcattcattccagcacacgcccaatttgatgcggttggaaatgtccgaagtttgtcggcggaaggcctttcggcattttgtgcctttgcgacgaccgttcgttcacttttaggcggccgtcgattcaattgagccgggcgcctttcagcggactccgatgattcaggcgattgtgctaaacaaaaacagactgaccaggcaatggtcaatgagcattctcaatattcaacagctgttcagggtccgggccgacatattccagggactgggcgagttgtactcgttggacttgcagggcaaccgattggaggaggtggagccccgagggttcgccaatttggccgctcttcgccatttggacatcaggtcgggttttg

SEQ ID NO: 45774 - DNA, 6695 bp, Heterodera glycines
  misc_feature (1303)..(1303): n is a, c, g, or t
  Genomic contig location: Contig_ID=SeqID_4315; Location=146..6840; Strand=-
  SCN-specific regions: Sequence locations=1-210,232-826,849-1003,1026 -1626,1658-1708,1730-4242,4264-4568,4590-5592,5615-5795,5817 -5823,5846-6301,6327-6488,6510-6611,6633-6695
atggaagatttttacattgtacttccctcgaacacacctggtccaggaaatactgcttcaaattttacggttagacttccgcacactttagagcttgactccaaatggtccgtcgcattatcggcattaatctatccatattcattcccgtcgatcagtgtggacgaggatgactctatctctgtcaaactggttaatcctaactacagagaagatgccggaaattctgacgaggaatcgcaaaagtttatcaatttatcagtgaagattccaaatgtacaattccaaagtgtacaaagtttacaaaaaacactgaatcagataatccagaatgcttacgatacaaagtttggcggctcatcatcattaaatgatggtacaaccaacaaaagagccaaacgacaaaccgaattgtcagaaacaggcgctggagttatcgaagtagagaatttcttcactcgaaacccctttgactactggcaacagattggagaactgagaaaaaagcactatcagctcagagaaagggttgaaaaaatggcaaaggagtacaattcaacagtggatggtgaacgaaaaacatttctctcaacggaacttggggtttttcaggggcgagaaacttttctgaaagaacgtttgcatttgattgaagaagaggcgaagagaagggacggtgagcagcaagaagccaatgaacaaagactcattgaccgtttctttgcccgataccccgacaattatagagagcagctggacgaatggaggtcaagttacctccgagatgtgctagatctacaaacaaagatgggagagtatgaaggagttaaagatttgaaaaggcttgaagagctcaattcgcaaaccgaacgaatgagaaattccatacacgtttttgaaagaaagatggaaatattaaacaacgcagcattgcaacgtgaccagaaaaggtctcaagaggagtttgaacggacaagccatgaacaaaacctgaccttcgtccaggaattcttccaaaccaatcccgtgaattattggcaagcaatccagaaaaattatgaagcgcttcagcttgagtacaccaagaagagggaattgagggaaaagcttgaatttgaaactgacgcaacggaaaggaagtcgctgcagcgacaaatagagagcattcaacgtctgattgactacaggcgtaaacggtttgccgctttggaatacgaggctaaaaaaagagatgcgcagacagggaaaactaactcaggcctcagtgctgtagctgaggggtcaaatagtactagttccaccncaccagactccttttcaccagcagatgagcccgcaaacccagacgaagaaaatgctaccaatagtaaaaacaaccacccaacaaaacatcactactactgccaccgctactttatcatccgagacgccagctgagcaaattttagcagatcaagataatagtattgatgagaaagacgaagcaggtacgccgccgccatcaagtggattaggacagtccgatgctgctgctacatcagtgactcaagttgaagatggtcgaaatttacctcaagcagccgcgttgacctccaataacccaaaaattgttgctaaacaatcaacggtagcgacagagagaaggaaggagaaaataattgaaaagctgatcgacgaacaagtggaccgaatggtcgatggaacacatgcacagcagaagatgctacaggaagaaggtaaagagaacgagagtcaacaccgcatttcaacatataaactcatcgaagaagtgctacatggtgagcatggacagctaatgtcgcaacagcgtgaatcgaaaatggcagctgaatttgcttacaatgaaataactcagcgattcggcattagaatgggcccaggagtaatgcacgttgatttgagcaaacagctgtcctatgtgttggggtttgatcgcaaaacacgcatttacaacaatcagtcggcaaaatatccacctgatctgtctggtggtgtccgtcagctgtacgtttacgcgcctaaactggtggaggattccatcataggtgaccgcatggcaccgttgctgcgagttgtcaacgtgtcagggacaccagggttggacatgccagaggttatatataccaatgaaatttttcattctctccaaaataaacgcatttctgaaattaacattgaaattcagacagcatttggacgttacgtaaaatttggttggggaactaccgtaatcacattacattttagacaaaaactattttagcaacaaaaaacgatagttatgacgcacgttgtttttaacccggacaacgtgaattggtccgcgttccttgcgttacagcagcagcaggagggaagcggtgagctgcagtattttgtaggcaataaatttcagcgtggtggcggtctgttacaaaatatttcgcggttcctgatgcctgtagccacaaacctgctaaagtctgcctcaaaagagggcatttccgcagggacacggatgcttgacgatctcgcgcagggaaaggcgtttaaagagtctctcaaaactcaggcaaagcaaggatttgagaatctggccgaaaagctcaaccaatgcggaaagggtgggcggcaacggcacaagacaatcactcatagaaaaaataaaaaaactggtacattgagagggaaacgacagatcatcgatcagctaacacttgcacattaacattcggcaccacacgaagcctataaataggtaggataattttaattttttccactaacgactacactctcagcaacatacattaaatattttgagagaaacatactaaccaaaaaactcagtggaaaatgagcgtaattaaaaagattgacaaagacagtgttgagggtctggaaggaagtctgtcattattctctttgccgccaaccaatgtggccataaataagacaaacgtccgtgaattgttgcctctgtctgcacttaatcagacaggtccctatttgtttcgcctgttctcggacagccaattttgtgacttgagcaaaacctatatgtacctgctcagctcaattgaacggaagaatgacgcgggagaatgggtagcactcagtgacacggacccaaacgataaacatgttggcgtcattcaaaactttgctagcagctttgtccgctcgctgaaggtcaatatttcaggcattgaggtgtttgacagttcaatttattatcactaccgcgactacataatgaaggagttgggctattcacaggaaattcgcaaggctttccatgaggcatcgtgctactacgcagacgatgatgaccagaacagcgcaacaaacccaggttttaccgcacgtgcggcacgcttttcaggtggtaaacagtgtgagacaatggtaaaactgaattttgatttggcacgtcaaagtgcattgatgttgaacaatcaggatgtaatattcaccattcaccgcaacaatgattcattcctcctgcttacacctccatacaaaaaaccagatggtacacagcaggaaaataagaaagagtaccgcatccgtgtgcatgacatgcgtctctatgtacgcactgtggacgtaacaccaagccttaaccttgccattagccgacaattagagtccacttcagcaaaatatccgctgcgtaaaattgagatgaggtccatttttcttggcacaggccggaccgagctggcacacaatgtgttcacttctacgttaactcgtcgtttaatttgcactttcgtttcaaccgatgcatattccggtaaccgaaaaatgtcaccctacaagtttgaacacgccaatgtacgttcgattagtgttgaggcgaacggacagacctttcccagcaccccgtatttgctgtccttcgatggtgtacagccccgctttgtccgtgcttttgtcgatatgtacgcaggcctgggtttggatgactccgacacaaaaacggtctcgattgggatgcagcgttttcttaacggttgggcctttttcgtcattccgctgacttccactctggaggacacacctggttttgagctgatcaggcaaggcacatgcacgataaaggtacaatttgagcagcctataaaagcggatggatatgagatgcttgtccttggtgaattcgattctgtgttgtccattaacgcagaccgggttctgagtacagacggaagtgtgtaactgactgaaactgattgacactgaaaagcaacaatgaattcagctcaattggaaataattctgaaaagattgcaccctaccaagaacaaattcattggtgttttcccatctgatcgaattccgaagcgggtttccaaattccctcattgtatggtcgtgaatacggacaaagaagggacacgaggtgaacattgggtggcttgctatgctttaagccatagaagggttgaatattttgacagtcttggtgagcccccaaaccccgatttagcagcctacctcaacacatttaaagaggtactggtcactagggagcaaattcaatttcccatatccgatacatgtggacatttttgtgtatattttttggcaagccgatgttctggcgttcctttctgccgtgtgattgagactttgcgtaagactcgaggcatggcagattacctcgtgaaatggtttgtcagaaacttgatcagcggtctataaaagctcacgtttcctgaacagtgagaaaaatgatggttcattttatgaatgttttttacgcaggtctagtcctcagccgtgtaccgtcactattgcaatcggagctgataaatgtggatttgacggttgacaatcaaaactatttcgatagcggcaaatatcgtaccttttcaaaagatgctacagcagcacaacattttggttatagttggaatacagcgtgccgaatagagaaatgtgaacgtgacagcgaatgggccgtttcacttcaaaatgtgtacactttacacagctatcagagtgtgtttttcgaaatgaaatcattggtgaaaatgtcaccattggcctgttttgaatacaatgggcatagttttaccttttttgaagacagcgaatctggtgagactactatcttccgtggtcaccagcataagattgtgcaacgactgtccaaacatggacggattgtgtttgatcacctttcgggtcgattgtttctgatcgataagtatcagaggcggattagcgaaatagagcttgaatacctggagcattggtggcttcgaaaaaaccaatcttccgcccatacgatcttgaagagcaactttgtcgcttttcttccaccagataaaagcgactttactatggtggacaaccatgtgtttgtgatcagagaccagcgcatctataaattttacattgccgactatgcaaaagggaatcgtgcgctaacttttgtaaccaattcaaatgacgtccgctttaattatctaatttataaacccaaagaccaaaatgctagtcgcggcgtttttgctcatctacgcatgtcggacgcctggataccgatatcgtacctgttcaatctgttcctaatagtactgtgcacatacatacttaaacagctacgacgagtggaccgaaagagtccgcttaacgtgtccgatagcgccgattattacagcagcccgttcattgacgacgcttattcatcccaacatcaacaattgttgaatataccgtatgtaactgcaacagcgagtgatcaaagtggtggagcccgtactcggagtatttaaagaacgatttttgttgtttggattcagttggccatttgtttcctagattttaagaaaagctatttcatttccataattgtcacaatatatttacctggttattgcatgcaaagggcaatccgttatctgatcgacagttacggtctgagcagtgtagacgatctgtacacctgtttgaaagaggaaattaaaagtgggcctgaaggtgggaattgtctctatcccaaccccctttgtgctgtggactgcgtacacatttcaaacgaagactatccgaaccaacctgtgcatattgacggctcgcttgaattgattgctgacgttgagctgtactcaacatgttatccgaagaggaagttcgagggaatagtgtggtaagttaactaaacaaaaaaacattattttttttgtcattatgcatttttaaggagcgaacctctgtatgtggagctgaaggacctgaagatttgtccgggcgactcgccgctgtgtctatcacgccatttcgaactaccgaacaacagcaacaacaacatgaacctgatagtcgacgagctggatctatccaactattggagcgacgacgaacgcgaaaacgagactacaacttggtgagagtgctgtgccgattcaacaactgtggtccctaccgactcgctaaacagctacagaaacggaggatggagaatctcacttatcttaatcaactggacattgaaactgctcatcttaggaagaatatcaaagttatcccggacgccttgtgtccaaatggcgctaatcgggtgtttgcctatcgcggattcctcggaatcactgttcagcaacatctctattctcgccatcgtgtcacgctaaagtatccgggtttaccctgtgttgtccaatttggcggtggctatcacc

SEQ ID NO: 45775 - DNA, 2194 bp, Heterodera glycines
  Genomic contig location: Contig_ID=SeqID_23317; Location=516..2709; Strand=+
  SCN-specific regions: Sequence locations=1-90,117-168,193-260,282 -1017,1040-1827,1850-2194
  Gene Ontology: Mol. function=pre-mRNA splicing factor activity; Cellular component=snRNP U6; Biological process=signal transduction
atggactctgatttatacgatgaatttggaaattacatcggtccggagctcgatagtgacgacgatgaagaaatacaaccagtgggtggtaatgaggaggaggaggagcagaaagatgacattatggagcaggtcaatttgattgttcaaaccaaaaatcacttccacaaaaggaggatgaggaagaggacggagaatcgccagttgttcctggcagtcaaattgtgctgcacgaggacaagaaatattatgccactgccttggaagtttatggggaggaagtggagacattggtccaggaggaggacgcccaacctttgacagagccaatcgtcaaacccgtcaaactgcggcgatttcaggtggccggcattacttttccgcagaaagacaattaatgtaagcaaatgccaggcgcaagaacaccttcttcccgagactgtctacaagaaagattttctggtcgatatgacgaaccatcccgaactcatccgaaacattgccattgctgggaactttcaccacgggaagaccgcgttcatcgactgcatggtggagcagacccacccggacttctttcgttatgaggaccgagacgttcgcttcaccgacactttgttcattgagcagcagcgcgggtgctccatcaaagctctgccgataacacttgtcatgcaaaactctcggaacaagtccttcctgctgaacatttttgacactcccggacatgtcaatttttctgatgaatgcactgctgcttttcgtcttgttgatggggtggttataatggtggacgtgcacgagggattaatgatgaacacagaacgattgttgcgacatgccatccaagaacatcttccgatcaccatttgtctaaacaaaatcgaccgattgatcttggaactgaaattgccgcctgctgatgcctatgcaaaactgaaattcacacttgaccaaatcaacaattttgtacagtaagttcaaaaactcagtttctttccccaacaaaagcttttaatttatttccatcatttaaaaactttcagtcgcttgtttcgaaatgctttttcagaacattcggcgaggatgacatacccctcttctcccctctgatgggcaatgtgattttcgcaagcggtcgctatagcatttgcttctctttggaaagttttgctaatatttacgctgccaaacatagccaattaaatgccgagaaattttcgcgtcgcctttggggcgatatgtttttcgacacggcgctcaaaaagttcaccaaaaagccacaattgggcggagcaacgccaacgccgcgttcatttgtgcatttcatactggagcctatgtacaaactgttctctcaggtcccccctccttcactgtttgaccgtcgtttcgcttttttaggttgtgggcgacgtcgacacgtgtctgcccaaattgcaacaacatttgggcataaagttgaacaaagaagagcagagaatgaatgttcgtcctctcatcactttgatttgtcaacgttttttcggctcattcacctgtattttagtagcgaaaattaaaaaataagcttttgcactttagcatttgtcgatttggttgtcaacaatatcaaatctccgattgaaaatgggccgagaaaggtgcaacattgttacagcggagacgccaccagtcaattgccaacggaattggccaattgtagcccaaatgtgagtcgaaatgcgaaggaaacaaacggacaaaacattgcaataattcccacttttagggtccgctatacattcacacgactaaaaattatgccacgcaggacactacggcatttcatgtgctcggaagagtgttcagtggcacaagtgggcaaacggcgggggaagtgcaaaacaggcattttgatgtcaatttccagttcattctggcgacgaggtgaaaatattgggcgaaaactacagcatccaggacgaagaagactgtagggttatgacagttgggagactgtggctgcccgtggcaaggttggcattgagcttttccattgttttttcttttgggtttcttatttatttccacatttaggtacactgttgaagtgaacagcgtcggcgcgggctgtttagttttgatggaaggcatcgatcagcctgtgacaaaaacgtgcaccatcgttgaaaaggactacgaccaggacgag

SEQ ID NO: 45776 - DNA, 678 bp, Heterodera glycines
  Genomic contig location: Contig_ID=SeqID_4320; Location=6779..7456; Strand=+
  SCN-specific regions: Sequence locations=24-294,326-405,428-444,468 -678
  Gene Ontology: Mol. function=DNA binding; Cellular component =nucleosome; Biological process=nucleosome assembly
atggcacgaaccaagcaaacagcccgcaaaacccaatcccaaaaaggcttttcgtcgagcagtggcagccaacacatgcagagtcaactgcacaacttgagaaaacagttggctacgaagcgtcccaacccaaaacgagggatcggatacaaagaattgcctcctgtcaaaatagcccaaaaacgtcatcataagaaaggtaatttggctctactgcattttacgcgtccaatcgacttttacgcgtccaatcacagttttcgcgtccaatcaaaagtttatgtgtccaatcaattattagaaattatttaaaatattggcattaaatgctttgtgtgctttttctataaaatttaattgaaaaaatggaatatagatggttttgagatggtgtttattcatcaaactaatgtttttccattttcaggagcattggcacttaaagagatccgcaagtaccagaagagtgtgaatctgctcatcccgcgccgtcctttcatgcgtttggtccgcgaagtcacccaggacatgtcgcagtcgaccgacctgcgctggcagggcttggcactgctggcgattcaggtttttgctaatccgagctcattgtcagttgttacccaaaccgggcaatcatgttttattagtaccgaaaatttttttgaaaccagaaaattctaa

SEQ ID NO: 45777 - DNA, 1034 bp, Heterodera glycines
  Genomic contig location: Contig_ID=SeqID_23339; Location=105..1138; Strand=+
  SCN-specific regions: Sequence locations=1-184,207-575,598-629,653 -846,868-888,910-1034
  Gene Ontology: Mol. function=peptidyl-prolyl cis-trans isomerase activity; Cellular component=membrane fraction; Biological process =protein folding
tctgcgagaccaaaggtttttttcgatgttatggttggcggaaaatcgacaggttataaactcggacaacaaatcgccctcattctctgttcaaaataggtttaggtcgaattgtgatggaattgtttagtgacatcgttccgaagactgccgaaaattttagggctctgtgtactggcgagaaagggatgggcaaaagtggtaattaaaaagtcttgaccgtgaccgttattgattttactttaggcaaaccgttgcactacaaagggtcgaagttccaccgcgtcattccgagtttcatgcttcaggtataaagttgtggcacttccgcgaaaaggaatccattaacggactccgttttcacattttagggtggcgattttactcgaggcaatgggaccggcggcgagtcgatctatggcaagtgttcggacgaaatgcgaatgaatcggtcctttaggcgagaaattccccgacgagaatttcaaagagaagcataccgtcccgggactattggtaacgtttctggaaatttaaggaatggaacactcgtagcccatgggccaaaaaagcgtcatttttcaacttatttttaaattcagtcgatggccaatgccggccccaacactaacggctcgcagtttttcatcaccacagtgaaaacggaggttggacgaaaggcgtatttagccattttcgagattcatttttaacacaaattaatctagcgaattcaagaaatactggaaaatgcctatacttggaaaattcttttttccgctctcctattcccggaaattgcttttgttattttcggtttagggtttttgatgattgttttcattgcagtggcttgacggcaaacacgtggtgtttgggcgagtcgttgagggcatggacgtggtgaagcaagtcgaagcccagggcaatcagagcggaaagacagcgaacgaagtttgcccatcctttcgctgttcatttcgccgtgactttgcctccattttcagattaccatcgccgattgtggccagctt

SEQ ID NO: 45778 - DNA, 1057 bp, Heterodera glycines
  Genomic contig location: Contig_ID=SeqID_23359; Location=370..1426; Strand=+
  SCN-specific regions: Sequence locations=1-155,217-276,342-397,419 -788,815-1057
ccgccgcattgaactgcgattttgaggggcagccctgttgctgggccaatgtgccaacaccgactgacgatcaaattgattgggttcaggtggagggccaacctcgcagctccattttgccgaggaatttcacggcggacggaaaatatttggtgaaaaatttatttattatttttaaaatttaaattaaatcgtttttttattttgattaatttactgctaagatattataattttaaaactacagttggccacaacatttttgttttctaaagctttaaattaaaaaaaaaattctataaatttttttgaatttttatacttaaatcaattttttaattggttatttcaagtttcaaaaaatagttttaagattttttcataaaaaaaacttgttatcatttgttttttatcttttgcatgacatcattctaacaccttatatacctttacctaatcagcacattcagatcaaaaataattttgcgagattctaataaattttagggctaattaggcccccctccccctcatttcgagatataattttcaaatttgatcacagattgcttatgccacttccgcgtctccgtctgacgaggctcagctgtcctcatgtgccatcgcctgtgccagctcatcaatccgcgttcgggctaggtaggtatgggttttggagaaaattttcaaaaaattctcaaaatttcaaaaattttcaaggcatatgcaaacaacgaacgtgctgctccaagtgtgccagcgcgagtgagaattttgtttttcgatgcaaaaattaaaattttaaaaaaattttcaaggtcctttccgccttcgctcgggttcaacccgttgctgaactgccaagaatttccgacctcttccgaccgtatgatcaacactgagctggtgttaccaaaagcctcctacgtggatgtttgtttgaattttaaatttggcgcacttttttggcgttacgttttttaattttaagatcatcattgttgcctccaatttcataaatgaacggggcgacatcgctctcctagacgatatccaa

SEQ ID NO: 45779 - DNA, 1201 bp, Heterodera glycines
  Genomic contig location: Contig_ID=SeqID_23382; Location=42..1242; Strand=-
  SCN-specific regions: Sequence locations=1-87,119-906,928-1075,1097 -1201
atgccattgaaagccctgaggggaatttcgccatgcacgaaaagcacatatgatcgagaggagaaggaggaactgcgcgcagcgctgaagaaggaggaggaggcaaagaagaagctggagattcggaagaaaatgtccgtggttgtggaaagggtcaacgacgacggcacggagggatggtcggtgagtgaacgggaattgaaattcgaattaaaacgaaacgaaattaaggacaatgtgccgatcacgaaagcacggatggccgaactaatccgccatttctacaatttgggatggatgcgcgacaacggcgccggcatggcggtgcgctttaagtgtccgaagacgggcgagcttctgattctgaactcgtccaactcgttggccaaggagatattcaacgagtgagccaaaagaaaatgaatgtgtccaatttggatttgttattcagaaatgagcattttgtgatgaaatcggccggcacaattttgaagcgtccggcggacccggacagaacgccgactgcgccgtattatttgctccgtgacaacccaggtgaagcagcagcagtcgggcacattttaacgacctcataatgatccgaattgctcagatttggtttgtgtggttcacacgcacacaaaatggggcaatctgatcactcagctgattcaaggagacaaattcatgatttcgggccaggagatgatccaggtaaagcccagtcgaactgatggccaaaattgggcttcatttctgttccaattaaggggtgcgaaaaccgtcagaccaaacgccgaatggaaaatgttgacactttggtggtgccgatcatcgaaacggaaatcaacgagttcgtcctttgcgtaagctctgctgatgaatgtttgccaatctgatcactgtcactttcagcctcaactgatgaagactttgtgcagatatcccgaagcgagtggcgttctcgtccgggggcacggcttcttcgtattcggcagcaacacgtggcaacggaccaaaatgatgtgagcgatttggcattccgtgttcaaaattagcattataattgccattcaaaaatggcatttgatatttggcattccgtttccaggttggagtgctacgaatatctgttcgagttgggctgcgaaatgctgcgcttgaggtccctctggtgaagaacgatgaagaccaaaacacc

SEQ ID NO: 45780 - DNA, 860 bp, Heterodera glycines
  Genomic contig location: Contig_ID=SeqID_23384; Location=629..1488; Strand=+
  SCN-specific regions: Sequence locations=1-386,417-457,479-578,613-860
  Gene Ontology: Mol. function=ubiquitin-protein ligase activity; Cellular component=nucleoplasm; Biological process=meiotic chromosome segregation
tttcaggtgcgtatcaaacggttggacattgtcggctcgtggcgttgggtggacggcaaagaggacgcgtgcggcatttgccgtactccgttcgagacctgttgcatggactgcaaattcccgggcgacgaatgtccattggtatacatatttattgctggcggcgggtggttttggattttaccggatttcgcggattaattgaacctgtcgtactctaggcctaaactagtggcaaatcgtttccccggtgttgccccacatttgcgtctttgtccaaaatcggactcaaaattgaatttttcaagcaccatgatagcctaatccgcattagaattaagaaaacgcggtcttttggttcattaggatcaataatttgttgtttgaaaattttattattttttcaaaaattttttgaagatcaaatgatcggatacaatcacttcactttcaatcgctcatttaaagctgtttatacaatcaagaaatgcaaaaaacttaattttgaacccgattttggacaaaggcgcaaatgtcgggacacgcgataagaaactgattgtgccaagatcgtcagcaaatttttgaaaaaaaaataaaaataaatttaaacaaccaaattattgttcctattccccggtctctatgatggaacacaacctatgtcaaacaacataaggacacttctttgaaattgaggactcaaaaattcaaaaaaaaattttttgaattttttttgccaggtgttgggccagtgcaaacatccgttccacatgcattgcattgtgaagtggacgaacacgcaaagcgggcagaagcccgcctgtccgctgtgccgtcaggagtggaaatttgcgacc

SEQ ID NO: 45781 - DNA, 1749 bp, Heterodera glycines
  Genomic contig location: Contig_ID=SeqID_4336; Location=1762..3510; Strand=+
  SCN-specific regions: Sequence locations=1-255,303-483,505-630,652 -773,795-801,823-874,899-965,987-1467,1497-1627,1689-1749
  Gene Ontology: Mol. function=zinc ion binding; Cellular component =nucleus; Biological process=neuron differentiation
atggattgtggcaacaaacggcctaggacaacaatttcggcaaaaagcctggagacgctgaagctggcctaccaggacagcaagaagccggcacgccatgtgcgcgagcagttggcctcccagaccgggctggacatgcgtgtagtgcaagtgtggttccaggtgggtgtgcggcacggcacggcattgaaaattcattttttgcgctttcttaagaatcgacgggccaaggacaaacgcttaaaggtaaaagcaatccatccatccatccattcatcaatttgcctaattaacctagttttgggactaatgaactaattggctttacggactaattgatcaattaattgattggggcggttgggcggtttttgacttttaagccgccaacaccaaaaaatattggcaagaccatgccaaaaaattattgcctccgattgtttcaacaattttttttttctatcatcgaggcccctttttttgcctggaaacccaagcatttgtcgtgtttttggagtcatcatccgtgtcagggatttttccggttttgaaaaatttgtgccggattttttgggatttggcgatagaagcattttttttcttatcatcgagacttttctttttacccagacatttgcaagggtttttggagtcaccgtgccagatttttgacagatttttcccgattctgaaaaattcgtgccgcaatttttttttggattttaacgattttctatcagtttcattgcccccagaaggacaacgagcgtcggttggctgccgcccatcaccagcaccaacatggcggcggtggcgcgggcgtcggtgccgacccgcaccaccggtccggcagcggttcgaccgtcagcagttctggcggcggcggctgcggtggcggtcccggctccgtgtccgggagcagtgggatgccaatgggcactggcgccatgctgtttggacgcagcgggggctccggcggcggcgcgctcggtgattccgactcgggcgcgtccaacgaagcggaaagtccattttacggtacgcggtaggcgagtttttacatggcattgcctactgtaatcgccctgtttgtaccagaatcccgagaattttggcaaaacccggtcctgtgtaccccagtacaaatcccctcatcagggatgccaatttaaaattttggccagacagaaactctgacaatattccctatccggcgttttttttagttcccattctcgaacccatgccacggcaccaattcccaaccctgcggagttctctgatcccggtcctaattgtcgtgccacggcacatattctgatcccggtccttattgcgtgccacggcacggcacatattttgatcccggtcctaattgtgtgccacggcacatattctgatcccggtcctaattgcgtgccacggcacatattctgatcctgattctacggggagtaaatcccgttaacaaatccccgggggcattttccggtcccgagcatcacaagtgacctgaggcgtctaaatcatcatcttattggggtggccaaaactaatttgttttttctgcccttggaccaaaaagtgatcagaattaaaaacaatttgtaacgaataattacttttctttttaaattattttttgtacgatttttttttaattaaaattttttttttacatttttttagcctacacaaaccccgaagcttcctccgatgttgatggtcattcgatgagcgaattttatg

SEQ ID NO: 45782 - DNA, 845 bp, Heterodera glycines
  Genomic contig location: Contig_ID=SeqID_23430; Location=85..929; Strand=+
  SCN-specific regions: Sequence locations=1-164,188-193,241-283,322 -337,361-445,475-511,533-845
  Gene Ontology: Mol. function=non-chaperonin molecular chaperone ATPase activity; Cellular component=intracellular; Biological process=protein folding
atggaggactcaaatgtacgttttttgtggagtcctttactttttttttattccacctcccgtcgcaaatgattaaaattttggtagcgggcgttaacaattttctgagccctttacaaaactactgtcagaatgggttgagtgagacccaggggactgcggtgttttttcctcctttctatcttttgattttaagctgaaggacaagatcagcgaggacgacaagaagaaggtgctggagaagtgcggtgaggtgctggcatggctcgacgccaaccaggcggcagagaaggaggaatttgagcaccagcagaaggaactcgaagggatctgtaatcccatcatcaccaagctctaccaagccggcggcgcaatgcccggcggtccaatgcctggcggagggatgcccggaggtggcggcgctgctggtgcgggaggagccggtggaccgaccatcgaggaagtggactaagcgagtcgatctcttcgcgatcatttttttgtttgatcgattatttaattttatttttttctcgcgtaaattgtttgacatataaattcattggttgcttacttacgaatctcaccgaacatgcccttctgctttaaaccgtatgttaaatgtaaaaagccaaagacaaattggttcgggaaatcattgataccttgtgtggttagtgatttataatcggaaattcaatattttaaaattcactttatgatcgtatctatatagaatgatattttttgatgtacaattgtttttgactatttttaggttattgcgatcaaattagaaacaaaattgggtaatggtgaagctggtgcccccccccctttttgga

SEQ ID NO: 45783 - DNA, 502 bp, Heterodera glycines
  Genomic contig location: Contig_ID=SeqID_23432; Location=846..1347; Strand=+
  SCN-specific regions: Sequence locations=1-216,238-309,365-502
  Gene Ontology: Mol. function=glutathione transferase activity; Biological process=glutathione conjugation reaction
atggtccaacaatacaaattgtactattttgatttgcgcggtgtggttgaacccatccgcctgttgcttcactatgttggccaaccatttgaggacatccgctttaaagactttgaagaatgggagaaaacgtacaaaccgagtgagtaattaaaacatgtggcataatgccatagaaataaatgccaaattaaaaaaaacaaaaactttttcagaatttttctacggaaaagccccagttttggaggttgacgggaagccattggcacaaagctcggcaattttgcgctaccttgccgaaaaatttggtaaattaattataataattaattttatttgtttttaattataaatttaaatttaaggcttggccggcaaagatgaatgcgaaaaggcgaaggctaacgaaatcatcgactttcaaaaggatgctaactccgaattgatgccctatttgatggtcaaaattggacgccaagaaggcgatttggtgaaaaaataa

SEQ ID NO: 45784 - DNA, 516 bp, Heterodera glycines
  Genomic contig location: Contig_ID=SeqID_4351; Location=1357..1872; Strand=+
  SCN-specific regions: Sequence locations=1-229,251-516
  Gene Ontology: Mol. function=transcription co-activator activity; Cellular component=nucleus; Biological process=transcription
taaaaggtaattatggcgcgaaacaataaattaatatgatatcgttgaatgaaggatcgccctgacgaatctatactgatctcatgactattagctgcacatggagatgacagtaagacccgtcagagaaactcttccattaagtaggcggaatgcacgcgaattccttgtgtggattagcccatttaagcaagaaaaaggttaccaggggaactgcctctcgctcccaaaactccacataagcaattcccttggaacgtcgcgtctttgtgtcggtaatcactcgaacatctctaacgtgtccaacacttgaaaaaaattcctccaagtcacgaggacgcgtttgacgagcaagcttaatcagaagaatttctcaataatcagaaaacgaagagccaacctggagaataaaaactgttcgctcatctctttcttcggaagtcatatccattcgagcatcacgcggcggtgatctccgaggcgtaaatggcatacttaaagaatcaaggctggaat

SEQ ID NO: 45785 - DNA, 1328 bp, Heterodera glycines
  Genomic contig location: Contig_ID=SeqID_4351; Location=1496..2823; Strand=-
  SCN-specific regions: Sequence locations=1-312,335-477,521-678,700 -1217,1239-1328
  Gene Ontology: Mol. function=transcription co-activator activity; Cellular component=nucleus; Biological process=transcription
atggctgaagatgaggtagatgatcttcttgaagaagcattcaaaaatgttgacgaggttggcttttatagtgacactcataaacaatacataaattaggcagagaaaaatgggacaaagatggatgatgttatcaagaaaaaggcgaaggaagttggaatcaagtaaacatcacatttttaaattttaattgctgtttttttcttagaatgagtgacagtgaaggcaaacgtaaacgtagcagaagcggaagcagggagagaaagcgcagacgaagtcgcagtcgcgagaagaagaagaggtttctgacgccatttgacactttaattatttacttttagggattcgtcgcgagagcgaaggcggcgttctccgtcagagaacagcaaaagaaaacgtcggtctaggtgatcaagtttacgattggatttactattcggggttaggaagccggataagcacaaaatttgagtgagcgaactcaattgcctaaatatctccagatcttgacgtctgatcatattctcctttgtttgttgatgaagacgaagaacggcgtggaacgtgcgttaaagcagaaactcattcctctcatattccacaacctttcttttctttcgttcataaattcgttcgcgccatgccttcattaccctcccataaatttattaatttgctttccaggcacacagacacattgatttaatttttaaggcaaattgtgctttcctacatggaattaatctgtaattttagttctcgtgatcgtcgccgctctcgttctaggtctcgcgatcggcgtcgttctccaatctcacgtcggcgctcccgttcccgatcacctcttgagaaacgtcgttcgcctgccccgcgtcgtttacccgggcccgagcgccgggatgtgtgagtttagaggggggtcgcttcaactaaaagtacacatttatgctaattccagccttgattctttaagtatgccatttacgcctcggagatcaccgccgcgtgatgctcgaatggatatgacttccgaagaaagagatgagcgaacagtttttattctccaggttggctcttcgttttctgattattgagaaattcttctgattaagcttgctcgtcaaacgcgtcctcgtgacttggaggaatttttttcaagtgttggacacgttagagatgttcgagtgattaccgacacaaagacgcgacgttccaagggaattgcttatgtggagttttgggagcgagaggcagttcccctggtaacctttttcttgcttaaatgggctaatccacacaaggaattcgcgtgcattccgcctacttaa

SEQ ID NO: 45786 - DNA, 1721 bp, Heterodera glycines
  Genomic contig location: Contig_ID=SeqID_4353; Location=2102..3822; Strand=-
  SCN-specific regions: Sequence locations=1-113,135-144,166-618,640 -1721
  Gene Ontology: Mol. function=phosphatase regulator activity; Cellular component=nucleus; Biological process=asymmetric cytokinesis
atagaaaatattctgattgaccaacggaatgctcatgaaaagtccacgtacattctctgcgattttggcagctccacaacaaaagttctttctaaggaacattacacccatggtcattcaatcaatcattcattgtctctccaacttttcagttacttttcttttcagcctttatggaggaagagattcaacgttacaccactctcagttatcgagccccggaaatgattgatttgtattcgggcattccaattggttagcattagttattgtgattttttgaacaaaattcatatcaaaaagactatgtttttagatacaaagtccgacatttgggcgttgggcattttgctgtacaaactttgttacttctcacttccgtttggtgaatctgcgttggctattcaaaatggactgttcactttccccgaatctccgccaatctctgaccaaataaaggccataattagtgggtttattgttagtcatttctcttgaatgttatcttcgtcttcatagatcttctcctcactctgaatgccaaacacaggccaaatgtttaccaagcttcgtatttggcatttttcgctgccgatcgcaaatgtccagtgtataacatcgaagttatttcctctttttcgattttgtaaattttgttgttcagaaaagtttgcggatcgaactgagtgaagctgttcagattctgaaaatgcgcaataagcttggctccgattacgcgcgtttgtatgaaaaggcttttaacgactttgaggcacaacggcgaaggcacacggccccttcggttgggagagggccgggtgaagtcatcgaagaaaggcacagccgagacggaatgcagcgaacattcgtcgcagggataaaaccgtcagaactccccgggcaccgaacggacgactgttcggccgtttgtagcagctcttcggcccttttagcagcatcagaaggaatgattgtgaacacagcctcttcacattgtaccgaaacgcatcgacgggccacaacaacatcagttaacccacggcttaggcccaaaccccaagcggtcctggtaaattccactccaatgtcgcagcgcaaagaaacggccgatgaaaggggggaaatgcctttgtccggacagcaacagctcaagcaacaaacagtggccaatgctgtgagaccattctgcctttttgatgccaatactttgcttgtttaatttgttaaggcagcacatgaaaatcacacgatttacgataacacacaaaaaagcgatgtttcaaatccgccgaagctaactcaaagcgcatttaggtgaagtttctttcgcgtgtctcttttcttataattttggcttaattaggccttatactctgacttatggccaacgtgagagtaattcttcggccgacgccaacaatttgaaccttacgcttcaaacattggctggaaatactttgttcgaatcgtccaatccgttcattcagccgtgtatgtccaccatcgaccatcacatggacgacaacgcttttggtgaatgcttcgatgaaatgcgacggagttgtgtcgtcgaacaacaatcggacttccaaagtgaaattaatcggccaaacattttgggtttggatttgacatcgatggagcaacagatcagcgatgatccgtttgggaatgcgccccctttactcccatatcagttttttcgcaaaccactggattaa

SEQ ID NO: 45787 - DNA, 1876 bp, Heterodera glycines
  Genomic contig location: Contig_ID=SeqID_4357; Location=1451..3326; Strand=+
  SCN-specific regions: Sequence locations=1-919,942-1798,1829 -1834,1857-1876
  Gene Ontology: Mol. function=ubiquitin-like activating enzyme activity; Cellular component=nucleus; Biological process=protein modification
atgaacgagcgctttgacgttgatttctttcggcaattttctctcgttatgaacgctttggacaacaaaggtgtgaggaccgagttttttatgtaacaaaacaaaattcgtttttagccgctagaagtcacgcgaatagactctgtttggttgccggggttcctttgattgaaagcggttccgcgggttatctcggccaagttgcagtcatattgaaaggccgtactgaatgttatgactgcacaccgaagccgaaccaaaagacatatgcaagttgtaccatccgaaacacacccacggaaatgatccattgcgttgtttgggccaagagtttgttcaagtaagcgactcgaaaggcttattattaggatcacgtttaaacgcatagttcattttgttacgttctttcccttttacaattagtcaactttttggcgagagtgaccctgatgacgatgtttctcctgagacggtcacttccgatggaatgggcgaccaaaaaaactcacaaacaatggataatgatgggacgaccaccaatggaagtgttatttttgctgacaatgggaatagtagtgctaatgatgcgattacaaaaaatggaaaaatgagcacacggcaatttgcggaagcgacggattacggaccaaaacaaatttttgagaaggtttgtttaacaaagtaaaacattcttgttaagtttcagacttttagttgttctttgatgacattaattatttgctttcgatggccgatctttggaaggagcggaagaaaccaacgccaattcactttatgcaagttattgacgaaggttttcaattttttaaggtggatctctgattttaaaatggatttgtttaactaaaggacttggtgggagtcggccgaatgaggacgagaacgagcattggggcgtatcgaaatgggctgaactgtttgaggactctctttttgcgcttgcggaaagataccgaggagctgtcaaggaaaagcgaatgctcatctgggacaaggacgacgagccggcaatgcaatttgttgcggcctgtgccaatctacgggcttacatttttggaatcggcacaaaaccattgtttgacctgaaaggttttaattggtcgcgaaatgccttcaaaattagtttttagctatggctggcaacattatcccggctattgccacaaccaatgcctgtgttgctggaatgattgtcgtcgaggctctgaaaatcgtttctggtcagctgagcaaatgtcgaacggtaactttcgcttgtccaattaattcccttttcatttgtttagatttttatcaaacgcttaccaaatccgcaagggaaaattttggtggaccaggaacccagtgctccgttcccgaaatgttatgtctgttccggcaaaggagaggtgacacatacgacaccattactccaaaatattgcccattcttggttctttttcaggtgattgtacacgtcaatttaaatgaaatgttgctcagaacattccgtcaaaatgttttggtcggtgctttgaacatgttgaagcctgacgtgatggatctctgccaaaaccaccgaattttgctctccagtgaagaaggcgaaaccgactccattttggaccgttctcttggcttattgggagttttgaacggcacgcaattggagtgcgatgactatgcccagcaattgaacttcaagctgatccttttcaacgacaacacactgacgggcgaacagttcaaaaaagtcgaagatcaggcgacgaaaggggcgaaaagcatttctgacgacaaacagaaaagagaaaacgaaatagacgaggaggaaggagtgccagtgaaaaaggcgaagattctctgcgaaacctga

SEQ ID NO: 45788 - DNA, 1487 bp, Heterodera glycines; identical to SEQ ID NO: 23481
  Genomic contig location: Contig_ID=SeqID_23481; Location=1..1487; Strand=+
  SCN-specific regions: Sequence locations=1-198,234-1181,1203 -1348,1370-1487
  Gene Ontology: Mol. function=ATP binding; Cellular component=nucleus; Biological process=Rho protein signal transduction

SEQ ID NO: 45789 - DNA, 3424 bp, Heterodera glycines
  Genomic contig location: Contig_ID=SeqID_4370; Location=1..3424; Strand=+
  SCN-specific regions: Sequence locations=1-311,333-699,722-892,914 -1063,1092-1126,1148-1260,1285-1770,1793-1949,1971-2804,2827 -2970,2992-3424
  Gene Ontology: Mol. function=ubiquitin-specific protease activity; Cellular component=nucleus; Biological process=pathogenesis
aaggtatgtgatttatttattgtgaacgctttaccagattgcaattgttacattgtaggtcaacgacacaatcccctcactcttcaaaggtcgcatgaagtcctatatcaaatgcaaaaatgtcgacttcggatcatctcgagaggaatgtttttatgatctccagttaaatgtcaagggaaagtcaaatggtttgtgttactgtctttgttatcgtcaataaattttaattattagtccttgaatcgttccgggattacattcaacttgaaattctcgatggagagaataaatatgacgcaggcggtatgttatttattttttactggataatctggcaatatgattacagattttggtctccagccagccgaaaagggactcaaattcctttctttcccacctgttcttcaccttcaactcatgcgttttcagtatgacccaatgatggattccaatgtgaaaataaatgatcggtaatgctattatcttttgttattttattttttgcttatggttttcaggtttgaattttctgaaattatggacttgaacgaatttgccgaatctgagggggatgatgaagctcagaagaacgactacacatatttgctttatgctgtgcttgtccattctggtgatttccacggcggacattacgtggcattcataaacacgaatttgaagggctctccgagggtttgtgttttatttttattatctcgaattttaatatttccctttagtggtgtaaattcgatgatgatgtcgtttcgcgtgtcacttcacgcgatgcggtgactgcaaattttggtggggagaatccagaaggagttggtcggagttttacgaatgcgtacatgttggtctacataaagaaaagtgcgactggtaactctttgaattgttttttcttaactgatcgttgtgattaaggcgaagtgctcggttctgtgtctgaagaggacattcccgaccatcttaaagttcgctttgaaagtgagaaaaaaagagaaatggaacgacgaatagagcgagaggaagcgaataattattgtgaaataactgtgagttttttaaaaatttattgactgtttttcttttttcttctcagcttattttggacgaagacatgaacgcacaccacgaattcgaattgtttgatgggcgaatgaccgagatccaggcacgaaaattgaaggtgcagaaatcgatgacttatatggagctttacaaatttgttgcaacaaatatggtaagtatagcactttcatattttaaatgagtttcaatttattccagggactgaaggaaagagaattccgtctttgggactttcaagaatcggacaacaaccaacgggaaatgatgcacagatttcgtgtggagaatacgcgacctcgttttttcatcgacccatttgagacatgcgacgaatatgatggtggcactgtccgctacgaccgaatggtttacttggaactgtgcagaggacatgttggagatgagctgggtttcccaaactacgacaaaaaccgtaatttttttttggcaaaaacagctcacattgatgatttagatgacgttttggccttcgttaaattcttcaccgctgagcgcaaagttcccgaattcaaaggaactttgatccttaccatgtcaagcgactttcctactattgcagctgccataaacaaagtgcttgggcagccccctgacactaaattaaatctttatgtggtaatgaaacatttcgatgctttaatttggtttattttctccaaaaggaaataaaaccggacaaaatcatacagctgcagtcggctacggtgaagaattcccagcaatacatgcagcaagatggagtgataataatagcagaattggaccaagtcagcgaggaagctagtgtcatgcaattcttcaaaacgctatacaacagaattgaggtaatctttaaaaaattactataaaacaaatgaagctatacataggtcgaggcgcatcttcaagaatttgggtctggcaaccatactgaacagcatgcaatttctccgttgagaggacagattggattggtaagataaatgcatgccgaagtttcaaaaagaacgtgtttttaggattggaagctgacgcgggtctgctcatggctgggttcagagctgaactatgatcccgcaaagatcatgctttataagagtgagtttgatttgtttctcgcgttttaagtttgcatttgttttatcagatgtgttacatggtgacaagcccggcatgtggataccggttagagtttttacattcaattaaaacctattcccaaaattaagcaccaacaattgttggaactgcaggttagccagatgctcaacctgaacacaggcagttacgacccacgttttcaacgcatcttcaaatttttctatgccaaattgccacttccaatggtcgactttgataatcatgcacatgtattgctgcacttgatgaatgaaaaattccagctaacggtggctttttttgcatcgttttttatatatagttgtttttaggaaatgagtatttttgtggataaaaacgcaagcgtgcaaacactcctggatgaggcgagaaaagagttcaggttctcgtcgatggggaccaaaactcttaggtaattttgtaaacaaaacaaagacatacaaaaatatttttcagacttgtgcaagcctcggccgacgggacttttagagtctatcaggtcctcaagaacgacattctttacaaggatatccaactccgaccatctttaatggtagtgcttatttagctatttttaaaaaatccggcgaattaagctgcgtgtggaagaaatcccgaaggatcagcttgaagttggcaccggcgaatatttgctgccagtggcccatttcgacagagagccgaatcggacattcggagtgccattcttcatcaaaatttgcaacggggagaaagtgagcagcataagggagagaatccgcgagatgttggacgtgcccaagaaagaatttgagaaggttttaagggtcggactactttaccaactttcccttccctttcagtacaaattttgcattgtgaggcagggccgagtgatgcgcgaattcgacaaccaggacgacgcagcagcagtcaatttgtcggaattatcccttgcccatataacttgtgtgtaggctgattatattcgagtacaaacgcactattgttttgtcatttcagatccgcagtcggcaccatttctggggattcaacacaattgccccaataaattggtggacttgccgaaaaaatcggtgatggcttttttgtgctgatgactttcgagaagatttccggaaaaatggccaataaacgtccgaaaaaccttcgactgaagccattggttctagtgcagaat

SEQ ID NO: 45790 - DNA, 1974 bp, Heterodera glycines
  Genomic contig location: Contig_ID=SeqID_4372; Location=181..2154; Strand=+
  SCN-specific regions: Sequence locations=1-1043,1065-1082,1104 -1471,1493-1549,1590-1599,1640-1682,1704-1807,1829-1974
  Gene Ontology: Mol. function=ATP binding; Cellular component =nucleolus; Biological process=signal transduction
atgcttaaacgggccgcgttgggtcgcatggtaaaattgctgcgtcgacagaaatcaagttttgagtatcttgaacaagtccgtcaacatttgagccgactgccaagcattgacccgaacacgaggtcaggtgttaactaatgtcgcaaaagtcgtcacaaaaattgtaaaagaaggtttacatggctgacccccttcgcaaagattagttgagtatctcccctcccccatttttcacaaagattaccatcgaatgcaataaaaaaaacttctatttgtctccagttaaacaaaattatattaacttggttcgaatttaccgcggttttgcgaagatggaataaacccaaatatttctaccttttgttcagaactctcatactatgtgggtttccgaatgtcggcaagtcttcgttcatcaataaggtcactcgtgccgatgtcgaagttcagccatatgcttttacgacgaagtctctctatgttggccatttggactatcgttaccttcgttggcaagtgagcttttgttcacttttgaatgaatttactgttgcctttcaggtaattgacacccccggcattttggaccatcccttggagcaacggaataccatcgaaatgcaggccatcacggcattggcccatctgaaggcatccattttgtacatgatggacatcagcgagcagtgtggacggacactcgaagaacaaatccatctcttcgagagcattcagcctttgttcagcaacaaacccgtctttgtcggactcaacaaaatcgacttaatcactcgcaaagatttgatagccgagaaagaagcgattttacgagagaaattggaaactgcgggggttcccgtggtcgaattaagcacattgactcagcaaggcatcaccgaactgagagataaggtaaacggacgaacaatgaaaatggaggaagagagtctgaatattttcaaaccgaagcagaccctttcttatccagacaaagtttttggggaaggctaccgccacccgacggtctttttactccgttcctccaaaaattttcttttggttcgatttttaaaagtccgtgccccccttcccttcctcctgaacacgggctgaatcggattctatttttaggcctgtgatgctttattggctcagcgtgtcgaaaagaaattgcaagtgaaaggcattgcccagggagggtcggtgatcagtcgtctttttgtcgcttacccaactccacgtgacgacaaagttcgagctccgcacattcccgaaactgtactgaagagacatgccgaaatggaagtggaagacggggaaaagccgaaacgaaaattggaaagggaattggagttggagcaagggagggagtacaagttggacttgaacaagcactacctgctgaagaatgagggagagaagtacgacaccatcccggagatttgggaaggacacaacatcggtttttaatctcatttttaacaaaaaccctttcaatgtttaagccgacttcattgacccgaaaattgtcgaggtaaattccaaaacattcattttcaattttaaatttagaaattgctgaaactgagagacgaggagaagaaacgtgaagaagctgggttttatgacagtgacatggacgaagacgacgaagagaccaggaaattattgcgggaagcggagaaaataacacaaaaagagcaaatgcgaagaatggaattccgcgaaaagaaaagcacaaatcagccgaaaatgtcgaggaaaatcggacggaaacgggagcgaagcatggcgaggctggaggaggagttgggcgacttgggggtggacatcgccagcaagaaaatgcgccatttgagcgaggagcagaacagggaacagcggggcaagaaaattcgcgtgggtcggtcaccgtcagtcaaagcaccgcccaaaacgccgcgagacgtacagggcattcccgacaaaaag

SEQ ID NO: 45791 - DNA, 915 bp, Heterodera glycines
  Genomic contig location: Contig_ID=SeqID_4373; Location=449..1363; Strand=+
  SCN-specific regions: Sequence locations=1-70,92-249,271-734,768-915
  Gene Ontology: Biological process=rRNA processing
atgtccaagagtgacaaagtgttgttaagccatccatggcgttgctaattaatgaattattccctccacaattgtgtctttcccattttgcaatgattctctctcaattttaaggtgtccaaatggccggtgaatcctctcgagaaaatcgtgctggacctcggctcccttccgcccggaagtgtcgtcgccgacttgggctgtggcgacgcggaaattgctaagcgattgggcgaacggctccgagttcattcctttgacctggtggcttcaaatgagcgggttttggcagcggacatggccgatttgccgttggaggcggagtctgtggacgtttgcgtttactgtctgtcgttgatgggcaccaatttggcccaattcttccgagaagctcatcgagtgctcaaaactcagtgagaaatcacaatggagggaatgtttcaatacgcagactcagataaggcgtagaatttcgcacgggggagggtccgagacgatttcacaaattttcggagaaaccctaaaactagcacccccccccccccctatcctgtccatatataccgccggccccaaatccttgattttttaaattgtgaatgctcaaaaaggaacgcaaaagtttcttgttggagcaaaaaatttaagacgacatataaaaaagtcccgacgaattccccctcctccgctttatttgtttcgtcgccataaacgcacaaaaggggtgcgccgggcccctccccctgggggtgggggagaggaggtggtcgtagagtgatagcaaatggcaaggcaattataacgacttctactttaagcgggaagatcaaaattgccgagataacgagccgtcttcggagtgtctcactgtttgtgttggcgttggaaaaaatgggattccaattgaaacggaag

SEQ ID NO: 45792 - DNA, 264 bp, Heterodera glycines
  Genomic contig location: Contig_ID=SeqID_23516; Location=482..745; Strand=-
  SCN-specific regions: Sequence locations=1-176,203-264
  Gene Ontology: Mol. function=oxidoreductase activity; Cellular component=integral to membrane; Biological process=embryogenesis and morphogenesis
ggcgtgtgcaccaacttcttggcggaccgtgccccgggcgtgtccaccgcgccggtgttcgtccgcaagtccacgctgcgcttgccccaccgggtgcagcagccggtgatcatggtcgggcccggcaccggcttcgcccccttccgcggcttcctccacgaccgattgtggcacaaacagcagggcaaggaggtgggcgagatgcacttgttcttcggctgtcgtcacccagaccatgaccacatttacaaggaggagatggag

SEQ ID NO: 45793 - DNA, 889 bp, Heterodera glycines
  Genomic contig location: Contig_ID=SeqID_23526; Location=1..889; Strand=-
  SCN-specific regions: Sequence locations=1-133,162-195,217-552,574 -616,639-681,705-889
  Gene Ontology: Mol. function=succinate dehydrogenase (ubiquinone) activity; Cellular component=mitochondrial inner membrane; Biological process=electron transport
tgcgtttttcgtgcttatctgtgcgtattaagtgcgcaaaaagttagcatttgcctaaaaatcgcatccctactgaattgtctgatcaatttggtaatttcttttactgtaaaagaaattgaattgttttggcattaattaattatttaaatattaaaaaacaaaatgccaatatatcgttgaaaaaaaacgaattggcggtggcgggggcggcaaagacaattcttgtcctaactttaaaatcttttcatccataatttgagtgaaaatcttctttaattaagtttagtttaaacgggttggcgagagtaatgcttctttcgaaaatcccacctcctttttgtattgctttgcgcgccgcttccacaaatccgccggctcgtggcccaagtgtaaaaacctttgaaatttaccgctacaaccctgaaaagccggaacaaaaaccctttctccaggtttagccgattggattatgtctttggatttttgtgtttttttagaaatatgacgtggatttgaatcaatgcgggccgatggttttggacgcactgatcaaaattaaaaatgagatggatccaactttgacttttcgtcgttcttgtcgagaaggtcggttcattgaaagtcatttgtttttgtcatcagaaaacaaaaaaatcggaaattgctttggatggtgcccaaaaaacaatttccaatattttgtttaaatgccatttaaccattctattgaaacaattaataaaatcaccgaataattaaggaatttgcggttcgtgcgcaatgaacataggcggcgagaacactttggcatgcatttgcaacatcgaaaagaaaaccaaatattccaccaaaatttaccccctgccgcacatgtgagtgggtaaag

SEQ ID NO: 45794 - DNA, 872 bp, Heterodera glycines
  Genomic contig location: Contig_ID=SeqID_23545; Location=14..885; Strand=+
  SCN-specific regions: Sequence locations=1-42,85-872
cctcagaccgcagctgaacatcagaaggacatcaacgaatcgtcgtcgtcctcctcagattcctcctcttcgtcctcgtcttctgacagtgaaagcgacggcgacgagtcggacgcgggcgaaagaggcggtgccacagccgaagagcgccgacgcacgtcgcactcacacggaagcatgcagtcgttgaacttcacctccgtaaaacactccatttgcttacatatggtttatcttcggttatttttcagatctttaaaagtaagcgcaagcgccgtcgtccttcccactcgcgttcttccaccacggccaaagaggacattgagatgggcaaacagaggaaccgaggttggtggttgcctcgagtggtccaatccccgttcgaccacccacaacttctgcttagattgccaatgccttttagtgacaagtcgcagtacaccgataaaggagggcccaacgttgaaggccgttgatgaagacggtgctggtgctaaacaaaggaaaagcaaaggcagggagggccgtggcgtccgtgcacttgtcgcccattcgacgattggagcggcagcggtgccatcggcgaccaacagtgattgaggagcaattcgtttttactaatggaaaatctttaggtaccggtggaagtccgctgttgtcccatgctccgcttccactgaataacgcaattaaccacgcctggccaactccaaaaacttacggcgcaataaaccccgacggaaaatcgccacattttctcgtgggaagtgacgaaaacattggcgactcgtcaaacgaagctgcttattaccacccaacaacaacttttccgacgaggcacagacgaaaaaagacagtgctcagcgaaaatg

SEQ ID NO: 45795 - DNA, 799 bp, Heterodera glycines
  Genomic contig location: Contig_ID=SeqID_4393; Location=1..799; Strand=-
  SCN-specific regions: Sequence locations=1-80,106-154,177-269,292 -332,365-432,456-457,493-542,568-799
  Gene Ontology: Mol. function=enoyl-CoA hydratase activity; Cellular component=mitochondrion; Biological process=energy pathways
tgcattttatggatgatagctttaaaatcaaatctcttcaaaataattttgccattgaaatgtgccattgtcagttatgcccaattacgaaatgatcaaagtggagagagtgggcgccgacgacgtcgtcgcactgatcactctgaaccgaccgaaggcactgaacgcattgtgcagccaattgatggacgaggttaacaataagtaacactcatttggtggtcccatcaattgcatttaccgctctttcaaattatttgatttttaccaaacaaaaaatgaatattttctttcattgtgccgtttctttcatagctcgcccattccctcacttatttggacaaagacgacggagtccatgccatcgttctcaccggcagtgaaagggctttcgcaggtgtccgttctatgcgtttctttcgctttttgtcgttgtaattttcttcaactttttagccggcgccgacattaaggaaatggtgccgaagaaatttgccgaggttttcggtggcggctttttggagaattggtcccaagttgcgactgtacgaaagccgacaattgcggcggtcaacggacacgctctcgggggtggatgtgaggtgaaagaaacccgggggggagggggagacttttcgccaatttggccgtttaaacatttgttatttagttggctatgatgtgcgatatcatttacgcgggagagaaggccatgtttggacagccggaaatcaaaatcgggacaatccctggtacttaattaggccaattttgttatataaaattatttcaggagccg

SEQ ID NO: 45796 - DNA, 252 bp, Heterodera glycines
  Genomic contig location: Contig_ID=SeqID_23637; Location=446..697; Strand=-
  SCN-specific regions: Sequence locations=1-150,172-252
  Gene Ontology: Mol. function=nucleic acid binding
agtctaaccctattaatgaaattgtcgatgttgatgaggacatgatgcgaatgatgggtttttctaattttgacacaactaaaaataaacatgtcgagggaaatgcctctggtgagtcgaagatcaaccgggcgcgcaaatatcgtcaatatatgaacaggaggggaggctttaatcgtccattggattatgttgcctaactgtacacgttgttttatgtaattgtttcacttttatatttcttttttgtga

SEQ ID NO: 45797 - DNA, 1256 bp, Heterodera glycines
  Genomic contig location: Contig_ID=SeqID_23639; Location=1..1256; Strand=-
  SCN-specific regions: Sequence locations=36-418,444-633,711-841,864 -917,945-981,1003-1114,1137-1256
tttaaatgtataatttataaaaactatttttttatggtctgtaaacgacattagtaccaaaaacagtgctttgacatgcagtaaaatgtaaaatgacaaaattacattttgaatgaaatgtgtcggtcgtattacgaaggcattcagcgaattctcgagtctgaccttttaattactaatactcaactaattacagtattagaagattggtacgacaatacggtaagaaaaatatcgactgtatttatgtggactttcggaaagcttttgattcccttcctataaacattttaataaataaacttcataacattggcattaagggaaaactgctaagttggttatctgaatttttaagggataggttttacagagttaaaattaacaataaatcttctaatttacatccgattcagtccggtgttccacagggttctgttcttggcccactgttatttttaatatacattaatgacctcccgcaggtaatcccttcgggagttagcatcaagctttttgctgatgatgtcaaaatttatgtctcttacaaaactcgtgatgaaagaagcaaattaaatattgcattagaaaatattggaaaatgggctaatgcatttggtttaaacatctcccaaaataaaacatttattttatttattggcaaaaataattcaaaacaacaatataaattatttaacaatattattaatgaggttgaatctattagtgatttgggcattttgattgataataaattaagattttctaatcattatactaaaattactaaagctgcttatttaaggattcgcaatattgccaaaattttaaaatcccgctctatacgtatttggaccaaagtttataagacatatattcgtcctcttttagaatatgcgcctgaaatttggaatccgacaaacaaaaaagatataaataaattagaaagatgccaaaaatattttacaaaaattgcattatttaaatgcagacttccttacataccttacaaacaaagacttgatttattcaaactttagaagaaaggagaaaaacaattgatttagttcaggcattcaaaatcattaatggtctcacttatcttaaaaaagacatattcccacaattttctggtcacatcccttataatcttagacgtaaagttgtgttaaaatcacaatccagtaaaacttcaaattcctttatcaacagaacggagttaatatggtgtagaatgaagaaagatataatagatg

SEQ ID NO: 45798 - DNA, 392 bp, Heterodera glycines
  Genomic contig location: Contig_ID=SeqID_4406; Location=1888..2279; Strand=+
  SCN-specific regions: Sequence locations=1-72,94-148,170-179,201-392
atgattgaaattactgtcaatgatcgtctgggcaaaaaagtgcgaattaaatgcaatccgacggacacaattggcgacctgaagaagctggtgtcagcccaaattggaacaaggtaaaaagtcatcgccaattggaaaaacttctgaattctctccccttttcaggtgggacaaactcatcctgaagaaatggtacaccacttacaaggtgagcaattgcgtaacacaccgttataaatatttaggccttattttcccatccttttgcttttcaggaccacatcactttgcaggactacgaaatccacgacggattcaattttgagctatattatcaatgacttgctgcgcgcgtgttcattacttttgtgatttacattacattttcccta

SEQ ID NO: 45799 - DNA, 812 bp, Heterodera glycines
  Genomic contig location: Contig_ID=SeqID_23653; Location=4..815; Strand=+
  SCN-specific regions: Sequence locations=1-309,339-696,723-791
  Gene Ontology: Mol. function=structural constituent of ribosome; Cellular component=eukaryotic 48S initiation complex; Biological process=protein biosynthesis
atggaaagttatgcccgtgggtgcgaattgtgggtcagcggcaagttgcgcggtcagcgtgccaaggcgatgaagtttgtggacggagtgatgatccattcgggtaacccggtcaccgagtacatccaggaggcggttcgccacgtgcaaatgcgacagggtttgtgttttaaaatatggaaaaatattttgggatctatttgaaagatcgattaaaagggttttcgggtaccaaaaatacttttgagttagtttccaatgccatgcgatcccatttttctatttttttcgcctctttgttcaggcgttttgggcatcaaagtgaagatcatgttgccgcacgaccccaagggacagatgggaccgcgcaatccgttgcccgaccacatccaggtaaaatgttctacaaaaactgacacacggaaccgcataactcgggatggatacaagccggaggatctatttttgaaaaaaaaactccatacctttagattagagaaggacggagaatttgctattaaaaatctaaaattctggttttcctagacaaaaataaagttttgatacttttccctaaaattgttccttttccattacaggtcaaagagccaccgattgacgtcgcgccgaccacgccgtactcggagcaccgcgaaccgatgaccactggcatgccgccccagacacaaatgccgcccgcccatcagcagcagcagctgccgatggttggccaagtgccgtccccggcacagttttaattgtgaggaagaaccgctgatgatggtcatgatggaggagggggagatgttcaa

SEQ ID NO: 45800 - DNA, 1692 bp, Heterodera glycines
  Genomic contig location: Contig_ID=SeqID_4417; Location=1387..3078; Strand=-
  SCN-specific regions: Sequence locations=1-684,707-1112,1137 -1274,1296-1434,1457-1527,1550-1692
  Gene Ontology: Mol. function=actin binding; Cellular component=actin cytoskeleton; Biological process=cell motility
atgcgcaaagcttttaagtcctgcaacataatcgaccaacattcgctcgatcgtcagaccttgccgcagtctttgcttgaacaataccaaaattgcgaccctcctccacaactcaatcagttgaacccttatagggaggatgaaaaggaagccctttgctattacactgacccgagttacttcttcgaattgtggcgaaataaaactttgaaggaatgcgatgggggattggctgagaagaaaagggccggttggtgtgattttgtttttggcaccgaatgattcatttttaaggccgttcttcgaccagtccgtctcgacaacgacgacgtcaacagcaacaacaacacaattttccgcaacataatgatttgtctgcccaccacgtgtcttcccgttctacggattattcgcgttttgagccacaaattggccaccagaatggcaaatcccaacagcacaaactgcgccatgggtttggtccggctcatttctctgtctcttccgttgctgcggatgttttgcactttcccgcagaataccaagttcgttttctattcctttggtaatttctttatttttttagaccccacaaagtttgatgattggcaacagaattactcacaatcaacaccctccgcccggaatgtcaatggttacaacaaatgagggaactgtcacccaacaacatcacaagcaaataaagcctaacgagcactcaccatttaatttgtcctccaatcattcttctggcaatagcaatcagcagtttcgcgtgaaagaacggaccattgacggaaaagccgacgcaatgaacacgacacaaaccgataacacaagcaaaaatgacgcagcacatgctgtggcttcgaggatggacgtgatgtttctggatgatgaggacgatgaattgccaccgcctcctcaaaatattctgtcttccacagtgaacacaaggaacttccctcgaattgctccctccgtttcatcctcttctcccgtcgggtctacaaactcgtccttagccgctccgactaatgaaccgctgaaaagcaaattcgaattcatatcgaccaatggatcaacggaaacttcggagttagggacgacacggcacataacaaatgaacagcaatctattaatgttgctgttattgaacaacgtcctaaccaactccattccattcaacaagtaacagagggaacgattgttaaatgaaaagtaaatgtttagcaattgcttttcagatccctccgtctgtttgcaatgccccggcgcctcctccaccgcctccgccaccccctcccaatttttctctcaaaattgcaaacgaagggacgaaaactttcggtggacaaaatgagaatgaacagccgaaagatttacaacgcaaatcttcaaacacgagcggcgctcaagtaaaagaagaacggaaaaataataaaattaaaaaatccatgaaaattacatttgattttaaggacaatcgctcccttctgttgatgcaaatccaagagggcgtcaaactgaggaaagtccgtcagcaggaggaattggaggagaaacgagcggttgccacttcaaatgacgtggccgcaattttgcgaaagcgaatggagcattgtctgggcgattctgactcatcgtccgaaggaagtccatcccccgaggacaacgaatgggacgactga

SEQ ID NO: 45801 - DNA, 1008 bp, Heterodera glycines
  Genomic contig location: Contig_ID=SeqID_23680; Location=389..1396; Strand=+
  SCN-specific regions: Sequence locations=124-173,284-399,466-508,599 -650,791-844,877-877,969-970
  Gene Ontology: Mol. function=stearoyl-CoA desaturase activity; Cellular component=mitochondrion; Biological process=lipid metabolism
atgtccgtttccgtcactcaaacgatcactcgaaatcggaaaagtgcggaaaagatttccgagggccaattcctttcaatggaagtggacgaattgcaagagttggaagaaaaggcgaaaaaggtaacacccaccgcttttggcattttggcacaaattaattggcacaatttaagacgcagttcaaaacccaaattgtgtggcgcaacgtgatcctgtacctcattttgcagaccggggcactgatcggagtttaccaattgttcacaagttcaaaatggctcaccgttttttggtgtaagtttttaatttcaacgattattacccaaaactttcgttacgaaatacttttaaatgcttttgtctttccttagctttgccaaatggccaattgtttaggccttttcctttggatggtcagcggagttggcattacagctgggccccaccggctgtggtcccacaaaagttacaaggccaagtggcccctgaaggcgttgctggtggccatgaattgcgtgtccttccaaaatgacatcatcgaatggtctcgggaccaccgatgccaccacaaatggacggacactgacgccgacccgtaagcattggcagcagaaaatgccaaaagcgaccaacaaacactccctcagacacaacatcaaccggggcttcttcttcgcccacatgggctggctgctggtcaaaaagcatccgctggtcaaagagaagggcgcctccctggacatgtccgacctcacctcggatccgttgctgatgttccagagaaagtcagtcgcttctccttgccgttttgatttggcatctcctctttgtttctgttcaggtactacttgcccttggtgggcatcttctgctttttgctgcccactgctatccccgtgtacctttggtctgagtccgtttgggtgtccttttgcacttccgcactgttccgctactgcttgaacaagcacgccacgtggttcatcaactcggccgcgcacactt

SEQ ID NO: 45802 - DNA, 3745 bp, Heterodera glycines
  misc_feature (3735)..(3735): n is a, c, g, or t
  Genomic contig location: Contig_ID=SeqID_4420; Location=1..3745; Strand=-
  SCN-specific regions: Sequence locations=1-208,230-508,531-793,815 -917,941-944,966-2317,2339-2906,2928-3305,3328-3671,3711-3745
  Gene Ontology: Mol. function=transcription factor activity; Cellular component=nucleus; Biological process=embryogenesis and morphogenesis
gagggtcgagcaatgtgacggacaaggagtacatccggacatgtgttgtgaccagtctggaggacaaattcatgacggaggtgtccatgtgtttggtctgtggcagcatcggacgcggcactgaaggctcaatgatcacctgctcgtgttgtgcccaaagcttccacacctattgtgtgctaatgcacgacaaagtcggtggtgatcattcattcagtttaccatttgtaaatcggtgaacgttttttcattcaagctcgtatcaaaaaaaatttggaagggggaatccaaagactttttttgcccttcgagtcaaaaaaattttcttcagtgttattgtaaaaattttagcgccgaaaagcaaaaaaagaatttgtggccatttttcctcaataaaaggactaaattttgccattttctgaccaaatttaaaaaatagtgtaatggggtccggttgtgccgataggcgccgccgggatttttttggaatttaaagcatttagtcaagaaaattaaataaaatttttaaaccccctcctctcttgctacgggccttttattcgatagataattgtagatttaagttatgagagtgttgattttgtatatttgttaaaaccctcttgttccaattaaattggttaaaatcaaatttcatttctcagttgaatccgactgtgatgaagcggggatggcgctgtttggactgcactgtctgcgagggttgcggcagtggcgaggacgaaccgaatttgttgctttgcgacgaatgcgacatttcctaccacacttactgcttggaaccgcctttgggtatgtgtaaatgaaaatggctttttactctctttcgtactctaactttgcagattgtatcccgcgcggttcctggcgttgtaaatggtaagtgccaatttttcataatttaaattttagtaatttactcataaatctctgattttaaaaagactattccaattctttattactcaaaggtgcgcgacttgttctcgctgcggtgctcagattaaacttggctccgatatgcagcggttggaagggttctgcgaaatttgctattccctgcgcaaatgtgtgaagtgccaagcatcctacgaaattggagatttgatgttgaaatgcggacgctgtctcaggtgattaatctattaattgttagattggaagttaattatccttaaaattgaatttgaaaagcatcgcttccctcccgattttataggatgcacttcattcaccccccccccccccttctgaaaaatcttcaatataaatttcaaaaatcttacaattaggaaatttttcataaatttttagattttaggaaaaaaattttgattcgattttttattggaattatgaaaaaggggcgggggacgacgcgggggggaaactgataaccgggggagagggtcgaattgctctcaatttttactatattgtaaatgtgagaaatccgtcagatggcttcacgcccgctgtgagggccttacaacggaggaacaggcggaaaatgcggccgaaaatgcgtttcgctgttcattctgtcgacctcaaatattccgtaagttttgttttccacgcctgcaaactgttacaattttgtcccaaatccaagatgacgcttcaaatgtccccgttgtggttgacaatgtgatggtcagcaaatcgatggtcgaccaaattcagggcatttctaacattcgaaagcttgccggacttgccaattttggagagcatttcgggaacatagctcggtccgtctcatgtgaacaaggttgtttcgaattggctatgtcggttttttggttttcattcaatgtgttcgaatgaaatatggtgacatcgatcgtcggattaacacagtcttttctgtctgaaaaaccacaccaaaatggacacgggggagagtgtcactttcatactggaactgacaatgagacaattttgtgagaaaatcgtaaaaaactgtaagagtaatttttggacggcacacttttacacagttggcaaatggtttggtaaatgtaacacatattaaatctgataaaattatccatttctctgttatttaaaagatgacatggaattgagcgacgaattgcaagagcagttgatcgcctccgtttttgcgggccgaggccgtggctgtggcagcggtggtggacgcggcggtgggccgggccgacgaatgctcaaaatgggcgttggcggattttacgttcgcactccgaaaagccgacttccctttttgatgggcagcggtgccaatatgacaccgatgaactcaaccgaagacgaacaacagcaacaaatgatgggtgccaacatgttggaggaggacttgggcccaaatggaaagccgcggattcgcaggccaagaaaactgaaaaggccgctgctggaggatgcgtacccgccacaaattcaggtgggttgtgcatttgcttacttaatgtttgatatctctattttgcatttttttcgattctcgaatttcaaaactttctaaacattaaattgtcaggaatcgtttttcggtgttgcggcggttgacagccgaacactggcggaacaaactgtggatgagccaaccttgagcgactacaaaaaggtgttgccggtcgtcagcggcaccaaatttgccagcgaactgtccgaacattcggccgaactgttgcgcaccgagcaggagatggacatgttgggcgacattccgttggtggagaacatcatggacggattggacatggagggactcgacttctcggacctaattgttggagaggaggacgagccgatgaccgttgagagcagtagcaacacaatcgacccaattagcggtcattaattgccctcccccatatttggcacattatttccatgtgttcttttcagatggttacaatgccggcagttcgtccaatttggttgcgcacagtgttgtctccgaggtgttctcgccctcgtcctgctcatcaatccgaacgcccagtcgagtgttcgagcccggaccaccgccaatggtggcggcgtcctcaacggcgacggctgtgttcttgcagaacaatgcaccaccacaaccacccattggacagcagcaacaagtgctttttggccaatgccatgttatttgtgttgcattctcactcatatttagacaattgacaatggggacggtggtgggaaaatggtggaccaacaacagaagcaaagtgcttcagctcttacaactgaacgttgggaagaagacgaacccttgggggacaaggcgacaaaagcggcggtgctttatgcaaatgtatttccctttttcggatgtttctgtttaaaatatttctttcgttttcctgttgaggtgcatcacacgtatttgaaggacaaattcccgatttggacggacagagttcgaatgatcagccgaatttggcgagacttgaaccccgagaagagacaagagttggtcaaccactcaacaagatgcacgcacattcatttctgttttcaattcagattcgttgaatgggcgaggaaaaaccgggccaattgtccaacaactcgacgacgaggaagacgaacagtttcgacagaagttgctcacaaccagcagcaacaaatggggcaacagggagcagtccaaaaccaacaaccaccaacgccaagaacagcatctctgttttgattggacaacaacagccggatgcaccctttcaaggnggagcagcaa

SEQ ID NO: 45803 - DNA, 973 bp, Heterodera glycines
  Genomic contig location: Contig_ID=SeqID_23690; Location=348..1320; Strand=+
  SCN-specific regions: Sequence locations=1-56,82-99,124-342,366 -470,498-624,651-687,709-875,901-925,950-973
  Gene Ontology: Mol. function=structural constituent of ribosome; Cellular component=cytosolic ribosome (sensu Eukarya); Biological process=ribosomal large subunit assembly and maintenance
atgccaccaacgagtaaaaaaacaggtattaataatgcaaattgaatttgactgtgttctttaatttaaaattttttaggaaaggctgtcgcaaaggctgtggaggccaagaagaagctggccaaaggccagcacattgtgcgcaaaaaaaacatgcgcacgtcggtgcacttttaccggcctcggacgctgaagctggcgcgttcgccgaagtttccgcgcaaagcggtgccgaaacggaacaaactcgactccttctccatcataaaacacccattgaccaccgaatcggcgatgaagaaaattgaggacacaaacacattggtgttcatcgtggacgtgaaggccaacaaacatcagatcaaaagtgcggtcaacaagctctacaacatcgaagcacagaaggtttgtccactctttgttttggtcaagaaaatcgagtatatgcaaattggatgagcgcaaaactgaatttttgggggccaaattttatttaagtttcaacttttcgaacaggcacttttaaaatagcgccgaaataccttttgctcacttcaattttatttattcgtatagatccgcattcgacttaggcgacatcaatgatatcttcaatttcttaggccataacttttttctttcttagtcaatgcctaattctgttgccaaccgaaaactttcccagtattttttaaacataagaaaaggacgacattggtaacaaaaaaaagctatagcataaaaaaactgaggatagtcattgattggacgtctaaaagtcgattgaatttcgcaattgtgagcataaatgggaaaacgtccggtcctctaacaaaaaatcagtatttcgtcatctgtattaattatgttggttgaataattaatttttaaatatttaatgactatcaaatatcagtcacaatcacttgtatgactatgtctaattctgtttaggctatcgtggcttgaaaaa

SEQ ID NO: 45804 - DNA, 1313 bp, Heterodera glycines
  Genomic contig location: Contig_ID=SeqID_4425; Location=1753..3065; Strand=+
  SCN-specific regions: Sequence locations=1-99,126-138,165-267,292 -297,339-339,387-429,480-756,792-857,882-1205,1229-1247,1274 -1286,1312-1313
  Gene Ontology: Mol. function=GTP binding; Cellular component =microtubule; Biological process=microtubule-based process
atggtcgacttggagccaacagtgatcggttgccatttgttgtttttcgttggattatccgctgttttagacgagatccgcactgggacttacaagcatctcttccaccctgaacagctcatcactggaaaagaagacgcggccaacaactacgctagaggacattacacagtcggcaaagaaatcatcgaccccgtcttggatcggattcgtcgcatcgcggataactgcaccggacttcaaggctttctcatcttccattcgttcggtggtggcactggctccgggttcacatcgctgcttatggaacgtctctctgttgactatgggaagaagtctaagctcgagttctccatctaccctgctcctcaagtgtccaccgctgtcgttgagccgtacaattcggtgcttactacgcacacgactctcgaacactctgactgtgcatttatggttgacaatgaggccatctacgatatttgtcgtcgaaatttggacgtggaacgaccttcttacaccaatttgaaccgtttgatttctcaagtgaagcaatagctaatgaatgaatctgaatctatcacattttttaggttgtctcttcgataaccgcttcacttcgatttgatggtgctttgaatgtcgatctcactgaattccaggttcttttgtagtctgctgtttcttggatatcaattattccattttagaccaatcttgttccttatcctcgaattcactttcctcttgcgacttattctccagttatctcagctgagaaggcctaccacgaatcattgtcggtttccgaaatcaccaacatgtgctttgagccgtccaaccaaatggtcaaatgcgatccacgtcacggcaaatacatggccgtgtgccttctctaccgaggtttatcaagcctttatacaagtcggaatgttatgtttttaggtgacgtcgtcccgaaggatgtaaatgcggccattgcttcgatcaaaacgaaccgttcaattcaattcgtggactggtgcccgaccggcttcaaggtcttgaagatgtctcgtaatctattagatattttattccaggttggtatcaattatcaacctccgactgttgttcccggcggtgacgttgccaaagtcccacgtgccgtgtgcatgttgtccaatactaccgcaattgctgaggcttggtctcgtttggaccataaatttgatttgatgtacgccaaaagggcatttgtgcattggtacgttggggagggcatggaggagggcgaattctccgaagcacgtgaggatttggctgccctggagaag

SEQ ID NO: 45805 - DNA, 186 bp, Heterodera glycines
  Genomic contig location: Contig_ID=SeqID_4426; Location=1334..1519; Strand=-
  SCN-specific regions: Sequence locations=1-48,70-131,153-186
ggacatgccgttggagacattcctggagttcgtttcaaagtagtcaaagttgccaacacgtcattgctcgcacttttccgtggaaagaaagagagacctcgttcatagaaactgacttcgcatgataaaggatttttcctttcattgtttttgttgattgcgattccgaaataaattgttgttgaa

SEQ ID NO: 45806 - DNA, 896 bp, Heterodera glycines
  Genomic contig location: Contig_ID=SeqID_23739; Location=1..896; Strand=-
  SCN-specific regions: Sequence locations=1-171,193-474,496-528,555 -568,615-896
  Gene Ontology: Mol. function=RNA-3'-phosphate cyclase activity; Cellular component=nucleolus; Biological process=35S primary transcript processing
ggcgtacacaatgaattacaattggaaggatgcaattttttgagacagcacattgttttttcactactaactggtaggacaatcacaattacaaagattcggtcttacgacgacaatcctggactgaagggtaacaaatttatttggaaaattcgttgtcatgataattcgaaataaaaattttatttaaaacttttttcgggtttggggttcgaattgggtcaaaacagatgccagaatctgtttttccgacctcgaaaacccctaaaacaagtttattcatgaaaaaaaaattttgaaaatctggacgcagataacccacaagtacccttttttaaaccaaaaggaattttttttgttacttgttaattatctatcagattttcaaaaaaaaatcaaactttttcaaaataaacttctcttttcgggtttcagagtcggaaaaaccgatatctcgtgaaaaaaaagttagaattttttatttttgaaagtctgaaggtggctaattaatgggacctagtaaaaaaagaatttttaaaaaattgagaatttttcatttttctaggactaaatttattttaaatctttttaaaaaaacagttattttaataaaagttgagtacaagttgccccgataatcctttgatttcttaagaatttgagcgcatttttctttccatgatcaaaagattgacgaatggaactgagctcaaacttagtaaaaacggtcagtcctttgatttttgtcttaatagttttggctatgccatccatttgacaggtacggaactcagttttcggcctggtctaattcatggaggagaattggagttcgactgtggggttcaacgttgtatcagttactttttggagcctctcattctcatggcgccttt

SEQ ID NO: 45807 - DNA, 2713 bp, Heterodera glycines
  Genomic contig location: Contig_ID=SeqID_498; Location=2411..5123; Strand=+
  SCN-specific regions: Sequence locations=1-364,387-738,762-807,838 -1028,1050-1251,1273-1282,1304-1464,1487-1957,1981-2192,2245 -2572,2608-2713
  Gene Ontology: Mol. function=proteasome endopeptidase activity; Cellular component=proteasome regulatory particle (sensu Eukarya); Biological process=embryonic cleavage
atggcgcacccagccggagatgtggtgagcgattggtgcttttcattttctttttctatgtcatttcattttttcaatttttcagaccgacgcccaagtgctggagatgtcttccgaccaaattgacgaacgcgtacgacagctcgacgaagaaattcgcgtcatgagggacgaaatgcgcaaaattgcgtacaacatcaaaacaatgggaacgaagacgaaggagaacaacaaacagatgcagaaagtgagcaaacaaacaaaaggaggaacgacaaatttatgacgaaaagcattttcagtacatgaaaatgccgtggctggtggccaatgtcgtggaaattctggacctcgcggatgaccaagcggaaggagaagaaggctcgagcagcgacttggacgcgcgtcagaagaaaggcgcagtcatcaaaatatcgaagggactcgtcatgtttttgcctcgcattggtcgcgtcggcccagacgagctgaagccgggggacctggtcggcatcgacaacgacacttatcacatcatcgcaaaattgccgccccattttgaccgacgcgtcaaggccatggaagtggtggaaagaccgacggagacgtacagcgaaattggcggatgcgagacgcaaatcaaagagttgcaagaggccattgtacgtgtcaaaaaacaattttggatcaaaacttcccattttctcattttcaggtgcttccaatgaccaaaaaggagctgttcataaagattggcattcatccaccgaagggcgtgctcatgtatgggcctccaggtgtcgtttctcacaaatcaattcaaattttcattttttctgataggtggcggcaatttctctcttttttaaggaactggcaaaacattgctcgcccgtgccgttgcttctcaaacaaaggctacctttctgcgtttgtccggtactctgctgaaccaagtgggcctcggcgacggggcgaagatggtgcagaacgcattcgagttggccaaacagaaggcgccggctatcattttcattgacgaattggattcgattggtgcgcgcatttttgaatttgctttactgacattgtgtttattccttctgcaacgcaggcacgaaacgattcgacgcctctgacacgggggaccgagacattcagcggacgatgttggagttgctgaaccaactcgacggattccaacccaacgacgacatcaaagtgagtggtggagcaagccaatcaattcacattcattttgttttcatttaacgcaggtcattgctgcgacaaatcgtgttgatgtgctcgacccggcccttcttcgctccggacgttttgaccgcaaaatcgaattcccagcaccaaatgagaagggcagggaacaaattcttcgcattcattcgcgccggatgaacgtcgagtcggtgacagaattttaggaaaacaaattattcctcgttttcagcaaaaatgtcaactttgttgagctgtcgcgctgcattgaggacttcaatggagcacaatgtcgagcagtttgtgtggaagcggtgagcggataaacattttttgaggatatgcgtcagcttatctcatttttacagggaatggttgcacttcgtcgtgactccactaaaattctgcatgaggatttcatggacggaattttggaggtaattagtaacaatttgagaaattttggaggaataagccaaacttttcaggtgcaaggcttgaagaagaataatctggtgtattatggctgatgggcgtcttctccggcggaatttaactgatgtgccacggctgaacactgcccagcaatttgtattgacattgacccatttccatgtgatgccttatgccttgtagcctgtattgtactacatttcgtatatgtgtttttgccactgtatttcatgtacaaatgttctcgtttagtgaaattgttgtttgcgtgtgtttgtttatattatgtacataaattattcgcgcatatagagaagtacccgatagcaaactgtaaccgtataagtgagcaggaatttcgtcactgaataatacatttgaaactcataattaatatttttaggtcctaaaaaacagaataattgctaaaaacgagaaaaagtgccaaaaaaactaaaatttagggggtgtaaaatgacaaaattttattccaaaagcttgagttaaattatttttaaaattacaaatagttcatatcaaaaaatataataataactagggtgcggattcttaggtttttacttattttttctgcggctttaactcgacgagaaatgcacgaaaaacacattttttgttcggaaattcttcgttttaacgtccctatccgaccctaggaatccctattttggatattcgcccctaaaaatccctattttgagtgttcgcccctaaaataagtttttatccctattttggcgtttcgcccctattttcgcccctatttcgcgaattttttgcccctatttaggtccctaaattggaatttttcgcccctaaaaatccgcaccctaataataactttaaatttatgaatgattgcaaaaattcaatttattttatttaagaaaataattagcaaaaacttcgcccaatcagtgacactttttgcagcccttcgaattgtcctcagacaaatcgcaaaagccatctttgcaacggtcacagctgaacaaattaacga

SEQ ID NO: 45808 - DNA, 1615 bp, Heterodera glycines
  Genomic contig location: Contig_ID=SeqID_498; Location=5559..7173; Strand=+
  SCN-specific regions: Sequence locations=1-136,158-257,294-369,391 -891,914-1265,1289-1343,1365-1592,1614-1615
  Gene Ontology: Mol. function=transcription co-repressor activity; Cellular component=26S proteasome; Biological process=embryonic cleavage
atgcatccatttaaatcatttttgtggcttttaccgcggcacgtgtccattgcattcgcattcgccacgctctttggactgctcgccgctgccggggcgccacggcaaatcgttgtacaaatccttcaaattggcattattttgaaaggacatttgaaacaaatgtatgtacgttaattcacttggcactgttcacaattcaacccttttgtgttgtgtttgcattcgtaaatgtcatggacaacctcataagaacggctttaaatcaacaaaataataataattaatcaaattgaaaattgtggcacattgccgcgcctggcatggtggccgtactcatattttgtgtatcatcgtgctgaattaagatttaatttgaaaaatattcaaaataggaaactctcgcacattttggcgcactgcaactgcacacaatgcaaaaaaaacgtccaaaattgtgtataaaagtcgctgttgtgatgcatttttctcatattttactaacggggcgtaacacaacgagaagatggcgcacccagccggagatgtggtgagcgattggtgcttttcattttcttctatgtcatttcattttttcaatttttcagaccgacgcccaagtgctggagatgtcttccgaccaaattgacgaacgcgtacgacagacagctcgacgaagaaattcgcgtcatgagggacgaaatgcgcaaaattgcgtacaacatcaaaacaatgggaacgaagacgaaggagaacaacaaacagatgcagaaagtgagcaaacaaacaaaaggaggaacgacaaatttatgacgaaaagcattttcagtacatgaaaatgccgtggctggtggccaatgtcgtggaaattctggacctcgcggatgaccaagcggaaggagaagaaggctcgagcagcgacttggacgcgcgtcagaagaaaggcgcagtcatcaaaatatcgaagggactcgtcatgtttttgcctcgcattggtctcgtcggcccagacgagctgaagccgggggacctggtcggcatcgacaacgacacttatcacatcatcgcaaaattgccgccccattttgaccgacgcgtcaaggccatggaagtggtggaaagagcgacggagacgtacagcgaaattggcggatgcgagacgcaaatcaaagagttgcaagaggccattgtacgtgtcaaaaaacaattttggatcaaaacttcccattttctcattttcaggtgcttccaatgaccaaaaaggagctgttcataaagattggcattcatccaccgaagggcgtgctcatgtatgggcctccaggtgtcgtttctcacaaagcaattcaaattttcattttttctgataggtggcggcaatttctctcttttttaaggaactggcaaaacattgctcgcccgtgccgttgcttctcaaacaaaggctacctttctgcgtttgtccggtactctgctgaaccaagtgggcctcggcgacggggcgaagatggtgcagaacgcattcgagttgtccaaacagaaggcgccgactatcagtttcattgtcgaattggatacgatgggtgcgcgcattggagaatttgatgctagatga

SEQ ID NO: 45809 - DNA, 427 bp, Heterodera glycines
  Genomic contig location: Contig_ID=SeqID_4439; Location=6..432; Strand=-
  SCN-specific regions: Sequence locations=1-194,216-216,239-427
  Gene Ontology: Mol. function=hydrogen-transporting ATPase activity, rotational mechanism; Cellular component=vacuolar membrane (sensu Fungi); Biological process=hydrogen transport
atgtctggtggtggcaaagatcggattgcagtttttccgtcacggatgtgagttttcgcttacactttataataaatccataccaaaaataatcattaagggctcaaactgtgatgaaaacgaggctgaaaggcgctcaaaaagggcatagtttactgaagaaaaaggcggatgcgttgaatatgcgatttcgtgaaattctgaagaaaatcactgaagtgagttatttacaacaacaaatgctgccaatgtgtggaattgcggtccctacgaaaaataaatttaaagtttttgttttatttttttctagggtaaaaaatgtgctgatagcgaatatgagaacccgggggttttcagggcctctgatcacgaatctgatatcagatttgcaaaaatcattgattttgaaaatcatagattttcgtaa

SEQ ID NO: 45810 - DNA, 4005 bp, Heterodera glycines
  Genomic contig location: Contig_ID=SeqID_4439; Location=1..4005; Strand=+
  SCN-specific regions: Sequence locations=1-194,217-217,239-467,490 -668,690-1060,1090-1256,1290-1297,1320-1445,1477-1504,1526-3337,3362 -4005
  Gene Ontology: Cellular component=CCR4-NOT core complex; Biological process=reproduction
aaaatttacgaaaatctatgattttcaaaatcaatgatttttgcaaatctgatatcagattcgtgatcagaggccctgaaaacccccgggttctcatattcgctatcagcacattttttaccctagaaaaaaataaaacaaaaactttaaatttatttttcgtagggaccgcaattccacacattggcagcatttgttgttgtaaataactcacttcagtgattttcttcagaatttcacgaaatcgcatattcaacgcatccgcctttttcttcagtaaactatgccctttttgagcgcctttcagcctcgttttcatcacagtttgagcccttaatgattatttttggtatggatttattataaagtgtaagcgaaaactcacatccgtgacggaaaaactgcaatccgatctttgccaccaccagacatgtttaaaaaaaattatttaatcttattgtaaatcacttaaaaaatgtacattcattagacaattcgcttctttccgagcgagactaaaaatcatattcaaaattcacttttttgcgccaacaacaaatctaattttaaatctgccaacttcattcaaaatttgacttttttcgtgaattttttgcaatttttttatgactttttcgagattttcgtgatttaagacctaaatttcatttagaataattattttcaaattttggatgctaccgggtagcaccaacacagctccatcgggccttgccaacgcgttaacaaacgagtttggaggtaataaacgcggaggtttcatttgtcatacaagcattagtataaaatcgctgaagagaaaaaaacaagccaaccttcaattgttaagccccataattatttgatttcttggtaatggtccgtaataaattaaacatcagttcgggtggtttcattttttaaattgtccagttccagtgagcttatcccaatgcttatgctcatgacatgacaattggtcttccaaattgtttatagaagacttggccaccgcggtgttcagtgaggacatacaggaagaagcgaactcatattttcaacaggtttcattttccctcaactttatttgattaaattttcctctttttgtgtccatagatttatgctccagatggtcgtgtctctgtcaatgatttcatcgcaaaactcaaaggttttcggcattctggaaacatcaaagagcgcgtgagtgttttgtcaaccaacgaacgataattccttctcccgtctgatagaaattttttaaactatttttttttaatttttaacaaaaaactttttcaaagaaaatttacatctctttctaggaattgctgctgtgtgtggtgaagaacttgtttgatgagtatcgcttttttcgcgaatatccggagagggaacttcgcaccacggccgaagtttatggaggaatcattcgggaagagataattttgtatatatatatataattttttactttttgaattcatcgctttcaggcagccattagttaaaccattcatttaggaatatccaatttgcgactgccattcgacgtgtaattgaatcgctgaatgacgagccgggcagcgtactttggacgtttggcattgtggcactgagtgcatgtcgcgcatgtctctacaaatatcccaaagtgtgccatatgatcatcaacacgaacagctatggccggttcccgcccggtctgaaggactacgtcagtgccggtgcgctgggccaactgccaatgaatcactcagcggcacatgacgtcggcctattttcgtccaaccaacaaccacagccgttctttccgccatcctctgttgaattcagcgtcccaattctgccgatggcgaaaatgtccatgccgggccttggtgccgccgctgcgaacatgcgatttaccacgcccagttgggggacgagcacggtcctccaaacaacaaaaaacacgggttttttctgatatttatatatttagggaaattcaattttgaatgtgaccaacgtggacacgctgatctcggccaccgaacgcgagggcaaccaagtgaaacagccgccacaacaactgttcgagaaagttgcattcacctgcaacaatttgtgcgcgaacaatttactcgacaaagtcagtctgtgtcgtgatttgttgacaacggatggatgatttattcaacattttgtttgttcgttcagactcaagaattgactcaactgatccgcgaaaacggtgacgagttcttggaatggtttgcccaatatttggtgatgaagcgcgtcactgtggagcacaattaccaacaactgtacaacagcttcctggtgttgatcaacaacacctcgttggacaactacgtgaagaaggagacgtaccgcaacatcaacattctgctcaaaagtgataagcaacagtcggtgtccaattttggtgaccgccaactgctgaagaatttgggccattggattggcattattaccattggacgagatcgaccaattctgaacaaggacttggacatgaaatatctgctctttgaggccttctacaagggtcagcatgaactgctgtacattgtgccgtttgtggtcaaatgcatcactgcaagtgccaagagtcaactgttcgggccccactgtggttgggtgtacgccattctgaaggtgctcgccgaaatacacaacgaaccggacctgaagctgaacttgcgttttgaaattgaagttctctgcaaggagctgaacgttaacctgggaagcattgaggttggcagctacctgaaggagcagcgacgtttggtcagtgtgaaacaaaagaaaattccgatgattgagcaaaatctcctttaagcccagattggtgccgccctccaaactcggcacagccgcagcatcttcaacattggcacaatgtcagttgccgccaatccaaccaccgcacattggcgctgggatttcgtcacacagcacggcagattatacgccaactgacatagcgaacatcctcgctgaaatgagcatctcccggaaatattcgccggccagttatacgcccggcggatcgcaacaacaagtttcatcaataacagcccatcagactctgcccaccttcaactacgcggacattgctttgcaatctggtacatatttatccattatttaattattactaattttactttttaaggaattttgcaaatcatcgtcattcctccgcatttgatgcttttccaagttcatccacagcttaaaacaacatgcaaaatcgctattaatcatgcaatcaaagatgtctatggtaattaattcatcgtaatacattgaaatgtactaatttattatttatttattttttgggtggcgtcgctgaccgcgcaattagcgttgcaatcgctgccactgaacaaatttgtcgcaaggacttcagcctggactcgaatgaacaaaatttacgtcgtggagcccaccaaatgatgcgttcaatgactgccgctatcgcgtcaattacgtgccgtgaaccgttgtcacagcaaatgaacagcattctgagaatgtatctgaccgacgcgatgggaaatgttgtgcctggaagcgaccaggccaaaatggtggaagaagcggccaccgctgtgacggacacgaacataaacatcgccacaaatttcgtcgtgaaaaacgcatgcgaaaaagcggttgccgacattgagaaaggacttgagtcggaatatatgtcgcgcaaaactgcttcagacgaccgtccgttccaagttgacgcggacatggccgagatgagtgaaaaaattccggaaatgatcagactaaaggaggggccgatcagtgaggcgatgctgaaggtgtacgacgacttttcatcgtaatgaaattttaatgattcatttcgtccccattttttaatattttattggaaaaattgtaggaaaatctgtggcttcaaaccattcgcacccgaggacagatttatcggattcacaaagcctg

SEQ ID NO: 45811 - DNA, 2296 bp, Heterodera glycines
  misc_feature (343)..(343): n is a, c, g, or t
  Genomic contig location: Contig_ID=SeqID_4444; Location=476..2771; Strand=-
  SCN-specific regions: Sequence locations=1-412,562-717,762-802,824 -839,863-894,916-996,1020-1105,1127-1437,1460-1587,1609-1653,1676 -1757,1779-2148,2182-2296
  Gene Ontology: Mol. function=protein binding; Cellular component=Z disc; Biological process=signal transduction
tttgtgttggcgaagggtcgttgttggtgtccagagcattttgtgtgcgctaattctggtagttattattagctaattagtattcaaaaaatcccccaatttttcatcctcaaataataattattattgtatacagcatgtggtcgacgcttattggagagtggctttgttgaagagccgcagggccgtaaaaattattgtcccatttgctatgaatgtttgatggcgcctgtgtgccgtaaatgcttcttgccgttgatggaggtggcacaacattgggattacaaattaaaaacaaaaaaagattttggtatcggaattgggatgtattggcaattttttngaaacccatacccccccccccctcccgccgcttgtacaatttcaacgggttaattgcaagtcgtacaacaaatttttttaaatctaaaattgaactttttgttaaaaattttaaaaagaaaaaacttgaaaattaaaattttcaatagattttaaattgtaaaattagcaaaaataatcctttaaaaatttttgaatttttcttttaaaaaaattattgtactagcgtaaaaatgattttttgccagaattgtctgaacgcgctgggcgacaaatggcacaacgaatgcttcacttgtacccattgtcgtaaaccgtttggcactctctcattctttgtcgaggacggcaaaccctactgtgaagagggtgaacacttttggggaattttttaaaattattttctttgtagtattaattccttttttttataatccatataatgcagggctaccctttgtacttatttgtaagtattgtacttatttcagctcaaggtacttattttgtacttatttttggaactcaaaggaaattccgatttttatagcaatatttgaaagaaaaattatgttttgaagcgaatgttaaatacaaaatcgtaacaagattcgctaaatattctaaatttcgaaagaaagttctatgatcacattttttagagtttaaattattaattatttacgttaatggctccaccaaaccgcaaatataaatttcacgctgattatgagcgtgaatttcaaggcataaaaaggagcaaaaagggggatttttgaatatatttttttaacaaaattcatgaaaaagcccaaaaaaaatttttcccgtcggcgcctatcggcgccgcagtgccgcaaatttccgctgagatttcaaaaattgacctaaaattttccatgcaaaaattggcctttttggtgaaaatttgttaccagtcgcgctaaattacaaaattttttccggcggcgcctaccggcactgccggaccccatcccatcgcccattcctcaaaattttttggaaaaagcacaccgcaaaaaattgttaaaaatctgattttttgatcccgaatgaactataattatttacaaattgcttatgttttaaacaaaattattaaattcattttcgaaaatgtataaatttctcatttctaagccggaattgctcagaaaaatagttggcggcgagaaatatgttgttaatgcttgattttgttgaataaaaatgtgatttaaagtttggaagcatttgaaaaaatgtacttattttgacccttaaaacttatttttgaccagcgaaatacttattttgggaaattttcaagggtagccctgatataatgggatgatgaggatcactaattacccttactaattactggaactgttcgctgcctccctccctccgagaaaatttatattgtaaaacaagttcttgttttccaactttcttaaaagtttttttcccataaaaatgtttttttttcaaaaatagatttctttctaaatttttttacaggaaaaactaagaaaaataaaacaattttttcgcggaggaaaatgtaatgcaaaacccaaaaataccaaggacgtaaattcattttaatatacaatgaaattgattctatgtacagattggaatttgctgttcaccacgaagtgttcggactgtctaaaaccaattaaagtgggccaaaaatggctggaagcactcggaggccaattccacgcggactgcttcaaatgcgcggtagctttaagtttttctgctccattttagcacctttcttgtcggaggcttaaaattttattatttttccccaaatttctgtttgtcggaggctctaaatttgttttgcttttccttcctgccccagacttgtggcactggacttgaaggtaaaacatacttcgaacgtgaccaacaaccattttgtcgtgtccatgcc

SEQ ID NO: 45812 - DNA, 1327 bp, Heterodera glycines
  Genomic contig location: Contig_ID=SeqID_23807; Location=305..1631; Strand=-
  SCN-specific regions: Sequence locations=1-147,170-358,380-473,495 -1169,1209-1212,1234-1327
  Gene Ontology: Mol. function=co-chaperonin activity; Cellular component=microtubule; Biological process=beta-tubulin folding
atgggtgctgaagttgtttcttcggtgttgaccaagtgcttcagtgattctgccgcggacgaggccaacgcgtggcacggcgggtgtttggcattggctgagctctgtcgtcgggggtgccttttgccgtgccaagttccaatggttgtttttgctttgtttccatttggcactttctcacttctctaaggtcattgtcgacctccttccccgtgccctcacttttgagcagttccaacttggctttatgcaggcggtcaatgtgcgtgatgccgcttgttacatttgttgggcctttgcccgcgcttatgaggtttcttttctcgctttcccctacccttcccgtggctcagtgcatttctcctccatttccgttggttctcccccaccctgcgatttgtcttatttgcgttaaatgatgacaattgttcttctttccccgactgagtttgtcgctgctgacatccatccgctaaaatctttctgataacgcaccgatttctcctcactttttttcattgttactttttctctttttggcacattttctctgatattttttccaggcccaacttctccgtgaccatttgccctctttggccggtgttttactttcggttgcgctgtttgaccgcgaagtgaatgttcgaagggcggcaagtgccgctttccaagtgccccccccccttttgagcccttttcattgcccatttaggagaatgtcggccgcaatgattcttttccgcatggcatcgccgttctgacattggtcgattttgtggaggtggcgcgcataaaacactgctacaccgatttggctgttcaggtggcttttcttttttttccagcggatttatttatttttcggttgcccaattcggcgaatacatccgtccgatgatggaccatttgtgcgaattgaaaagcattcattgggacgaaatggtgcgcaaattggcggcggatgccattcaacggatcgcttcttttgacttggattatgcttatgaaaaagtgagtgtcctatcattttcaatcaatttaattaacaaaactcgaaaagaaaattaacaaacttttataagaaattacagtatttcttatattttttttttattccggggattttcccctcgcctatgggcgtacccaattttaccaaactttggctatctttctttctttccctccctcttttcatttatgttatttcttcagattttccccgttttctgtgcccgtctccgttcttcggactccgtcgtcaaacatggcgctttcctcggcgtttctgcgcttcttttcgctctcaacggaacgcacgacg

SEQ ID NO: 45813 - DNA, 2041 bp, Heterodera glycines
  Genomic contig location: Contig_ID=SeqID_23812; Location=1..2041; Strand=-
  SCN-specific regions: Sequence locations=1-90,113-1337,1359-1682,1705- 2041
  Gene Ontology: Mol. function=protein binding; Cellular component =nucleolus; Biological process=growth
ctttaccctgttgtgttagatggcgattttgttggttttatccctcgcaaaaaagctgcgtttattgaacgtcaattgcgcgcaatgaaagtcgcttctcatgatgatcgtgtgccagcatttacggaacttacgcttatcagacattcacccgactctgagaatattcaaatgcaattcgccgcgttttttatttacagcggccttggaagattgatgagaccagttaggaaccttttatttgatcaaatcgagcaaataggttaactgatttaaacttacccttttgaacttaattacatttaggaatttttgaacaagtttacctttccattataattgaccccgaagaggcagaaccgggcgtaacaatgcaccaagaagttagaaagtgcccatgggttggatgagcgtccaacaatttttagcttcatccctcgtctctgttctcattcgctggcaatttgattccttttcccgatcacaaccaatcgcctcgaaatgtgtatcaatgtcaaatgggaaaacagacaatgggggtgattgtggaagggcgctattcaatacaaacatccccttttgcttattgtcaggtcccagtccacgcttggcagacgcgtacggacaacaaaatgtacaaattgcaaactgcgcaaaaacctttactcaaattggaggcccatgacaaatacgaaatggacgaataccctctaggcacaaatgcgtgtgtggccgttatttcgtacactggtcagttgggaagggttaatgggtaaggcgttttacacaatgtgtctggtcaggatacgacatggaagatgcaatggtgatcaacaaggctggtttattgcattgcctttgtcccgttcaacctcaaaaacccgttttaaggcttcgtatcagcgtggctttgcacatggaactgtcgttaaagtgcagaggtatgaattttttgagttttataaacaaaattgcttcaaggatcagtttggttgatcgctccaccggtggttttggtcagagcaaaaatgcggaaatggtctttttggggaagccgaacgaacgcaattacggcatcggtgcggacggcctgcccattgaaggccgtctctaccagcagggcgactgctattacggcactttcagttgagtgtccccggggtgtttaatgcttttgacaattttcagatttggtcagcggacaattcaacgagcacaaattcacgaacagtgagcccgcttattgcgggttggtccgaattgtgcaggaggcggaccacaaaaacaaaaacgtggtaattcattcgcgccgtgcagcgatttttgcctattttcattttgaacattttgtcccttttccatgccatcagcacgtgttaatccaatggcgaatccaacggaatccgatcatcggcgacaaatttgcttcacgtcatggccaaaagggcatcaattcattcctttggccccccgagtcgatgcccttttccgagtcgggaatggtccccgacattatttttaaccctcacgggtaattgctgttctttttgaatatgaatttaaatgagtcactaatttgaatggtctgcagttttccctcccgtatgaccattggaatgatgatcgaaagtatggccggaaaggccgcagcaatgcacggcacttcttacgatgcatcgccctttgttttcaagtgatttttaaaaaatcacttgaaaacccttcaaaattaagtgagcaaaatacggccattgaacacttcgggaaactcctggccaaatccggatacaattattacggcaatgaaacgatgtattcggggatcgatggacgagaaatgaaggttcagaatggaaggaaaatgggctctttgattgacaaatctccaggtaaaaattttcttcggcattgtctattaccaacggttacggcatatgatagcggacaaattccaagtacgctagagggggcccgtcgatccaagtgagtgaatcaatgatcataagaaactaattaaaaacaatttgcttgtttacagtta

SEQ ID NO: 45814 - DNA, 1302 bp, Heterodera glycines
  Genomic contig location: Contig_ID=SeqID_23821; Location=150..1451; Strand=-
  SCN-specific regions: Sequence locations=1-170,211-386,408-454,478 -575,604-705,743-847,870-895,917-1302
atgaaggttgaaatcaatggtgcttcaaccacaggatttgccttttctgatcttacaacaaagcttcataaaaatgtcctttcaaatttgggtttgaatatggcaaaccatgtagaaagcgacacaatttcattgactgtcgatgcattgtactatgcttggtaaaagtctttattaaatcaattaattaattattttacaaaaaattttgaggcaaaaatttgctgatactaaagcaattgtgctgataattgtcgccaaaaataggccaaattactatgaatcgtggatcataaagaagaaattgcatgataaatatgcaattaattcggttgtattaagtttattccaatgtgccaaaatgtatgaaaattaagtaattatgaaaaaacaattaattaatttttaggctaacgcttaatatcaaagatttttcattacggttaaacaagcaaattgttgttgctgttgtgtttaatcagcaaactatgctcaacgaaaatacatatcaaatgaaagctcgactgatcattgaacgttccacagcaatcgtaaaaaaaattagatattttcgcaataatattttattttaatattttttttcagaaagcaccatcgcttattgcagtacttgcatattcaaagaaaatccaacaggtcatccccataaaactattttgggatacagtatggtcacctccccccataaaaaaaataaacaaattatatttatcaattaattcgtctcgaggagtaaagcatgaaaaataatgctaatccgttcgctgttctgatttcgatcatcaaaaggcaatttttttgagattttatgactttggcattctgtctaattatttaaataaacagaaaatcttaaaataattcaacaaatgacaataaaaattcattttaagccagttcaatattaaatttaaactcatttccgcaaatggatatctattttcatgcttacttagatccacgatacgaatcgattagtaatataagttgtgccatttttttgtgttgggattgactatagttatgccatattttgtattagccaataatactgattaaaagggcttttaacatttcgtaacttagcactaataaattattaggctctcgcccagcctggcatggttgaacgttttttccctaatcctgaagaagcgccactaatcaaagctatccgagacactgaagcgaaaatatggaccatcgaacgggacaatgataaatttgctgaaatgatgaaagtaaaaaatttcgaatttaaataaatttacaaaaaataaa

SEQ ID NO: 45815 - DNA, 6231 bp, Heterodera glycines
  Genomic contig location: Contig_ID=SeqID_4461; Location=74..6304; Strand=-
  SCN-specific regions: Sequence locations=1-380,489-816,864-900,922 -975,1011-1044,1094-1178,1208-1344,1372-1439,1471-1654,1687-1907,1973- 2565,2588-2654,2676-2713,2743-2877,2914-3234,3257-3260,3290-3330,3352- 3396,...
  SCN-specific regions: Sequence locations=...3422-3427,3452-3580,3611 -3932,3963-4170,4193-4238,4264-4277,4312-4407,4429-4502,4525 -4536,4558-4734,4759-4964,4986-5067,5089-5089,5185-5510,5532 -5551,5583-5780,5805-6023,6053-6231
  Gene Ontology: Mol. function=transcription factor activity; Cellular component=nucleus; Biological process=negative regulation of transcription of homeotic gene (Polycomb group)
ctggactgatcagtggtgtgccgccacaacagcaggtgctgtcgccggcacaataccaacagatgggctattattacaaagggcctggcccgccgccggggatgatgccgctgggccatgccgaaatgatggtcagtcaatcgtcagcacttcacttgctgcactcttgctacctatttgttgattagctggaaaatttggagaatccgggatggattgaatgttatattttgtagcagggaatgtgccgatgccctaaaaaatatcggaattcggcatttaaggggagggggcctttttcaacaaaaaaatggcttaaaaaatttggctaaatttatggattttgttctttttttagtccgcttctgctcacagcagggaagagcaacaacaacaacaaaagcagcaacattttcaacaggcacagcaacagcagcaaatgttccagcatcaacactatttgttgcaacaacagcaacaacaacaaccgccgccccagggcatcttgtacacgtcacagcaacagggcacaaccgttgctgctgccggagcgcaggtgccgcagattttggacgaaatgaaaaatttaaacaaatttgccgacgttagcctatctcggcatgattgccagccctggcactaattttcacttgaatttttctaaaattgcggcccaaaatccgcaaaattggccattttctggctcaaatcagggtcggtgcattttgcttgcttcaagagttacatggtgtcaaaaatcggaaatttgctcattctcgacaggagggaaagggcgaacctaataataaagtggtcaattaaagataatatttaaatttaattatttaaatttaattttatttgcagaatacgacaaaggtttctttctctattaatctgttcagtttcaaacagttttaaaaactttcaaaataattaaggacaaaattaagtttgatcattattctgcaaatgaaattattgtaaataataattaaatttaaatattactttcattagtaccttttttagaaatttcgccacattttattaaattttttattaaatcaaattttataattttgtaaaattagtttttgttcgagttaaagttaggggtccagaattgggctaaaatgaatgtcaaattcttgatcagcggacccaaaaagcccgagaaatattaaaaaaaattttttttttttttgcaggcagacggatttgaacccatggctaaaaaaatccaattttaactaaccctgcattccttcaataaacaaatttccaatttgtacccaaaagtagaactagcataaacttaattgggcccacaaaaagatgggcatattatttttatttttaaaatttattggtaaatttttcaaaaacgatcatttaccgtatacagcagcagtcgaattttggtgccgggtacggtatgcagcaacaacaacagcaacaggcaaagcaggcggcaagcgcagcgaaggcagccgctgcggcacaacaaatgatcaaaagcggcggaggatccgcgacggcgccgggtgccggaggcggtggccaatctgcagcggcggcacaaccgtacaaccagcaacaacaacagccaatgttctacaacacgggccagcaaccgcagccataccaagcccaacaaccgcaacaacaacaacaacagcagcaggctgctgctgctggacaatatgtggggcaaggggtttaaatgccccctcccctcgggggtcgttttcccttcggtcaccccccacccgtctgggaaatttacaaaaaattcaaaaagaaaaactgggcgcctggatttcttcttcgggtcactttcccccgggagcagtttcgttttccattccccccgaaaatcaaaaaaacaaaaaagtttcatgcagaaattttcaaaaaaaaaaaaaagtttataaaattttctaagaaaatttcaagaaaaaataaataagaaccattttccagagaatttttcataattttaagatgaatttgtaagttgtttttttttcaactaatctaagtttgaattgtttattctaatctaatacaaaatttaataattgggcatatttaagccgatgatgggcatgccttcccaaccatctgctgctggctatccccaaatgcaatatccaacgtccgctgattacacccaacagatggccatgcaacggcagggtaaaaaaatttgtaaaatttgttggccctttttggcattttccaacaattttttatattttggcattttggacaattttactttgttttcgcgttctgacgccctgtgtttttaatcgtgttgccctagcttttaaatgcaaaacaaaattcttcaatgttttaacagttttcgtcgccgtggaaaaaaaagcagaattgtagccatttttcgccaaaaaatgaccaatttttgccattttggtgtcaaattatttttccacttttcttacaattaaaagtttaattttcattttcgtttttttttgatttttgatcggctaattccaaaattgcgcgaattcaccgttctttgaaattgcaaaatgaatattaaaataaaattgcgcaaaaaaaaaaaatttctgtcgcgagaattgacactttctcaaatcggaatcgtcacagtcacctcacttttttatggaatgattgtgtgatgatcattgacttcacttccgttaatttagggttttttttattatttttaattattaatttgacaatttaatcatttaccggtgatcattatttatcttaatgagtgtgttgaataattaattaagcaattactaatcatcttgttttcgaaaatctgctgctgtaacatttaattttttttaatggttccgttgctccatttcataatttgctaaattattaaaatggactgccctttgccccggataaatcactttttgggggtttttgaaattttttcacagagttttggttgtttttcaaaaatttttattataccatttaaatattttttgtacaaaagtgaattcgggacacaaaaatgggaacaataagtcaattttttcctcggtggccctgtctgtcggtgccaaaaatttgaaaaaagcgtgccgcaaaaattggtgctcgcggacgaaaaaccaaaattttgtgcaatagttgcacaatttcaaaatttgtgccatgcccttccccctaaaaatgccatgccattgtttcagcatactacttgcaacagcagcaacaaatgctggccgctgctgctgccggtggtggtggcggtggcaccgctgtgccgtcctccgccgctgccgctgcgcacattgccggaggcggcggtgccggtgccggaggcgcaccgacgacggcattttaccatcaaagttacatgaatcctcagcaacaccaccagcaacaacagtacatgatgcaacagcagcagcaacaattttaccgtgaactttacgagtgtgatcagcaactgaatgcgttgttgccccaggcccaacaaaacgcggaggcggcaatgcgcgtggaaaaattgcaggcaattctttggcatttataatagaatgccaattttaaattaaatttttaataaaaaaatgccccaattttaattgtttttttttgtagatgcaccgcagctacttgcaagggcacctcattcagctgcagcaacaagccgctgcggttgctgcgtcgatggcatcatcgtccaacattgtgccaccatcattgtccaccgctggcatggttccaatgcagcaacaacagccaaccgcaacatccgctggtgctgacatcattgcatcaccgtccaacgcgtccagccgtgaacaaccgccgcaacaacagtttatgggcgcgcaaccgaccgctgctggcacacaatacgctgctccatcttcggcatatggcatcgctgcgcaaccgccgcaacagcaacaaccgcagcatggacactttcctggtgccactggacaacagcaacaacaacctgttgctgccggtcaaattcctgtgcaacaaaagttgcaaccgtcaagcaaccaacaaccaacctcggcaccgcaacatcaatttggtggtggcacatcgtccgcaccatcgtcgtacatgccaccaactccgcagacggtggtaggggcagctgcagggtacagctcgccggcggcgggcggcggcacgccgcaacagcaacatcaacaaccgacatcggttggcatggttgtgccacaacaacagcaacaaccccagggcattactgcttcccaccagcagcaacaacaacaagcgccgcagccgcagttcacgcaacagcatttggcaccaccgtctgttgcagtgatgtccgcatccagccaagtgcaggtgagttgggcacggtgcatgcggtactacgtcccctccccgggcgtttttatgagaaaatttcaaaaaaaaaatacaagaaaatttccagcgattttttggaaattttttttttttgagaaaacagtaattcattatgaaactgaaaaaattcgctggataatttttttaaaattttttcttgacaaattgaaatttctcataaaaatttttaagattttttgaaaaaatttcaaatttcgaaaatttggcggagtgaaatcagctgtctcccagttgggcaacatgaattctatatgaaaagttggtgcccgggactttgatcagttcccagtcatcctcccaacgcttatgccctgttttgtgtttttaggttaatatccgtcctgaaatgccgggccgaacgctgatcagcgtgtaccacagccaggacatggcaccgccaacagttgtgagcagttcagcagcgccggtggcatcattacaccagcaacaaccgcaacaacacgccgcaacatattcattgtcatcgacggcagatgcttcctctgcagctgcttcagcaattatggcacaaaatttggcaatggctgctgctgcggcggcggttaaggactccattccaccggagcccgtgccgtccaacattgtgcaggagcagaagcggcgccagcaacagatgctattgttgcagcaacgggaagaggaggaccagcaacagcagcagcaacaacaacttgagcaacagcaactgcagaaattcaaacagtaccagcagcaacaacagcaacaacaacagaagcagcaatctttcaatttgggtgcatcaacgatgccaacaaaggtgacatttggcatgggttagataattagatggcacaccacaattgaacattccatcatattttcgcatccctaaatattttgtgaattcgacagagattatgcaacattttttgacggcattttggcaatctaaaaatagttgaaaatgaatagtgtattatagtaattgaattttgggtcagtagaactttaccatttctacaactaaaatttgaggcctcgccagaaaaaaaaaataaattcttaccatttttaacagatttttaccaaaaaattgctaattttgtgggttttttgggaaaatttagcggaaatttattaaacctacaaaattaaaataaaataaactaattaattttccacagacttcgtcactttccacatcaccgccacccaatgcgccaatttcacctgcaaccaaagcacgtgacaatgaagcagttcagcaggatgcagcacaacatcgcttccggagtgccagttctacccaaatggcaccgtcggcggcgccatttcggcaccgttctcatacgtctgcaatggtgccgcaaccggaaattgctgttgaacagctccagcagcaacgacaacattcccagcaaaagtcgccatcaccatactggtcttcgtcgtcacaacagcagcgcgcaaccacaccgcctgaatttaccatgccgtcgtcacatggacatgctcgtcatcgccagcagcaatcttatgccggtggtggtgggtccaccatgtttggcaacagcagcaaagtgccaacacctccgtcacctgcggttgttgtacgtgctccaccaccaccaccaccgctattaccacctgcagtggtcgtcgtacaaaatgccaaagtggcgcttcattttgttgcaaagcatgctgcatcgtcattcgcttcgtgtgccaccgtacgacgaattgttgcacgtgaatcggtggctggaacggtcaaaattgtgccaagaaagccgccgccggaagtgaaaaaggatgcagcaaaag

SEQ ID NO: 45816 - DNA, 517 bp, Heterodera glycines
  Genomic contig location: Contig_ID=SeqID_4462; Location=5491..6007; Strand=-
  SCN-specific regions: Sequence locations=1-517
  Gene Ontology: Mol. function=DNA-directed RNA polymerase activity; Cellular component=DNA-directed RNA polymerase II, holoenzyme; Biological process=transcription from Pol I promoter
atgaatagcctgtatttcgaggatttgttcaccgtcaaaaacattgaccccgatgggaaaaagttcgacagagtcagtcgtctcttttgtgacagcgaatcattcaaaatggacctcattttggatgtgaacacccaactctacgccatgggaatcaacgacaaattccggttgatgctttgcacttcgattcgggacgacggactcaccgaagagggcgaatacgacaaatcagtgggtggtcggcttatgagggctgagtattttcggaagacatgcttatttcgcttgtcattttcagatagaaaacattccccgggttcgaatgttcgaatatgtgatgtacggcaaaatttaccggattgagaacgacgagggcaccgcagaaacgagtcgactgaccgcatacgcttctttcggagggcttctgatgcgaattcagggggaggcgaacaatttgaccggatttgagcaggacaaaaacatttatttgttgttaaagaaagttcctaattga

SEQ ID NO: 45817 - DNA, 1771 bp, Heterodera glycines
  misc_feature (1184)..(1184): n is a, c, g, or t
  Genomic contig location: Contig_ID=SeqID_23857; Location=255..2025; Strand=-
  SCN-specific regions: Sequence locations=1-131,185-308,332-511,533 -833,946-982,1004-1195,1217-1771
atgaatattgaaaatgtttttccacaaattcttttgattttaattttgggtattcgttttttggactcggcacctcccaaaaatgaatccgctggaaagtacattagttcgtcaagttcaggtgattatcgaataaaaatttaattaaagtccataatattaatttatttttaattattattttccgtaacaataaagtatttcacaatttgttacggaaaatatcgttaacaatgtgtaaatttattttgtgtgatttgccttatggcttattaattaatcagtgttaaaaaaccaacacaattttcttaaataaattatttatttttatcatacaaaaattgcttaacttaaggaaaatatacggtaaatgcttatatgggcgacatagaaaaacaattaaacacatttcaaactgagaagctaattgatgaagtgaaacgatgggcagaaaatatgggacttaagattaaactttttgatcaaaggtaaggttgatcgaactcgagattgggttttttgttaaaatttttgtaagattttgttctgaatttcaacatttgaaatatattgagtcatatttttgaaattcgcattaagacaaataatttccatttagttataataaaaactaaggattggaaataatgggatcgagaatttgattaggagaaagcctggattccactcggctaactccaatggttttttgaaatgtgaaagggcaactaagcttcattcatttagtgctatgttacaagtggcaccatttacgctttttccgtcgccattttctggaacatattttgatcaagcgtacaatgctcaaacagtaatatatttatttatttattataattttaattattaacataacttattcaataagcccttcattttttaaacgatttaataatttttcataaaaaaatatttaaaatttttgataattcaatgcatttttttgtttacaagaactgaattttggaaaacaaaacaattttccaaaaagaattattcactgattgcagttacaaatgagatacatttcaattttttcgggagtaaaagacatacgattgtcggctaaaaatgatttgtaaacggaaaaagatcgttttcacgtcgcaacatgtcagaggagcaaaaataaatttgggagactaaaattttatgaaaatttntcatctcttatgtgtctatttttgaaaattgtagggtcgattcttaggaatatatttttctaattttttttgagtcgcttcttaggacaaaacgccaaaatgtgggcaaaaacttattttaagggtgaacactcaaaataaggattcctaaggtcgaataaaatcgataaaactcaaaatttttgaacaaaaaatttgtttttcgtgcatttcaaacgagctaaacctgcataaaaatccgggccctacctaaaacacacgagcaattaatttatcactggttgcagttcaaataaggcacatttttaggaggtttttgaatgcatttgaatacaaaaaagttcgaaaaaatcaaaatttaatggccaatgcagattcgaaagtattctttatttttaggcatttaatttgttgtatttccgaataatgcgcgattacgaatttttgcgggaagtttaccaaggcctaattgggcatgacgaaattatatcatcagcttttgacataatggatcaagttcattctgatggcattaaacaaccactcactttgcttttccaacgagcagtaaatttataaaaaataaa

SEQ ID NO: 45818 - DNA, 1034 bp, Heterodera glycines
  Genomic contig location: Contig_ID=SeqID_4469; Location=608..1641; Strand=+
  SCN-specific regions: Sequence locations=1-541,568-1034
atggcatacaaaacttatctttctcatgaactttcgcaatcacttgaagctaaagtttcgcatttaactgctgctggatacgaccgtgaagatgctagcaatctacaaaacgcaaattccgaagggttcaaaagtagaagacaacggtatttgggaggtcgaacagcacaatacattgcaaaaatcgatgccgatcttttcaatgtaccccaatatttgattaatcattgtgaaattgacataacgatacaaccccatgatgacaattttttgttaattgacaccttagacccccctggtcagccatatagccttgagcttgttggattgaaactctactgcaaaaaagtcagtcttatggatggtttggctcttgagttggcgaaaaaattggaaatgaaaccagcacggtatgctgtacgaaagacgatgatgaaagcactgttcataagcccgggacgctatgaatttaatgcaaacttgttcatggaccaagttccacgtcgcgtaacaatgggacttgtcgcaaattcagattatgtggggaacatcaaaaggagtccattcaactttcagcactttaatgtacgggagttaagtgttgtggccaatggtcgctcctatccccaggccccgtatgacattgactatgaaaattggaaatttgttcgaccctacaatgacacgcaggaggcgcttggttttgccaactctacatatggaaatggaattgattacttttcgtttttgcacactcactgtatttatgtgtttaatatgacaaacagcggagacgatcatggcggtttatttgatctaatcaaaaaaggctgtacagcagtgaacattaaattcaaaaaaccagtacccgatggtggaataacgcttattgtgatgggtgaagcggactctatttactttttggataaaaaccgaacaattgcaaccgatacaaccatttgataaaaatgtaccaaattttacttgcttccttattgtttcaaccaattgtttcattgatagttgaagaagga

SEQ ID NO: 45819 - DNA, 1262 bp, Heterodera glycines
  misc_feature (1212)..(1212): n is a, c, g, or t
  misc_feature (1258)..(1258): n is a, c, g, or t
  Genomic contig location: Contig_ID=SeqID_23896; Location=405..1666; Strand=+
  SCN-specific regions: Sequence locations=1-1225,1247-1262
atgacctttcacaaaattgacgcgagtagcatcgattcgattaccaatgccgttgattttttcagtatacccccgacaaatgttaccgtatcatcgtcaaaggttttcgagattttgccgagtaatccactcaccgacactccttatcattttaaaatacactcgagccaaaactacattgacctgtcaaagtgttaccttttgaccgaatttcgaatgcgaaaattgacacccccaaatggtgaatggggacatttggatgctactgatcaggttgttccaatacaattgattgggcacaccttcatgcgggacctgaaaattgcaataaacggtcgtgaaattttcaattctaattcactgatggcatacaaaacttatctttctcatgaactttcgcaatcacttgaagctaaagtttcgcatttaactgctgctggatacgaccgtgaagatgctagtaatctacaaaacgcaaattccgaagggttcaaaagtagaagacaacggtatttgggaggtcgaacagcacaatacattgcaaaaattgatgccgatcttttcaatgtaccccaatatttgattaatcattgtgaaattgatataacgatacaaccccatgacgacaattttttgttaattgacaccttagaccccctggtcaaccatatagccttgagcttgttggattgaaactctactgtaaaaaagtcagtcttatggatggtttggctcttgagttggcgaaaaaattggaaatgaaaccagcacggtatgctgtacgaaagacaatgatgaaagcattgttcataagcccaggacgctatgaatttaatgcaaacttgttcatggaccaagttccacgccgcgtgacaatgggacttgtcgcaaattcagattatgtggggaacatcaaaagtagcccattcaactttcagcactttaatgtacgggagttaagtgttgtggccaatggtcgctcctatccccaggcaccgtatgacattgactatgaaaattggaaatttgttcgtccctacaatgacacgcaggaggcgcttggttttgccaactctacatatggaaatggaattgattacttttcttttttgcacactcactgtatttatgtgtttaatatgacaaacagcggcgacgatcatggcggtttatttgatctaatcaaaaaaggctgtaaagcagtgaacattnaattcaaaaaacagtacccgatggtggaatacacttattgtgatgngtga

SEQ ID NO: 45820 - DNA, 1690 bp, Heterodera glycines
  Genomic contig location: Contig_ID=SeqID_4476; Location=4738..6427; Strand=-
  SCN-specific regions: Sequence locations=1-61,83-284,309-395,418 -470,540-550,578-651,674-1441,1463-1560,1591-1628,1650-1690
  Gene Ontology: Mol. function=transcription factor activity; Cellular component=nucleus; Biological process=skeletal development
ctcccctcttggatcttctgcactcgctattccgacaggccaagttcaggtcgggttttggcttcttcttctttgttctgttgcgttggattcctttgccttttccattttaagggccaaggacaaggaaaagcaaaaggcgcgaattgacggaggaggaaaagcggccgaggacggcattcacaacggaacagttggaacggctgaaaacgcaattcgtgcacagtcgctacctgacggagaagaaacggcaggaattggcacacgaattgggactgaatgagtgccaaatcaaaatttggtttcaggtaagccaaagggggggggggcaaagagtaaattttgccaattccctaagctttttccgactaccgtattcaattacaccctttgttgtgtgttttagtttgacttgagctaacaacttttgcgatgtctctttcgagagttgagactcgggtcgagttcgaccttttccctctttctctctccccccccccccccctctctctccgtcctttcgttcattcgtccctctcattttattgcctctgtccgtctgtgtgtctgtctgtctctttcttatgacctctctccccactcgtgcaaatgtgcgcatcatttaccgcttgtcggcaaaagatggatggcgggggagggggagggagtagcgaagcgaggcgcgatgatattatcgctcaaagcgatttgatttgattgagtttgttcgctggagggagagaatggggggggggaaagactgttgttgtaaaacaaaactaatgtaactgaataatggaagagtctgacgtccctccccccccccctcccgtaatttgaattcgtccgtctcgaatcagccaattagagaagagaatatttattagtcattatgcttggtgattgttgccatcttatagccaattaccacggcttttccttctgccttttccccatctttctcgctttttgccgtttcttcgctcgtaaattgacacgttttgattaataatgatcgtcttaatctgatcgtttatcctccttttgtgaccttcgccccttaaaacagaatcatttgaataaatgggttcagatgctcacttttcgactcattcacaaatcagcgtaataaaacggagaaagaacacggttatttttaattaccactttttcaaaatgaattgggaaaatgagtgcccattttaaaggtttccttttgatcggattgacttttgattgagttttctcctaccaatgccaacaattaccctccattctccctttttttcattcatttccccgctaattacaaccgcttttagcgcaaacgtagcaaatgaattgactgactgtccctagtgaaaagaaaaatttgaattgacagccgccctcccccccccccccgacacatttatttggcggacacaacgcactcactcacttacatatgtatttatttacactcttcgtcgtttttatgataaaaatctccgcttttaatgattccatcggaattttgattgaggggcattttgcgaggcgggaaaatttcgaagattcaaaaacaaatgcattttttcttttcattttgccgcttcagaacaaacgggccaagctgaagaagtccgcacaaagagtgaatcaacaattggcgaccccgcacggactgcttgagcaaccgttgtttaaa

SEQ ID NO: 45821 - DNA, 890 bp, Heterodera glycines
  Genomic contig location: Contig_ID=SeqID_4477; Location=882..1771; Strand=-
  SCN-specific regions: Sequence locations=1-36,59-777,799-854,876-890
  Gene Ontology: Cellular component=nucleolus; Biological process=growth
atgcgaaaatccaagcagaagttggaggccgggccttcctctgaagttgccgctgttcagcacgtcgtccgactgagacacattccgtacggattttttgagaagcaaattcatggctatttcaggtacggtttggttgtgttctacttttatttatttttgaattggtttcagtcagttcggcgatgtgaagcgcgttcgggtgatgcgcaacaaaaaggtgcggttgatttctctaattttgtcggatagtgccaatcgccattcgattctcatttgtcagggaggtcacaacggcacggcatttgtcgagttcaaagaggcagcggtggcgaaaatcgcggcgcgcgcaatggacaattatttgctggcagagaatcggctcagatgcaaagtgttaggccaagaggaagtgccgaaatgcattcggaagggccggtgcttcgtcaaaattccaaagatcgccgagaagcgtaagtcaaaaatggaacctcaacgaaagaaaaattaatcatcgagtttgccatatttaaggcgttaaacaggcgaaagaacaaaatgagcaacgaacgccggagaaggaaaagcgacgaatggtgggaaaattgagaaaataatgcaaatggaaattgcaaatttaaggagagatttgtgggggaattgcgaaagagaatggcgaaactgcgcgaaattggcattgaatatgagttcgactttgagaagaaatacaacgagtttttaaattctcaaaataccgagtgatttttgcctccgttgttttatttttttataaattttgttggttcttttgcggaatacggtggaccaatgagaatgtactgtatttgccattacttaaaaaaccaaaagggcaaacggcgaaaaataaa

SEQ ID NO: 45822 - DNA, 1504 bp, Heterodera glycines
  Genomic contig location: Contig_ID=SeqID_23903; Location=266..1769; Strand=+
  SCN-specific regions: Sequence locations=1-79,101-643,665-929,963 -999,1031-1047,1076-1104,1134-1301,1331-1504
  Gene Ontology: Cellular component=extracellular space
caatattcttacataattcctttcattcgattaactcaccaaatcctcatcagctgttccgtgctctgttttggcactttctgatagcagccgcgtagcggtgctcgccttacacaacaattaccgctcacaactggccaaaggcactgcagcaaatttgaccggcacaatgccggcaggcagcaatctaattcaacaaaaatataatacgagcattgagtcggtagcgcagaattgggccaacggatgctcaatgtcccactcgagttcatcagggatgggagagaatttgtacatgaccagttcgtcgacaatttcggaaggtttaattgaagtgcccatttttaacaaattaggtcgtaaattccaaggggcagcggcaaaacttttcagtttctgtttgtatgttaattggctattaattgaccataaattcattattttcctgggcctacattaagcatagatattaggttaattgaagaagacaatttgcagctgatgcgctgaaacaagcttgcgacatgtggtgggcggagctgaagcagtacggcttccagtcgagtcttgtgctggacatggatcagttcaacaagggcatcggacattggagccaggcaactgaatgaataatagttgtagctatcaaattaaacttgttctttcagcaagcgtgggccaacactgctcaaattggctgtgccatggcacgctgtccctcctcgacctggaagacatgggttgtgtgcaactacaaggaagcgtaagcaaaatggaattttcttagctttataactaggatagcaatttttagttacgaaaaatatcgaaaatttaatgtaaaatagtgaggaaaaatgccaaaataaaaacaaaataatgaaaaaaagtccgaaatagtgacgaatagtgacaaaaaattttcagccaaaaattgagcaaaaataatttttattttcaatttcccccccccccccccgtttaggcgcgtaaaatgacaaaattttatttttaaaaagtaacaaattaagccaaacttgtattgagaaaaaaaaaattttaaaatcaaaaatttcttgtcaacaaataaattgttgagatgaatttttgaaaatttaaaaataatgggcaaaacgccaaattagttaatttcaaatattttagtgacgaagcgccaaagtagtgacggatagtgagccgaatcaaaaatttcaaatagaaatgcgtttttgagctcctttcttcaaaacaattgagcaaaaaaaaaaaataggcaaaaacctaaaaataaaaagagccgatttaatggttttttgtttgtttgccttttcctttggcttattttctgattattatatatttttttacattaatctaattcattaatctcaacagtggcaactatttgaaccagctcgtctacaaaaaaggaaccgcgtgcagtcagtgttcggattacaatggggcgtcctgcaacagcaccggcggactgtgcgtattgcca

SEQ ID NO: 45823 - DNA, 1433 bp, Heterodera glycines
  misc_feature (1337)..(1337): n is a, c, g, or t
  Genomic contig location: Contig_ID=SeqID_4478; Location=96..1528; Strand=-
  SCN-specific regions: Sequence locations=1-164,186-527,550-638,660 -684,713-909,932-994,1025-1026,1048-1218,1244-1433
  Gene Ontology: Mol. function=protein binding; Biological process=cell adhesion
tttaaaaaattgattttcacaaatactttttatggtaatggggaataccaaaagcaaaattggcgagcttcaattatggaagggccgcgcaccgttcagcccccaacaattggacgaataccaggtgacagctaaacgaatcagctaatttttccgggcgcctattacaaatttgttctttaaaatttaaaaatgaactcaaaaatttgaagtctccccattaaaatagtcgaattcattgaaaaaaaatgataaaatctttttcgaaaaaaaaacttttatcattcacaatatcaaattcccaagtcaaaacgaattggtcgggaaaaagtggaatttgaagaaatgaattgtgtttttttatttcctttttttcaataatttatgacccctttttgcatctttgccttattttttcaaatatgacaaatttttatttttctaagataaaataactttattttgttttccaactgtgtatgactcccgagttttgcgtcattttgggctgcttcggattccagctctattttataaatgtttatttttgatattcataggattgcacatttttcacgcgaaaagacattctgcgcctgtacaagcgcttccatcagttggactcgcgcattgtgccagcaaatattcaaggcggacaagcgcaaacggtagatggatacaatgttttttaaattgatttaataaatattttcgattaaatcttagcattaataatcgctctttaatttaacatgtttaaatgatttaatttttctaattgtttcctgttcctcatactgtaggtcaaactgtccatggagcagatcagtcaaatgccggagctgcgcgagaatccgttcaaggagcgaatttgtcaggtccggcggacataggacgggtcattttgcgacaaatgctttaacattttatttgttacataatataaagaaaaattaatatggtataaaggcactttgtagctccatttgaatgcaaaattataaaaaattactataattaaaaagacatcaccaaaaatctctaaaattttacttttttttatcattttggccctgcgggtaatattttggttgtaacttaatattatttttaaaattggcagcctaatagaaaacattttaaatctatcgaatgatcccagaaaaatccgggttccatttcttgtcattttcaaaatatttcattttaatttgttgcataaaattaataaaataataattaagtctaaatatattgttcgatttttttaatggactgcatctgcccagtttaaacataattgtcctattttcaggtgttttcagaggatggccagngcaatttgagctttgatgacttcttggacatgttttcagtgttcagcgaaatggcaccgcttcagctgaagctgaaatatgcattccaaatatacg

SEQ ID NO: 45824 - DNA, 1173 bp, Heterodera glycines
  Genomic contig location: Contig_ID=SeqID_23914; Location=607..1779; Strand=+
  SCN-specific regions: Sequence locations=1-1173
  Gene Ontology: Mol. function=protein binding; Cellular component=cell- cell adherens junction; Biological process=cell-cell adhesion
atgtccctgtcagaaaaaagtcagttcgaagtaacggcgttgttgaagagcaaatcggttggggatgtcattgagctgctgatcagtcggaatgttgctgaagagccaaaacaaatgaacgcaaagaatgaaaaagaggacactttggaacatcatcagtcgtccgatttgatttttgacagtttaaatgcacacttttcgggaagcaccgatttggaattgcattgtttggaaattcctctcaatgacacgcccggtgctggcttgggactctcactgaaagcacagcgagttggcgccacggatgcgggccttttcattcgtagtgtgagttaatagtcatgaataaaaggaatacaaatttgattacgatatcccattcttattgttagatcctccacggttccgcagccttcaaagacgggcgcttgcaagtcaacgaccgtttggttggcatcgaaacccaaaatttgcttaactatgaactgaatggggaagctttggaggcatttatgcggaccatttctcagttgcctcaatcgaaacattcactacggtgagataatgctaattttttgatttatttatttttgcattatgtaagactattcgtgctgcgtaaaatgcatcaatcgcgcgattcgaagccattcggtggtggcgcaagacgtggcagtgacagtgatttgagtcagctgtcaaatttcgaccgtgaagcgccttcacggaggtctttaaattaaaaaacgatcgattcatggacgaatccttttcaatcataatcctaattactttggcacatttactctattagttttcctttttttcgtttaggtcgatctctgaaaaacggtcgctggtcacccgcagggacccctctcagctcagaacctatcaaggaattgtccatcaacgccaaatcagcggtaagcaatgagaaaaccttctttttcactctgttacttctcagctcctgcactgtcctcaacggcggttgccaattcgactcgctctcgacgttcactttacgatgaacttcgaagggtccgttccacgcattccgggccaagcgccaaaaaacaacggccaaaaacaatgttttatgtggacgagtcgggcgctgcagtgacatcggaatcgagtctgataccaaactttatcgtcacaaattaa

SEQ ID NO: 45825 - DNA, 676 bp, Heterodera glycines
  Genomic contig location: Contig_ID=SeqID_23929; Location=1358..2033; Strand=-
  SCN-specific regions: Sequence locations=1-109,131-444,467-676
  Gene Ontology: Cellular component=mitochondrial matrix; Biological process=mitochondrial translocation
tatatttatttgctgaatgattaaaaacttcagaatccaaagacaatgtgtcggaagtgctaacgcaaatatccaaaatcgaccccgaattcgacaagtcggaatggctccgtttttgcgaaaaagaaatgatcccgaacattcttgaatcaacttaccaaatgaacttcgaaatccttcgtgattggtgttacgagaaagtgagtgattcgttgaatcataatcaatttgtaatttattcatgcttcaaaaggcgttcaatttaatcgcaaattctatcaaagaatacgaaaagattggcttcaacacgagggattctcgcattatcgatgttagcaaagtggaggtactttttagggatgtcttcttcaaccttttcgtcgagttttagttggtcacggggaatatgaccgaccaagggccgactttggtcatccaattccaagtattcatgacaaatgtggtgaagaacagcgaggggaaaattgtccaaggtgaccctgaaaaagcggttcgagtgagacacatttgggtgagtaattaatgggtggggcgaacggaagagggagacgaagcagtgattgtttaggtaatatgccgagacatggaggagttcaacccggcaacagcttggaaactgcttgagctgcacatgataaaggaggatttatttgtt

SEQ ID NO: 45826 - DNA, 690 bp, Heterodera glycines
  Genomic contig location: Contig_ID=SeqID_504; Location=2468..3157; Strand=+
  SCN-specific regions: Sequence locations=1-507,529-629,659-690
aaaacttttgtacttcatttggggaataaaaaccccaaagaaatatataaaattgatggaaatataataaatgttgtggatacaattagggatttaggcataaatattgataataaattgcaattttccaatcatgtcacacaaataataaagaatgcatatttacgtatgcgttctttatttcgggttattaaatcaaaatctactaggatttggattattttgtacaaaacttatgttagaccgttattggaatatgctcctgaggtttggaatccatctcttctaaaaaatattaaaaaaattgaaaaatgtcaaaaatatttcaccaaaagagttctttttaaatgcagccttccacccattccataccaacaaagattagaataccttcaactgccgacacttgaaagcaggcgaaagctgtctgatctgttcatggctcataaaataatttatggccgaacagatcttaatccctttgaaatattcaaaccttctgaacgctttaacattcccttttatagacttaactcgaaatataaattaggcaaaaaatttataccttttgcggggcgggtaactaaaatttggaaccaactcgataaaaggctcattgaaataaactcattaaattaatttaaaaataaaattaaaactatctctattcccgtaaaatagaccggaaaa

SEQ ID NO: 45827 - DNA, 1393 bp, Heterodera glycines
  Genomic contig location: Contig_ID=SeqID_4490; Location=117..1509; Strand=-
  SCN-specific regions: Sequence locations=1-112,134-564,587-867,889 -1004,1026-1393
  Gene Ontology: Mol. function=structural constituent of cuticle; Cellular component=extracellular; Biological process=cuticle biosynthesis (sensu Nematoda)
aaaagcactctccgcccggttgcctttgcagccgtggtgttcagtacggtggccatttcgtcctgtctgctcacctttccgctcgtcttccattacgtccaaactctccaggcgacggttcaggtcggtccctcctttgatttgtctccttctctcaccgacgcgcaacaaaaaaataaagggcgaagtggaatattgcaaatcccgctcccgggacatgtggcgtgaaatggtcgatgtggagatggcaacgctggacacagaggacgaagtgggcggcacaccatcgaagaggggtgccgaggaggaagtgatggtgacggaactgctcggaatggcacgtcgccaacggcgtcaagccgaagacgaaactttgtgctgcacctgccaacagggaccaccagggcccgacggtgataaacacagcaaaaccaagtcaacgcgacgcattaactaactaaattcattcaggagcacccggcgaagctggttaccaattttactcaacaaaatatttcaaaaccggcgaatttaggaaaggatggagccccgggagaaggccctggcccccctggggcaccgggagtcgatgccgaactgcacgaccgagtgctgcccgtcccgccccaatgtccatgccaagcaccacccggacccccgggaccacctggtgaggaagggaaaattgaagggctattagtcacaccattaaaggaccccccggcaacgacggcctccccggtggaccgggaagaagtgagtaaccgagagaaagtgacaatgattattaattatggccacagatggagaagacggagccacagggccaattggacccgcaggtccagtgggaccgccaggacagccgggaccaccaggtggagaaggacgaacggaaggacaaacgaagccaaaacctttcaaacaatttaaggacagcgaggtcccccgggagaaccaggacagctaattcctggagaaaagccaccgccaggtgagaaatgagaagtcacaaaagaaaaagaccatttttaaggaccaccgggacagccgggaagacccgtaagttaaagagagaaaggacgaaatgccaatggatcgattcgttaagggaccgccgggtccgccaggaaagccgggacaggtaaatcccgagaagaggggggaaataatgtgcgaattcaggtgggcaaagacggagagaatggaccccccgggccgccaggagagccgggacagcggggtaagaggaaaaagcattgtatgagtcaccgtgtcatttgcaggaccacccgggccaagcggacctccaggactaccaggccaagtcggacaggccggcgcaggagggtcgtgcgaccattgtccaacgccaagattggcaccaggatat

SEQ ID NO: 45828 - DNA, 1547 bp, Heterodera glycines
  Genomic contig location: Contig_ID=SeqID_4492; Location=103..1649; Strand=+
  SCN-specific regions: Sequence locations=1-366,392-454,476-596,619 -629,651-1492,1516-1547
  Gene Ontology: Mol. function=lipid binding; Biological process =triacylglycerol metabolism
cctgaattgatcgcttattggggttatccagtggaggtgcacacagtgaccacagaagacggatatgtgctgcaattgcaccgaattccctacggcagaagtggcaacggtgtgattgaatttgctatttttcggcaaaattcccccccccccccaaaaaaaatgtcaatctttaggccactccgccgtgccttcctcgccccgtccagttttcttccttcagcacggtctcattgcttccagtgctgattgggtgactaatttgcccagccaatccttggcatttattttggctgatgccggcttcgatgtttggatgggaaatgtgcgtggaaatttttactccgacgcgcatatcaattggacgaaattggagaaaaaattttgggaatttacgtgagtgagccaaacaaagcaatggtcggaagaagaacaatttgagatgggacgaaatggcattcaaagatttgccggcaatggtcgaaaagtccttaaacattagtggccaaccatttctttattacgttggccatagccaagggacttcgattattttcgccaaattggcatcggaaaacgaaacattcgccaaaaaggtgttacttttttgtttgggaagcaattgaacggctttttcttcagattcgaaaggtttttgctcttgcgccggtcgcttcggtgaaaaacatcgatggtttaatcgcctttttgggccgttatttcgggaggaatctttgggcgagtgccgccgtctctctccgattgtttcaatatttctttgctcctccttaggcgcttcgcttcgttttcggcactcatgacttcctcccccacaattggatgagcataatgttcgccaaaatcatttgcggaatgagttggcgaaatgttttgtgcgaaaatgtcgcctttcaaattgccggccccgaaagcaatcagatgaatcaggtgggaaaaggaaaagcggaaggaaaagctaagctaactaacgcagagtcggctgatggtttatgcggagcatatccccgccggcacttccacttggaatatcatccattgggttggcctaattaacaaaaacaggaagtaattaatgatgggcaaacatcccaaggcacaaatgcgcaactcgggaaagatgcaaatgttcgactttggagacaaacgaatcaatcggaaacactacggacaggcaaatcgcagattaatcccagcaaagtcaaatccgatgacattttgcaggactctccgccgctttacaatttgagtcgcatttccgtgccgatttatttgtattacagtgacacggattggctggcggatgctcgcgacattgaggtgagaaattggaagaattgggaggaaattgcgacggacgccccctccaacaaaaggaaacgattctccgctcggtccgtccccaattcatcaaaagggcactgaaagtgaccaagtttaatcacttcgacttcgtttggggactgttggcaccggaaaaaatatacaaagaaattattggaacggtgaaaaggcacgaaaaagcgatt

SEQ ID NO: 45829 - DNA, 1893 bp, Heterodera glycines
  Genomic contig location: Contig_ID=SeqID_4494; Location=777..2669; Strand=-
  SCN-specific regions: Sequence locations=1-24,46-422,445-663,686 -995,1017-1298,1322-1412,1434-1585,1607-1893
atggccgacgaaagtgccacgaatgcaggaggagccggcgccgctggtggcgctcagcccgccgagtacatcaaactgaaggtggttggccaggtctgttttttgcattgtgtgatggcgcaaccacttaattgtccgtttttaggactcaaatgaagtgcatttccgggtcaaatacggcacatccatgggcaagctgaagaaggcgtacgcggagcggactggcgtccaggtttgccagacttgggattgggggttgggtagggcaaaatttttgttgggtctttgactgacaaaatcacgtacgagttcagtcgggaccttgttaggtgttcggaaaaaaacaggatttttgaacgggccaatgcgcaatacctatcgaaccggtactaatgtcgtttacagaccataaaaaaaatagttttaataaatcatacatttaaacatttctggggggttttcggggtcgctgatcacgaatttgatacacatttcgaccaattccgaaccccggacctgaattctgttcagattctaacataaaaatgaactttgatgaaaaattaattttcggcttctgttcgaattcgggtccggggttcgaaattattctaaatggatgtcagattcgtgatcagcgatcccgaaaaccccccagaaatgtttaaatgtatgatttattaaaactatttttttatggtctgtaaacgacattagtaccattattttacacaaagattaagaaatatttttgcttcttgtgagccgccttcatatgtctatatcatttttacggaagaaaaaagtgaaatttaacgtcgagctttgtgttctgaaactgacagacattccacttttaaatgcaattatttttgcaaaggtacaataaaattttaacttgcggaaaacgatcttgtcaggtccgtctgttggattgcggctcttttgcgggtatcacattgcataaacctgtctgttcacatgaggtggacttcacgacgagtccgtcctcctcttttggtcatcaaaatgaattagaaaatgtgcaaattcgcgctaaaactttggatctcccaagtatatcacagcaaaatggtggcgttcacaggtaaatgagatttaaaattaagcaccaaaatcatttttcaggcatagtgtgacttgctttgctacggaacaactccctttgccaggacggcggaattcactttctgaggaaagcaatcggacaatttcgaagccacaacaaacgcaccaattgggactagtcgaaaacaacggcaaccaaaggggtgaatatgatgacgaacaggaggaggagaatgaggaacggctgctgggcagcaatgaggttggaccaaatggagaggcaacaaatgagtgatttagaaagagttggttcgtttctttcaggtcggaaatggtggtcacgatgagggtggtcaaattggttttgtcgagaaggacccgcaaccattcaaattcagttgttgcattccgtttgactcaaaacagactggaatgttggaggttgtagttaaaaccagaaatattcaatgaattttattttcaggcatgtcgttttaaaatttctctcaggaaagtccgttttcatggcagataaagcaattatttgtctcatattattcaggaggaccgtgcgggccgaactccgcaaaagcttggctttgttattctgaatttgacagaatttgcctacagcggtgctaaaggcataacgaggtcatatttggtggacggatacgacaacaatcagcgcgcggacaactcacgagtgtacgtctttgtcagaatgcagcacaactcggccgaccctctcttcaaaatgtcatcaatttagagaaatctaagaaaaattttcactcaaataaa

SEQ ID NO: 45830 - DNA, 1216 bp, Heterodera glycines
  Genomic contig location: Contig_ID=SeqID_4498; Location=658..1873; Strand=+
  SCN-specific regions: Sequence locations=1-596,618-724,746-1216
  Gene Ontology: Mol. function=acyl-CoA dehydrogenase activity; Cellular component=mitochondrial matrix; Biological process=energy pathways
atgcaaccatttgtccattggtcgaaatgcatattcaaacgtccattttctaattcttcaaaattattttcgtcgtcattttcaatggggtttaattttggtaagttttatgcatactaactaatacttcatatcacattttcaattcttaaaaatcatattgtattaattttcagaatttaccgaagaacaaaaacaactccaagcggctgtaaagaaatttactcaagatgaaatcattcctaaagcgtcacattatgataagacaatggagtttccatgggaagtgataaagaaagcacacgccaatggatttatgaacgttgacattccgtcggattgcggtaaatattttggtacaatgtgaatgcaatttgtaaatgtttatatttaaagggggtcttgacttggaacttgtaagcaacgtgctgatcagtgaggtcattgggtatggatgcaccggaattggaacggcaattttgggaaatgacttagccgcgactcctctggtcattggtgccaaagaagaagtcaaaaagaaatttttatcccgtttgattgatgagccaataatggctgtgagttttttttgtgcgctttttatacctttctaatttagtcttattgtgtgactgaaccaggcgccggttctgacgttgccgcgcttaaaacgaaggcggagaaaaagggcgacgaatgggtcattaacggatcgaaggtaggcgatattccccttaaagtcaatcttcgattttagatgtggataactaatggtggagttgccagttggtattttgtccttgcaaggactgacccggacccgaaggcttcgacgggaaaagcatttactgcatttgttgttgacgggaatactcctggaattgttaggggaaaaaaggtgggcaagccaactaaaacagatagatagaagatcactgacaacaaaccattgctatgtctaaaggaaatcaacatgggccagcgatgttccgacactcgtgccatcagttttgaggatgttgtcgtcccaaatgcccaggtcatcggtgcgcccaatgaaggatttaaagttgccatgaaaacttttgacaaaacgcgcccaattgttgctgctttgtccgtgggacttgccgctcgagcgttggatgaggcgtcaaaatatgcacttgagcgcaaaacatttggtgtgccaattgcacaggtcgacaaatcctaa

SEQ ID NO: 45831 - DNA, 1185 bp, Heterodera glycines
  Genomic contig location: Contig_ID=SeqID_4503; Location=948..2132; Strand=+
  SCN-specific regions: Sequence locations=1-56,79-99,124-342,366 -625,652-688,710-876,905-929,954-1112,1134-1185
  Gene Ontology: Mol. function=structural constituent of ribosome; Cellular component=cytosolic large ribosomal subunit (sensu Eukarya); Biological process=ribosomal large subunit assembly and maintenance
atgccaccaacgagtaaaaaaacaggtattaataaagcaaattgaatttgactgggttctttaatttaaaaatttttaggaaaggctgtcgcaaaggctgtggaggccaagaagaagctggccaaaggccagcacattgtgcgcaagaaaaagatgcgcacgtcggtgcacttttaccggcctcggacgctgaagctggcgcgttcgccgaagtttccgcgcaaagcggtgccgaaacggaacaaactcgactccttctccatcataaaacacccattgaccaccgaatcggcgatgaagaaaattgaggacacaaacacattggtgttcatcgtggacgtgaaggccaacaaacatcagatcaaaagtgcggtcaacaagctctacaacatcgaagcacagaaggtttgtccactctttgttttggtcaagaaaatcgagtatatgcaaattggatgagcgcaaaactgaatttttggggccaaattttaattttaagtttcaacttttcgaacaggcacttttaaaatagcgccgaaataccttttgctcacttcaattttatttattcgtatagatccgcattcgacttaggcgacatcaatgatatcttcaatttcttaggccataacttttttctttcttagtcaatgcctaattctgttgccaaccgaaaactttcccagtattttttaaacataagaaaaggacgacattggtaacaaaaaaaagctatagcataaaaaaactgaggatagtcattgattggacgcctaaaagtcgattgaatttcgcaattgtgaccataaatgggaaaacgtccggtcctctaacaaaaaatcagtatttcgtcatctgtattaattatgttgcttgaataattatttttttttaaatatttaatgactatcaaatatcagtcacaatcacttgtatgactatgtctaattctgtttaggctatcgtgacttgaaaaaaaaataatttgaacctgatttttgacataggctcaaatgtcgggactttaagggaagggttattcggatagttaatacgctttatctcactgtttattcgtctaaggtcaacactttggtcacgcccgatcatacaaagaaggcgtatgttcgtctagccgccgattatgatgctttggacgtggccaacaagattggtattatctga

SEQ ID NO: 45832 - DNA, 2418 bp, Heterodera glycines
  Genomic contig location: Contig_ID=SeqID_4503; Location=4227..6644; Strand=+
  SCN-specific regions: Sequence locations=1-29,85-85,122-122,157 -157,179-452,476-506,553-553,582-582,652-994,1052-1101,1160-1177,1218- 1704,1726-1903,1925-1942,1965-1972,1994-2350,2372-2418
  Gene Ontology: Mol. function=phenylalanine-tRNA ligase activity; Cellular component=cytoplasm; Biological process=morphogenesis
acatagttataaccgttaagcgtattttgtaatggccgctgataattttgacgctcaacgtattttgaacattttggccgagagagacaatttccaaagtaatgaactcgccgatcagttggccattgaccaccagcgactgatcggtgccatcaaaagtctgcaggtcaaagaaggggtgagcttttgtctgtttttatgcgtcatttattatcaaaattcattttatatcgtatctttacagaatgaccatgttttggtttttaaatagttaagtttaacaaccccgaaaacatttttaagagaaactttaaaaaaatttagaaattaatttctcaaaaaatgttcgagttcgggttagggattcggaattggtcgaaatggaggccggatttgttcacagcgccttaaaaaaacccctagaaaagtattagtattagaaaaattttcagaataaaaataaaataaaaattttcgggaccatgatcttcacaattccctttttagttggtttgcacttcggaagtcaaaatcaaacgcatcgaattgaccacggaaggcgaggaaattatccaaaagggctcccacgagttcaatgtgtacaaaatcgtcggagaaaagggcatttccaaatcagaaattgaagtaatcatgcaaaaaatagttataaacatttaatggatgcattctctgtcagaaaacatcctttggtcccatcggattgggcaaggccatgcaatgcgggtgggtgggcatggacaccacgcgacggagtgcctttggtggtgcggaaggtggcaaatgccgaggacggggccaaggagcaattgaaattggtgaagaacggaaagggcgaccaattgacggcccaatgcgtggcccaactgaaaaagcgcaaatggataatggaaaggtgcacaaaatgacattcagcgaaaagaaattgttttgcaaattttagcgcaattaaagccctttccgttgccaaagggccgaacttcacgacgactgtgcagaagcaggaattggatttgacttcggagatgattgcctcgtaaattgccaatgatgaccattttatttactcaatgtccatttcatgggttcgtggcgtggcaagcagttcaaacagtacaatttctccgcgatgggcgtgccgcccccctccggccatctccaccctttgctcaaagtgcgtgccgaatttcgcgacattttcttccaaatgggtttctctgaaatgccaacaaatcgctttgtggagagtccttctggaactttgacggtgagtaatttcgcttttccttacctccccttccctccctttagctttgttgcaaccccaacaacacccggcacgcgactcacatgacacctttttctttcacgtattgccccttttcttttacgttttttgctttttcttttatgttggtattctgaaataacctctttttccatttaggaccggcactttcaacagaattcccggaagattaccttgaaagtgtcagaaaagtgcattctgagggcggtttcggttctattgggtgggttttttcatacattttagtttttttacaattaattttcgctgattgttaagctatcgctacgattggaagttggaagaagcgcagaagaatttgctgaggacgcacaccaccgccgtttctgcccgtcagctttaccttctcgcgcaaaaagtgtcccttttcgatttccatcataatttctccgttgtttttctccgtccctccagcctttccaaccgtccaaaatgttcagaatcgaccgcgtgttccgcaacgaaacattggatgccgctcacttggccgaattccaccaagttgaaggcgttgtggcagaacgaaacctctcactggcgcatgtcatcggacttttcactgaattcttcaggaaatgcggtcaattagaaagattctttgtcttcctcatttgttactaattaaaattggaccatttaggaattgaaaatctccgcttcaaacccacttacaacccgtacaccgaaccatccatggaaatttacgcttttcacaccggactgaacaaatgggtggagattggcaattcgggcatgtttaggcaagaaatcattcattttatctatggctaattttgcatttaggcctgagatgttgcttccgatgggacttccggaagatgttgccgtggctgggttcggtctctctcgaacggtgggggttcggttcggcttaaatcagtctctaagcccccttttcaggccaaccatgatcagatacggcatttccaacataagagagctttttggccataaggcattcaccatttgctcactaacagataaattttttatattttcagattgatctcgaaatgatctacagaaaccctttgtgcaggttggagcag

SEQ ID NO: 45833 - DNA, 1403 bp, Heterodera glycines
  Genomic contig location: Contig_ID=SeqID_4509; Location=1684..3086; Strand=-
  SCN-specific regions: Sequence locations=1-295,324-978,1002-1052,1074- 1097,1119-1403
  Gene Ontology: Mol. function=ATP binding; Cellular component =cytoplasm; Biological process=protein amino acid phosphorylation
ggaccaaccgccaacaaagggtaccgaccagacgaagcactcaggatcttcggctccaagctcactccttatgaacacacggagctgttcaactaccaacgggtgagccgggcaaagcgcgcctttgtcattggccttaaatactttggcatcacttttaggtatatttcgttggttcacaagccaagaaacgactttgcgttgcgggtggagccaacaactcaaattttgacgacgagaatggctcttatgcgttggtttcccacgatcacatcgcatatcggtacgaaattctcaaagtgatcggaaagggcagttttggacaggtaaaaatggaaattacacaatttgccattcaacaattttctgttcgtcaggtgataaaagcgtacgatcacaagcaccagcaatacgtcgcgctgaagcttgtccggaacgagaaacgcttccatagacaagcggaggaggaaattcggattttggaccatctgaagaaacaagacggggacgggtcgcacaatgtcatccatatgctcgaccacttcacttttcgaaatcacaaatgcatcactttcgagctgatgagcatcaatctgtacgaactgatcaagaaaaacaagttccaagggttcaatctcaccgtgagtgttcatcgccaattggtgacacctctgaattttgtctcttttttagcttgtcagaaaatttgcgcattccatgcttcaatgtctggaattgttgcacaggaaccacctcattcattgtgatttgaaaccggagaatgtcctactcaaaatgccaaaccgatcttcgatcaaagtgatcgacttcggctcctcttgttttgacgaccagcgtatttacacatacatccaatcgcgcttttatagggcgccagaaggcatttacacgcccattaggcagtgaattaaaaattcttttagtgatacttggcgcaaaatacggaatgccaattgacatgtggtcgctgggttgcattctggcggaattgctcacaggctacccattgttacctggcgaagatgaaaatgatcaggtcgattggtgaaaggaaatgcacaatgacatttcgatgtttaaatcagcaaattttttaaggtttacgtttggtccattttcagttagcattggtcatcgaacttttgggaatgccaaatccgaaactattggagggcgcaaagcgatctcggaacttcttttcatccaagggacacccgcgctattgccaagtcactcaggtgggacgggcaaatctccgtctaaattcggcatccttgcagcttatggacggcaccaccgttctgactgggggacgatcaaaaaggggcaaactgaggggaccgcccgggtcacgaacaatgcagagcgcactgaaaaatcag

SEQ ID NO: 45834 - DNA, 1999 bp, Heterodera glycines
  misc_feature (1260)..(1260): n is a, c, g, or t
  Genomic contig location: Contig_ID=SeqID_24035; Location=1..1999; Strand=+
  SCN-specific regions: Sequence locations=1-47,126-611,633-684,706 -1090,1112-1148,1213-1690,1713-1801,1823-1999
cggaaatggtaatgacagaaatcaagcccaaagtcaccaattaatgcagaaggacgagggcgaagaggaggaggaggaaaaagaaaaaggcggtggaagcgaagcagaaggggaggaaggaggggacgactgctcattcgaaaagggatacgtggccatttcgctgtactatttggacggaccgatgagcacggtcaatctgaaggcccaagtcaatcggaagagcaaaaacaaagcgagattaatgagtcccaaattggcacaggtgcgaattgccggggagaggcgcaatttggacgacaaacaaacgctgctcgaagaaagtgggcgatgttggcgatttacccattcgaaagtgtgcagggaacgctttgtcggtgttccgagggcacgaatgcgaactgtccttcaaagaccgggcacatctgacggagtacatccgccacaaaatcgggctgcccattcgcctctctctgctgctcgaaatggacgcgcaactcttccggacggacacttatctgaacgtcctttcgcccaccccttatcattcctttttgacagcaaattaccgggcccgaattggcagcaaagtttggaggaaacgatcaaacagaaagtgagtgagagagtgaaggctggtgagaggaaaagtagccaaggtacagggcgagaagtgcctcggatggccattctttggtggccggccacaaaaagttggacttggagacggtgttcatccatgtaatggggcaggagaatggccaaatgcggaggtgcagcgcatcgggccaacgaaatgccgaccccctcactgacgatggcattggaaaggaatcgggaaggactgagagtagagaaaagtcgacggacatcgaacatggcaaaagcactgtcgaagcaccccctctgaatgattcggctgaatttctgacgaattgccgacagaacaaacagtcgaatcgcccaccaactccttcttctgctggtgcgatcccaccaggcccttctgatttgttcaaaaaactattggtcgcttgctgtgatagctgcgagcgaagggcttcgctaatcacagttaggagaaacgccgaaattgagggagatttaatttggcaaattgaaagatggtcacaaaagcgaatgatgaggagggagaaacaaaaagagaggaaggggaaacggaagaggaggacagagagacggaagaggagaacaccttcgaatgcgacgaggaagccaaaacggaagtgcacgacactntggcaaatatgtgagagaaatgccggtggcatttttatgggcaaaaagcgaagcaatggcactcactgaccgatcagatcagtcaccaaattgaggtacttcaacacagttgtgttgcccgaaatggaatacgtggaggacttcgttgactttctgatcgacgccgaactcagtgatttgcccgtgctgaaaagagcctgcgaaagatacctttgcggagaattggactcggtcagtgagcagaagcaaagcaaatgaccaccggtcgaccaaagctcaattaaccaaatgaaaaatgcccccaggaaatttcctcccctcaagtcgaatttcagaaaaaggagctgatgacttcccttattctcgactttttcttcattgcgatggttttttcggttgttgaatttgtcaaaattgtttaaaatacatattttttcctctttatcttcccgttatgaaatcgatgactttgaccgaattgtgtgaccgatacgccgaattggaaattgtggacaaactgttggaacaagaggagtacaggtaaaaacagaaacaaatgaatgccaaatatgtaaaaaacaaaaaaagaaatgtggacaagcgaattcgccaaatatgcggcgaacggaatttgcacgatttggtggacgaatgcaaacgatttcgggagcaatgcacgagagtgaaaaaagtggagctaaacaaagaaaaagcgagcgaaaaagggggcgaaggagaa

SEQ ID NO: 45835 - DNA, 1783 bp, Heterodera glycines
  Genomic contig location: Contig_ID=SeqID_506; Location=1918..3700; Strand=-
  SCN-specific regions: Sequence locations=1-613,635-1181,1203-1783
  Gene Ontology: Mol. function=casein kinase I activity; Biological process=signal transduction
atgccggagaagcgcgcggaggacgacgacgacgcggtgtcgcagagccctggaacagcgtcggcggagcgcaaggacagctacgacttggtctcactgagcgcaggcacacgcgtgagcggcggccgatggaccatcatcaaggagctggggcagggcgcgtttggcaccgtgtttctgtgcagcggcaacactgacgccgggcgacgagaagcggcaatgaaaacggagcgcgcggacgaggagccattcctgtggaaggaggtgcggtttatgcggggcgggggcggacgggagcagcagttctgtgtgattatcgaacgcgtctgatcagtgatcacgaatctgacgcatcgtccatttcaaccaatttcagaatcctggaacccgaattcgaatcactttttgctcaaaattccggagtctgacaaaaagtcgcaaaattaattttttgactgaattgagccagattggagttcgactttttgttcaaaacgatacgggattcgaaattggttgacatggacgtgtcagattggtgatcacactgatcagtacccacaatatgcgttgaactactcaaaacagcactacaaatcccccaaactgtgaaatttgaaaattgcttttttcgattgagtcccttaaattcgtaatttaccaatttggttattaatgtgtatccctcccccttttacaggccgaaattatgcgaaaagtgagcactgttcgggtgggccaaggctcggaacatttttgtcgctgttttgacgagggccgagacgttcaacgggacacacaaagcggagagctggtgacgttcaactacgtcgtgtaagtcgagtgccgtccgaatcgcgtcattaaaatgccaaaaattctaatttttcccccaactttcagtatgtcgctgatcggacgtggcctgtttgatctgctgagcaaggcgggcgacgtgttcagccctgggacggcaattggcgtttcgcttcaactgctcgatgcactgagggcgctgcacaaagttggctaccttcatctggatgtcaagccggagaatgccacaatcggacgcgcggagaccaatgagcgccgccgcatttttttgatcgactttggacttgcgcgccgttacatcagccaatccgtgagcagagattatccgcccattcctctctcataattaattttttccaatttttcacagggtcgattcaggcgagaaagatcaaagacgcacttccgcgggacgccaatgtacgcatccatcgcagcgcacgcgcgggccgactactgccgagcggacgacatcgagtcttggttctacacactggtcgacatgtacaccggcaagctgccatggacccatgtgacgagcgaacgccgcgtgagttttgtgggtcggaggggatttggcgcgggatttcaaatatccatttcccccttcattttcagacaggcaaaatgaaacgactccgtctaagccacaagccgaaggaagtgcaacaacgggccctgcatgcactgttgaagaaatgcccgccaatattctacgacatcttgttacacattgtgcgttttatgcgacattttgtgccgctttaattatactaattacccccccccccccctcttcccacaggacgacctggagttttaccagcggcccaaatacgaatggatagacagggttctgcgcgactacctcaacacgaatggcatccacgagttcccttacgactgggagaaagaagcgaatcgacgaacaaggagtgcaacctga

SEQ ID NO: 45836 - DNA, 796 bp, Heterodera glycines
  Genomic contig location: Contig_ID=SeqID_4520; Location=167..962; Strand=+
  SCN-specific regions: Sequence locations=1-353,375-796
  Gene Ontology: Mol. function=succinate dehydrogenase (ubiquinone) activity; Cellular component=mitochondrial inner membrane; Biological process=electron transport
caggtatgtggtcaaggatttggtgccggatatgactctgttttacgagcagtacgcttcggtgcagccgtggctgcaaaagaacaaaccgaccaaattaggcgaagccgaaaacttccaaagtcaggcggaacggaccaaattggtgggcattttcaaccaatgggagaagggctggtccatcaaattggtaatgttcgttcgctttgcttttgaggacggtctctacgagtgcattttgtgcgcctgctgcagcacttcgtgtccttcttattggtggaactccgacaaatatatggggccagccgcgcttctccaatcgtacaggtccaattggcaaatgcgtccaaacatatggaaaaaggggagggggtccagcggtgccgatagacgcctccgggagaaattttaagaatttcaacgaaatttgttaattgtaagaattagccaaatttctcttctggaatgctaattttttaatttaaagcgttttctttctttttgtcagatggattatcgactcgcgcgacgacaaagccaacgaaaggttggaacggctgaccgaccctttcagcgtgttcaaatgccacaccattctgaactgcaccaaaacgtgtcctaaggtgacggacggtccttttggtgtcgaataatttgtttttagcaccttaacccggcgaaggcaattggcgaaattaagaaattgttaaccgggatggagtaagaggaaaggcattaaaacaattgaaaattgaatcttttcagaacaaagccggcaccaaaacaggcgacaaac

SEQ ID NO: 45837 - DNA, 877 bp, Heterodera glycines
  Genomic contig location: Contig_ID=SeqID_4521; Location=1..877; Strand=+
  SCN-specific regions: Sequence locations=1-175,198-488,510-746,768-877
agcaacaaatgttcagtttcgaatgccaatccaagggggtcgatgcggctgaaatggtcgcggttggctgtgtgacgaacggcggagagcatcgacgaattggccaccaatggcaggtgggcccagcaaaacaatgacattttatggggaattaaagcgaaatgagtaaaaaaggaaatttaaatcaaaaaattaggaagttaaatgacaatttcattcaaataaaatccaattaatgtgatctatcgcttttcatgtttatttaatctttgaattagaaaaggaaaattcgtcgctgtaaatccaaaaattgaattggacacgaaagaatggggggggggaaagaaggaaatgaaaaaaacaacaattaccctcgagcaaactcatcgcgggggagcggggcaaaaggggggcaatgagtgtaacggaggagcgaaaaaaacagtggaaatgagaaagggaacgataattaattattagtgattagattttgaaactcttttaaaaggacgattatgatacaaaattcaatgagaaaaacattggcagagaatgcccaacggacaaatggggaaggcattttcaaatgttttaaattgccgaaaaatgctttaatagggaaactcattttggcatcattcaattggtgcgcactttgcctttcttttttaggacggcgattttctcttttactgcaaaaggaaagccgcgggactttgcgagaagagctgtttggggtccgtccgtccttttccatttgttttcaaaatgattttccttttagctgtttgctgcagggccgccgtttgtacgacggcgaccgtttccgccacgggcgcaccgttttccaatgcgaaattcggccaaagcggcacgc

SEQ ID NO: 45838 - DNA, 2162 bp, Heterodera glycines; identical to SEQ ID NO: 4523
  Genomic contig location: Contig_ID=SeqID_4523; Location=1..2162; Strand=+
  SCN-specific regions: Sequence locations=1-1,23-98,120-522,544 -584,606-1206,1228-2162

SEQ ID NO: 45839 - DNA, 3167 bp, Heterodera glycines
  Genomic contig location: Contig_ID=SeqID_4525; Location=812..3978; Strand=-
  SCN-specific regions: Sequence locations=1-184,208-607,629-631,665 -799,823-1061,1099-1194,1236-1259,1288-1465,1490-1693,1719-1802,1832 -2093,2159-2186,2208-2222,2244-2253,2298-2524,2549-2582,2627 -2731,2755-2857,2882-3040,3087-3108,3147-3167
atgccacaaaatttttgccaaaatggcacacaatttccaggacatggtcggtcaagaccaccagccactgctgttgagcgagtggaattcgaggacaccgagctcagcaagcagtacacatgctcgttgaacaacattttgccaagagtcagtgcaaacaaatgaactgttttgctatctatgccctgattttttgtacaaaattgtcaaaaaaaaaagacgcattttggtgtctctgtactcgaatttttgatttttctcgctatacaatctcttaccctttatttcatgttttttttttgcaatttaagttggatttggaccatcagatttcaccggacgattgcattcccttcaagcgcattttgcaccattttcatcgacttcgagcaggtcaaatgactctctaatttttgccgagtgttttcatctttttcttagacgattttttttttggggggggggttatttgcaaattaaaaccaaggggcaaatgtaccttttcggtatttgtaaaattttccttccaggaaacacatcctttttggtttgtaaatttttttttcataaaaatcagggaaatcttacccgggcattgttggggttgttgaaaccacaaaaaattccaatgaaatatttataaaaattactaaaaaaaaaaaatcataaatcctttccagcacaaacaccatcaaatggcgttgttggcagcattgaccaagcactttaccaatacattggtcgttacatggatttgtgctgtgcgagcactggggacactgactataaggtattttgcaaaaaaaaaaaaaaaatttttttggaaaatttccattttttttcctctagcccctgttctgtttgcacgcgttgagccatgtgatgcgcacacggaatttggtgatcagcaacaaacagaggctggagaaggcccgggaacaggtagtggttgcaaatttgtggggcaacaatttaaaatggaattaattctggcggcggtgcccgaaaatgaaatttaacaaaattccccaaggcgccatccctcgggaaaatttttctggaattttaatgaatttattaagaaaattaataaaatttgcgatcccgtccgacccccccccccccccccataaaatgtttacttttgttttaccgggtagtgggatagtgccgccccgtttaccctaccgtctctaatttttttttttaaattattttttgtaaattttttaaaacccattaattttgggtactgccaaaatttccattttgtttttctatttgatatatgttcaaaaattttatggttccgtctcggaagcgctgatggaacagtgccgggaccaagggttggcacggccgaaagtgctcattttggcaccgatgcgcaaatttgcgtacgcaattgtaaagacaatggtggcactgatgttcggggaggtttggcacaattttcggtttttagatttatatattttttttttatttaggatcgtccatttgtgcaacggttgtcacggtttgagtccgaatttggcgacacggaaggcaatcaaatccacgagaaacgggcggtggcccaggactacagggtttgtttgtttattttatggacggatgggattttcacggacaaaaattttatggaaaaaattaaccaaaaaatatttttttgaaattttggttttttcccattttaaatttaaaaaataatttttgattgcataatttatgcaaataaatttgaattttttgtcggactgagtttttcccgaacggatattttctggagaaaacgatcgaatttattcatttttaaaaatttttttttggcacttttcaaaaatttttttttatttggtgcataatttgtgtgccaaacaatttgatttttgtgttttcaacgtctcgcattaaaatttttttaaggagttgatggatgggaatgtggacgactgtttccgtttgggcatcggattggccaagaaatgcttgaagctgtacacaccgttcaacgaggtgagcgaactcggaaaactggaaaagcttagaagttttttttaggggtttatacattttataacaacacattctttttattttttttgataaaaaattatagtttttattgaaaatttcttttaaaaaattttttatacgaaatacgaactgccattaacccctttctgatctctaatgaaaattctgtaaatttcatttgaaaacccaactttgtttaaaaatggggtgttgatttatatatttttttaaatttcggtttttcattcattttttcagtccgattttatcctttgctcaccgctcggcctcaaaatgttgctggacgaaacggcgccggagggcgacgaaacgacgccaaaaaagcaaaaacgccaaaaagcatccgcgccatttttgcgtctcggcaccgaaaagcggcggaaaaccgacgaggcaactaacgacgacgacggaggaccaaatgactttttggcatccatcgaattgctaattgtggaaagagtaatttaatttaaaaattaattttcattcataaaacctgaaccattaattaacccatgaaaaaaaatttaattaatttttaaaacaatttaaaaaattatttgatggcaaagggacccgaacccgggatgcaaaactctgtgttaaacaaacgcatagaccgctcggacacactataactcccacatgttcaaggcggacattctgttgatgcagaactgggagcatgtgcagtcggtgtttgcactgctgaacagcgtgccgtgccgcgtgcgcaccgacatcacgcgcgtgcgacggtgggcgctcagcggggacggcacgcacgcgcgccactaccgccagacgctgctgttcacgcgcacgcacgcggtggaaatgcacgcactgtattacaatttttaaaaaaaattttcgaattttggacccagggtgggctgtctctaaaaaaccaaaaaacactcgccaagggcggatgtttttcaaaaaaaaaacgacgcctgaagtaacctttatgaaattttttaaatcttttttttaattaaaaaaaatcttaattttttctggggattgttcttctccccgaccctaaaagaaaaaacttttaaaaatattttctttgctaaattttatgatgaaataaa

SEQ ID NO: 45840 - DNA, 2016 bp, Heterodera glycines; identical to SEQ ID NO: 24099
  Genomic contig location: Contig_ID=SeqID_24099; Location=1..2016; Strand=+
  SCN-specific regions: Sequence locations=1-38,67-131,247-257,279 -349,374-543,565-758,780-908,930-1076,1098-1327,1375-1655,1678 -1690,1727-1968,2004-2016

SEQ ID NO: 45841 - DNA, 753 bp, Heterodera glycines
  Genomic contig location: Contig_ID=SeqID_24106; Location=261..1013; Strand=+
  SCN-specific regions: Sequence locations=1-418,451-522,544-594,616-753
  Gene Ontology: Mol. function=structural constituent of cuticle; Cellular component=extracellular; Biological process=embryogenesis and morphogenesis
agtgtaagtcgcgaaacacgtgccctgcgggtcccgctggtccgccgggcgacattggaccctcgggcgtgcccggcatcccgggaaaagacggcatacccggacaggcggccgaagactcgcaaaacgcaccgctcaaaggctgcttcgtaagtgccaacacgggagggaaaatatcatgtgtacaaatgttaatttttacgcatggttcagaattgtcccgccgggcccaccggaacgccaggcaccgccggaaggcccggcattcgcggaatgtgagcaatacaaattcataaaaagggcataattacacagtgtgtcaacaaaatgccgaccaaaatatgagtgacataagttaaacaaattgttaactaagaatgccaaatttcggcaaaaaaaaactaaatcctattttgtctataaatattttaaaatattttatttattaatgtaacaattttattgatatgcttttttcttgaattggcctttttgttgggccaattatttgtccgcccgtttaattcaatttaattttattttaggcgtggtcctaagggttaccctggccaacccgggcgtgacggaggtgatttttcggcatttttgtgttttaaactcaatcaccgtccataattaagtgcccggccttcccggcgaacaaggccaagtgggagagaatggattggacggacggctgggacccaccggattcaaaggcaaagacgaggagaagcaattgggacgcaaagg

SEQ ID NO: 45842 - DNA, 1344 bp, Heterodera glycines
  Genomic contig location: Contig_ID=SeqID_4550; Location=88..1431; Strand=+
  SCN-specific regions: Sequence locations=1-522,545-595,617-634,656 -1242,1267-1344
  Gene Ontology: Mol. function=long-chain acyl-CoA dehydrogenase activity; Cellular component=mitochondrion; Biological process =energy derivation by oxidation of organic compounds
atgatcaactacggactgaaagtccgacaagccaagagaaggacaagttcccggcaaaagcgcatcttgcgctggcaaaacacaaagttttcgctgccgcagtgccctttgaatttggcggaatggtcagtgtttatcatttttttctatttggttcggataagacttggccctgggtccaggcatgtgttttttttcttgcatccaggcagactcggatcggttttcggtattcggtaacctggattttcttgtatgtttgtccaggatgacaaggtcaaacatggaaaaaaggctaggttacccatgaaaaacctgaattttcgggctgatattcgaattattattccaggaaatacaatgcatattttagatttataataattttgcggtataattttttcgtattatttaaattgaacgaatttgataactttcgatagccctaagtatgctctatttagcttgcgaaatttcattgttttttgaaaaaagatttggacaaaataatcggaaaactgctggccaaggcccaattacccccacccgaacttatccttcatgtataaaacattgaatacctaaatacctaattaatatatttcccccaaattttgcagaatttttgccaaaaggacatgctgcagctcagcgaatgtttgggtggtcaggacttgaatttgttgagcacgtatggcgcattttcattggccacttcactgatcatccaatacggcaccaccgaacagaaggagcactatttgccgggcattgcgtccggccaatggcgtccggcagtttgcattgatgacgaaacgtacaattttttcatgaaagtccaggctgttaaaaaaaattttcggaggcgtgaatccgaagactttagactcttagcgggactaaaaatctccaattgcagcgccgagcaaaaatggccattatgccaatttttgagttcaaattttcaaagaatatggcaaaatggggtccgtcattgccttaggcgccgtcgagaaattttttggaaatattttattaagaaaattttgaatttggaacttcaaaaaatttatttatttttggcccgaagagcaaaaaaaataaaaattcttcgaaataacatgtctttattttaataattgtagcactggcccacagtcgaatgagcatgttttttccgcaaaaggacaacaacaatttttgagcgcggttatgctttataaaatagcttctatcttaatgttttaaaatttatttatttgtttttagacaaaaatcaatgtgcagaatgcgcacaatgccaacctgtttattgtgtttgcgaatcgaacagttggagatgtg

SEQ ID NO: 45843 - DNA, 2587 bp, Heterodera glycines
  Genomic contig location: Contig_ID=SeqID_4557; Location=508..3094; Strand=-
  SCN-specific regions: Sequence locations=1-208,260-377,415-551,573 -733,755-1212,1234-1459,1481-1745,1767-2084,2111-2463,2485-2549,2574 -2587
  Gene Ontology: Mol. function=phosphate carrier activity; Cellular component=mitochondrial membrane; Biological process=transport
atggtgggcatcacagagctggctgaagcgaccaaaaaggcgtttggcgccgggccactgatcgctgcgaactgtgcgacagcagagaatggtgcgtttggcagatgtcggaaatggcattaatcggacgaccgattgattgtccaattattccatcattttccacttttatgagttctgttggttgttaatcaacatttctgcttctcatccatcccttttctttccttctctccgttttttgttttgtttgacattctcatctcgtcaccaccaccactgattttccacgtggcaaaagcgcacacaatgagaaatgagttttaaatgtgaaaatcacggcgtttttttggttgtttcctcgtgaaagtgtacttgacaaaaaattaccgaattcatttatttttctgattgaaattcagaaatttacccattcccttctcacaaatttttaaaaattctcatgacctccgaaacggcagagaagaagaacccaattgttgttgtgcgttcgcgtcgcaaaagtggcgaccaaaatcgttacggagttgtggtggtggtggtctcctgggtgtatttgtacttctccgtcgtgcccaccctttacgatgggttaaaggatttcctttggcttagcaccgctcggctcgtcactgagttggtcgccagtacaattgccccggcattattgggtactttgaataggtccaaagaatcatcttcgatttatttgaaaaacaaatcgacaacttttccagctaagagcggcaatgaagtggagtttggctcgatgaagttctacgggttatgcggcattggcggaattctctcttgcggtatcactcacaccgccattgtcccgttggatttggtcaaatgtcggattcaggtattttccgacagtttaattggtgcgggatgagcatggatttttgcattgcgtttaggtcgaccctgccaaatacaaagggatcatcggcggcttcaaagtcactctccaagaggagggcgtccgcggcttggccaaaggctgggcacccaccgccattggctattcaatgcagggccttggcaaattcggactgtacgaaatgttcaagaatgtgtacgccgggatgatcggcgaggtttgtttgtgtgttttggtcatagtcagttgttgacaaaactgctcaaaatggtggacccttttagcaacaaaacttttgcgtgtatatttttaaattcaaatttgcatttataggctctaatagatgtgcaatccaaatcattcattttaaagggatggcgatcccatcctcttacttttttgaatgcgatctccaaaattaaatttttcgtcttatccgaacgagccaaacatccaaaaatcgaatctaactaggcattagaattttaaatggttttgtttttttagtcatcaatgactcaaacatttcaatcaaccgataaatcgaaatttaaatttttgtccatttgtgccctgaattagtttttcttagcattccgtttgctccgttgtaaatttggtccattcttttccaggaattggcttacagctgccgtacctatttgtacttggccgcctcggccagcgcggagttcttcgccgacatgatgctggcgccgatggaggccaccaaagtgcgcatccaaacatcgcccggagcgccgccaacgctgcgcggctgtgcgccgttcatttaccggaccgagggactgatgggcttctacaagggactgccgccgttgtggatgcgccaaatcccgtacacaatgtaagcctttactttattttaaagagtccagggtgtaaaaaaacaagaattagggtcggaaggagggacggaatgggattcccgcgtctaaatttctgttttgacagacttccgctttccggtcttttccctcaaaatatccggacatggtccgagtaaaaatctcgaccacccattggttgtattgtttatcttcttttttttgtgcctcaactcattttttgatttactttttatttacaacctttttaatatttgtttcccttatttaggatgaaatttgcctgcttcgagcgcaccgttgaactgctctacaaacatgtggtgcccaagccaagagccgaatgcaccaagcctgaacagttggtggtcacattcatcgccggatacattgcgggtgggtggagagggggcatatttattaacacaattagtggaaagaatttgattgaacgtttaacttgcataaactcatgatttctaggcgttttctgtgcgatcgtttctcatccagccgatacacttgtctcccagcttaacaaggacgcgagtgcggacgcaatgggcattctgaagaagctcggcccgcttggtaatttaaatttcacttgtcgacaaacattttatgcctgttaccatgttcgtaaatatctaattggtcggccaaaaccgaattccgcattggccctaatttcattcattttttgtcatcagaactcgaaataatcttacaaatttgccgtttcaggtgtctggggtggacttttgcctcgtatcatcatgatcggcactctcaccgctcttcaatg

SEQ ID NO: 45844 - DNA, 988 bp, Heterodera glycines
  Genomic contig location: Contig_ID=SeqID_24174; Location=69..1056; Strand=+
  SCN-specific regions: Sequence locations=1-206,228-988
atggcttacaaaacatacttttcacatgagctctcctattcaaccacagcaaaggactcacacctaaatgcagcggggtactaccgggacccgggtgatgtgcttgagacgggagacggatgcacagcgcgacgcgatttgtttgcgctcagcaacgttgctcagttcattgccaaaattgacaccgacctattcaaccagccgctgtatctgatcaacttttgtgagctggacattgaaattttgcccaacgataacgaatttgtgctaattgcgccgctcgcaggtgcaccccgctaccgtttcgaggtagtgggactgaaattgtatgtgaagaaagtgtctctgatggatgggttggcgctggatattgcgcgaaagttggaggtgaaacctgcccgttacgctgtgaggaaaacaatgatgaaatcgttgttcatcagtcaaggccgttacgagtttacagccaatttgttcatggaccaaatcccccggcgtgtaacaatgggtctggtggcgaatgcggattatgttggctcaattcggcgcagtccattcaattttcaaccgtttaatgtccgagaaatttccattgttgctaatggacgatcttacccacaagcgccctatgacttggagtaccccaacgggaggtatgttcgcccattcaatgacatgaatgaggcggtgggattcgcaaactcatcggagagcaacgggataacttttgcccaatacggaaaaacgcattgcatttacgtgttcaatttgaccaacagcgggggatgatcaagcggcactgtttgatttgataaagaatggcactacagcggtgagcatcaaatttaaccacccagtgccagacggaggaataatgcttgtggtgatgggagaatgcgactcattggtgatgctggacaaaaaccgatcaataagcacggacaccactatttaagcttcccacaattgtcatttcatcattttgtaa

SEQ ID NO: 45845 - DNA, 387 bp, Heterodera glycines
  Genomic contig location: Contig_ID=SeqID_24177; Location=169..555; Strand=+
  SCN-specific regions: Sequence locations=1-202,225-387
  Gene Ontology: Mol. function=protein serine/threonine kinase activity; Cellular component=integral to membrane; Biological process=signal transduction
atgtcctacagaggcctgaccaaagacgtgccaaaagatgagaagattccgttcaaatggtctgctccggaggtctggacgcaaaacagctacacgctcaaaagcgatacctggtcatacggtgtgctcagctgggagattttttgcgatggcgccgagccattccatgggatgaacatggaggccgttatgcgcgtggtgagtgaaaaaatttctaaaaaattcatttcacctatttatttgcaggtgaatgacggataccgattgcaatttctcgataatgcgcctgccaatttcatcaacctcatcaatgaccacgtttgggacttcgaccagcgcaaccgctactccatgaaacgcgtttacgaattgctgaaagagatgtag

SEQ ID NO: 45846 - DNA, 3325 bp, Heterodera glycines
  Genomic contig location: Contig_ID=SeqID_4567; Location=1552..4876; Strand=-
  SCN-specific regions: Sequence locations=1-391,551-605,627-716,744 -1368,1390-2348,2370-3325
  Gene Ontology: Biological process=N-linked glycosylation
atggatggtgggcatgtctggcataatatatcccaacaggtgtgttgtcttgcgcagttcttattgccaatgtacagtttagttgggcgactgtagggactctagagagacaatacgcagtgattcacctgcgcgatggtcgcaagttccggttcagagtgccaaggggtagcttccttacgcctcagcagctcgaacggggaatgcaccatggcatgatcgcggaaatggaacgactcgtgacccgaaaaaggtcaatacagtacccggatgagggagaacttcttgacatggaagtcgtttaggaggaagagcctgaagaagcaccattaaatccgttgaaaaatcgcacaaaacttgatcaacttcgcttgaagcatgagcgagacaaaaaagagagagaggaggaagataaaaggcgacagcagcgagaagagcagcagcagagaaagcagcgagagcagcagagaaagcaacgagaagaacagcagagaaaacaacgagaagagcagcagagaaagcagcagggagaacagcagcaaaagcagcaagaaaaagagcaagagaaggcaaagaaatctgaggctgaacgattagccaaagagaagaagacagaaaaggagcggttggcaacggaggaagtagaacgactcgccaaggagaaggcggaggaggaacgattggccaatgtgaaaaaggaagatgaacgcttggctagagagaagaaggaaaaagaagacgaacaactcgccatggaggcagaggaggatcgtttggccaaattgaagcaacgagagttggagctgctaaaagagctgaagccgtggcgtggtggctacatgcgactggtccacggcaaggacccgacccccgacgttcattatctgcacgagaaggatgattatcactttgtgaatgctgtgcacaagtacattgtgcgacatccggaacttccatgggactcgccggagtttaacccatcagcaaacattcaacaaaacatcgcagaattctgggaaatctttgagcgcgaagttttcgacgaaaattatgagctaaagacaagagaggagaagaatgagctgatagagctggtcaagggatttcgattctatttcgcggacgagcttggacgttttacgctaaggattttcagcgacaaaatatcacacatcactttgacggatcagctggcctacgtgttgggctacgaacagcagcaagaaattcataacgaagaccaagccaagtacgctgttgacttggccggtggtgtcagtcacctgtgcatctacttaaacagcggaataatcgagagcatgatttttggcaactccttcgccaatctcctccaagtgattgcggtcgagggtacgtcgggcagtgtggtcgagaaagactttcagtcaccgttgttccacaaaattgtggctagagaggtggacgtactggacgttgagattcgtacgctcacaggacggtagtgttgtgattttcaaaatattttccatactttttttttttttggtttaagagaggtgccttttgaatttggccaattgtgctgactcttcagtttaaaaaagtcgtaactttctgatacaatggtccgagttatattcaacgggtcgaacttgcggttggagaattatcatcagcagggtggaagcatttcgtactttgagggagctccgaccttccacgctgaacccgatcagctcaaggcctttccattttaaggcaaatattgggcaatgtataactcttatcagtgtttgttcagattcatccgatcaccagctacatagacctcagcaaagtgtttgtgtgcacggaattcaagctcaagaaaatcgcagaagacggagtggtagttgacgtatcagccaacgtggctgttggccttatacaaatgcccggtgcaactttcatccgcaatctgaaggtgcacataaaccagcgtgaggtgtacgactccaatcagctgtacagctacaaggtgtacctggacaccgagctcagttaccctgcggcggcaaaggatgcctactttggcgtggcgggctattttcgagacagtgattcgacaaaagtgaacgaaaaacggaaaaaagcggtggaggagagcaagagcttccaaacgataagcaagctgagtgccgacatattcaaccaggacttgtacatgatcagcaacgtcgagattgacattgagctcgcactgcagtcggacgactttatggtccaccaggacgatgcgaataaggacaagtacacgcttgaaattgtcgactgtaggctgatcgtgaagactgtcgatttgatgaacgggctgagtcttgacattgccaggaagttggacactgaacccgccagatacggtatccggaagtcgttcatgaaatcgctctttgtcactggtggtcgctatgacttctctgccaacctattcacggaggaggtgccacgaagagttgtcattggactggtgtccaatcagaattacattggccataatcagaagaatcccttctattttaatcaccacaacgtgagtggcaaatggcaactgcttgtgaatcagattattcaggtgcgggacattgagcttacggcctctgacaggacatatccccagtacccgtacaacctggactacgagaacaacaggtacgcaagggcgtatcatgatgcccaggagcaccttggcatggcgtgtacaacggagagcaacgggatcagctacagcatgttcaagactgcctactgcctctatgtcttccaaatgaccaatgcgcaggaggactcgccgggctttgagctgatcaaggagggctgtacagcggtgaacattcggtttgccgtagcggttccgaacgagggggtcactttaatagcctatgccgaggctgacgggctcattctgattgaccggaacagatcaatcactagtgaccttacagtatgaatggtgagaattattcctccgattttgttcaaatgccctcctccaatgctgcacacgaagggattgtactgtgttttccggatgtgatcgagaagtcgccaatcaacttttttctctgcctcatctacctgtttggtgcagcaggtactgcagctgcgggattttacctgtttttgaggagaggcggattcgtcgcaggaatggacaatcggttcatcgacagagctctctttgagaaccgggcgacgagaaaatattttgttggcacatttccggccgaccgattgccaaagtgcacgaaatttccctgcagtctaattgtcaatttggtgagtgccaaaaaatacattaaataaa

SEQ ID NO: 45847 - DNA, 318 bp, Heterodera glycines
  Genomic contig location: Contig_ID=SeqID_24220; Location=787..1104; Strand=-
  SCN-specific regions: Sequence locations=1-318
atggctccaccgacaaacaaagtgcaaaaggtgatggtccagccgatcaacctcatctttcgctgtctccaaagtcgttcgcgcattcaaatttggctttatgaaaacgcttcttcgcgcattgagggttatattatcggtaacaaaaaaaactgttttgttgtttaatcgcttttcgttggtttagggtttgacgagtatatgaacgtggtcattgacgaggcggaggaggtccaactcaaatcgttgaaccgtcacaagttgggccgcattttactcaagggcgataacattacgctgatccaaacaatccaatga

SEQ ID NO: 45848 - DNA, 150 bp, Heterodera glycines
  Genomic contig location: Contig_ID=SeqID_24231; Location=300..449; Strand=+
  SCN-specific regions: Sequence locations=1-10,35-43,66-150
  Gene Ontology: Cellular component=cytosolic ribosome (sensu Eukarya); Biological process=protein biosynthesis
cttcccaatgcccacttccacaagcattggcagcgtcgtatcaaaacttggttcaaccaaccggcacgcaaggaacgtcgccgcgctgcacgttccgccaaggcggcccgattggcaccgcgtccggccggcggtctgctgcgccctgtt

SEQ ID NO: 45849 - DNA, 973 bp, Heterodera glycines
  misc_feature (902)..(902): n is a, c, g, or t
  Genomic contig location: Contig_ID=SeqID_24245; Location=83..1055; Strand=-
  SCN-specific regions: Sequence locations=1-156,178-735,757-828,850-973
atgaacttgaaacggcccctgtttttgcgcccgaatttgcgcatcaacacttcgagaggtcccttccatctcattcgttttctaaacaaattcgtttttagtgaaaaaattgtcggatataaaaacctgaaagtgtccgtgctttattcggatccaaccctttttctgacttccctttatgaatgcgaacagaaagaggatgactctacgaaggttcgttgttggtcaaacagtaatgactcattaattagctaatttgccgtcatttagtgcgacgatattgaatacagaatcaaagacgcgctcccgcaaactcaactcaacgcctatttgacaattgagaaattcaggcagaaactcagcgagcaaaagaactttgttcctttcggagaactcatcacaaagttttgccttaaaggtggggaaagtgaagggaatggtgacacaccgtctgaactcatcaaactcagttttttcttaattttttcgttttataattcaaatactaatttcagattcagagattgaacataactttatactttataaattcgagaaaaaacagcaaaacgatgctcaatttgaccagggctataaatttctggagcgagtgcaagcgttggcccattggtacatcgatgcggtcagtgttttcgctctttcattttcccattttccgctcatccatttgttccctcttttcaggtctcttacactgacaatgatgaccatcgttatttcaattattttctgtttgccgtgcgtccatcttccgatggcgatggttcttccgtccatcgattcgccggttacgtcaatttgtaccgtttttaccaccatccggacaaggaacgagtgcgcatcgcacaaattctggttccaccaacttaccggcgcattgngttgggtccgcgactattgcgtgccgtttacaatgacttatgccgtgccgaacgcgtcttcgacataactg

SEQ ID NO: 45850 - DNA, 1188 bp, Heterodera glycines
  Genomic contig location: Contig_ID=SeqID_24259; Location=371..1558; Strand=+
  SCN-specific regions: Sequence locations=1-303,326-465,492-506,528 -558,580-975,997-1188
  Gene Ontology: Mol. function=nuclear localization sequence binding; Cellular component=cytoplasm; Biological process=NLS-bearing substrate-nucleus import
gagattgtggtccaagcgcaaagtgctgacccggaagtgcagatgctggccgttacccaggctcgaaaattgctctcctccgaccgcaatccgcccatagacgacctcatctccagtggcattctgcccatcctcgtcaactgtttggagtcgccaaagtataaattacaaaaggggtgtactacttctcccctgaaattttaaacaaactttaattattaaaaaaattcaagaagaaatgatgtgggaaaagctggggtcgggaaaacgagctaatcctttaaagaatattaattaaattcatttcttttaattctgatttatttaagtgccacgcttcaatttgaggccgcctgggccctgacaaacatcgccagcggcacttcagaccaaacacgcgctgtcgttcaggctggagctgtgccacactttttgaagctgcttgagtcccccaacatgaacgtgtgtgaacaagcagtgtgggcacttggcaacatcattggtatgaaaaatggggccaaattaaattaatgaaaattgtgggtaatgactattttgatttttatcattctttccaattttccttttagcacattaattttgcgtttttggttcaggcgatggacctcactttcgtgactattgcattgagttgggaattgtgcaacctctgctgaaatttgtcgctcctgaaatccctttgaactttctacgcaacgtcacttgggttggttttttggattttattgctgtcatattccatttcttttcaggtgatggtcaatctttgccgtagcaaagacccgcctccgaaccgtcaaattgttcaaatgcttttgccgatgttggccattctcatccatcaccaggacaccagcattctcgtggacactgtgtgggccctgtcctatctgaccgatggtggaaacgatcaaattcaattggtcatcgactcgggggttcgttttttattaaaattgacaacagcaaatatttggttaaaaacaggttgtccaatatttggtccctctgcttggccatccggaagtcaaagtgcaaacggccgcactgcgtgcagttggcaacattgtgaccgggacggacgatcagacgcaattggtgttggactgtggggccctccaaatgatgccggcacttctctctcaccaaaaggaaaagatcaacaag

SEQ ID NO: 45851 - DNA, 1085 bp, Heterodera glycines
  Genomic contig location: Contig_ID=SeqID_4585; Location=9..1093; Strand=-
  SCN-specific regions: Sequence locations=1-193,215-623,645-673,695 -1085
  Gene Ontology: Mol. function=dynein ATPase activity; Cellular component=cytoplasmic dynein complex; Biological process=oocyte cell fate determination (sensu Insecta)
gaacttgcggatgaacaaatccatctgaatgcgaagctgcaactaatgctcgaggcggaaaccgagaaacgcacctccgaaacgttgctgaagcaaatccgagaggaaaaacaatgcattgatcgaaaaaaggacgaagtggaacgggaattggccatggtttgttttttagtcaaaatctggtagcaaatggcactaaaaatacaaaatttttcccggcggcgcctatcgccaccgccggaccccccccccccccaaaaaaaagttcttttaaaaaagcgcgtcgcaaaaaaagcgtttttaaagaagaaaaaagtcgtcgcctggctaaaaattgcaaaaatctggcaatttagttagaatttcttttcaggttaaacctgaagttgagaaagcgaagagcgcgattgcgggaatcagaaaagctcaattggtagaagtgcgctcaatggcatcgcctccaaatgcggtgaaaattgccatggaagccatctgtttgttgttgggcgaaacgcaaacggaatggaagtccatccgcgcaatgatgtttaaaggcgacttcatctcgcgcattcttcaattcaacacggattcaataacaccggaaattatggagaaaatggagcagtatgaaggcaaccctgaatgggaatttgagaaggtccgttattacaatatattattaataaaataacaaatccaacaattcaaggtcaatcgggcatctgtcgcttgtggaccaatggttaaatgggcaagggctcaactttcctacgcaaaaatgctgcgcaaaatagaagcgctcgagaacaaaattcaggaactgaaggttttttttatttttctgaggttttcgggatttttccactgctgggtgtcataaattatggttaaagcacaaaaatttgttttgtttccaattgcttgatttccatttgaatttcaggaacagcaactgacaatgattcgggacggcaacggcgacatgccgtgtccgtccagtcaaaagcggctgaatgacaacggcgaaattcagtgtccgtcttcctccacgtcctccacctttgctgcctcaacttcggatg

SEQ ID NO: 45852 - DNA, 1996 bp, Heterodera glycines
  Genomic contig location: Contig_ID=SeqID_4587; Location=931..2926; Strand=-
  SCN-specific regions: Sequence locations=1-10,32-267,289-521,555 -802,892-1041,1063-1140,1162-1258,1305-1308,1330-1350,1454-1505,1560 -1560,1675-1738,1766-1796,1844-1996
  Gene Ontology: Mol. function=SH2-domain binding; Cellular component =DNA-directed RNA polymerase II, holoenzyme; Biological process=cell cycle
gttccccttgcccaattgttttttcttctgataatgaatgtgttttatccttttcctacaaaaagggcaacaaggagcggaaccgagagaagcgcaaggattggtttactcgtgccactttgctgtacacggcagcagacaaaatactcatgtacgaccagaaccatctgctgggacgagcgtacttctgtctgttggagggcaacaaagtggaacaggccgatgcccagttcaattttgtaattaatcaggtaagagttgccagtcattttttgctgttcattctctgtcctttttaagtcccaaggcaacgaaggccgtgtgattccggcaatgatgggcaaagcgtgcatcgcgttcaaccgcaaggattacaaggcggcactccatcagtacaaacggtgtctcaagcaaaatccaaacagtccggccgacgttcgcgttgggatgggccattgttttgcgcggttggggcacatggacaaggcgaagttggtccattgcaaacaataatgggtgggtgtacaaagttgttattatttgtttattttacagattggccttcgaacgagccctccaaattgacccgaacaatgtcccgtcgatcatcgctctcgccgttttggaactgaattctggcattcccgagggcattcgaaacggaatccaagcgttggggcaggcgtaccatcgcgagccggaaaatccaatggttttgaaccatttggcgaatcatttcttctacaaacaggtgaaaccattctacattagaagtcatttgtataaacactgattttcctcaggacattgaaaagacgcacaatctcgcttctgcagcacatcaattggcggacaacgacgcaatgcgagcggagagcatgtaccatttggtaaatgggcaactaatgactaggtcaaggaataactcgttccctcaacattcccccttctgaaaaaaattttcaacaatttttttcgttattatttttacatttcaacaaataattgtaaaattttaggttttatagaaaaccatcaacagggaaaccaaagatattttcagtttttaaaaaaataattttgaaggggatgattaggggaggaaatgtctaatatttaaggggcagcggtccagaggcaatttcataaattttcgaaaatttaagagaaaaaacaatagaggggaaatcctacgaattaaataacactaaaacaatttcatattaaaatcgttacgatttctaaacttcttttttaaggctcgttgttaccataagaagcaggactatcaccacgcatttcaggtgttccttttcctcgtctttctttcgatcacaatctgtcctttcttttcagttctattaccaggccacaactctttcgcatccgaaatttgtcctcccctattttggacttggccaaatttacatttatcgtgaagaatatgaaaatgtaaatgaaatattgtcttttttaatttatttccttttactttactttattaggcgattgtcgcctttgaaaaagtgctcaaaatggtgcccaatgacattgacactttggccgtgctcggttcactgtacacaaatgtgccgcataaagacccgaaaattgttgtggaaagaagagaaaaggcacgcgaatatctgaccaaactcgtggacagccaaacggaaagggcaccggtggaagcacttatcgaattggcacaactgctcgagcaacaagacccacaagtaagagaatttcaaaaaataaacagagactaattctgttcggatctcgggtacttcctgatgacagttcattttaagaaatcaaattaaattattttatcatttaatttcaggtttctttgaatttgtacactcgagtcgcaaatttgctcaaagatgacattggtgtcgacattccagcagaaattctgaataacatcggatctttgcactttatgctcaatcaattggatgaggcgaaggcaatcaaattgacatga

SEQ ID NO: 45853 - DNA, 2117 bp, Heterodera glycines
  Genomic contig location: Contig_ID=SeqID_4598; Location=1..2117; Strand=-
  SCN-specific regions: Sequence locations=1-45,67-150,172-333,357 -507,530-632,655-823,861-1245,1267-1600,1622-2117
  Gene Ontology: Mol. function=high affinity oligopeptide transporter activity; Cellular component=integral to plasma membrane; Biological process=transport
tgctatcttttctaattttcgaagcttaacgtaaataactatatgtcaacatttcatttccaaattcagatcaattcttgcggacggatatcttggaaaattcaggtgggcattggcatttgtcatttttgaattggcatttcgcatttgtctgctctgccctcccctccctcaggaccatctttttcctgtcccttctgtacgccgttggccaatgtgtgctgtgcttcgcctccactttgaatggcacttcttccctccacccttttctcgacattctcggcttggtcataatcggcgtcggcaccggtggcattaagccgtgcgtttgttcctttggcggcgatcagtttgagccgcaccagcagaagatgctgtccgtgttcttctccgccttttacttcgcaatcaatgccggggcaatgatctccactttcatttcgccaatgtttcgtggtcgttaccgtacccctttctgagagtgaaattaccgtattcctcctattcgcagcaatgccctgtctgggccaggactcgtgctacccattgtcctttggtgttcccgccgcgttaatggttttggcgacgagtcagtggggcaattaattaattaatggccgaaatgccaaaatcaaaatttcattacaaaagcaatttgtgctctctttcagttctgttcatgtccgcctctttttggtacattaagaggcctccgaaggagaacattttccgcgaggtgtaccaagttggcaaagtgagtgagtgccattttttagtcatttctttttggcattccctcggggggaaatcttttgtaaattggcattttgtttcatttattttctaaaaaataaacaaagtgttacagaaagcgcttgtgaataaatggcgaagcaaaggcaacaaaaagcgtggttcgcattggcttgacttttactttgactcgcatttgtgcgactccgacccaaaatgtgaagagttgcgcactttgaaggacaatccgaacgaatgtcacaaagtgagcggcgaatagcaaatcttccgattgttttttggccatttcttttctttgcttttcctttggccattcgattgttttgttttagcggcgcctcgtctccgacgtgcggggccttctccgtgtgctcgtcgtttatttgcctgcccccgttttctgggcattgtacgatcagcaggggtcgcgttggctcattcaatcggtcggtcatcgcctggggctgcttgctctttcaaatgatgctaattgctccttaatgattgtttgtaatttgctaattaggtgatgatggactgtcgcctgtggggcgacacccttctgttgcccgatcagatgctcaccttaaactcagtgctcattctgctgttcattccaatgttccaagtcattgtctacccaatggtttctcttcttgccaaaatcacgtgcgttgttttttgttttgttttgcacttcctaattggcccattaattttaattagtcccctccgcaaaatggtggccggcggactgttcgccgccctcgcctttgtcctttcggccatcgttcaattccaaattaatgtgattaaatggccgtccgtttaaattcacatttgtgtccatttagaccactttgccggacattccaatggatgggcgtgcctttgtttccgcaattaacgcatttgacaattgcattttgaaagtgtgcgcagagaatggaaaagggccagaaaagtgtcgaataatggagccaaatcaagtcaaaagcggacaaaggatgacaacattcacaaaacccatttagacactgacaaatacgaacagagaaaggccggaaatgttcgaattggacgggggacagcgaaagtggcactttgaaggggaggggggagactgcggggggaagcaattcgggggagaggtgggccgggagttgagtgccggacgcacttattggatgatggccagtcgaatgggcgttctgtttgggagacggacacgctaaagccgacgggagggaagggcgaattcaaagtggggtaagtgccgaaattggaggggggggggccccccaaggggggatggacagggaaaagccgacgggagggaagtg

SEQ ID NO: 45854 - DNA, 2451 bp, Heterodera glycines
  Genomic contig location: Contig_ID=SeqID_24328; Location=15..2465; Strand=-
  SCN-specific regions: Sequence locations=1-58,90-1437,1461-1579,1603 -1658,1681-2257,2279-2328,2356-2451
  Gene Ontology: Mol. function=H3/H4 histone acetyltransferase activity; Cellular component=chromatin remodeling complex; Biological process=negative regulation of transcription of homeotic gene (Polycomb group)
caaatgtctgtgcctggctctcaacctccgcaacagggtgaggacgccgaggagcggctgatcaacgaggagtacaaaatctggaagaaaaactgcccgttcctttacgacatggtggggtttaaaacaagccatcaaatttcctgtttttggtacgtcttgttgctttattctgtcgttttcaggtgatgactcatgcgttggaatggcccagtttgaccgtccaatggctgcccgacgtgcaacgacaggagggcgccgactacacaatccatcgcctcattttgggcacgcacacgtcggacgagcaggtaaaggtggtggcttgatgtgacaattgcacgcaaatgagtaattttagaatcatttggtcatcgccaaactgttactgcccaacgacgacgcacagtttgacgcgtctcgctacgacactgaccgagtgcccaaccatattaattttaccctaaaatccaatcatattccagggcgaatttggtggctttggcacagtgaccggcaaaattgaggtggaaatcaaaatgaaccacgagggcgaggtgaaccgggcccgatacatgccacagaatccggttctgattggcaccaaatcaccctcctcggaggtgtacgtctttgactacacgaaggtctgtctgttgattaattaacggtacaattatcagcataattaatgcactttgtccatttagcatccgtccacgccggctgacgtggagtgcaagccgcagttgcgactgcgtggccacaccaaggagggatacggtccggttttttggcattcaaaccaaaggggggggggaggaggacagttccatgtttctgtcttgtgatgacattctatttgttcgttgcacccactagtaaaagctcgcaaaaacaaatttgggcggttctgttattattaataaatatagatcatttcaaaaatagtaaattaccacaattttcttaatttttctaaaattttttagttaatgcgttctttttcatccataataacaaatttaatcaaatcaggcttatcctggaacaacaatttgcctggtcatttgttgagtgcctccgacgacatgaccgtgtgcctgtgggacattcaagcggcgactgcgaatgccaactttttggacgcaaaatccattttcacagcacacactgcggttgtgagggacgtggcatggtagtaaacatggaattacgaactgaattttgagaataattttcaaattaaggcacgttttacatgacacagtctttggttcggtcggcgacgatcacaaactgatggtgtgggacacgcgcacgaacagctccacaaagccaacccatgttgtggaggcacactcggccgaggcaagcggagaccggggggggggggggagattgatgttaaaaaagggtagaaagaacatttttttattggaaaaaaggaaattatatcttactcgtagccgaaaatgctagaaattgggacagcaaaaatcagtccataaatgtgtgtgctaaaaatcaggcacttaaccagtggtataaggatgaaactgccccctccccatctcactaaattttaaaaaaaaattttttgaaagataagttaatgaaaatttgtatgggtttccctcccaaaatacttagaaaaaattaaaattgtaaatcttgagaaatagacaaaaacgcattttgattcggtccttcgatcggtaccaaattttctttattctatgccaatgtgtgatgttttttgtttgtctctgaattattcattaatttttgttacttcccaggtgaattgtctctccttcaacccgtactcggaattcattttggccaccggatcggcagacaaagtttggacgcatctgctagcatttttaagcaaatctgtttaagactgttgcgttgtgggaccttcgtaatttgaaattgaagctgcattcatttgaatcgcacagagatgaaatatttcaagtgaatttgtgcatttttcaataaatttaaacaaaaaaaaacatttttccaaggtccaatggtcgccccacaatgagaccattttggccagctcgggcaccgatcgccgtctgcacatttgggatctgagcaaaattggcgacgaacagtcgccagaggacgcggaggacggaccaccgggtgagtggaggcaaaacggactaaaatggatctttttaaagaactgttgttcatccatggcgggcacacggccaaaatcagcgacttttcgtggaaccccaacgagccgtgggtgatctgttcagtgtcggaggacaacataatgcaggtgggtctggaacaaaacaaattttttgtaattttatttgtctcgttcacagatttggcagatggcggacaacatttacaacgaggaggagttggacccggcgatggtggaaggtgttgcggccgcaagcggcgccg

SEQ ID NO: 45855 - DNA, 426 bp, Heterodera glycines
  Genomic contig location: Contig_ID=SeqID_4604; Location=519..944; Strand=-
  SCN-specific regions: Sequence locations=1-426
  Gene Ontology: Mol. function=chitinase activity; Cellular component =extracellular space; Biological process=response to bacteria
ttctgcgaaatgctggcaaacggtgcgcagcgttacgtggaccgggaaacgctggtgccctttttggtggcggacaacgaccagtggttcagctacgacgacgtggagagcatcagaaacaaagtgaatgaaagcccatttcgaatttcaatttgaaatgcttttgcctcattcagctcagttggattcgccaaaactctttcggcggcgctttcgtgtggactttggactttgacgatttcaacggacaatgccccggcagccaactcggtaccgtacctttatttgcaacaataattcggaatatttggttcaaattgaatttaaattatgttttgtccaggccgttacccgctgatccgcacaattgcccaagaattgggcggcatccaactctcacagacacccgtctcggcactttcgaat

SEQ ID NO: 45856 - DNA, 2927 bp, Heterodera glycines
  misc_feature (21)..(21): n is a, c, g, or t
  Genomic contig location: Contig_ID=SeqID_4605; Location=465..3391; Strand=-
  SCN-specific regions: Sequence locations=1-169,212-322,352-360,404 -406,427-503,526-528,559-708,731-870,895-1290,1365-1397,1443 -1485,1510-1619,1641-1784,1830-1885,1907-2005,2032-2071,2093 -2101,2154-2262,2284-2364,...
  SCN-specific regions: Sequence locations=...2492-2502,2528-2701,2734 -2776,2812-2927
  Gene Ontology: Mol. function=chitinase activity; Cellular component =extracellular space; Biological process=response to bacteria
tggcatttcatcatttaaatnagggaataaatgggaattttattggccattaatccggccgatttgccaagtgataagcattataataactaagaatataattaccagaaaagaatttccacccatttttgaaattgacaccgagttgacgttctagcagaaaagggcgaattttataaattattaaagagaattctaaatttttatttaagcaaataaaaaggcattaaaatttcagggcctatgacccggccgatttgcctagcgattggcagccaaaaggaatgtattctcgagtgaacgcactaaaggttataatagaaagagaaaagaataaaatatattttaatatgcaataccaaattatatatactttttattattaaaagtataaatattttttgaaaattaattaattaattaattttaggcttttgatccggtgctgaaaacgctgctttcatttggcggttggtcatttggcacgcgactttttcagggaatgtcctcaaagtgaggccacaaaggaattttttcttaaatttttaattttaaattcacagtgaagcgaacagaaaagttttcatcgattcgtcaattttatttgtgcgaaagtacggcttcgatggcattgacatcgactgggaatacccaaacggagaagcggagaggcaaaacttcaacaaatttttgaaggcaaattaattaatagcaaaattaaattgaaaatttagccgaaattaggtaaaggaatttgatttttaaataaagttttttttttttggattggcataccgttaatttttttttggattggcataccgttaatttttttttggattggcataccgttaattttttttttttggattggcatacctttaatttttttttggattggcataccgttaattttttttttttggattggcataccgttaatttttttttgggttggcataccgttaatttttttttggattggcataccgttaattttttttttggattggcataccgttaatttttttttggattggcataccgttaatttttttttggattggcataccgttaatttttttttggattggcataccgttaattttttttttggattggcataccgttaatttttttttggattggcataccgttaattttttttttggattggcataccgttaatttttttttttggattggcataccgttaattttcatgctcattgtcagccgagcctaaaagtgtcactgtcgtgacaaaattttaattcaattttacagtgcaaatttttattaatttaaaacatgcaaaaaatattaaattgttttagtcaattaatttaaaatatgaaattattctcgtgtaaattgcgcttttacatcggcacaacatttttaatttaatttaatttttgtagagaaataaatttttatttgaacatctttaataaaatgtcgaattaagggaaatttaatgcaaaaattaaagcatttccacttttcactttaattttaaaatgttttttggtccttcgaaaaaatgcttgaattttttcatctaaatatttttgtttttattaacagactctataaaacagtctaaataaaatgacaaaaaattaatttatataattgcttttctgcaggaactgaaagacgccgttggggcagaagcgtcttcaagcggaaagccgcgtctgctgatcactgctgcggttgcggcggggacggaaaacattgacaacggatacgacattccgacagtcggaaagtcgagcaaaatataataaaataataattttttttaattataaattaaatttgaaaggattctaaataccaatttaggtgcttttccgtttggaggccccacattcaaattttaaaaaatattaacaaagaaatgttgggttcttatctgtgcaaattactctgatattttggcccaaattattttagctaatttgcaagcgcagttttttggatgttcagcgcgctctttgttaacattttttaaaaattttgatgtgggcccccttacggttaagtacacccccaattttataacataaaaatttggaaaatatctgaacagatttattactttataatttaccaaatttacttaaaaaatatttataatttttcgtctcttagtttttatttcttcgatttaatttagttttcgtttttatttaattttatgcttaaggcttctcgactttgtgcttctgatgagctacgacttccatggctcgtgggagcagcagacggggatgaacgcgccattgtacggacggtccaaagatgtgccggagaagcgcttgtggaatgtggtcagtcagtgtattcctatacattttaattattaattaataattattttttaattaaattaatttatttttatattttattgtaatcattttacaataataattgagtaaaatatgttaattttttaaatcaaatttcattaaaatttcagtaactaaattttccctcatcaaaaaataatttaacttttttttactcattttttacagttgtcgttttagccaagccatatgaaatttttgaaaattttcatctgccttccctactaatttctgctttttaggctggtgctgcaaattattgggctgaaaagggcatgccaaaatcaaaggtcccatttcttttctttttttgtatgtttaatataattttattattaaagattattatcggaatcccaacatatggtaacaaaaatttaaatcgaattaccaaaatattatttttattatttatttttaataaattgaggccgtggttggactctgagcaaccctcaacaatttcgtggcctcgacgcaccgggccaagcggcaaaagccacaaaatttgtccaattggcgggcactggagcgtattttgag

SEQ ID NO: 45857 - DNA, 1453 bp, Heterodera glycines
  misc_feature (1386)..(1386): n is a, c, g, or t
  Genomic contig location: Contig_ID=SeqID_24336; Location=1..1453; Strand=-
  SCN-specific regions: Sequence locations=1-331,353-615,654-1057,1079 -1269,1327-1453
gcgagcagaattcatgaccattttttaatcaaaatttctcttggatgtattgtataaaattttactaattttccgagtccgaattttcaagaatttcaaaatttggcaaataaactcccttttcccggttcttttcatttatggtcctgtactgggcacaaaaatcatgccatcttgatagttatcaccagtcttgaaagtatttgcatccaatgtttgcccccattttaagagcaaaagggccagcaccgtccgcttgggtccttacccggcaattgactcgatgatcgccgagaatcgcttcacggtgctcacccggctgatgcgagtggttgttcttgcaaattgacaaaaattaaatgtcaatcaaattgttttccctcctcaaccaggtcacccatttcatttcgcacatggcccccgaggtcatttgtccgtcgttgtgccgttctctgctgtacatttgccgcagcggcttctcctttcaggaaagcgatctgcgccatcgcgtaatgcgcgagagagcgtccgtcgaagtgttcgccgacttcagcaagttagtagggatttactagttgttttttcgaaaaatcattgatttgcctttccaattaattgcttttttggggatttttggcttaaatttttaaaaattctacggagcggtcctatgtaccccttctcaattgctgtagaaaggctcgcatccgtgtggtgtccccatttctcgtcgagtccatcaacggagtcaatttcgcactgctcaacggacacgcggacatcgccctgcgcgcgttggacgccgcccaccagcgggcgcagtacgaaatgatggcggacgtccttttggtattttttttacttttttgcccattattttaatttgtttttcaaacccattcttagggctccttttcgaataatctttttgtgttttactagtactatattatacattttcaatttactcctggtggctgtacggctccaactccatgcacaaggagttggagcagtacactcaactggggagaggcatatttaagggaatattttctgtgacaattagttcataggcctccattttgctgacacatagataatccggatgagtttcatgttatttaattcgttgtccacaatttcaaggagactaacgcattgcgaaacgcactgttggacccaaaagcgatggaaacaatcgttgcgaggaattccgccggcattggcgcaaattaatgacatttatttggacggatggataatgagaattaaaaaataataatattaataaattttatataaatgatagaaaataaaaaatatctccgctggtcagtaatttttgaggtcgtccgattattttcacattgtcaatttgcttanaacgccggcaacgccgcaggcgatgatcgtggcgaagacatcagaagggcggagatcacgccagcca

SEQ ID NO: 45858 - DNA, 1709 bp, Heterodera glycines
  Genomic contig location: Contig_ID=SeqID_24357; Location=1..1709; Strand=+
  SCN-specific regions: Sequence locations=1-337,359-609,631-1073,1095 -1194,1216-1333,1355-1564,1591-1709
  Gene Ontology: Mol. function=copper-exporting ATPase activity; Cellular component=integral to membrane; Biological process =intracellular copper ion transport
ttcatccaattttaatttgctttttgacaggcgattatcgtttaagatgagccttctctgaacactttgcagcaattttccgttgttattggaacagaaaaatggttgacagaaaatgaaattccgacagaaaattatttgatggagactttgcacgcagagcgacaatcgggaaatattttgacactttgtgcggttaatggtgaaaattattataatggcagtaattccaattgcaacactttggattttcaggcaaagttgcggctgttatttcgattgtcgaccaggcaaagcgagaggcgcctttggcggtttgggcattgtatcaaatgggcatgaaagtggtgctgctgactggtgacaatgcaaagactgcggaggcgacggcgaaaagagtcggaattcgggaagtgtacgcggaagtgttgccgaaccaaaagaaggacaaaatcaaacagcttcaggttgttggcagtgaattggtagagagaaaacaatttgcatggcaattagcccaaaaaaagaaggttaatgaagaaggaaatgccaaagggttaaattcaaaatggatgtaagaaatttgatgatgggaataagaagcaatgaatgaatggcatggaaaatggagcagaaacacaattcgattgattgcttaaattcttttgttgaatgttccccaatcgacgcgacattttcatttgctgcgaatttgcaagccttgctcttctttattgcactgtcccttttatactgctccattcgtttttagttccaaaaccaagtagttgccatggtgggcgatggagtgaatgacagtccggctttggctgctgccaatgttggcattgcaattgctcgtgggtccgacgttgccattgagagtgccggaattgtgctggtcaaagttcgtcaattttctgtcttccgcccctcacccactttctttcagaataatcttgtcgacgtggtcagtgccatcaaattatctcgcaaagttgtccgccgtattcggctaaatctatttttcgccttcgtttacaatgccatcggtgttccgttggccgccggagttttttccccttggggggtgcacattcagccgtggatggccgccgccgcaatggcattgtcctccgtgtccgtcgtgagcagttcgttgctgttgcgaagattcaagtaatgtccactgccttttttgtttcatttcttaattcccggaaatcaaacacttaaggaaaccgacagaacattctctgtccagcacagagtttaagcgttaccggaggaatttgaatgaccaaaacggaattgaagttaatgtgtacaaagggctggacaaaagagaggggaaaaggaacactgagcaaacggatttgtcggcaatggaacgcttcgcttctggcactgaaatggacgacaaggcaaaacggacaattggtgctgtccgatggattaccaaaggcgtaaagaagagtcgttcaccgccccacttgtcggacgatgtgggaatgaagagttttgcggacaaatcggcctctgaacggtcgtatttcctcatttcttttttaatttattatttaaaatttagtttcctttcgtccggtagtgatttaagcgacgatgacggaccaaatttaagtgacagagcaaacgcccgtgcaaaactatttgaaaatgtctaataacggacagaagaacttgcccaa

SEQ ID NO: 45859 - DNA, 1372 bp, Heterodera glycines
  Genomic contig location: Contig_ID=SeqID_4616; Location=166..1537; Strand=+
  SCN-specific regions: Sequence locations=1-100,123-684,706-1268,1291 -1372
  Gene Ontology: Mol. function=protein tyrosine kinase activity; Cellular component=plasma membrane; Biological process=cell proliferation
atgtacaccgtggacaacaactccgacaagggcttccgaacaatcgaacgattcgtcgaccactaccttcgcaccggaacatcagtcacaagcgtaagtcaaaaatttaaattataaatttagtgattttcctttgtttgcaggagcgattcgtcactctcaggaatgccgtgcaccgggcgaattgggagctgtcgcactcatccatcaccatcagcgcagagttggggagaggggcattcggcactgtttacagagcaaagctcaccgaacgcaatgggaacaactcgcaggtcgccgtcaaggaggtgtctcagacgagcaccaaggagcaggtaaaggcggagtttgaagcattgagatcgcaaattacacatttttccttttcagatcaaagagttcatgaacgaggcgcgcatcatgcggcagctggaccatcccaacgtcatccgcttccatggcgtcgccgtcggacaggagcccctgatgatcgtcatcgaactcgcatctgacggcagcctcatcgactacttgaagactcaacggagaagtgcgcgcaccagactcttcatgtgcgtcggagcagctgccggactggcccacatccactccaagggcatcatccattgcgacatcgccgccagaaattgtctctactcgaacggcgtggtgagtcaaaacttttgttgttttagtaactaatttcgctctgttcccacaggtaaaaatctcggacttcggcatggcgcacagaggaccagtgaagaaaatggagcccaacgcgcgcgtccccgtcaaatggctgtcaccggaagcactcgccgagcgctgcttcaccgcgaagagcgacacgtgggcctacggagtgatgtgctgggagatcttcaccaacggagaagtgccgtactcacaaatggcgggatcagacgtggcggtatcggtgggtgaacacacttttgtttgcttttttcaacttttccttccttttcagctgatcaacggacagaggctcaacttcccgagagatgcgccgtcaaaattggtcgagttcatcttgcagcacatttgggatgcggagacgagcggcagatactcaatggcagcggtctacgactggctgaagcgacacacgtaaggaacctagcggtgaacggattcaatgccatcagaagatatatgtgataaccctatgcttgttgtatttttacatattgctgactcattgttgtataactactattatgatatgtataaatgactgatgtccgatgtttgctgattggcactttgcctgaaagaaaaactgaattttatgactaaaatagaaatcaaaaatgaccaattttcgattaagcttattttgctcaagaaa

SEQ ID NO: 45860 - DNA, 2012 bp, Heterodera glycines
  Genomic contig location: Contig_ID=SeqID_4617; Location=374..2385; Strand=+
  SCN-specific regions: Sequence locations=1-61,83-582,630-679,701 -1206,1228-1377,1399-1743,1765-1832,1878-2012
  Gene Ontology: Cellular component=exocyst; Biological process =embryogenesis and morphogenesis
ctttccaatgcgtatttgcccgttcaaaaacctgagtttattaatgtttctcttccggtggacacaatgatgccgaaggtgggcaattcccaggacagcggagaaacggagagcaaaaacatcgaaatggactcaaattatcaggtggcttatattgtaatttctaataccaaacagtcgaatataaaaatgcgtaacttttttaattgctccaattcccttttaagccaataacacaacgtgaggaggccgattttcgacgacttcttagcaaatcaaacctccaaattggacaagcaaaacaatttgcaactgttctcagcgaacagttggcccaattggacactgcaaatttatcgaccatcatggagaacaagcaaaatgtgggcggactaatcgaattggttgacaccgcaattgaattggcggaatgcattgaacgacaattggacgaatacgacactttgctttccgtaatatttgttttgtttatctcccaaaacacggagcaaaacgtcgccaagaaaaaagaagaaaaaatataaattttctgcaaaaaatttaaatctttacaaactgttacaaaattcaaaaatttattttcttgaattttaagaagaatattaaagaattaggcttgtatgtgaagctttttcttttttcggcgccgttatgtctcgtgacgttttgtcctgctttgccattaacatttcccttttcagtttgtacgtgacagtgttgaactgatagaggaaaaaggtaaacattcctttcgctattttttcccaattttagccctttttaagacagtctgagacacattgagcaacagaacaacaagcgactcttcgacgagctcaaagacttcgtcttccttatggaaatggtccatgatcagcacatcgatgccctcaaaagtgccaatttgtccgatcccactgggtatttactttcattgttttcatgtgcaattacaatatctcagaatcaactcgtgttgtcaagctgctcgcgtggtagaccattttctgagcaaaaaaacgccactcaatgggatgagagcgtatcagacaaaagtggaattgctgaacaaattgacggtggatttcatcgacaagttttacgcacacatttgcgcaatattcgggaacatggtcggccatttatttattcattccatcgccgacagaatgggatgggtttccatttttatgattagtttttcatgaaagggttcaatgttggagtgccagcacatcggcgacattatcatacaaaagcactcgcaaaggcatcgcgcccttttgcccttctccgatctgatcgcttggctgaaacaggcacggcccgcagtttatgccaaagcgatggagcggtacaaaaaggaagcacgcaaattatacaaaaatgaattcgaccgttttttctccgaactttcccgacgagccttgcaaactgttcaaaatgaaagtaaaacaatcgattggcactaaaactgaaattttaatcagggaaggaaatgaaatggcctcagcagaatttgggaataaaaaccattcattttaagatttaccgaatttaattgtaacttttaaggtggaagtcattctttgagtgcagacaatgcgatctcttcgttaaagccatacactgacgtgagatgagactgtctatttttggatgcattttcaatttttacagttaactgaaacggcggttgccgagtgtcgtacggtggtggaaagtgaacagaaattttctattcgttttttccacctaaacattgacattctatcgcaggttggagttgagatgaacaaaaaccgtatgtcatttttataaaaaaaatcaaaatgtttattaaaaaactttttttagaaaatgacggtagaaaaacagtagagaaacaattgaacgaccaaattaaatttgcaattggcgacattttcgactcattgcccacttacttttatgcccttgtctcaacattcaaagaccacaacctcgtgtaa

SEQ ID NO: 45861 - DNA, 630 bp, Heterodera glycines
  Genomic contig location: Contig_ID=SeqID_4617; Location=3980..4609; Strand=-
  SCN-specific regions: Sequence locations=1-49,71-191,221-630
  Gene Ontology: Cellular component=integral to membrane
cccccaaggtgatcaccacttcgctgcccgtcaattcgctcgtctctttggtcatttggttttgttgccttctctacgcttccattcgcacttcttcatacacggcactgggcaaaattggtggggcgatcagtgaaggaaatgccgaaggtcaggacatccctctgagtaaggcgaaagtgaacggtggcgggaaaggaggaggaagagaaaggacattagcaaccgaaggggggggggcggaagacttatggtccatttgagcgaacaattccatttgttcaggcgaagcttcaatgtccgtcgaggagggcgaccgtgggacgacggggcgcaatgtttacgacaacgaaaaggggtccgtggcctattcctactcgttcttccacttcatttttgcgcttgcttctctctatgtgatgatgaccctcacttcgtggtacacgtaagtgacgaaatgcgaacgtttccgtgctaaaacatatcgctgccttcagcccgagcgatgatttgcgctatttgaacgacaacatggcatctctttgggtgcgcgtcatctcttcttggctttgcgctgcgctttacctttggactttgctggcgcccgtccttttccccgacagggatttc

SEQ ID NO: 45862 - DNA, 1021 bp, Heterodera glycines
  Genomic contig location: Contig_ID=SeqID_24402; Location=624..1644; Strand=+
  SCN-specific regions: Sequence locations=1-409,431-1021
atggttcatattgtgtttgacccaagcattgcgcagtatgacgagtatgtgcagtacggtagcggattagaaaaggacgattttgactacttcagggggtcaagcccctttcagagggggtacggtattcaacgaggggcgggcgttggagatgtgtttcgtggactgtggcgttttttcctacccattcttcgccgcgttggcaccacggtagggtcggaggcgctaagcactgggcaacgcgtgctggagcgagtcgggaatgagggggtgccatttaaagaggcgcttgtcagtgagggaaagcgaggaattgcaaaggaggactaccaaaacagtttggaagcggaaaacggagtataaaaagaaagagaacacatctacccagtcatcagacactaattggacgaccttttgtaaaacaggcaaaaaagcgtattcgatcggacgcttttggactttattaattaaataaatggctttccataaaatcgacaacgactcggtgaactcaatcaccaatgcattggactttttccgtataccccctacaaatgtgagcatttcatcatcaaaagtgtttgagcttctgcctagcaatccgcttacagacacaccttaccatttcaaacttcattccagccaaaattatattgatctgtccaaatgttatttgctcaccgagtttcgaatccgtaaggaaaacgttaatggtcaacttgttaacctaactgttgacgatgcggatattgcgccaattcaaatgatcggacaaaccttcatccgcaacataaaaatgagtatcaatgggcgtgaaatttttaatgccaatgccctaatggcctacaaaacatatttctcacatgaactctcttattcaacgacagcaaaagactcccatttaaatgctgctgggtattacagggacacgggtgaagtgcttgaaacaggaaatggatgcatagcgcgacgtaatttgtttgctggtagtaacgttgctcaattcatcgccgaaaattga

SEQ ID NO: 45863 - DNA, 1877 bp, Heterodera glycines; identical to SEQ ID NO: 24431
  Genomic contig location: Contig_ID=SeqID_24431; Location=1..1877; Strand=+
  SCN-specific regions: Sequence locations=1-137,161-407,431-450,472 -965,987-1180,1202-1280,1303-1420,1444-1877
  Gene Ontology: Mol. function=microtubule binding; Cellular component =spindle pole; Biological process=meiotic spindle assembly

SEQ ID NO: 45864 - DNA, 812 bp, Heterodera glycines
  misc_feature (25)..(25): n is a, c, g, or t
  Genomic contig location: Contig_ID=SeqID_24437; Location=651..1462; Strand=-
  SCN-specific regions: Sequence locations=1-158,181-737,774-812
atgctgatgatgttaaattatatantttgttataaagcaagagccgacacggaaattatgcataaagcattgcataatttattcgaatgggcaaataactggcaaataaaagtttcaattcaaaaaacttttgtattatatttgggttcaaaaaacccaaaagaaacatataaatttgatggaaatacaataaatgctgtggatacaattagggatttaggagtaaacattgataacaaattacaattttccgatcatattaaccaaataacaaggaatgcgtatttacgtatgcgtccttgtttcgaataattaaatccaaatcgtctaagatttggattacgttatataaaacttatattaggcctttattggaatacgctccggaggtttggaatccgtctcttcaaaaaaatattaaaaaaatcgaaaagtgtcaaaaatatttcaccaaaagggtattttttaaatgcagccttccgccaattccataccaaaatcgattagaatacctgcaactgccaacacttgagaataggcgaaagctgtttgatctgttcatggcgcataaaattgcttatggccgaacagatctgaaactattttctatttttaatccctcaacgcgctttaacatccccttttacagatttaactcaaaatataaactgggcaaaaaattcattccctttgctgggagggtaacaaaattgtggaatcaacttgataaagaaatcattaaaataaattctttaaatcaatttaaaataaaacttaaaagttcactagggtaatctgtaagaccgggaaag

SEQ ID NO: 45865 - DNA, 685 bp, Heterodera glycines
  Genomic contig location: Contig_ID=SeqID_4635; Location=2808..3492; Strand=+
  SCN-specific regions: Sequence locations=1-252,274-283,305-385,407-685
  Gene Ontology: Mol. function=apoptosis inhibitor activity; Cellular component=cytoplasm; Biological process=embryogenesis and morphogenesis
atgattgatcgaaactcgccattgcacatgttcgtttttgctaatcggttagcaacttttgagggccgatggaactacaaagaaggatgcaccgctgaaaaagtgagcacattcgaccttagggttctactggactttgatccaggcctgaatttctcatggatccaggtcctggctattttttcagcaacctttattttactggacctggggttttactgggtacaatatggaatcaaggtccaggattatttttaaaatctcaaattctaacattaccaacattaagatttcttttttccaataaaaactgttcaggaaattcctaataaattaagccgatttattagtatgatttagtgtaacttttcagatggccagggcaggtttcttctgcactgagaagcgaaagaagccctctgacgcagcgaaatgttacatttgcctgcacgaaatgtattgggacccggaggacgaaccgtggttatttcatttttagtgaattcggcttttcactaaaaaaaacaacacattttccagggaagagcacaaaaagcaccgcccggactgtcctttggtgaccatcggcaaacaaaatgaggaggaattcactgtgcgcgaagtgctccttttgcttgcatatgaacacagcacgaaaatggttggtgccaatgccattgaataa

SEQ ID NO: 45866 - DNA, 582 bp, Heterodera glycines
  Genomic contig location: Contig_ID=SeqID_24455; Location=144..725; Strand=+
  SCN-specific regions: Sequence locations=1-513,538-582
taaaagattcaaagtatcagacgcttgccggtttggatgcgaacatctttgtcaagaatgcaccaccagcagcagcgccaaaaccgcagcagtcaaaggcaccgcaacaactcggtaatgggcaagagaaaccgttcaaattttaaccaaattcatgtctgtgttcccctctttttcagtaaaagattcaaagtatcagacgcttgccggtttggatgcgaacatctttgtgaagaatgcaccagcaacaccagcgaaggcggcaccgcaagccccgggtaagagcaatggttttttgtgtttcatctccaaatgacatttctatcctccccttttcagtaaaagattccaagtatcagacgcttgccggcttggacataacatctttgtgaagaaatagttgccgaagtgcgtatatgatgagaatggatgattgaccgatgtatatatttatatatgtcatatgatgtatttctctctgtttttggttgtatattcgctgttgtacagtactatatatatacatatgtgttcctaactcataaatattattctcaagtgtacaatgtgcatttttgttta

SEQ ID NO: 45867 - DNA, 686 bp, Heterodera glycines
  Genomic contig location: Contig_ID=SeqID_24458; Location=767..1452; Strand=-
  SCN-specific regions: Sequence locations=1-137,159-590,612-686
tttgccattcgtcggatgcccaaagtaatttaaatgattttcaccccccccccccacctctcaaccttaggacaggaccaaatcatcgcggacttaggccgtctcattgtggaaaactgtccgccaatgctttgcacgggcaagtccatccaagacttttcaactcaaagtcttacgagtgattgtcaaattgttcagggctcgactgtgccgtggtaacggaacgcaacggatgccaggtaaaaggcattggtcaaagcgtgccaaagtcagttcattcaaagctttgtgcgtgtccaatcgggtcgcctgcccgcggctgcgacccaatgccatttgttctttggcacgatttaattgtcaacggctgcccaaacattacggtgaacacgcgcgactcggcacagaaagtgcaccggtggttcagaagggtaaggcattgcacttaagaagtgccattggctaatgcacttccatcccaaggtgaacagattcagcaacactgaccaatgcgaggtcagtcaacccctcgcccgcccaaaaaatgccattccccgtgccgtcccttccattcattcacccttccgtccgtttagccttacattttcccctattgtcctgaactcgacttcaacctttggcgttctccccgcactaagcaggagtgcgagttggtcagttagctc

SEQ ID NO: 45868 - DNA, 1555 bp, Heterodera glycines
  Genomic contig location: Contig_ID=SeqID_24474; Location=323..1877; Strand=+
  SCN-specific regions: Sequence locations=1-297,319-360,382-416,455 -570,594-862,943-958,994-1109,1131-1376,1399-1415,1438-1555
catatcacgctccaactgatcttcctggacggggaggaagcgttccacgagtggtcccacttggattccatttacggggcaagacatttggcggacacgtgggagcgcaagtggtacccgagcaccgatggcagtgcgtttgagctcagccgagaaattgatcgaattgtaagggataatcggatgccaaatcagctattttgagaggatttggaagggggggggggataatcctaaattttattatgaattttactgacctctaactcagcccccacccccctaattctgtgcggttatttacctctgtcactttcttcgttggggtatataatctctttttttcatggttactggaaattttgatgaaattcatcaactaaaagagctcaaaaaaattaatttgaaaatcgttgaaaaaataaaataaaaatataatttaacaattttaattcgtcttaagaatgtaggatgtcttggtgcattaacttcccatctttcttcactttttgcctgagatcaatttcctttttattagtttcatttttttaattatgagcggagttttactattataattttttaaattttttctcaaagccgccttttcgggggagcaggtgctaattgcactttataatgataattagtagggttcgaagttgtatgcactaaaaaatgccaaatatgcttataaaatatgcactaaaaaccggaaaaatgcccaaatgtgcactaaaatatgccttaaaaattacccaaaatagcttttaaccctcaaaaaaatgccaaaaattgtgtataaatagagaattgactttgaaaagaagacaagggctgggagcatttttttgacaattgcaaaaatattgaatttctaaatttttgaatttttattatatgctaaaacaaaattacatttttatataaataattttttttccaaaagttcttacagaaaattaaaaaattttcgatttttatttaaaatttccaaaaagtcgatccttaggggtgtatttttcgcttttttcgcatttttcttgtgaaaatttgctaaaaatgaccgaaatatgctctaaaagcccaaaaattgcgaaatatgcatttattctgaaaaccccaaaaatatgcttttatatttcaccaaatcaaaaaattttaacgtagaaatgctttttttgagtccctttcttcatagcatatgcgcagaaaaaatatgcaaaatcatacaatttataaccctaaaaattagtaattagcctcttaaattcaaaggatgtctttgtgctgctggatttgttgggtgccaaaaacccgcacattcaaagcgtgccgggccatggtgcggcctcactgtttgaacaactaccgtacactggtgagaaaggggcttcagctactgtaaggtgatgataataattttttaaaattatacagagggacagttggcctaagctgaacttgctgaaccggatcccgagaatattttatccgggcacttcatactttggagcagttgaagatgatcacctcgctttcatgcggaagggta

SEQ ID NO: 45869 - DNA, 1258 bp, Heterodera glycines
  Genomic contig location: Contig_ID=SeqID_24485; Location=358..1615; Strand=+
  SCN-specific regions: Sequence locations=1-134,170-195,217-652,674 -822,844-875,905-1034,1056-1258
  Gene Ontology: Cellular component=exocyst; Biological process =synaptic vesicle docking
atatttggaggcttgtcgtcgtcgggttgtggacgacttgcgcctcgtcagaacgtcgctttctgcgtgttttccacccgagtacaacatttacgatcgatacgtcaaatattatcatgacagtatatcacttcatgtaaaaatggtatttttaaacccaattttttaaattgaattttagatcaagaaattagcttccgatgcgcttgaaaagaatgaacttgtgcaattgctcagttggatccaaagctatacgtgagtgagattacttttgacaatttacattaaaccggacacgccgaagttcttggataataatcggaattgttgatgaaatttttttattttctgagatttctttgtcattatcttgtagttttttaaatttataaaattgccttttcttctcgtacgaattggtccctcttcattctatgatttacaacataattttagaggggagcaaatgttgggccatcccaaattgggaatccaagcgcaagcacttgtccacgagtttccattgctacccaaatcgaccaccaatcatttgcacgaccgattcatcgaaatgactcggagagatatgcacgaatggctggacaagacaatgatgcaggaaaaagacgtagtgaaaaaaaaaatctgtggtttaatttctgtatttttaggattggtataaacaggtgccacccgagacggacagcaacaaattcttttacactcagttgcccagcattttatttggaatggtcgaggatacggtgagttcgctgttcgtttttgagtttaattccgcgtaattttaaggtgtctctttccaaagaaatttcccaagaaattgttccgcgagtgattgatgttgccgtcgatgagtttattattttttcaaacaaatacaaagaggcggcaacggcgtacaaaggcaaacactttgaggatcggtcgcatttccaaagttacacttcgacagtggtgggcattggcattgattaaaactcactaattgtagaataaaagtgcagattgcaattgccaataatttggacatttgtgtggactccactgacaaactcgaaaagcacattcgtcttaccatggaaagcggctccatcgacggcctttcctcgcccgaaccgaccattgcctatggccccccttcagcacgttccgtcggattttctgtgattaatcgccaggagttgattggaaaaatggagcagctgaagaaaaaatggcaatttggcattcaatttgc

SEQ ID NO: 45870 - DNA, 1152 bp, Heterodera glycines
  Genomic contig location: Contig_ID=SeqID_24497; Location=115..1266; Strand=+
  SCN-specific regions: Sequence locations=1-448,470-1152
  Gene Ontology: Mol. function=cytoskeletal protein binding; Cellular component=cell-cell adherens junction; Biological process =intercellular junction assembly and/or maintenance
cctcattgcgcgcaaaggagcggcgagaaatcgagcgactagaggaggaggagcgagagcggcagcgacaggacgaggagagacgagagagggaaaggcgcgagagggagcgactggaggcgatggaacgcgagcggcagcgacaattagaaggtcttaactcgacaatggcggaaaaagctcttacataaatcactgtagaacagcgcgaacgcgaccgaatcgctgctctcgaggcgtccgccattgaaaggcgagcgctccgtgcgcgtgaagagcagcgggcgcgggagcgcgcggatttggacagacgcgcggaagagttgcgggagcaggaaaagcgtgaacgcgagcgcagggatcgcgaacgggcagaagaggagcgacggctggccgaactccgtgaggcggaacagcgcaatgcggggcaacgcgaaagggagcggcgcgaggcacaggagcgcgaggagcgtcgtcgaaatgagggctggcgcagtcgcgaccgcttggagcaattggcacgcgagcgggacgagcgagagcgctgggaggcggagaagcggcgattgctggtgcggcattccgcccaatggcacataatgcataatcaccattccttcagtctgactacgagcagggagcccgcaagcggcaagaactgacttccaaagagacgcttgagcgtctgacgcgcaagccatactattcgcgcgaaaatctgacccaactcggcacgggcggagagccgactgagtaccgcggcaaaggcattgagccgccggaattcaccacgaaggtcggcgaagcttcgtcttggcacttaccatttgtccattctgtgccaggtagaacgacaagtgatcgaacgcgtcgaccgcactttgtggacagagccggagacgacgcgcgtctccgccggattgcctccggcgagctccgcctatttcggcaacaccggcggcatttttccgtctctgttggacgcatcggaagaaagcacgcgcgagcgcatgtacaacccacgcgacgaggactttctgcgccgcgggggttcacaacggacgtcgaaataccgcgcacgaatggaaaaagcacggaaggattttctgcagggaacgggcggaggcgcggaacaatatcagccaagtgcag

SEQ ID NO: 45871 - DNA, 762 bp, Heterodera glycines
  Genomic contig location: Contig_ID=SeqID_24504; Location=58..819; Strand=-
  SCN-specific regions: Sequence locations=1-214,246-499,521-619,642-762
  Gene Ontology: Mol. function=protein phosphatase type 1 intrinsic catalyst activity; Cellular component=cytoplasm; Biological process =cellular morphogenesis during vegetative growth
atgggctacccgtcgttcaccaaatacatgttcctgggtgacatggtcgaccgtggcaatcaaagtgtggagacgattgtcctgctgctgctctacaaggtgggtggaaatgccgtgccgcgggagggagaatttgatcattttgcagggccaatttacctcccccccccccaattttaaggtgcgctacccaaccaaattctatgtactgcgcggcaaccacgaatgtgccagcatcaacagaacgtgagtgctgtggtgccgtcccatgtgtcacattttaactctcaatttcagcaaaaaacaaaaaattttcccccattttcagatatgggttctatgacgaaataaacgagcgttatggacaccacaatgtgcggcctctgtgggagcggttcaacatgacattcgcctggcttccgttcgtcggattggtcagcgactgtattctgtgtgagttttttgccgttgatcggctgtctgatcgatcggacgaactctaatccccccacccttttttaaggcatgcatggtggaatcgcgccggagatgaccaacattcagcaactccgcatgctgcgccgtccgtacatcgacccgccagttccgtccctggagctcgacctgctgtgggctgatccatcaaccgctgtggaaggcacggcacccaacccgcgtggagtgagcatcctgttcggtgccgatgtcgtcgccagtgtttgcaaaaagctcaacatcgaattggtcgtccgcgctcatcag

SEQ ID NO: 45872 - DNA, 633 bp, Heterodera glycines
  Genomic contig location: Contig_ID=SeqID_24515; Location=445..1077; Strand=+
  SCN-specific regions: Sequence locations=1-295,327-334,356-633
  Gene Ontology: Cellular component=nucleus
cttatttgacgatgattgacaacgatgcgccctgttgcatttgcaatggtaagcaagtttggattcacaactgccggcttgcaattagcgcgaaaaattggcgcatttgtgcgtaagaactcaaaaggaggtggccctttcaaaaaaatttttacatgttgttcacaaattttctgattattttggataaggcgttcgaggggcgatatgttagaaatgtgccgaaaaatacaatcaaattccggtaaacaaaatcgcattttctttttttttgaaattgaccccttggggtttgaaaattattttttttttaaattaaatttattctttgctaaaaaattgttcactttgttttcttcataattcgtgtttagacggcgaggacagcaatgccaatcagatcattttttgcgatatttgcaacattgctgtgcatcaggttttctggcacttttcccacgctcaactttctgtacgattttttttttgttgccaggaatgttatggcgtgccgtacattccggagggccaatggctttgccgtaggtgtcaaatgtcgccgtcaatccccgtcaattgtgccctctgtccgtgcagttcgggcgcattcaaacaaacatcggatggtcgctg

SEQ ID NO: 45873 - DNA, 4168 bp, Heterodera glycines
  Genomic contig location: Contig_ID=SeqID_4655; Location=599..4766; Strand=-
  SCN-specific regions: Sequence locations=1-194,227-743,768-851,883 -912,934-973,996-1399,1421-1650,1681-1749,1772-1990,2012-2119,2141 -2382,2408-2415,2456-2479,2508-2549,2571-3014,3037-3334,3356 -3864,3887-3993,4036-4168
  Gene Ontology: Mol. function=transcription factor activity; Cellular component=nucleus; Biological process=regulation of transcription, DNA-dependent
atggcattttacacgggcgaagcaatggcgacaacgacggcactgattggacggcaccagcacaacagccacagtaacaacaacagtaccaatggagaagctgaccgtagtaatggcaccggcacaactgttgccaaaattggctcaccatcagcagcagcggtggagcagaaacggcacaacagtaacagttctgtaggaagaggaggaggagggggaacagcggcacagacagcgactggtggtggtggtacggtagcggcggcggcggaggctaccgtacgccttcagcaccacggaatggagagaagggcaccagcaactggagcaggtaaaaatgggggacaaaaatgcagaaattgggaatgaagctggcgaattaccccaaaaattttggattggttcttttcgagacagtgtcgagactcgaaatagggatataccgagactcttgaggattattagtagagagcggtatataaattgggtgtaactccgacacccggcagtttcggtaccggtattccgattttttaaatttctggcacaaaaattctgaattttttccctaacccttgcccccttcaattgtcctaaaaggactgaatttgtcgatggcaaatggcggtgcgctgacgccaaatggggcagaggacagcggcagcgttaccagcaacgggacaacggcggatttgcaagtgaaagaggaggtccgttttcgagcggcggggctgcatatgccgtttggggtgatttttcaaattttagcccttttctttgtcggtcgctcatcaatcggtcgcactgagctgtgcttttcaacaccctaatgatcagcagagagacagaggtaaaattctaattttaaattttaatttatttccaaaatatattttgaaagtgtgccaaattgcaaacattttttggcactataacctacgcgtgctcgtattaattaaaatataaatgtcaaatgttggttgcttctgtgtttgagccaccatttccctcacttttactaattggcaaattaacacttattgtcaattaccgataccataaagtttggtagaatttttttttgatttccctcaaattttttggcattgtgtgccctccgcccaccctcagcagctgaatattgtatgcgcgtgtatcatgtgcatgtcgttggcccatcatttgtggtattgtccaacgaatgcgggaaaggggggggggaacccattgccaatgccgtcccctttgtgccattcatcccaccgccgtgccgttttctcaagactctcgacgacgggacaattaccccctcccgccgcagccccttattggctggagagtggggggcactctttagcgatgggcttttgtgcaacgattatccctccccccttatcggcctgaggggacagaggcaaagagcggcgatgcttttcctcccccccagggcaataaaacgggagggggggggggtatccgactgaattttaaaatagtgccaccgatattggcatgagatttattgggccaagtcaccacatcatattgcatgtctcagaaaaggaccaccaaaaaagggggcgcacaattttttatgtacggcataccgtatatgcaccaacaaaatgccaaatttcgtatcagctcaaactcctctcccctccctttcttcttttgtttgtgccgccgattgggccgcccgtccgtgccttcggcgcactatggccaattttgttgccattgttttcagctcgctccgggagagaggcggttggccatcgcctccggggtcgagattctcgacaacttagtcctttcttcctctcttaattaaactttgcctccggctgcgatgggtgccccacgaaagggcacatcattcaattgttgttttgttggcaaaattcaatttggcccccgtcggtggtgccccaccattgccggcgggccgtgccgtcgttatcggcacggcagcagagccaaaagtgagtgagcggtggtggtgccatgattggctgcccgacagctctgcggcgtcacaattgtgggccaagttttggggcaccggattttgttgatgaactcctttgatgcatggttcagcgcttctacccccaagcctcccctaatttgcataatttggcaccggattttggtccagtcagaaagtccttaagtcaaacaacctaagtagtataaattgagaaaatctgttgaaaagtttgtggaaagaaaatcagagagagagggggggggggatttgtaaattggtaatgaaattaaaaaaatatatttggcattttatgtaagacagcaaaaaaataatcttttttatccattccctgaaattaaatttttaaaagaagatatattcagattaattttgaccttttcatttgttttctgttcttaaccttttattttacatataaaatttaaaaaaagaattttaaatcttggcacttcattatgaacaaaatttctctcaattttatattttaatttatggcatttgtacaaaatgccaattttgctcccgaggacggactcaaattaatccacacaatgcatgcctaattgttttttcttggcattctgctgacctcccctcccagggcaaaatggggtcaaacgccaacagattgttgtgtgtattgcccgagtcttcccgagaatgggatttgcattaggttgagcacaaggtttattgtatgatgtgttgtggcgttgtgtgtccattggcaattaacggtcaaagatttgggcattggtacggtaataattaataatgtgagcgattagtcaccgttccctcggacacaaattagggacgcgcgcgcgctccaaattcgctgctaattaccactgctgtgtccattgatagatggggccactgatgaagcttaaaaggaggactaaagagagggggggaaggtgaaccgtgtcgggattttgagcatgccaatcaacgaaaaattaatggaaaattggaatttacatgaaaagaatgaaagaaaattaaaattttttataaatgttagagaatttcgcaaaattggctagggattagatttagtccaggaattcatcacaagcagaacattggcatcattctttgggaaaaatcatggctctcagtctcgagctgagtttcttttggtcaacaacattggtctccattctcggcacccagcctcgggtctcggggccacacatttcgactccctgaaaaacaaaaactctgtttcaaaaatccttagaatttttagtataaaatctcgggaacaattcttggtgtccatcccgatcccgagtattctcagtatatcacgactctcttggtcaactctcttgttctgccgtgccccgctagctttttgagaaattaggaaaatttcactatctctcttacagtattagtgtaatactacagtaacccattttcacagaaaatccctatgaagtgctgggcccaatttgcagtcggctggccgctgcgggcagtggccaaatccaactgtggcaattcctattggaactgttgtccaatccgctgaacgctgaaatgatcacctgggagggcacccatggcgaattcaaggtgagaaaaagtgtcaagccttggctaaaaaatccatttctggcggagggggggggggctacccgaaaattttcgatttttggcaaggagggaggaattttgattaaaaattagttcgtgtcacgaccagagacgttccagggttggccaaaaatggttcggattttgcctttgtacgagttgtcatgacgccgggatttgaacaagaaaattcgaccctctttaactttagctccccaatccccatccccctcctaggctagaccaaaattttttgaaaatttccagctttgcgagcctgatgaagtggctcgacggtggggcgagcgcaagtccaagccgcacatgaactacgacaaaatgtcgcgcgcgttgcgctactactacgaaaaacagatcatgagcaaagtgcatgggaagcgctacgcctacaaattcgacttcgatggtaaaaaccataactcctatgcttatcatgccactttttcaatggcattatttcggacaatttttttgtccaaatggttatatgatttgctctgctgcggatggcaggcctttttctag

SEQ ID NO: 45874 - DNA, 660 bp, Heterodera glycines
  Genomic contig location: Contig_ID=SeqID_24553; Location=189..848; Strand=-
  SCN-specific regions: Sequence locations=1-531,553-596,619-660
atggaaagaattcttagccaaaatatttacaactttctcctaaaaaacaataaaatttcggaataccaatttggttttgttagaaataggtctacgacaagtcaactaataacagttgtggaagattggtacgaggcaattataaatggaaaaaatgttgactgtatttatattgattttcaaaaagcatttgactcagtgccccataatttacttttatacaaattggaaaaaattggtataaagggcaaacttttaatgtggataaagggctttttgagtaataggacttttcgagttaaaattggggattctttatcctcaagtaaaaaagttacctctggcgtcccccagggctctgtcctgggccctttattatttttgatttatattaacgatcttcctgatgccttgccatcaggagtgaaaataaaattatatgctgatgatgttaaattatatatttgttataaagcaagagccgacacggaaattatgcataaagcattgcataatttattcgaatgggcaaataaatggcaaataaaagtttcaattcaaaaaacttttgtattatatttgggttcaaaaaacccaaaagaaacatataaatttgatggaaatacaataaatgctgtggatacaactagggatttagga

SEQ ID NO: 45875 - DNA, 754 bp, Heterodera glycines
  Genomic contig location: Contig_ID=SeqID_24567; Location=1..754; Strand=+
  SCN-specific regions: Sequence locations=1-101,128-476,498-754
tgtttcggtgttcggtgaaggggcgaagtgtccgtgcgtcgaaatgctttcaaaggggcgaatttgttgtggagtacaaaggttttccgggcaaaaaaaaatgcatttttatttccaagttttttgttcatttaggcgacttaatcagtgtgaagacggcccaactccgcgaacaacggtatgccaaagatgagaacgtgggctccttcatgtactactttcggcaccgggacaatggtacggattggatcatttgtttttggagtcgatatttcgaacaatttcgaagtcgaacctaaattgttacgggtccaaatttgagacactacctttgtttcaaaattttagggtagtttaggccgatccattatgaattttaaaccgattttggacatgggcacaagtcatattttgtgtaaacatcaaaacaaattttagtgttttgtatcgacgcgaccgatgaaacgccgtacaaaggccgactgatcaaccacagctatttgaagcccaacctcaagacgagggtattcataatcgggcggacatgtttaataccccgatagtttcttaatccgctccatgaactccatattttcttcccaattcgctattttgccaggtggccgacttcggctgtgacggcttccatttggtgctcgtcgccatgcgcgacattgacaacggcgaggagttgttgtacgactacggggagcggcggccctccgtgctggcggttaacccgtggattttgggc

SEQ ID NO: 45876 - DNA, 2043 bp, Heterodera glycines
  Genomic contig location: Contig_ID=SeqID_4672; Location=381..2423; Strand=-
  SCN-specific regions: Sequence locations=1-1769,1791-1907,1929-2019
  Gene Ontology: Mol. function=casein kinase I activity; Biological process=signal transduction
acttacaacatcgcctctcttcattcaacagcagcgccaacttaccccacagagcgacagcgacacatggcggatgagcttgtggcgcttgcaccaggaacgcgtgtctcaggccgatggaccatcctaaagaagcttggcgccggagcatttggagccgtctatttgtgcaaagatggcaagggaacagtggcagcactgaaaacggagccaatcgacacacgtcaaccgcttcttgttatggaggtagaataatggatgttttaatcaaaaatttttgtttttgttttaggccaccgttttggacaccctgggcaaaaaacttaagaatgctgatggtcaacacttctgccgtctgttggaccttggacgtagtgaacaacggaatgctacgtctggagatacggtgttcaactacgttgtgtgagtctttgctctgattacaaatcgggttctaacatgttttccacttttagcatgactgtggttggcactccgttggacaaacttattcgagacgcgggcgatcgcttcagtccgggaaccgcaatcggcatgtcaatccaattgctgagtgccatcaaggctcttcacaatgtcggttttcttcatcgcgacatcaaaccagcaaacacagcgattggacgggcggagaccaacgaacatcgacttctctaccttatcgacttcgggatggcccgtcaatttcttcggcccgatgtgagttgcagacagcttgatgaattgccaaataagcccaacctccccattttacagggtacgcagcgacgtccgcgagcctccgcgaatttccgagggacgccaatttacgcaccgatctctgcacatatcaagcgtgactacagccgcaaagatgacgtcgaatcgtggttctatgtcatggtcaaattctacaaaggtgctgtcccctggaaatttgcgaatgacgtcaaggaggtgggttcttggggaaatatgattaaattaacaaatccatctacagatcggaaggatgaaatgtcgccgcatggaagggcaaccggacgaaattcgacaacaggccatcacagaactcattggagggtgtccgccggaattcacccagatacttgcgcatattgtgagtttttacggtttttttttttgcgttttaacaattacatttttcgcaggatggactccagttggaagaccggcccaattacgagatgattgagacgatgctgcgtgagcacctcacccgaagccgtgttccggagcacccgtacgactgggaagtgggaaggcgcaacgcgatggcacaagcgcagagtgaggcagcgaggaggaagaaggataacacgaaagaaggcggaggaggaaaaaacaacacgcaaggatgagcccggccctggtctgatcgtatttgctcgccattgtacatattactgtgcctgtctgatcataattgctcgtcattatacataatatgctgtgatcagttcttatttgtcctgtcttaaacttatcattgacttgtgataaaattttattgattaggttaattttgttattctccgatcgtggtcacctatcccttgttcgaaatggatgccggattcgtgatcaacgaccccgaaaaatcacaaaagagacttgtttcatgattagaaaacaaaaaaaacttggttctagtcggttttacgcgtcacaaaaacagtttttttcgaaccgtcaatcgaaattttataccttccgaattgattgtatactttttaagccattgttcgagttgcctgtgtataagttgtcatgataaccttaggtttaacaacgaaatttttagttaaaaactttactgaatacctgacaaaaaaaagtttttctcagttattaggacaactataataccatgagaccagggatggcacggaattccttggggcatcggaatgccatccctgacatggacacaaaaatgtgatgggacgcgtaaaatgccatgggacgcgtaaaaccgactagaacccatttcttttcatatttttataatttgtaaataaa

SEQ ID NO: 45877 - DNA, 2132 bp, Heterodera glycines
  Genomic contig location: Contig_ID=SeqID_4673; Location=120..2251; Strand=+
  SCN-specific regions: Sequence locations=1-577,599-1024,1047 -1366,1388-2132
gaagtactcattgaaccaatcgtcaaagagtctgaagaaggtgcgatttgctggcgtttgttggctctgatcgaagaggaggccgaccttcggcgtctgttgctccgatctctcattttcctgcacaaagataagagtttgccgcctcggctggtccctcgtctgttgagccgctgttccgcaaatcccgagctcacttttccctgttggatgcttttgagtgaactcagcaaatttctcgacgtattccgtggagatagttttttcattgtttgtccattttcatttttcaggtgtctcccaacgaagctgtcagttattggtccgattatctcacgctcactcaccaaaatcgtctgatcggatacatggctgatctgatcgccaaccgagcaaaagttctcagttttcagcagcgccgttttctcagggagagtgttagcggagcattgcagcaattcaagtggactttcctctggtagcgcttctgcacaaatcccgcttttcctgttgaaggatccatcccacttacatttcctctgtgtatcatttgttcgcccgaattgtcaatggaattggccaagacgcatccggaaaagcggaacttaccaagttcaaccagcaatggtttagcaagtgtctggtggagttggacttgttggtctatgccaatgcaccgcccgaggtggacgatgccgaatcggtgaacagtcagggcagcaacagcaccgaactgccgggcagtcaaaggcgagcgagtcaaatgtgacgaacggagtgaaaaatggaatttaagtgacaattgcgagaaaatcattcggctgatcacttccatcggcgagtgccttcagtacacgcccgcactgatcaacaaacaaatagtgaaccttctccaagtgatcatcgcgtcggatgtgctaaatcggatttaccaagcgcacaacgacaatgaacacggcggtgagcacttttaacgcatgttttgttcatttctctcctcgttaagacaaattgggagtcccctccccgcagcgtctcttctctcccaacacttcgttccacacggaactgcccgcggacggccccggcggcactcagtccaacgcggcgagtgaagcaggcggtgtcgctgccagtgaccaaaaccagcgacactttcacatgcgcatcaaaaaacgcattttccgcggagaattgatgagccgagaagttcgcgccagtggggtgctcgccattggcaaactgtgccttttggacgaacagttggccaagaagtgcatccccgtgtttgtgcgacaattgcgagaaaacccggaccattttgtgcgcaacaatatcgtcgttgtcatctgcgacctttgcattcggtgggtattttcccaatttaatactgcataattaacgcattaatcggaatccctctcatcattgtagttacacttccgaagtcgaccggtacagcaccattctcgcctcgtgcctttgggacagttccattctcatacgccgccaaacgttgctgctgctcaccaatctgatcaaagaacagtacctcaaatgggaagggacggttcgtctcgctgtttctttattcggagaattgcattttgattcgatttaggtcatttaccgttttgtgaccactcttttggacccagagcagtgcattgaagaatatgccaatttttgtttggtattttattatttcgttcgttttttatgtttcattttacagacggacattttgttgccccaatttcgtgagcggatgttcttccatcactttttggaatgcatgttcaatttcaacggagttcggcatgtctcttggatccccagcggttgggtgaattcatcggtgcctttctaattcattttgtgccatcattctcagctggctatgaactgagtgaagaggtacaaaagcgttgttccctcgaaggtcgcgaattgttcgactcgcgaatgcgcctttacaaatatatggttttgctccgtgctttatactttacagcaaactgtttcagctgaacactttcgaagaccaacaaaaggtgtacattttggagaagatcggtttggagatatttgtgccgatcgttgagggtcgactgaaactttcggatgtgaaa

SEQ ID NO: 45878 - DNA, 2325 bp, Heterodera glycines
  Genomic contig location: Contig_ID=SeqID_4676; Location=175..2499; Strand=-
  SCN-specific regions: Sequence locations=1-324,346-361,383-495,533 -901,929-959,981-1780,1812-2325
  Gene Ontology: Mol. function=transcription co-activator activity; Cellular component=nucleus; Biological process=histogenesis and organogenesis
cagttcatttttaaagttcgtttctgcccctcttaagaattggccctgtcaatgttttccaccgtttctccctctcccctaccgccggcgatcgtcagcaatgagccgatctttttgaataatgcccagccaaaaatcgctttatcacaaaatccaacggcggcgagcatagcaaacaacgaagtatataataataagacaaatggaggaacattggcatttttataaagaaaacactcataaaaggatgaaacggcggccgattcccaccggcggaaccaaagaaagaagcacttaactgatttataagcgcaatggcaaatgtccctccctcccatacatttagaggatttgttcatctgggtaatttcagtccctttggctctttagctacagtcactttttaattgaaaagatttactaaacatcatcttttctgtttccgatagagaaagagagaggagtaaagggggggggggggagaccattggacccattgcattccaaaggaaaaaatgtcttcctttttaaacttcaattatgattttgctctagggtaggtgcttttttgtgttataaataaaaattattgtcaacttgtatttttaaccaaaacgtattatatgattaattattggcttgtaaaagggaatggaagcaattgatcgttgagtgatcagtgagaatgagtaacccctcttccctccccaaatcttcaaaatgccgccgcctcctccaatcgaacgaatggcaatttatgtgctgcctaagaatgcagttttcagatccgacaagatctgctcgaatttgtgctgggcggagtcgcctcaactctttcgcccttcgaccgctcgcttctcagtgccgcaggctcagtccaacctttggagacaccgatgctaattcaccaccaccagcagcagcaacacaacagtcattgtcagtcgtaccatcagcagctgttgctgcttcagcaacagcaaatgaacgcgacaggttggaaaggaaggcaattttgtagtcaattagcagttgtgcagctgtcagttgccgaacgtcgtcgccctttgtgccttcccttcaaaacgaaatgccttgtgccatttcgtcgttgtccaattccatccatgccattgcgtcaccgtcctcccactgttcctccgccgcttacctttgctcaaattcggccgatggtcccccgcccgtttcgtctgcccctttttcatcgtccgccactctctctcctccgcttcttccgccgcttctgctccattcgccattgctgatcgaagcactgaacactgctcaccagcagcaacaattgctccaatcgccgctcgtccaacaaatgctcatgatgaacagcagcaaaacgctcgaaatggcagcacaatcggcgcaaaccaaaaacagccaattccatcaatgggaatggtccatctcggaaaggtgtggctgagccaaaaacgtcatgccaaaattgaaaactgcctcttaagctataaacagcaactcgccgaccattcgccattggaatgcccgtctcccgcctcctccctttccctctccaatcactccctcgcagtgcccccgccaccaattcgactcggctcaccacccaccccaagaaaaaggcgcaatttggcatcaaatgaggatgacgcattaaaaaacaacgaaagtgctgtcaaaatggaatttgatgagggaacaaagggaatggcaaaaaacagcaagaacgaagaaagggaagaatggagagagccaagcgaagaccaatttgaaaacatggagcagcaaaaggaaagcagcctaaaatggacactgattgaggaaagaagacggagtgaagtgcaagtccaaaatgaagcgaatgagcggcataagccgcgcaagacactgccccatttgctggcacggcatcagcaccgatgtgcccatccgggatgcggaaaggcgtacagcaagtcgtcccatctcaaagcgcacttgcgaacccacagcggcgaaaagccgttcagatgcgactggaaagactgcgggtggtgctttgcacgcagcgatgaacttacaaggtcattgcgcctcaagaaaaccattggcaaattcagaataatgctcaaaatgccttagtttataaaggacggagaatcattatttttaaaatttttctcgtcttaaaatgtatctgtcacaagtaaaattgtcattttcaggcattaccgaagacacaccggttatcgacccttccaatgcgcctattgttccagtgaaatgcgatttgctcgttcggaccatttgaaatcccatgtgaagaataggcat

SEQ ID NO: 45879 - DNA, 1646 bp, Heterodera glycines
  Genomic contig location: Contig_ID=SeqID_4709; Location=1857..3502; Strand=-
  SCN-specific regions: Sequence locations=1-169,412-617,752-846,886 -915,995-1143,1244-1246,1405-1408,1443-1448,1470-1646
agatagaatgccaatgctttttgccaaccacctcttccaacaaatgtttttgctgtttatgatctcatctttccatgcccaattggttgctgttgataatttaaatccgagacctcgacaaattgtcaatgaaggtgatcaaaagtttatattaactccaaaaaatgagatttatttatttttattaattaaattaatttatataataataaataaaaattacttttaaatcattaaacttttgcattaataaagtttgtaataattctgttaagtaataattttcttaattttctaaataattaaaaaataaattaaatttgcttgaaataattatcttaattttctaaaatagtaatttaaaaataattaatttatttaaattattccaataataattatttattttttgaatattcagttgggagcactccacgctttcacagcccaagcaaaagtcaagaccaatttttgttgatcgatgcaaccaaaaatttcattctgatcggagcaaggtagaagaaataattgtaatgaacatttaaataataattgttttttacttctaagagatgcattattcaatttgagctactccaatttggaatccagaaatgtaattattattaattagttaattacttttaagttatcaattgacagtcattataattagttaattatttttaattctcaacttacagtaatcattttcattaattaattttcttgattactttaattaatcaatgggcaattatcatttttgtagagtattcactggaaagcaccgggacagaccattgaggaatgccatatgaaaggcaaatcggaagtaaaaatgccattttatactaaaaaataaataattttgtttatttttaagacagaatgtcgtaactttatcaggcaagcattttattttaaatttaaatttaaaataaataatttaaaatttttcgaattaacctaaaaattttatttatttttttttgtagagtggccattcaacttgcaaatggccaagtgttggtctgtggaacacatgccttttcgccacaatgtcgccaatatgaattcagccaatctgagagtcgttttgtggaaaggtcccaattcaatggacaagtgggctttagaaccaataatttttaattaatttaaaaaattttatggaaaatttttttattaatattaaatattttacatcaaatttaatttatatcaaataatgataaaatttcaataacttattttaacatcttcaaatataaattaatattattaatttattttattaccaatttctaattaaaatattataatttttgattaaaattaatttacttactatattaattttcacaacttataatttaaataattatttgtaatttaatttaaaaccttaaaattaaatgaatattataatttattttaaacatctctggttttaaatacatttattaagggaatttcaccgtatgatccacgacaaaatgccacattcgcctattccaatgaattgaacgccatttttatcggtgccatctccgattttagtgccaccgacccgttgatttatcgacgaaaattgtctaatggggaaacaatgcgaacccagaaggacgatcgagtgctagatg

SEQ ID NO: 45880 - DNA, 391 bp, Heterodera glycines
  Genomic contig location: Contig_ID=SeqID_24766; Location=184..574; Strand=+
  SCN-specific regions: Sequence locations=1-30,52-60,100-117,156 -267,305-391
  Gene Ontology: Biological process=cell cycle
ttattccgttttgcacaccggatcattttgaaacaaaatataatgttccaaattttcgtcaaaactctcaccgggaagaccatcacccttgaagtcgaggcgagcgaccccatcgagaatgtgaaagcgaagatccaggacaaggagggaattccgccggaccaacagcgcctcattttcgcgggtacatccgcttgatatgccaggatattaaatgtttcacgtaatccttgtttttagggaaacagctcgaggacgcacgcaccatggccgactacaacatccagaaggagtcgacgcttcagctttgtcttaagcttttcgggggcgcaaggacgggcaaaacagcacactactctcggagcgtaagtcatgattatcataaaaggcc

SEQ ID NO: 45881 - DNA, 647 bp, Heterodera glycines
  Genomic contig location: Contig_ID=SeqID_24776; Location=1057..1703; Strand=+
  SCN-specific regions: Sequence locations=1-88,110-157,227-330,363 -363,386-647
atgaatgtaactgttggcattgaaattctttacgtgccatttggaatttcgatttttggtcttcttggcaatacggtcgctttcttaacaattattctctctgatcttcgaaaggtatttaaaagcacgatgaaactcttttgcatttgaaaaaaggaaataatttaaaaaaattatttgttacaaaaaaggaaataaaattttaaaatttatctttttatataatgctctgcaaatgaaacacaattatccaacccctaacctattgttttaaattttcggaagctcatttccttgtggacaaaaggtcgtccttggttcaaatattcctattaattaattactaattaaattttaaatttcaaatgttaattgcttttctttctcagaattacgtgaacatttaccttttggtgctgctctgctccgactctgtgcttcttctcgacattttcgttcagcctttgttccgtttcgacgtgctcactttttggacatgcgcaatcaccgaatatttgttcaatgcttccgcttttgtgagcagttttgcgatcatttcactcaccggcgaacgctttttctccatcattttccctctccgacatttaaaggtccatttttatttagattcatttatttatatttaa

SEQ ID NO: 45882 - DNA, 1053 bp, Heterodera glycines
  Genomic contig location: Contig_ID=SeqID_4726; Location=1598..2650; Strand=+
  SCN-specific regions: Sequence locations=1-506,528-643,667-756,778 -848,870-984,1006-1015,1037-1053
atggagctgtatttgttccgtcccactgattaccaacgactttacaattgttcctcgtacaaaattgacgacattccgcttgttaaccgtacccataccgtactcggcatctccttcatcatgcagttcgtgctgttccaattgtgctacatcccttggtacgtttagtttgtgcttgttcccctaattatgtgctaacatttagcatgttctccatttggaaacaccgtgaccaggcttgctacaagttcatgttcttcatcggtctcatcgacattctctgtttattcatcaactgcttaatgcacggctatttcgccatcacaggcgttgtgttctgttcctatcccgacttgatctacttgtccggcattgtcggattttgtaagcggcctacggctgttcactaaaaatacaaagaaaaagcgaatatggatcggtagctcaatggtagtctgcccattaaagggttggcgtcggctcaattcaaaccctatgcctaattttggctcatttattattttattggccgtccctttttgctttggtatgtattatggctttcttattttgtgctaattagtgtcacttttggcatttcaattctatgctaattaccatcccatttgcccttccgttttcatccttttcttttctcagtcttttgggtggccgaatcatcggcggacattcttcttgcggtaaaccgatgtgttgagatgatctcgcccgtttggggggaacggctttaccacggcgggcgtgcctggctttggctcattccgcccctcctctacgccacttacatcgccatcacgcaaatgccggttcttttcagcggcatttacttttcctggttctttaaccctcatggtatatgtcatttgtacattggcatttggcttttccttttttagcatttgctttaccctttttcatttttagtcggatacatcgacgactttggcacaattgtgagaaatgcatttttatattataattcttgcaagtccaagtggtgttttattttggtctttattatggtgctgggac

SEQ ID NO: 45883 - DNA, 1954 bp, Heterodera glycines; identical to SEQ ID NO: 24795
  Genomic contig location: Contig_ID=SeqID_24795; Location=1..1954; Strand=+
  SCN-specific regions: Sequence locations=1-49,85-136,158-323,346 -462,486-1044,1066-1097,1119-1197,1239-1256,1327-1954
  Gene Ontology: Mol. function=adenylate cyclase activity; Cellular component=dendrite; Biological process=signal transduction

SEQ ID NO: 45884 - DNA, 1012 bp, Heterodera glycines
  misc_feature (16)..(16): n is a, c, g, or t
  Genomic contig location: Contig_ID=SeqID_24803; Location=142..1153; Strand=-
  SCN-specific regions: Sequence locations=1-154,176-216,247-584,606 -712,749-844,867-950,972-1012
aatcgactgtatttantttggacataattaaagcatttgacaaagtccctcatgaattgctaatttataaaatagaaaaaattggaattaagggcaaccttctaaattggctcaaagatttcctaaccaacaggacattcaaggtcagaattaatcaacagttttccaaagaatttcccatcaaatcaggtgttccccagggatctgtcctggggccaattctatttttgatttttataaatgatttatccccagtaatccctgaaggaatttcgctaaaactttttgccgacgatactaaaatttacttgtgttatgacaccgaatttcaacgtaaaaaactaaacgaagccttacattgcgtctgccaatgggcccaaatgtggggtctacaattttcaccagaaaaatcagcttctctgtacctcggcaaggacaattttaaggttccctaccaatttaatgaaagactattaaagagacccaaacaattcgagatcttggaatcttaattgacaacaaactgacttttaaatcccatatttcatctattcttcaaaaagcctaccttagaagcagaacgctttttcaaaaaattaaatctaaatcatcaaagacatggattaaagtctataaaagctatattaggcccttacttgaatattcatctgaaaattggaaccctcacattaaaaaagaaattattcgccttgaaaagtttcaaaagttttttaccaaaaaagttttcttaaagtgccatttaccggttttacaatattcagataggttaaaataccttaatatttccactttggaaaataggagaaaatatttagatctgatcacagccttcaaaattattaaacaagaaactcacctaaaccctctaaaattatacaatttatctcaaagaagaaattcgccttttctcagattaatcactaaatctaaaataactaaaactgaacattcttttattaaccgtactacaaaaaacttacaagaattaagc

SEQ ID NO: 45885 - DNA, 1363 bp, Heterodera glycines; identical to SEQ ID NO: 24825
  Genomic contig location: Contig_ID=SeqID_24825; Location=1..1363; Strand=+
  SCN-specific regions: Sequence locations=1-493,515-534,575-856,879 -1047,1069-1298,1321-1363

SEQ ID NO: 45886 - DNA, 1107 bp, Heterodera glycines
  misc_feature (101)..(101): n is a, c, g, or t
  Genomic contig location: Contig_ID=SeqID_4742; Location=87..1193; Strand=-
  SCN-specific regions: Sequence locations=1-354,376-733,756-962,984 -988,1010-1040,1063-1107
  Gene Ontology: Mol. function=SH3/SH2 adaptor protein activity; Cellular component=cytosol; Biological process=EGF receptor signaling pathway
agcgattctacgaggaccacgaaaatgtggtcgagaatctcgaggattggacttcggaatcgcccaacaaattgcactttatccgacagcctcagaagtgngccctcttcaggcatccacagcactttctgatcgctgatcggaatcgaaacaacgaatttccgccggtggagagcattggcgaatgggatacggaacagaaacagcggttgctgaacgcgttcctcagggaggacggaggaacgcgagtgcccgaattggaggggtggctgatgctgaaggcggacggcaagaagtcatggcgacgacacttttttgtactccgttcctcggggttgtattacgtgccgaaggcggggaagccccgggggcccgccagggatttgaactgtctgatgagcgtgttcaacaaccaagtaggagatgagcagcccattaccaccccttatcccactcattttgaaggtgtacatgtgcacggactggcgcaaaaagtacaaagcgcccaccgaattcggatttgcaatcaaacatccgcgcatccaactgaaaacctccaagtacatcaagtacatttgctgtgatgacgagttcactttccgccaatggctgacggcgcttcgaataacaaaagtggggccgaaaaacaccgaattctcatcaaatttaaatttcattcgaattgcttttccaaattcataattcgtttgcttttgctttacgctccctctcctccaattaatccttttcaagaatggctgtcccgcgctgtacaaggacttccgtgccgctcagtcgcgcgagtgtccgctcgtcggccccgcctcccccgcgcgagcggaagtgccgcaggtgtccctacagcgcctctccgcgttggactccaattttgccaccgtctcttcggcgtcgccgcgtcaccgtcccgcgcttcatctcggcgacttcgcctgttcctccttctccactcgcgcatcgtcctcaacccccggcggctcctcccgtgaaggactgatcagtcgcattgcttctccggcgccgtcaatggcattcaatgttttcgaccaggacgaatgtaacaccataaaacgacatccggaaggtgtt

SEQ ID NO: 45887 - DNA, 305 bp, Heterodera glycines
  Genomic contig location: Contig_ID=SeqID_4747; Location=1877..2181; Strand=+
  SCN-specific regions: Sequence locations=1-150,175-197,222-305
atttgatgtgtgttaaccttacaaattaataaggtcaaaactttgaggacttcgccctctaatgacgaattgttggagatatacgcattgtataagcaagcgacctgtggcgacaacaacacatgcaaacctggcacttttgatttccgtgggaaggccaagtgggaggcgtggaaaaaaaagcaaggttctcacggaaattattaaaaaatttaaataaaggactttcgtcaggcatctctcaggagaaggctcggattgattatgtgaaaattgtcgaaaaaatggtggccaaatacggtgtt

SEQ ID NO: 45888 - DNA, 1121 bp, Heterodera glycines
  misc_feature (32)..(32): n is a, c, g, or t
  Genomic contig location: Contig_ID=SeqID_24856; Location=1..1121; Strand=+
  SCN-specific regions: Sequence locations=1-230,252-466,488-511,535 -595,618-655,677-908,933-1088,1110-1121
tgaatttgcccaaaaagcgtggaccatcagcngtcgacgggttcatttggggcacacaaatggtaaaaataaaatatactagtatttattgccttttttaagaaaaatttattattgttgtctaaaataggccaaaatgtaaaggaaatctctattaaaaattactcattttttcagtttttttttaaatttctatttctgtcaaagggaaacgattggatgtggccttcaaatattttattattttttttggtctacataatttttcacaatttttcccaaaaaaggtacgcaattttgttggacagaacagcggaattggagggcaacaaagcgcgcatcgccaaagcaatggaggtcaaaacgcattttgaacgtgccctggagttgaacccaacggacgcgaccacttggcaccttttgggttcgttggccaaacattcaaaaacaataatgtaatttggtgtaaaataatattttgttttaattttcttggtctaaccacatttacaatttattttaaaaaaattaaaacgaattgggaaaaaaatttaacacctcattttaaagtggatcatccaaagcttttgaatggtatttttacattggaatgtttttgttttcactaacaattttaacacccatttttatgacgaattaaaattaaaattaataagatttccatcaaaattcaatattgccaaaatcatcgcgggaattaaggcgtgtggcactacgaattggctgatctgtccacgcacaaacgatggttggcctcgttggtctatggcagtccgcccgagaccacttatgacgaggcattgcgctgctttgaacgagcggaaacattggcggtaattttatttttgatggatggatttttttttgatttttttttttttggtggtggaatttttaaaatttgtttttagccttgcttttactcggccaacaattattatttggcacttgtgtatgaaaaaatgaatcgcaaagaagaggcagtgaaacagttcaaattggcatataacgcgccaatggccgaaccggacgacttggaatatcacaacaaagtaggggaagatgccaaaaaaaaaatttttttaattcaaaaatccatt

SEQ ID NO: 45889 - DNA, 858 bp, Heterodera glycines
  Genomic contig location: Contig_ID=SeqID_24864; Location=115..972; Strand=-
  SCN-specific regions: Sequence locations=1-225,247-556,587-623,645 -653,676-858
atgcaacaatacattaatgacaacaacgaattgcttagaaaacgcatcgtaaaacaacaaaaaccaaaagaatgcatcatcatcagtaggggagccacgacatttgcggccccagccaaaaacgacaattgcggtccgacatttgcggccccagccaaaaacgacaattgcggtccgacatttgcggcctatttcttaagggccattttccgacatttgcggctcaaccaaaattagacttatttaggcataaatttagtaaattttacataaaaccactattattttcgcattataattggaatatgcatgacgccacaattgaaaaccttcataggacctaacaatgccatggaggcaaagccatttatgggtgttgcagggaagggatttaagagacaaaacgccaaaaaaatgcaaataacatgaaaattagccaaaaaagtttttatatagataagtcggttattttaagtctaattttggttgagccgcaaatgtcgggacacgcttttaacacctagaaatttaggaaaaaatatacaataaaaaaaagttttcagttttaaaaatttttggcccgcccgcgtctatttttttggctccatcataaattcaatttgtaaaattttctttctttttatacttcggtctttccccccactttttaattcaatttatcgaataaatatttcattttccagcccccgacttttccccgccgtcccccgacgtagtcgaactgagcgccttcctgggccaggaactgtccaagtcggagcggcctgagttgggcggtgccaagattgtgatcagcggtggccgagggctcaaatcgggcgaaaacttctcattgct

SEQ ID NO: 45890 - DNA, 223 bp, Heterodera glycines
  Genomic contig location: Contig_ID=SeqID_4755; Location=833..1055; Strand=-
  SCN-specific regions: Sequence locations=1-160,182-223
  Gene Ontology: Mol. function=protein binding; Cellular component =ubiquitin ligase complex; Biological process=apoptosis
atgcgcaaatcgttgaagcatcagctgttggtggccgaggtgctcaaccaattgacaacgcgtttccagccaaaggtgggggagaatgattttgggtgcaaatgaatgcctttcctttccttttaaggtgccgatcatcaagaagtgcatcgactcgctgattgagaaagaatatttgaagcgctcggaggaggatagcgatttgtatgaatatttggcatga

SEQ ID NO: 45891 - DNA, 878 bp, Heterodera glycines
  Genomic contig location: Contig_ID=SeqID_24873; Location=759..1636; Strand=-
  SCN-specific regions: Sequence locations=1-30,58-163,187-249,274 -499,521-557,591-878
  Gene Ontology: Mol. function=transporter activity; Cellular component= ER-Golgi transport vesicle membrane; Biological process=ER to Golgi transport
atgatcagagagttgtcggcaatgctcaccgcggtcaaacacgagcaggagtacatgcaagtgcgggacagagtgcaccgttcaagtaagtggaggacggaacggcaaacaaaaaaaaaataaaaaatagaagggctagtggagggtagggacggaacggaacttttaaaaagggggagaggatggagtaccctatcaaatcccatccactattgaagtttggtgcattccaataaaaacgcttgtcctttttatttgggttgcatttgatcaattattgatccccgagaaattaaacgacgcaaactcaaacccaatcaaaacgttcatttccatttcagtcaatgagaatacgaacagtcgcgtggtcgtatgggctgtgttcgaggcgattctgctaatttgcatgacgattggccaaatctactatctgaaacgctttttcgaagtgcgaagggtagtctgacaatgagaagggacgcaacgggtgatgtgatcgacaaaaccaacccccaaaaaagggggggagagattcgtgaggggaattgtcggggaaaagcccttttggttgttgttgttattatatattcggcggaactctcttctcccaaatttcgattgaaacagaatttaatgacgatactggtcaatgatttgcccgagcgacggaaagagtgccgtccattcctaatttattccaaatgcatagtgtttgtggtataaatgttgcgcggtaacatcgatcaaattgtttttttcatatgatccgttcaattttcaagatgaaccgcgtaatttattttgagtatgtatccaattgttgacataaattattgccatgtgtgttattttatgagggattttacaaaaaaaataaa

SEQ ID NO: 45892 - DNA, 1041 bp, Heterodera glycines
  Genomic contig location: Contig_ID=SeqID_24880; Location=153..1193; Strand=-
  SCN-specific regions: Sequence locations=1-41,63-124,156-201,223 -596,618-1041
  Gene Ontology: Mol. function=pre-mRNA splicing factor activity; Cellular component=nucleus; Biological process=embryogenesis and morphogenesis
atggctgaacgggcgcaaaagcacgtggaggacaacagaagcagaaaactgaccagggaagagaaggccgccaaggccatccggaagattggggaggacacaactttggcagtgcacgtcaccgtttttaagtggggaaaaaaggggaggggacattagagaaaaggggcatcattagcaaagcaaaacgggacaatgccaatgcattcattcattctctctgcaggatcaaatcgttggcaaaccctgcgaagaaattcaaagtgatgatgaacgccaaacagttgcaaatgaccggtgttgtcattgtgttggaagacataaatgttgttgtgatggagggaggtcagtttaaaattccgttttgcttctacacttaaagattttaaaaaatcaacaaaaggtgcacggaacgcacaatttttgaaccattccaatagcataaattggccaactgattaaccaaaatattcatacgtgaaaatgccataatatgccgaattttttttttgttcaatgccttcaaaacagtgtcgtacatttaatggcttcccgcgtgcccttattgactttttttaaaattttgaggtgtaggagcaaaaccaaaaacctaaatttcggcacgcaaattttattcactttatgtaattaaggtcccaagcagcaaaagttcttcaaaaacttgatgctcaacagaattcgatggtctgctgaaattgccggtcaaaagcacgaccgaagggcgacgcataacagagcgaatgaaatgggagaagggacggaggatggaccagcggaagagaagaggaacgagtgcgttttggtaagcatcccaaccaatgtttgttgtcttaccaatttcaaattttcaattctcagatttgggagggcgtcgtgcaaaagcgagcattcactggtgagccacgcttcactcctgtgaccaatcataagcaggcccgtgaactgctcgaaaagtacggagtgccacactactgggacctgtgttactctaccactgtccttctgaatgacgagacctga

SEQ ID NO: 45893 - DNA, 476 bp, Heterodera glycines
  Genomic contig location: Contig_ID=SeqID_24897; Location=25..500; Strand=+
  SCN-specific regions: Sequence locations=1-42,82-255,277-405,427-476
atgcctccatatgaaattactttcttctttcgtccattgactaaggtttttctcttaataatttttcaaatttattataactttcagccatctttggtcgaagcaataaaaaggcaggcgactcttttgatggataaaggcgcagtgattacgaaattggaaagcctcggctaccgcgacttgccctattcgcgattggacagattcgcgaagaaaaacgtccattatgcaaagttagtcgattgattgtgatatttgctgaacattttggatgctttcgtctttgaaacttaaaaataacaaattctcaaaaatgcaattgtattcaagatttgatggctaaatttcactttttgtttctcattttttacactgtttttagctccattctgatgaattcgtcgatgtcagtgaaaacaatgaatgatgcgagaacattgttttcgaatgacaaagaattggtcggtttattgtga

SEQ ID NO: 45894 - DNA, 1169 bp, Heterodera glycines
  Genomic contig location: Contig_ID=SeqID_24907; Location=1..1169; Strand=-
  SCN-specific regions: Sequence locations=1-154,176-177,199-367,400 -485,507-890,914-937,961-983,1006-1043,1084-1113,1144-1169
  Gene Ontology: Mol. function=calcium ion binding; Cellular component =endoplasmic reticulum lumen
aatattgccaacacgatctgcaattctgccacattaattaacagatacttacaattttaaaacttttcggcttcaatgtaaaaatcgccaaaattggcatttctctcacccgaccattaaaaaccgaaaattttaatttcggagaagaattcccaaaaacaggaatacaatgttggtttaccattttaaattcatatgcgaaaatataaaatttggcaaaattataattttggctcaataattcgaccaaaaaatttgtcattaaattttgaatttgttgatatagattagggctattctcacaaatattttgaattccgctgtgatttgatcgattttctatgcttcggttcacttataaatttcgttttttatttttaaattttttcaattaattttcttatatctgactaatccttaaaaataaaataaagttttttttacagaacaatgatgttgagcggacatggaaaaattacaaggaggagcagctgaagaatggcttgctcgattggcaagactacaggtgaagaaaatctaacagagggcgagaaggatggaaaattctaaaaaaattaagaaatttgatttacggaaaaccgcaggagggccaggagatttcaccggaatacgtcaaaatgattgagcgagacgaacgtcgatggaaggtcagaagcaggccaaaaagacctgctaatttatattaaatcgagaggctaacggccaaattttaatatttttaaatgctttccatacagtaaactcaaaaattgatttacaggtggctgactacaattcggacggtaaaatggaccgcacggaatacggctgtttcatgcacccggaggactgtgaccatatgagagacattgtggtgcaggtggattagcaaatttatttattaaaaaaaaatcaaattagattattgcttattaaagtccctttttcaatgattttcactttatatatttttcacttgtcttaacttggaacgggaaaaattcacctcaccctaattctcatatttacccagtattgttgcctaattatttaaaatgatttattattaataaatctttaattgctattggagcccattcattaataatacttaaaaatttctgtacaggaaaccgtcgaagacattgacaaggacggtttcgtcgaca

SEQ ID NO: 45895 - DNA, 763 bp, Heterodera glycines
  Genomic contig location: Contig_ID=SeqID_24908; Location=67..829; Strand=-
  SCN-specific regions: Sequence locations=1-434,456-629,651-763
  Gene Ontology: Mol. function=protein tyrosine kinase activity; Cellular component=plasma membrane; Biological process=cell proliferation
atgacagaagaaatttcgggcacggagcgtgtgtatgcactgtcggtgaacgtcggcggcttgctgaaccacgtcatcttccgccgacacaaaggaatgttcaccgtggacctcaactccgacaagggcttccgaacaatcgaacgattcgtcgacaattatctgcgtaccggagtttccgtcaccaccgtaagtcaaacagcttggaatctttttttttcattttccctttttttcagcaacaatacgtcgctctcatcagggccgtgccccgcgcgcactgggagctgtcgcacacttcaatcatcctgggcaatgaacttggccgcggcacgttcgggatcgtcaagagtggcgtctacgtggatcagcaggggactcgagcggcggtggccatcaaagaggtgtctcagacgagcaccaaagagcaagtgaggaaggggggtgggttggaagactgcgtccgcatattattaattttcagatcaaggagttcatgaatgaggcgcgagtcatgcggcagctccgacaccccaatgtcatccagttctacggcgtcgcggttggccaggagcccctgatgatcgtcatggagctggcgacggacggcagcctcaccaactacttgaagcagcagcggcggagcgcgcgggtcaaactctacatgtgcctcggcgcagctggcggactggaccacatccactcgaagggcatcatccattgcgacgtcgctgccagaaactgcctctacacggacggcgtg

SEQ ID NO: 45896 - DNA, 3779 bp, Heterodera glycines
  Genomic contig location: Contig_ID=SeqID_4768; Location=417..4195; Strand=+
  SCN-specific regions: Sequence locations=1-315,347-357,379-423,452 -602,624-817,839-898,931-933,957-1581,1605-1805,1829-2008,2032 -2811,2833-3041,3064-3161,3185-3779
cccccaaaatatggatttatatggactaaaaaccttcaccaaatcaaaaaattttaacgcagaaatgctatttttaagcccctttcttcatagcatatgcgcagaaaaaatatgttaatccatataatttacaaccctaatgataaagcataaatattagcccggcaatagtattgttaaaattcgaaatctctgacaacttaacggacgggcacgactgggccccgccaactgggccccaaccaactgggccccggattaactgggccccaccaactgggccccaagagacagtaatttttccaccattattgttagggctgcgatttatatgtaagaaaaatcgtaaaatatgtaaataaatatgtattaaaatatgccgaaatatgtacgaaatatttacaaaaaccttaaaatatgtactaaaatatgtaaaaaaaaattttttaatggttattttttggaaaaaaattcttcgtaaaaagtgaaataggcacaaaatgctataaaaatgaccaaaatgaatcactttttagtattttaaattaatttttgatagttaattttttgaaaaacattcgattttttagggatacattttcaaaaaattttttttaatttttcacaaaaaacctataaaaattctcaaaaatcctcaaaatatgtaaaaaaaaatgaaaatatgcacgaaaaattgcgaaatatgtacgaaaaagtccaaaatatgtataaaaatatgtacatatgtaatatgtagaaaaatcccaaaatatgtaaaaatatgtaaataaaagtcccaacttttgttcgcaaacacaaaaaagaaagtgtttttcctactaattagagcatggagaatccaggaaaaaaatatgtatttacatataaatcgcagccctaattattgtataatattatttatatatttttcattacatacacatatgtatgtgtgtttcgtttacaataatctaatttgtgtttatatttttttcgttcagtgcctaactacaataactttccttcagctattttttaaatttaactatcatttcatggcaaataatatattatcgcagaataaccacaaaaaaattgagcatgaaggtcatctttatgttttcgccaaacttagcgcggatggttttatcaaatttttgaggtgtgagaacaaaaacaataaggacatgaagtgccgagggcgtctgcacaccaatttgaatgacgtagtgttgaaacaagtcaatgagcatgtctgtggagcaaaccctgcgcgagtggaagcacagcgcgtcgttacaggttaggttatatcaaatgctgaagattttgaatgcatatttgacaattttaggaataaaatgtagagccattgaaaccgccgagccgccatctacacttcgctcaattgcactccaaaatgtgggaacccctgtgttgtctgaagtcccaacaaaaaatgcaacaaaacaagttgtgttaatttctctgcgctcattgtattgccttttttagctaatcaaaagggcccgcaatgaaggaattactcccgcaatgccgcttaatctaaaccagttacaaatcccacaacaatatcaaatttatgcacggaacgaaaacgaaactgaaaactttttgctagccgattctggtacatttttgttgaatgaaaatggacccccgcaacggtaggcaatgcgttttgttcgattcaccattactttttttgttaggattttgattttcgggcgcatgtctcataatagctgggccaatcaaatgacagaatgttacgctgacggaacattttcattaagcccaccactattttcacaagtttttgcagttcttgcccggtatgctttaattaaatttttgtattaaatgttcagtttttttataggcgcggcaagtgggtcttcccggttttttacgctcttttaacatcaaaaacttccgccatttaccaaagaatgttcagtatgatcaaagcagtttggccggccttttcacctcagtccatgtcgttggattttgaaattggtttgatgaatgctgtacgagaggaattccctaattgcaatttgcgatgttgtttttttcacctcgtcagaaatttcaaaaagaaaatggtcgaacaaaatgttattcaggtcccattcttccccccaaaaaaataaaacatatttttagcggtataatcacgactctaattttgctgaaatggcgcgctgcatcacatcattggcatttgttccgttgggtacactcactcaagcaattgtcgcgctcgaccactacatccccgccgaattagaccccgtttttgattggtccaaacaacgaaaatttaaaacaacaaatttgaaaaaaactacttttaacaacattcaaaaacaacacgactttatatttttctgcaggtttatgaccaactacacgggtagagtgcgcccgaacggaacccggacccaacccctctttgacccaggatgttggaatttgcacgaaagaactgttcacgagcaggacagaacaaacaattttgcagaagcggcacatcgacgattgcagcgcgccttttcgtgtcatcacccatcagtttggcggttcatcgacacaattcgccaagaacagaaaaaaattgacgcagattacgctcttttcgttgccggtcatgatccaccgccaaagtgcaagaaatatcgcgaggcagatgaaagaattttgagactgacacaaaattttaacccactaaacattatggaatttttgattggtgtttctcgaaattaccagatggatgcttagaattttatgaataaatttttgggatgttaaataaatttttgacagtatgaaatggaaaatgtgacaggcccttggggcccaatcggcggggcccaatcgtaccggggcccaatcggcggggcccaatcgacccccaccgaaacttttgatgtggataaaggactttttgagtaataggacttttcgtgttaaaattggggatgatttatcctccagtaaaaaagttggctctggtgtcccccagggctctgtccttggacctttattatttttgatttatattaacgatcttcctgatgctttgccatcaggagtaagaattaaattatatgctgatgatgttaaattgtatatttgttataaagaaagaaccgaaacagaaattatgcataaagcattgcataatttatcggaatgggcaaataaatggcagatcataatctcaattaaaaaaacttttgtactttacttggggaataaaaaccccaaagaaatatataaaattgatggaaatataataaatgttgtggatacaattagggatttaggcataaatattgataataaattgcaattttccaatcatgtcgcacaaataataaagaatgcatatttacgtatgcgttcttaatttcggattattaagtccaagtcttctaggatttggattattttgtacaaaacttatgttagaccgttattggaatatgctcctgaggtttggaatccatcgcttctaaaaaatatttaaaaaattgaaaagtgtcagaaatatttcaccaaaagagtattttttaagtgtaaccttccacccattccataccaacaaagattagaatacctgcaactgtcaacacttgaaagcaggcgaaagctttctgatctgttcatggctcataaaataatttatggccgaacagatatgatcccttttaatattcaaacttctgacgctttacattcccttt

SEQ ID NO: 45897 - DNA, 1449 bp, Heterodera glycines
  Genomic contig location: Contig_ID=SeqID_24927; Location=235..1683; Strand=-
  SCN-specific regions: Sequence locations=1-668,690-943,965-971,993 -1449
  Gene Ontology: Mol. function=phosphoglucomutase activity; Cellular component=cytoplasm; Biological process=cell organization and biogenesis
ttagtccctttgtccaattgttcccgctactccaaacaacttttcgtcgattgtgccaatggcgtcggcgccctttgggtgaacaaatatttcgatgctatcactgacggcactccgttttccgcccccgccaagggattgtctgtggccgcttcgactgactctgtccaattgcatgcactcaacacggacactgagtctcttctgctcaaccacgaggtgccctttaattcgtttaattccttttccattccttcgcatttccttccgtcgtttcagtgcggtgccgactttgtcaaaatcaactccaaaatccccgccaattttgactctgtccccttaaattcgcgctgtgcgtctttggatggggacgcggaccgtctcatttacttttacccttcggcaaccaattccaacggcggtgggggcgtcgttctgctcgacggtgaccatatcgctgctctctttgccactttcattgctcaagtctctgccctttcttttcttttgcctatattcgttaataattttatttttagcaattttctgtcgctgaaaaattgggccacaaaattcccctctcttttggcgttgtgcaaacagcttatgccaacgggaattcgaccagattcttcacagaaaaattggtgattttaaatttaccatggtttaaattccattttgtttaagggcattgaaccggtgattacgaagacgggcgttaagcatttggaggaggcggcgttgaactttgacattggtctctattttgaagcgaatgggcacggcacggtgtgcttcagcgaccgcttttacgcgtatttggaagaaatttcagggttttagccttttttaatgccaattaatctctctttttttgaggaatgaaataattcctcgtcacatccaattgctgtcaatgttctctcaacttgttaatgaggtgagttcttttcttttctcctaaattgcattttttgtgcttttatgttgtcggggatggcatcgctgatatgttagcggtggaatgtcttctccggcactttgactggtccgtccaggattggttggccgagacttacgccgacattccgaatgtccaaaagaaagttgaggttcagtcaccccccccccctactttatggttttaatttggaccacaattaggtgaaagatcggtccatttttgagaccgcagccgaccgcgaaacggtgttaattcgccccgagggaatgcaggcgaaaattgacgcaattatcagtgaattcgacaaagcacgtgccttcatcaggtcattggattcttttttgctattttttgaaatgtttttgacttttttcagaccctcgggaactgagccaattgtacggatttatgccgaagccgaaaccactgaaaaagtgaacgaaattgccgaaagacttgtcgaacttgtccttcccttctga

SEQ ID NO: 45898 - DNA, 647 bp, Heterodera glycines
  Genomic contig location: Contig_ID=SeqID_4774; Location=705..1351; Strand=+
  SCN-specific regions: Sequence locations=1-265,288-618,642-647
  Gene Ontology: Mol. function=RNA binding; Cellular component=small nuclear ribonucleoprotein complex; Biological process=positive regulation of growth rate
atggaagactctgagcagaatattaccgaacaatcggtatcggctcccaccactgatcacgacgaatatgaagaactttgcaaattggtcaacccaatctcaaaaccgcttgcaaacagaaaattggcaaagaaagtctacaaattggtgaaaaaagcggcaaaagagaagggctttttgagacatggattggctgatgtgatgaaagccttccgaaagaatgaaaaaggaattatcgtcttggcaggttcttgaccatttacgctctattataaaatattttgaaaggaaacgtttcaccgattgacgtgtacagtcatattcctgccatttgtgaagaaaaggtcaattttctttttttcagtttaccgattaattttcaattctgtcctttcagggtcttccttatgttttcactccgtctcgtgaacaccttggtctttgtgctggttcgtcgtctatatattttttcctttatgttttatattttaaggctataaacgtcctgcaattgtccttttggtgaagcgacacgattcgttcgcggagcttttcgatcaaacgcacgagtcaacttatgcgctggtggtggaaccggaataagcttttaattccaaaattgttgtttgttcgttttgtttcactca

SEQ ID NO: 45899 - DNA, 706 bp, Heterodera glycines
  Genomic contig location: Contig_ID=SeqID_4777; Location=142..847; Strand=-
  SCN-specific regions: Sequence locations=1-284,307-706
atggaacttcgatggtcgggccgcaagggaaggacagtcgctaccaccaaagtaaaatggtcaaatggggaattcccggaaagtttgaagacttccagaagcaggtttctttattttgttttcatcctaagtttggtctcttctcttaagatcagggagaactgttcgcaatacaaacaaatcgctgaaaaatgggacctcagtgacgagcacccgggcattgcggtcaacccttcgctcgactcgatcattcgccaaaaataccgtccaattggcacggtgttccctctatttcctaaaatattggcttggccgcgtttttgggataaaccaatgaatgagggctgtttcgaaaagggacttgcactggccaaatattcgctgccgatcagtgagttttgttttgactgacgcgcccttaggcttttaatttgcgtctacacctttagcttggattgcttatgcaggagcacttcgtggatatgatccgccaggtcatattcaatcaaagagttgtatgtcttttttgtttcagccaccaatgtcggtcgctttgaagcagtggagtttgtcatccaatcgttccgggggtggctatttagtagtaggatgattctgcccgcgttttattcctttacctttggccttacttcatgcacttcggctacatttcgcgatgaggacgattcgtggaattggatcgcag

SEQ ID NO: 45900 - DNA, 631 bp, Heterodera glycines
  Genomic contig location: Contig_ID=SeqID_24941; Location=334..964; Strand=+
  SCN-specific regions: Sequence locations=1-155,177-631
  Gene Ontology: Mol. function=microtubule binding; Cellular component =spindle pole; Biological process=meiotic spindle assembly
atgaaatgcattggggaaaaggccttgggctgtttcatttcacccgaattggccaaagatgcgaacaaaatggccaaggtcgtttcataatttttgttttttaataatttctttcctatttttagattgctgaataccaagacaaggcaatggcagaagctgctgttataacacaggtaatttgtcttcgtgtggtgtggaaaattggaattttccgctttttgttcgattccgggtttggtgtttggaatgaatggcgagcataaatatttacgaaatttactaaactaaattgtaagcatcaagttcaccaaactataaggtgtctagtgttttttaaatatacttttagaaccaagccagtgcccatgccaatgatttgtctggcacttcgtcctccaatcagcagagcgatgagtgcggcacccaacaaaatgcttgtgaaaatgaagttgatccatgggatttgatggagccagtcgacatctcatcgaagctgaacatcaatttcgaaagcccaaaatggcaggaaaggaaagaggcattggacgcactgcaacaattgttgttgcaatctccgcgactttctgattcgccaaattaccgggaggtcatcgaacgcttagcaaag

SEQ ID NO: 45901 - DNA, 1883 bp, Heterodera glycines
  Genomic contig location: Contig_ID=SeqID_4779; Location=286..2168; Strand=+
  SCN-specific regions: Sequence locations=1-215,320-321,363-456,484 -935,957-1000,1022-1114,1157-1186,1237-1466,1488-1561,1586-1647,1696 -1735,1757-1883
  Gene Ontology: Mol. function=receptor activity; Cellular component =integral to plasma membrane; Biological process=regulation of smoothened by patched
atgcaacagcggttggacgtggcgaagcgggacggactgttggacaattttgacggggatggcacaacgacggcgacaacaaattcaagcagtatatccgcagcagcaacgacaccaaaggcgaaacatcattcgcccgacctgcaaattgcctattcgttggcctgctcctacgggcagaactacgactgtgccagggtgagttttttttatttaaaaaaactaaaaactgaaaaaacacaaaataaaaaaaactctaaatcaaataatacaaataaaagtattaaaaaataaaaatgtaaagaaaaaaaatataaaatcttttttttaatttttttaaaatttatttttttatatttttagcttttttcttgcatttgcctacaaaatttttaaaaattcaaaaaatttcggccaaaaaaaatcgaaaaccacgtttttaatgaattttcatccatgcttttgaaaaaacaaaattttcatgtagagctatcgaatgatatcaaaattctgtttacttggattggttgaattttaagaaaaattatgtcggtttttcaatttttaccaaaatgaaaaatccctcaaatcaaacattttttgttaaggccggcacagtccgtctgattgatgagagcggcacaatcaacacggaaggcttctacaactatttgtatggatggcacgaatacgaacaaatggtatggggttgtccttctaaatttactgttttttctcgaattttttatgaaaatttgaaaaattaatcaaaaaatgtaaaaaatttcccttcctttcagttctatgccgtctctcaggccagcttctacccccgtcttcgcaagttgcgccaggggccgcctgggccgatgaaatatgtccgtttttgttgcatttccatttttaaaatttgattttggtttaggtccgtaatagaaaaagtttttccgggggttgggaagggaatccgaggagtttttcttaacccctcaaaaaaaggtacaattttttgttaaattaaacaccgtaaatgtaaaaaaaaaagcatttttagtagttttgttacaaaaaatgaatccttatggcatttaattacgaaaattagcgctcctactttaaaaattaaaaaaaatttccataaaattttttttaatttcccatttgaaaatttttattattagtcctcaattaattcattatttgatattttaaaatcaaatttatttcaaattatatgcatacatttttcaatgtatctctcccattttctcagcgctatttcattccgcccgcgccgaagccgttgttcagccgaattccgttttactgtgacgggttgcgcgacacgccgaccatcatgcgcatgatccgcgagatcagggcaatcagcgaaaattacagccgtgcgggcctgcccaactacccggaaggtgttttttttttggaaatttaggaaagttttcggggaaaatacaaatttattttttcaaggcgtcgctttcaccttttgggagcagtatttgcacttggactactacttggtgttggctattggcgtaagtttttctttctttttggtgaacaattattatacgaaaaataaaatattcaactaaaagttaaaggattttttcatagctttgcttgattatttcttaatttaaaaaaaaaatttttagaaattaaaaaaaattacattttcatcacaaatttaaaaaaagttaattcgctgaacacttaaaaattcctcattaaaatatataaaattgatgaatttatctaacaaattatacaaaaaaaagatttagatcatttccgtgtccgtcttctgcgttatctccaccatcattttcaacccgtgggccgccgctttggttggttaa

SEQ ID NO: 45902 - DNA, 2248 bp, Heterodera glycines
  Genomic contig location: Contig_ID=SeqID_4785; Location=1726..3973; Strand=-
  SCN-specific regions: Sequence locations=1-155,189-219,424-491,540 -1213,1235-1382,1404-1467,1527-1586,1609-2008,2030-2055,2081-2248
  Gene Ontology: Mol. function=metallopeptidase activity; Cellular component=basement membrane; Biological process=integrin-mediated signaling pathway
cggtgacggacactgcgcgggcccgtcaattcgctacatttcctgcaatttggagccatgcccagcggatgcgatggatttccgggccgaacagtgcgcggcgcacaatgacgacccagtggccgacaaatattataaggtaataggaggcgcggaatttaaaataattatttttaattatttttttaggtatttaatttacagaaatggggagaaatgtaaaaaatttaaagaattttctgtttttcattttttaaatatttttaaacattttaaatatttcttattaattttagaaatacatctaatttgattttccattaggttaacagatttttaaaattaaatattaaattaatttttcaattttatattaaaattgattaaaactcaaaattattaaaacatttaaatgaaattaaagctctttgttttttagctgactttcaaaataaattggaaaacttatatttcattccaattaatagaactataaaattattatcaataattataattaaaaaataaatcaaattttagtgggtcccacacacaagcaaaaacaaatgcgaattgacctgtcggccggagggcgacagcttttactacaattgggccgagaaagtgattgacggcacaaaatgcgacgcctacggcgaagagatttgcgtggacggcatttgcctgccggtcggatgcgacggcaaattgggctcgggtacggtataaactgcacaaaaatgacttatgtaatgatctgccaaaagtcttttttgatcactgttcagcgaaatcccaaataatgatcataccgattaatacaacaaaattgggttttcatcaattctcgctcggtagttactgatcactgagactcatcacactgatgtatgtttgccgtataccgctttatttttgtactacagaagcaaagcgtgacaaatgcggcgtttgccaaggcgacggctcccagtgcaaaacggtggagggactgttcgacgaacgcgcgctgtcttccggatatcatgacatcatcgcgttgcccgtcggcgccaccgcaattcacatcgaagagttgcgcccgtccagcaatgtgttcggtaaaagttttcggcatcccaaagccaccgaaatgtcaccttttatgccattttttctctatgtgtccgcaaatggcattttgtgccatttttgttctttttttttttactcaaaatgccaaattgacattttttgcataattattttggtacttttgtgccattcgtaggattctctttgttaatttgaaaattttagctcaaaaagaggcaaaaaagaatatttaaaaaagtcgaaaatccattaattttaattaattactaaaggaaacaaatgaaaacaattttaggattagcttttccttgtctttttactaaccagttaaaatttgaactgcttcaatcattttaagaagaattatgggcgattaaaattttaaaaaagtcaaaataatatttcaaaaatttcaaaaatttaaatttttaccattgctaaattataacctaccgtggcattctatgcaatgaaatgcccatttcagccatcaaaaatgccaccggcttcttctacctgaacggcaacttccaaatccaagtgttggacaagaacattttggctggtggtgtcccattcaaatatgagaagggcaacggtggtactgagcggctaacagctaacggtccattacaagtacagttatcaaaacaataccgtctttctaaaatacagtccccgacgggacccatttttcaaccttcctcgaaatgagaggaagctatgtcttgggggagtggcacaaaataccaatttattatacaaattttacagcattggaaaatacagtatgccagtattcatggtatcaaattgaaaaaaatactgtaaatatttcattgaattttagttgtttttttacttactatgcacagtaatctttgaattataaaataaaaaaattcacgcttgataattttttaatttaaggatagtaagccaaatacagtaccgtttggtacagtaatttttcttgcttttttatcaggaatctgtcaccgtttcgctgctgctccaacggaccggcgccaaacaaagtgcggtcaaatatgaatattcggtgccgttggagaaggacgtgaagtatttgtacaagccgggcgaatggtcacaatgttcagtgacatgcgggagaggtaaaaaaatgggatag

SEQ ID NO: 45903 - DNA, 603 bp, Heterodera glycines
  Genomic contig location: Contig_ID=SeqID_24973; Location=1..603; Strand=-
  SCN-specific regions: Sequence locations=1-114,139-490,516-603
  Gene Ontology: Biological process=embryogenesis and morphogenesis
ttataaggacattcattgcgtcgatccatttaacgcgtgcatcgctgggaagtgccaatgtgcacccggcacacatagagactcgtcaaaagggcgttgttttgcaggcattccaaaaaattatttaaattaattaatggccacaattttttttcaatttcccaattttaagtgtgtcccgatggcatcgcacctttgcagacatgccgtcgcctgttcatcaacgacgtggatatgttggacaatgctgcgaccacggacagttgcccaattggttaccgatgcgtcacttatggaaggttatcggtttgaaaatcataaaagattatctatttacgtggccggaccccttcgcaaaaaattttacccacccctttttttcatttgtgatttgttttcacctaaataagtttaatcattttatttctgcttcttttttgtcttcaaatttttttcgaagtttaattagttttggattttcattactttgaaaatttaaattttaataattaattcacattttttgtttgcgttcgttcagtccatacattggccactgttgcaaagtgcgctgtccgtacggcgagcctgacctaaggttag

SEQ ID NO: 45904 - DNA, 456 bp, Heterodera glycines
  Genomic contig location: Contig_ID=SeqID_24997; Location=122..577; Strand=+
  SCN-specific regions: Sequence locations=1-15,43-456
  Gene Ontology: Cellular component=integral to membrane; Biological process=proton transport
atggccggcattgtggccatctacgggctggtggtggcggtgatcatttccggccggctggaggcggccgggcccggctacaccatcgaccgcgggttcagccagttcgctgcaggcctcgtgtgcggtctgtgcgggttgggcgccggctatgccattggcgtggtgggcgacgcgggcgtgcgcggcctgtcgcagcagccgcgcctgtaaaaagcggtgttgaaagcaaaaaaggtcattgatttacattaatttacatggccggagaccccttcgcaaaattggaaaattggccgctgatcccttgttttgcaataatctgaattctgagctctacatctgaattttagtgttctttatcctgaatttgaaaaaaaaacttggtcaccctcaatatacatatacttctgaacaattctaatgctaaaaaacaggcactcgcgcgaaaactga

SEQ ID NO: 45905 - DNA, 822 bp, Heterodera glycines
  Genomic contig location: Contig_ID=SeqID_25014; Location=26..847; Strand=-
  SCN-specific regions: Sequence locations=1-159,181-581,603-822
  Gene Ontology: Cellular component=cytoskeleton; Biological process =microtubule-based process
acgcttgacgtggacgtgtccaatgtgaaggaactgtaccgccagctgccccatccaacgcccacccagcgagcagcacacgacaacatggtgcagcgctggcaagacatttgggagctgtcgcgcatgtacgtggagcggctgaaggggcttgaatcggtgttgaacgggttggacgaagtgacggacattgtgcgacgccatgagatcacgctggcctcctttgacgacatgccggccgcgctggagcgcctgcgcggcgtgcacgcccagctgctggagctgaatatggtactgcaacagcaggaaaacatcgtcaagaagctgaaccgggacactgcaacgctgcgccaacatgttgcgcgcacgcgtttcggcgctgcaaagtgtgtttgtacagtaaactttgtgaatgctcgtaagggatatcgtacaaattggtggtgtaaaaccgaactgtatagtagagtgatgcgatacagtaccaatttacagtagtgagttaacacacacaatatgcattgcctgcttctggtgatttaattacatataagttagtgttgtacggtagcgaattgtacaataatgagttttataaaggtgatactgtagtagcgatagtgtcacggtagcaaatctttggcattgttcaacccaatcatctaaatgtttagccatccggatgtggaccaaattgaggaccgtgtctcgcagatcactgtccgatgggacaatgtcaactcacaagtggcagaacgactgcgcatcgcggaagaagcccagcaaacgcagatggtctaccgctcccaatacacagaagag

SEQ ID NO: 45906 - DNA, 1868 bp, Heterodera glycines
  Genomic contig location: Contig_ID=SeqID_4797; Location=546..2413; Strand=-
  SCN-specific regions: Sequence locations=1-405,441-934,957-1426,1448 -1450,1480-1491,1521-1868
  Gene Ontology: Mol. function=protein binding; Biological process =protein amino acid phosphorylation
cgaagcacaaatcatgaagcaatgcaaccatccaaaacttgtccgcctttatgccgtgtgcactaagggagaaccggtaattttgtgatgatttgaatgggcataaatgggctaaaaaacaaattttccagtattatattgtcactgaatatatgcgaaacggcagtttgttggagtatctgcgtgataccaacaacagtttgcgcttgcatgcacttgtcgacatggcagcccaggtcattaattaattattgtgttgcaattgatttgacatgttttttatggcgcttaacaatttaagtggttgtgatggcttgttaaaaaaatattacactggccgggaaaaacagttttgggaccgaagtgtaaaaaaaggggggtttgaactctcccctcgcccacccgaatttttttttttgaaaaatattaaaaaaaattaacaaaactagaatggaaaatgacatggagggcgaaaggtttataatgcacccgatttttttttttgattaatttgactccatctgactagtttttcacttaactgtttgttcatttcttcattcacagattgcgagtggtatgatgtatttggaaagcagaaagctggtccaccgcgatttggccgctcgtaatgttttggtgggcgacaaaatttccggcgtgcccgaggtcaaagtggctgacttcggattggcccgtaaattgatggatgagaacatttacgaagcggcaacgggcgccaaatttccagtcaaatgtcagttttttttaccatgggatttttaacggtttgttgaaaaagtcattggtaccctggatttatggacaaaaaacaagggttgacgaaatgtcctaggccaggcagggcccatgaagaatccgggcctgtaggcctgtaaccagggggtgaaaaatggggcaaaaaaaaaatcagaaaaataaaattaaatttaaaagcaagaaaaatccgggcccggcagtgctcattcattttctttacctgccatttaaaaaaaaaaaatttgttaacaatttagggactgcgccagaggcacagcgttgtggaaattttacggtcaagtcggacgtttggtcatttggaattctgctctatgagattttctcacttggccatacgccatatccaggtagtgcatgcagtgtgcacaaatagctcagaccggggttggtctcgaaaaaattctatttttttcctccggtagtgcctgtcggcatcccggacccaatctccaaaaaaaactgtcaacaaagaaaatttgaaaattggtcctgagacatcccttttacatgatgttgtaaagccgaaattggcattcactttctcatatacattcggaactcaaaaaatagtaaaaaagagaacataaaaataccattttgattttttacagacagttaaacaacaccgccccccccccccccgccgttattgattttaattttggaaaaccaacaattagtaaattcatcataaaaattttgaaaaattaaaattttttgcgaaattttcgatggggggcgataaagcgcgtccccgtctgacaattgattccggaagaatacagttttcaacaatttttgcgcaggagtacaaaatcatgatgttcttcgtgacctggaccaaggcaaacggatggcatgtccgaagaattgtccggatgaaatttaccaagaaatgttgaactgctgggatcaaaacccggacagacggccgacctttgaatatctgttcacctttttcgacgatttcttcatttccagtcaaccaaattatgtgccgcccagcgttgacggcacatcgtttgatgcgcaagcgatcgatggcattgagggggagcaaagtggag

SEQ ID NO: 45907 - DNA, 677 bp, Heterodera glycines
  Genomic contig location: Contig_ID=SeqID_4803; Location=638..1314; Strand=-
  SCN-specific regions: Sequence locations=1-102,127-275,300-405,427 -567,600-677
  Gene Ontology: Mol. function=5'-nucleotidase activity; Cellular component=cytosol
atgagtcacagcgagggaacgattttcgtcaaccggacggtgcaccttcaggacatcaaattgtttggatttgacatggactatacattggcgggtaagaccttttttaattttaaaattccatgtcgaacctctggaacaggcccctgtttttctttctgctaataacttttccattgcttgagaattttttttaaggctaataaagtatgtaagggctttcgaatgataccatgattgtctgatttagttgaaatttaaaaaaggtatagcccaaaaacttggactggcgccgaaagacccactattcgggaatccccctcccccaaaaatcgaaaaattagtttttaatttgaattaggtcttggacaaggaattaattgatcggaatgggtgtgcattcttaatttgaattttatttttcgaggaatggaggggaaaaccgcagtatttccaaaaatggtaaaaattttgtcaatttttcagagtacgtgtcgccaacaatggaagaccaaaccttcgaactttgcctcgactatttgattcaaaaaactgggttcaaattccattttaaattttttttaaatttttcatttttagttaccccaaagaaattgctgcattcaaatacgacccgatgttttccattcgtggcctctggtttgacctcaaattcg

SEQ ID NO: 45908 - DNA, 1931 bp, Heterodera glycines
  Genomic contig location: Contig_ID=SeqID_4816; Location=2772..4702; Strand=-
  SCN-specific regions: Sequence locations=1-789,811-837,866-1288,1310 -1742,1764-1931
  Gene Ontology: Biological process=reproduction
gtttggttccggtacatcgaatcgttctggcgcgaatattccaaattgggcattccccgtttttcgcttatgcatcactcttatttgtcacacgacgacatcaaccgagtgcagcaagtggacgacgatttggagaaccatctgaggaagatgctcacagtgggcgcttttgagaacgctgtggcaattgtaatggccgaccacggcgcacgcttttctgaccttcgccaaacgcaccaaggtgaaggggggggcagggaatgggaagggcaaacaaaccggaaaaggcattcaaaagatgggacagttgaaaacactttttgtatattttttatggtacgacctaattgcccgcaccttttttactgcatttttaatacatttttttgatcgcttttgtggatatgcaaaaacacaaaaacaaatcttaaatgaaaaaaacagctagttattgaaggtataattttatcacattctcaggacaacttgaggagcgattgccatttttctccctccgttttcctccttcaatcgacggaatttcgcctcaaattgttgaaagaattctgtcaaatctgaaaacgaacgcacaaaagcgactcacttcgccgtttgatgtccatgcgacgctaatggacgcaatgaggtgattaaactaataaaacttatataatatggggttcaatgcgaagtgcgtgtgggagggtttaaaagacgtagtgcgacatttgcggaccgacttttgcggaccgacttttgcggaccgacatttgcgggtcgtaatttctggatttaattttcaaaaacaaatttttttcttaaattggatgatcatttgaatattgaattttatatgtgatttttcggagttaagcaagttaatgcgaatgaaaatatgaaaaatttataaagtttttccaaaaagttcttttttcaattcctcttggtgctaaaaatttgatcacttcatatcatccttaagtagtgatctgattttctcttttttttatatttagtcacaaatgtcggtccgcaaaaggcggtcctccgcaaatgtcggctaaccttaaaagagggaggaaaaactgatatttccccaaaacacataatcagatggccttttccgttggattatttgtccctgcccccttcttctgacgtcgccctttcgtcctccaaggcaaagtctgtgcctcccgccggtcgttcgctttcgttctttcgcgaaattccttctaatcggacgtgtgatcaggtgacaatggacaactgaaatgtttaaaccttctttgttaatatttttgattttgctaaatccgctctattaaaactgaatgtataggccggcattgaaccgcattggtgcacttgcttgggctgggaatcggtgccgaattcgacccacgaaattgccattttggctaagtcggtgataaaagtgatcaacgaatacacccaatcggagaggaagctgtgtgccctgctgtcgttgtctaaattggacagtgccaaaaggtgggcgaattgttttattataacaaatcaatgcttcttttatccaggctcgtgccaaattcggatttgatgaaatactcgggggtgaaggacgcagacggatttgtgccggatttgaaggggaatgtgaagacgacgttcgccacatatcagatcggtttccagacgcagcccgggaatgccaaatacgaggttactcaaaacaaaaaacatgagcaatccgaattggctaaccaatacaatcaaaatcataggccacgctgttcttcgatggacagcgacgcatcaccgtcgacatgacggccatcagtcacgtgaacaaatacggagacacaccgcactgcataatcgacaaaaactacttcttggccacttattgtgtttgctacgacaaaatcgacgacggagagacttaa

SEQ ID NO: 45909 - DNA, 1861 bp, Heterodera glycines
  Genomic contig location: Contig_ID=SeqID_4817; Location=40..1900; Strand=-
  SCN-specific regions: Sequence locations=1-243,265-400,422-1054,1076 -1172,1195-1234,1256-1561,1583-1773,1796-1861
atgctagatgaaacctcagcctccagagcaattggttccaatgaaactgctgtgatgatcaactcggatgaacacgaattggacaccgatcccggcattcagggcagtgacaatggcgcctcctcttccatgcaaaggcagctgtccgccgctatgcaggcggtcgtggaggagccgaccttcaatttgcgtttaattgacgcggtcaggcaaagccattgtctctacgacgcttcggacaagtgaaaaattaaaaaggcagtacatttaaatgaccattttctatttgtgtagacaatacagaagcgcggactacaaaataaaggtttggaatcggcttgtacacgttctcgggttccaaggtgacgcgcggacattgtacaaccggtggaagcaattgagagacaaatacggaaaagaggtcaatgcaacttcaaagtcgatatattgtttaattttttgccaatttgcagaaaaagaaactgaaatacagcggggagcagcactcgcaatggcaatattttaaggtgttcaaaacattttgcaaaaaggtaaagtgtttttttatttagcatctcgaatttctcgatccgcacatggtggacaggacacaacaacgttttgagcgcaacaaagaaggcaaaactgtaacgcattttatcttttctttgcagaacctttgtttttaggaacaacgccaaattgtcattaccgacccaaactttgctcttcacctgatcaaccaagttcggacgcagccttgcttatacgatatcaaggacacgaagtatcgtcacacggagtacaggtctttctcgagtttattattaaaatgataattattggcaatcgcattcccatccattcactggatttgtcccatatgtctttttggtactatggcactttcctttcaaatatctaaaagtgtggctctgatgagattatctatcgccacgccttgcccgtccacaataagcttttttgaaaacagctctgaaaaaactaacattaaacgaagagcagcaaaaaagtgtcgtcatgttttgtgttttgatcttttataaaaatctgttgttgatcccccccccccccctctttttcatataatacaatacgtgtttctttcagaaatcaggcatgggctgagattgcaaaaaacctggcatttcctggtgagcattcgtttgtctctttcagttaattatccgcccctttcttcaggcgatgtgagtgccctttacaaacagtggaagaaaataagggatcgatatgtgcgcgaaaaaaggaaactgcgcatgaccaatggtacggagaatgaggagcccaattgggagttgtaccgggaattggtttggatcgaccgatatttggacgaacgcgcagcgtgcgtttccctgcaagcataaattggaaatcaaacgcttttatataaaggcaggtaaagcggaagcaggagagcagcgacttgtccggagaggaattcatagaggatgcttactccacccaaaatgcttccggccttagtaattcgttgcccggaaattccgccaccccattggactctgcccatccccaccaccacccgcagcaacatcactacgccaatgtgctcatgccaaactctggccaacccattgaagagacggcaattgtcggtcaccaattacagcaactcgtaaagctgcagccccaacagcaaattgtcggcgcgacgctgcaggtaataaaccaacattaagtctttcggagtttccgtttttccgcatttactatcacaaaatattcatttgcagaattccacgaggtcacgggtgtccgatgttggaacaacgctcctcggagcgggcccaattggaat

SEQ ID NO: 45910 - DNA, 1830 bp, Heterodera glycines
  Genomic contig location: Contig_ID=SeqID_25107; Location=86..1915; Strand=+
  SCN-specific regions: Sequence locations=1-397,430-859,881-1082,1118 -1153,1183-1516,1559-1830
  Gene Ontology: Mol. function=rRNA (adenine-N6N6-)-dimethyltransferase activity; Cellular component=nucleoplasm; Biological process=cell cycle
ggatcaaattcaacacggaaaaggtccaacacattctgaagaatcccggcgtggtccatgccatcgttgagaaggttggttttttataaaccactaaccatgaaatttgaggctgtattctttcacaattccgcgagttttttcacataaattttcataaaaatcatttaaattgacacaaattgtaaattttccgattattttttattgacaattttattaatcaaaaattttacagtccgctgtcaagggcactgacactgtgctcgaggttggcccaggcaccggcaatttgtccatgaaattgttggaccgtgccggccgtctgattgcctacgaattggaccctaaaatggtggcagagctgcagaaacgtgtggtcggaacgtatgcatagatttttaaatataaattattatttttttttttgcacattcatgctgactgaccattggcttggtaaatcaataggtttttggcctaaaaaggactccgaatttgggggacgggacaaaatttcgctgcaaaatcagcgatttttctcaaaattcatatgaattagtaagtttttcgaaaaattttccaaaaaatcgctaaaaaattttcaaaaaatttttcgttggaatttttatacaagaaaaaaaattttgaaatttgaaaattaaaaaacaaagtttctttggcgaaattatgtcccggcgaaattttggggtgcaccccgaatttgatgagttttttgggcggctacttaaactgaaagactaaattggtgccaattaaaggcgcgaaatttcagtttcgaaaaatctccggatttttgagtttgattttcgagtttaggtgtcgttgatgccaagtgtttatcttgagaaatcaagaaaaatgatttaagattaatatttttgcttttttaaagacccgtccaatacaaattgcgtatcattgctggcgatgtgatcaaagcagccgagtggcctccgtttgatgtgtgcgtctccaatttgccctaccaaatttcatcaccgtttatttttcgactattgctccaacggccattgcccaggtgtgtttaaaatttgaacaattttttttaattcaataattcttaaaaaaatttccacggcacgtatattatattggcacccggatcaagtcatccctcctcctcctcctccgtcgtgttgaaaaaaattgtccatttacattgcacaactttttcgcaaaaacttcgtttcacctttgacaaaaaaatcacataccccccccccccccccgctccatcgtcattcatcatgttgcaggtacgccgtgctgatgctgcagaaggaattcgccgatcgactgttggccaagccgggcagtaaggtatacacaaataaaatattaattaatccgaaatgaaattgtctcaaaaatggatgaaatttctcaaaaaaaaaaaaaaaagattgtaaacaacgcctttcggagcgcaccaattagtagaccctcaattttcaggaatgctcaaataattaaaaaatcacacaattttttaattatcaaaacaaaaaattttgtcccaaacaggtgtattgtcggctgtccgtttctgttcaattattggccaccgttgagcatctgatgcgtgtgaagcgttccgaatttgtgccacctccaaaggtggactcggccgtcattcgcattcagccgcgcaatccgccgccggccatcaattacaaggcaaacgaaaacaaaaaatggatttttttttaaaatttttgtttctaatttaaatctctaatttttagagcctggacgggatcgggatcccgcagggattgtccctag

SEQ ID NO: 45911 - DNA, 1141 bp, Heterodera glycines
  Genomic contig location: Contig_ID=SeqID_25126; Location=621..1761; Strand=+
  SCN-specific regions: Sequence locations=27-119,145-282,304-304,328 -431,452-741,763-960,986-1141
  Gene Ontology: Mol. function=structural constituent of ribosome; Cellular component=cytosolic large ribosomal subunit (sensu Eukarya); Biological process=protein biosynthesis
atgggtgcctacaaatacatgcaggaattgtggcgcaagaagcagtcggaggtgatgcgctatttgctgcgcatccgctgctggcaatatcgccaaatggaggccatccaccgctgcacgcggcccacgcgtccggagaaggcgcgccgcttgggctacaaggcgaagcaaggtgtgtgcagcgagtgaaatgcgagtgatggaggcggattttgagggggttggcggattttcgagagaaaaaaactcaggttttgccaaacaaattgggtggcggcacggcaatttttatgaaaattgggcgaattttttcaaaaattaaaaggtaatcccagccgtaattggcgcgttcagccctagttaaaacactcggggtctccaagttggttcatagaaaaaaaaatcctacaatcattgtgtcatggtgtcagttttttttttttttttttttgtaaaagtgccaatctgtgtgatgaattgatgctttggaaaaaaggggaaccgcccaatttgtcgcggccaactcaccgtgttgagtttttgtctgttaaaattttactgttttttaggctttctcatttaccgcgtgcgcattcgccgcgggggtcgaaagcgtcaagtgaccaaagggcaaacgtacggaaagccgaaaacgcatggcgtcaaccagctgaagaacacgcgcagtttgcaggccgttgcggaggtttgtttcaattagatgggcctaacaaattgtgcggttttcccaaaaaatggtcaaaacttggtgattttagagcaaagcgcattgaaaaccaatgaaaaaaaaatgcgtcaaattttaatctgccctggcggtaacaagaaaaaaggaaggtatgggagctgccacaatttcacccgccccttgtcatcccaggctaagtagcccggcccatcttttatttcaacccttaaagtttcacaaattttctgactgattttccccccttcccttttcccataggcccgtgccggccgccgtttgggcgaacttcgtgtgctcaattcgtactgggtgggccaggactcgacctacaaattcttcgaagtcattctcgtcgacccatcgcacaaagtgcgttttggtttttgtttgtttgttttgttgcgatccttt

SEQ ID NO: 45912 - DNA, 1444 bp, Heterodera glycines
  Genomic contig location: Contig_ID=SeqID_4839; Location=613..2056; Strand=+
  SCN-specific regions: Sequence locations=1-723,745-1180,1202-1444
  Gene Ontology: Biological process=synaptonemal complex formation
gtggtcttccgattgacatcactgagacggagttgaagcaggcttttcataagtgcgtttctcgtcggtcggctttcattcattgattcatttgcttttttctctgctttaggttcggttcgttgctagtcgattggcccaaccgatcatccgattcacactttgttaaaaaagaacattgtaagcgctgtcatttggcggactgttacggcgaaacagcaaaattcagtgcatgaaaagggcacaatttctgtatgttttcagatagtggcgctgccagcagagtcaccggctacgcatttctcatctttttggaggaggcgtcggtgcagcgtctgatcgctaagtgctactcggagggcgaccgtttctacatgctgatgtccagtcagactgttcgcgagaagcccgttcaggtgcggccgtggcgcctcgccgacatggactacatgccgcgcccgtcggcccacttggacccgcgccgcaccgtaagagaccaccgattgacaccgctaggaccaaaaccgtcccattccaagattttcatcggcggtgtgccacgaccaaccaaagcgagtaatgagtgattggcacgcaatttgcgataaatacaccagtttaggcgagttggcatttgtgctcgaagccgccttcggtccggtttgctacgcgggcattgacgtcgacccggaaatgaaatatccgaagggtaatttgtcatttagaaacattggtttttcatttcccgcttatagcaaataacgatgtttttctctcaggggctgctcgcgtaactttcagcactttcaaatcgtacgccgctgccatggccggtcgcttcgtccaaattccgcactcggacaataccaaacgcgtaagttggctctcctcaagtgaagaaatttgttttggatcattgtttcgacttttaattcgaaaattgccgggctttgaacttttaagtgatcaaaccatttgttcattggatctattgtctctgtccttcttcaggtggagatcaagccgtacttggtcaacgatcagatgtgcgacaattgccatggcaaactctgtcaggaccgttacgcgccgtacttttgtggcgacgtcgcgtgtcttcagtattactgtgaaatctgctgggaccgcctgtaattaattaattgcgcattccttgcccaaaaagccttaatttcccctctttcagtcattacgggtcgggcaatcgttcgcgcgaaatgcataagccatttgtgcgaatgggcgaacagatcaaagtgagtgcgttcattcagaggaaaacaaataaaaaatgccgttatttttctttttggctggtacaatttttcagtattaatttcccacttttcgtcttaattcccaattgtttaatttgctcccttttttgatttttcagatcaaaattccgcagagggaattctaa

SEQ ID NO: 45913 - DNA, 1046 bp, Heterodera glycines
  Genomic contig location: Contig_ID=SeqID_546; Location=12..1057; Strand=-
  SCN-specific regions: Sequence locations=1-119,141-1046
atgggcaaaggcaccgacggagtggtctttttctccatgggttccattatgcgcagcagtgacatgcccgagagctttcgacggcatattttcgaggctttttcccaacttaaaaactaccatttcattgtcaaagtggagaaagatgacaatgtaaaaatgaagtgaagtgaacagaaaactcgtctttttaagtattcggaaaatttggccaaaaatttggacaatgttttcttcacttcttgggctcctcagttggacattcttggtaagtttttacatgttgtttttttcttggttctcaattttttggctcagtcctgatcatgctaaaatttttaaataaacctaaaacgactatttaattagcctggttttcggcattttgtccgttcatttcccattcgattgttccttcccaggccatccccgtctccgtctgttcatcacccacggcggcttcaacagtctgctggaggcggctaatgcgggtgtgcccgtccttctgatgggctttttcgctgatcagcaccgaaacggacgggtggccgagcgcaatgggtggggaaaggttgtggaaaagcggcaattattggaaggcagcgaaaacttccgtgcagccattcagaaggtgttggaagaccaaaggcaatttacgctatattatcaaataccatatgggattacagtattccctttacagttacgctgccaacgcaaaaagaacccatcgactgttggcaacaaaggttggcattttgtaattcattttctatcgattgagtttgtgccatccgttttaaagcctttcaccgccaaagagcgtctgttgaagaacattcgctttttggagatgaacgggggtcagtttcccgagctgttgagcgagtctcggcacatgggctgggttcagctgcacaacttcgacttggccgttttggccgcactttcggcactcacttttctcttcgttctccgatatttggccaaatttacattagctttagcaatttggaccaaaaatatgcttcagaaaaagtacaaaa

SEQ ID NO: 45914 - DNA, 3302 bp, Heterodera glycines
  Genomic contig location: Contig_ID=SeqID_4844; Location=1..3302; Strand=-
  SCN-specific regions: Sequence locations=1-1089,1111-1695,1717 -2666,2702-2974,3022-3302
  Gene Ontology: Mol. function=structural constituent of muscle; Cellular component=sarcomere; Biological process=striated muscle contraction
tctcagtaaatttttcatcccatttgcttggtgatgtcattttgcttaattaattatctcttttcagtgcctccggcgatcagtcgcgaaagtgccgaattgaatccgagacttccgttgggccgttccctcacctttttctgtgacgtcataggaaaaccgccgccgaacattcgttggacaaaggacgagaaatctttgaaggaagatgccaacgttcagctgggcgagggcaaccgatcgctgctgatccaaaacatttctttgtctgatcgcggagtttaccgatgcgaagcgaccaatcacgtgggcaacgacagcgtggagtatcggctggacgtgttccaagcgccgatcattgccaaggggggcacggagcaggcggtggagggcaaagtggccgtgttggactgtgtcgcttcgggcgaacccgcgccactgatcagttgggtaagcaacggctgataaacgatttgatttcttggccaaatgattcgtttgcctcaagcaacgaaacggcgttcttgtcgaagtgggcgttcgatatgttctggagggaagtcgtctgaaagtgatcgacacgcgcagctccgactctggcatttacgtgtgtgaagcgaccaatgaagcgggcaccgaccaacaagcatttaccctggaagtgttaataccgcccaagctgacaagcgaatcggcacgacaaatggccgtcctccggggcggaaatggcactttgagttgcaccgcacgaggctatccgacaccacaagtcatttggagtgccgagagcacaaactcatcggtgagaggagaaaaagcaaatgcgaatccaagcgaatttaaagcattttcatccgattggcacggttttgaaaagaaatgcccaatacgaactctccgaatacggacaaacgctgcacctttttggcctttctcacgaaggcactcgcctcttccgctgctccgccgttaacaacgcgggcattgaccaattggaattcggaattggcattattcgggcgccgaccctttcgagaaaggtggtcgagaaaggaggcgagggacctttaaaatggcaattaattaactaattcaaagggtattttaacaataaatgtcactgagggcggccctttgcttattccatgcggcgtaattggcacgggaaaagaaattggagagcaaatccaatggacttacaacggacgggctttggcgggggagggaccgacgaaaagcattggcaaagtgacgcgggctcagggcggaaattacacgtgcacaatgaaaaacaaagcgggaaatgcttcgtcgacagtgatagtccatgttggaggtgagagggaattaggcgggacaattcggagaagggaaaggcacgtggccaaagtccgtaagaaatggccgaatcagcggaaggaaaaggaaaatgccatcattaaaaaggaagagccaactgagaagttgccaagaaattggaggaaaaggccacatttaaagtcgaacggaaatgggacagacggacactgcaaaatttagtcgcgccgaaaataagggaggacgaagcgcgtgcccgcgggcgtgtcatcgtggagaaaggcgcgacagccgaattgtggtgcgaagcggtgggaattccaccgccaaagatcgttggcttcgagacgatcagccactgaccaaatgttatttttctcccatttttggcctatatttcgttttgatcagttgcacctacggctttcaccgctaacgaaggcattggcggctcagtccaatcggcggacacacggcgatcgacggcagtgtttggggaggtgcagccgcaacacgcgggggtttacacgtgcgaagcggataattgggccggaaaagccaacaaaacagtggatttggtggtgttaagtgagttggaagcaaacatttcatttattcgtgctaaattattctcccggaaaagtccctccgtccattttgcctgaacgcgagcaaatcgaagtcgaaagcggacaaatggtcgttttgcagtgcaacgcgacgggcattcccgaaccgttggtctcgtgggagaaagccgacgacacagcggcggcggacatttccggcgacggacgaagtgccaaaactttgccaaacgaaggggtggccatctgtgatttgttcgttcagagtaccaattgctcggcacatcgctcgcaattcgcgaagtcgagaaaaaggacgaaggcatttaccaatgcatcgcaaagagtgacgcggggcaaaccatcggagttcgccaagtcattgtgaaaagtgcgtgaaaaacacaactatttccgttttaagtgcctttttaacgctctccaacggctctttccaacaatatttttcctttcaattcatttcaattcagtacctcaactgaaaaaagcgaagcgacagcgcattttcgtggaatgcgacgcaaacggaaagcccgtgaaacattcattcgcgcgcgtccggggcgaccgtcccaaagggtcggacgattatggccattggacgggaatgccaaagaatgggacggaagtcaagtgcttaccaaagggggacaaattttggaagaaacggcggtggagaggacgaattagcctcgaaagaggggggaaatggcgggtgactaattaactaattaatggacaaataaattgtattattataaaaagtaataaaggtttacaattataattcggacttcggttcagcatttaaatacactagaaaaatttataagtaccaattaaaaagtagtcgaaccaaaaaggcatctgtcgtaacacaatttacacaactaacagcaaaacagtgcaaattaaagttacaatattaacgtataaaagtaaaattgactattacggtattatattgtatggtattgctaataaaacagagatagagattgactggatgagggaaatgagcaaatcaatcaaatgtttaaagctatggacaaaggaaaaggaaacaaaaacggtaaggggaggaggagaaaagaagcgatcaatggggaagggataaaacaaaacggctcacaatcagcgctttgatacgagtgctgacattcactcgcgcctattaatcggtgtcaaatttagtgaaatctaatgaatcgatagatgctaaattacatgttggcattgatgcaactgtactggtcgtaaatgtttgggcaccaacaaatgataaggcaacggaagtcccttccctctctcggcatttctcacagcgtttaaacccattaaccccccccccctcaatccaatcgatacaaatgaaca

SEQ ID NO: 45915 - DNA, 874 bp, Heterodera glycines
  Genomic contig location: Contig_ID=SeqID_4851; Location=39..912; Strand=+
  SCN-specific regions: Sequence locations=1-320,342-841,863-874
  Gene Ontology: Mol. function=GTPase activity; Cellular component =mitochondrion; Biological process=ribosome nucleus export
catttgctctccattcttcgtcaagccgtttcagaagcttttcccgatgcgattgctcagggctcttcccaagtgatcggtaaatgtgaaataaccctctatttgatggatttccccaaacttttcaggaatggtcggatacccaaatgtgggcaaaagtatgacaatcaatcgactgctcggcaccaaaaaaacggcggtgtcctcgacgccgggcaaaacgaaacatttccaaacactgatcattgacgagggggtaaataaatatgaacatttatactttggtcatcatttttacaaaagttttgccgagaattaataactattttttccttttcagttggttttatgtgactgtcctggccttgtgatgccgcagtttggcattagcgatgccgacatgattttgaatggtacaatttttgttttgttttttcggacaacaattccgttttaaattcccactttttcaggcattttgccaattgcccacatgcgcgactatttcggacccatccaattgctgtgcgaacgcgtgccccgccaatacttccaacaacgctactccgtcctgttgcccaagagcattgggtctttgaacgggcacgacctgttgaccgcagtggcattcctcaagggcttcatgaatgcctctggcattcccgtacgtcatgcctttggcacttcaaatgcatttctttttcccctcaaggattgttcgcgtgccgctcgtctgatcctcgccgatgtcatcgatggttcactgaaatgggtcgccgcgccttcgaatgtttcacagcgacaatttgatcaatggacttttaagactattgagctttcaaaggcacatcaacaagagcaacaacggcagcag

SEQ ID NO: 45916 - DNA, 358 bp, Heterodera glycines
  Genomic contig location: Contig_ID=SeqID_25232; Location=699..1056; Strand=+
  SCN-specific regions: Sequence locations=1-48,72-328,350-358
  Gene Ontology: Mol. function=DNA binding; Cellular component =nucleosome; Biological process=nucleosome assembly
atgccccgtcatcgtgcaaagcctcgttcttttcatgccggattgaaattccccgtcggtcgtgtccatcgcaagatgaagaagggtatgttggaatacaggacaacaccatattctgattttgtttcattcacaatcgaatcatacattccctttcctgttcacatccacaggtccgtatgccaaacgtctcgcgaacggagtgccggtctacatgactgctgtgctggaacacatcacgggcgagctgctcaagaaaattggcgagatcacgcaggccgaaggcatgaagcgtctcagtgcatttcacatccgaactgcagcgcgcgatgacgacgaggttgaggaaggtcagtga

SEQ ID NO: 45917 - DNA, 692 bp, Heterodera glycines
  Genomic contig location: Contig_ID=SeqID_25235; Location=410..1101; Strand=+
  SCN-specific regions: Sequence locations=1-199,300-405,428-465,488 -627,658-692
atgcgcaaggccgtgcttggcccgttcatcaaccgcgcctctctgatcacagcctctgccggccctcaacagtcgtttttccctgtcgacgtgagcccttgggaagcgttgccgacggaagaggaaattgagaaggtgtgccgtcgatgttgggcaaatgcatggaaaataattaatcctttttttgatgtacagcatgagaagacgaaaaagaaaaaggaccagaaaaagatgaagaagaagaaagagacggacgaattggaggaagaggaggacgaagaagaggaggcggaagaggacggacgaatattcccaaatttggacacaattgatcagaaaatactgatgaagcttatgtgatcgatcatcaatcaatcgttgaatcctactaagaatgctttgaaattatgattgattttattttgatggaaaatacaacttaaaaatttaaatgaatgaatcaccaaaaaaaaaaaaaaaaatttttccccttcacctttttaatcagtcagtcacaccattagttaatcgttaatcattggttgaacagaaaagcttttctccccttgtacattttttaattcattcccaattgggtgcgtttattttttgctttttcttgtggggttaaaaatttatttttttaatttaaattttgtttgctacatagtttttttttattaaaaaaacca

SEQ ID NO: 45918 - DNA, 2460 bp, Heterodera glycines
  Genomic contig location: Contig_ID=SeqID_4865; Location=1..2460; Strand=+
  SCN-specific regions: Sequence locations=1-706,729-796,822-1311,1333 -1675,1697-2087,2109-2297,2319-2460
  Gene Ontology: Mol. function=protein binding; Cellular component=COPI vesicle coat; Biological process=intracellular protein transport
tcggataaaggtaaaaatgaagtcaatttttgtcgaatttagtttttagctcagcgccaacatactttcgttgagacaaattctgtacgatatgtctatcagccgatggacaacatttacatggtaattctattgttttttgttcatttaacagttaattttcaggttttgatcaccacgaaagcatctaatattttggaggacctggagacgcttcgtctgttttcccgagtggtgggttagggttattattactaacatttgaatcagagcgcgggaaagatttgttctcccttgaagggttcgaggcataactttgaatatacacagtatgcgataaaagggtggtcaaataatggtaacgaataaactcgtaaaacccaaaaagctatagccggaaattttcttcactacaaatttcgctcctctgattgtgtgctttttttttggagggattaaatttaaatatttgtttatttgaaaaaacagcaggtggggtcatgtactacatattcatactgatggtcagtcccgtttaatttagatacccgagtattgccgttccaatgatgagtccgaaatcactgacaaggcattcgatttgattttcgcttttgacgaaattgtcgtgcttggttatcgcgaaagtgtcaacttggcacaaatacgaactttcactgagatggactcgcatgaggagcgtgtgttcaatcaaattcaaattgtacagcctttcgaaatttagccaaaatttctcacaaactttttaggctcaacaacgcgcagcccatacactgatgaaagagaaggagaaggagataaagcggcaggaaaaactgaaggaagcatttgaagggcggaattggaggtgaaacgaaagtcaacaattatttaaattattctaaaaaaggtacggctgcatccgccacggggatcagttcgtcacaggcacgaactgaacttacgtcggtcgtcaaagacaccgcgcccatttcttcactgttgggtggaacgggtggaacctctctgtttgggggattgggtcaaaaaaagcaggcggtcccatttgtgggcggaggaaaggcgttgaaattgggcgcgaaatcggcaaacgaggacgcttttctgcagcagttacggcatgagggcgaaaaagtattggataaggttaatgaaatgccaaattgtgttaataagccgaaaaacaattccactttccaggaatcggccaatgtcaccgtgtcaatgtctggttagaatttgattattgtattattgcttgacggctgcataatttattgttttttgattatacaataaatattgcattaactaaagaaagaattccgtttatttgagaatctgatgctgctgtttcgaatattggtgtaaaggctggcgctgtccacttcaaatgcgttgagaaaataaatgccgtgctaagccgaggcgggggattgaattcgtctgactcggcaaaagtgtgatggatttattggatttgcctattccattccttcttcagatatttggctccatttcgctctgtgtttccgatcccaagtttaacagtgttgccatccgagtgttgaataatatcaaacaagtgcctggttgtcgacacggtgacacttctcaggacagcaaagcagttcaaattcaagtaatatatcggtttctgtcctttttcatttttatatgatttcatctattactgtcagcgtttttcataataactccagtaagaattcccaaaattaggttcatccaaatttggacaaatcgtcatggcaatccaaatcactgctccgcctcaagtccgagcaaaaaccgtacccggtcggtgttgacgttggtgtgttgaaatggtccattaaattgcctgacgaagatgcacttccattgacacgttagagttggatgacgaatcgaattaaaaaatgaatctttcagtaaattgttggccaaacgaatcctcggagggagtgacggtgaacatcgaatacacattgcaacgcgaggatttgcagctcaaaaatgtgcgaattgtcatccctctaccgtatgtgctattcattctgatgaatcttttatttttattgtgtttagtccggcaacagctcccgtcatttccgagtgcgaaggagcgtacgaatacctaaagtctaaaggccaacttttgtggtccattccgctggttgaacggggcaacaaaacgggcactttggaattcacaacagccaacggaaatgctgatcactttttccctgtccaagtccatttcagctccaccgacagtttttccaaaataacggtcaatcattgaatatattttttatacttgcaagggtttatagtattttcaacgtcctttaggttgaaagcgttgagacaatgcaaggagatgatgttgagttcactgatgaagtgaatttgtttccagaaaaatatgagattatt

SEQ ID NO: 45919 - DNA, 421 bp, Heterodera glycines
  Genomic contig location: Contig_ID=SeqID_25259; Location=1..421; Strand=-
  SCN-specific regions: Sequence locations=1-88,117-312,339-351,378-421
  Gene Ontology: Mol. function=GTP binding; Cellular component =microtubule; Biological process=spindle assembly
taagcgcttactcgagttgttaagcgtgaagtgatctctattcatgtgggacaagcgggcgtgcaaattggaaatgcttgttgggaattgtactgcttggaacatggcattcagcccgatggaaaaatgccatccgaccaaaacaaccaagacgattcgttcagcaccttcttctcggaaacaggcaatgggcgtcatgttccgcgtgcggttatggtcgacttggagccaacagtgatcggttgccatttgttgtttttcgttggattatccgctgttttagacgagatccgcactgggacttacaagcatctcttccaccctgaacagctcatcactggaaaagaagacgcggccaacaactacgctagaggacattaaggggacggcaaagaaatcatcgaccccgtctggatcggat

SEQ ID NO: 45920 - DNA, 1416 bp, Heterodera glycines
  misc_feature (1261)..(1261): n is a, c, g, or t
  Genomic contig location: Contig_ID=SeqID_4872; Location=509..1924; Strand=+
  SCN-specific regions: Sequence locations=1-624,646-974,996-1076,1100 -1191,1225-1344,1384-1389,1411-1416
  Gene Ontology: Mol. function=signal transducer activity; Cellular component=nucleus; Biological process=neurotransmitter secretion
atggagccgtttgagcaatgccaaatctgcgaccgaaaatggcaccgaatttgcgcacttcacagcaacaaaatccacccgggcggcttcgtctgcgagcagtgtcgggtcgagaaaaacagaacgcgacaggagaacaaattcaccgccaaaagtacgttttttggatcactttggcctatcaaatccgatggaatgatcgtttatcattcaaatttgcttccagaattgccgcactacaatctgagcaggcacattgaggatcgtgtgaacaacttcctccgccggaaactcaccgattctgaccccgaggtggaagtgatcattcgcgtgctgtgcagcgcggacaaagaggtggaggtgaagccggcgatgctcaaaaagttagtgaaatctaactaacattgctaaaattgctcgaattcaaatcattattttctcagatacgcctccgagggctacacggaccgctttccctaccgttccaaggcggtgttcgcatttgaggtggtcaaagaccctgatactggtgcctcgcacgaggtgtgcttcttcggcctgtacgtgcaggagtacggcaccaactgtcagcagccgaaccagcggagggtgtacatcgcctaccttgactctgtccacttcttccaaccgcggtcgctgcgtacgtcggtgtactacgaaatactgctcggctatttggacgtaagtttgcgtgcgattttatcccatggggatgctaatgaatttttcggtcttactcttcgaatttgctatgaaatcatgttactttacaataaaattattttagtatgccaagacattgggctacacaatggcccacatttgggcatgtccaccgtccgagggcgacgactacattttccactgccacccgccggagcagaagatcccaaagcccaaacggttgcaggactggtacaaaacgatgctgaacaacggacagatggagggcactgtgtacagctacaaggacatctacaaccaggcgagagatgacgggttggacacgccaatgaagctgccctattttgaaggtacagctacaaatttcgcaaaatttgaaaatgtttaaaaatatggccaaaactggcaatttttccggtgtttttccactcagtggttctattgacaggtgattattggcctcgcatcatcgacgaatgcatcatcggggcggagaaggaggaggagcaggaaaagcggatgaagcagcaccagcagttccaatcggcggaggagnggcggcggtatcggaagggcggcggttccgcggcaaccgcctcactgtccgacgacgacactttccaaacggacgacggctttccggtggtcaaacagaaacaacagccacaacaacagcaaaaggcgagcagcaacaagaagaagacaacctga

SEQ ID NO: 45921 - DNA, 1617 bp, Heterodera glycines
  misc_feature (1379)..(1379): n is a, c, g, or t
  Genomic contig location: Contig_ID=SeqID_25291; Location=1..1617; Strand=-
  SCN-specific regions: Sequence locations=1-713,741-916,938-1187,1210 -1577
  Gene Ontology: Mol. function=ethanolaminephosphotransferase activity; Cellular component=endoplasmic reticulum; Biological process=growth
tacaatattattatggttgtgtctaaacttttcggggtcaattatttgtcgcaacagcaactcgccgggttcgaccagtacaagtacagctgcattgacaactcgccaatttccacatacatttcgcatcccttctggaattgggtggtccaagttggtttttgaggtttattcttaataatcgcatcattatgaatgataaattcattcgaattttaattggtttaaaatgcattctttgcttaaagataggccttaatttcaaaaatttaaagattttcaaaaaaaaaaaaactgccgttgcccctccctcctttttggtagaaatttttttagggtgttgtaaaatgtgaaagcatgtttagggggatttttggagcgcctcacggatttgacatttatttttgccttttccgaatcacgaatttttaaaaattgaatttctggcattttttgttcgaattcgggtctgggaatttggaataagccaaaatgaatgtcagattcatgaccagcgaccccgaaaacaaccataaacatgttttcacgacttttaaagcaacttttttcaaaaacgggggggggggggctccgcagtattaccaaaactggttctaccggaaataattaacagacctaagggcctacatgaccgaattttggtgctttagtccaattttgaaaaaaaccaattatttggtcggttcagtgcgcccaaaatttgcaaaatttttcaaaaaattttttttttcagttttacccccgttggttggcccccaatgtgctgacatttgccggtgcactgattgtgatgtgttgctatgggctcgtggtgtgctttgaccccgggctgagcgccaattcggccaccgggccggccgagctgaacatcccgcgctgggtgtggctggtgtgcggggttggcactttcttggcccacttgttggacggcacggacgggaagcaggcacgacgagtgggtgccagtggaccgaccggggaactatgtaagtacgccgtgctgtggtggacggggtcgggacccggtcaggttacaagatcccgaaccccggaatccgggcgggtttttaaatgatgaaacggatcggggtcccgcaaaaatcaggttttaatttcaaaatcctgtccggggcatccagaattgtcaaaattccggtctcaaggcgaatttttttaatttttttttttggttttatttttccctcattgaatttttcaaggcttggtaaattgtggccggttcggcccaggattgaaccccaatttttcattccatgaatttttattaaaattgctgcccttcctgaaacaaaattgggtggttgccagagatttatagaatgccaaagaccggcggngcacttaaaattactttccgggctattgaggccaaaaattgggctcgaaaaagccaaattggtatcagatggggctagggggcccggttttggaaatccacgagatcaaaaatctctgggggtttaaccctcactttcttttacaatatctattttttttaaaatccaattgattttcaccggattttcttaaaatcctggaattttttacaaaattttccaaaataaatttatttaa

SEQ ID NO: 45922 - DNA, 575 bp, Heterodera glycines
  Genomic contig location: Contig_ID=SeqID_25321; Location=806..1380; Strand=+
  SCN-specific regions: Sequence locations=1-102,124-575
  Gene Ontology: Biological process=chromosome segregation
atgcctcttcattggacttctgtggacactcgcaacgcacttttgtgcgccgccgttccttccattggcgccttcgtgggctcgacgatggccatcaaagatcaggaattggttcaatttctcaaggtttgctgacaccagagttgagcaattaattccaatcagcttttagaatcaaaactttccttctttcgcccgttgttgcaaatacaattatttgctggccaacactgccgtcaccattccgttcggttacgcttcttatttggtctacaaaattggaggaggtgtcaggttttttgacaattaatggatcaaaggaatgcattgaggattcagttgcaccgactcaaaaatcgcattgggactgtacggtgcgacgctgctcagcggctgttttttggtgccaacgctcaaaaaacatgataccaaggcggtaggcaacctacaagttcatcttcccatctccaagtccaaccctttaagctgactgccaacgctgttgtccttgccggactttccgtcgccacttctgtggctttctacaacatcgacaagatttccgcttattggac

SEQ ID NO: 45923 - DNA, 624 bp, Heterodera glycines
  Genomic contig location: Contig_ID=SeqID_25338; Location=176..799; Strand=-
  SCN-specific regions: Sequence locations=1-624
  Gene Ontology: Mol. function=protein tyrosine kinase activity; Cellular component=plasma membrane; Biological process=cell proliferation
atggatcctgccgaactcaatttgctgcgttacgaatattaccatggactggtgagtgatgagccccgcccgtgttgtgctaaaatttccctcccattttttcagatcgttcaagaggacctccaagagcggcttcagaaggatggtgactttcttcttcggcgaacgcaagacaaggacgaaactcgcacttttactctgtccatcaacacaaatggagaacttttggatgtgcacttttacgaaaacgccgacgggactttcatgcgtgacaatgagaacatcaattcaattgaaggcttcatcgaatatcaccagcgctcagaggattcgctcattagtgtgagaaaacgggaggatcagaaattcattcaattgttccccctttttttacagggacgttgcgttgttctaaagagaggcgtgaagcatgccgactgggagatcaaacacaaccaactcacattgggcgaggagcttggacgtggaaaatatggcgttgttcttggaggacttttggcgcgaacaccaaaacaaaagaagcgcgtggcggttaaacgacttttggaaactgccaacaagcagaaggtgacatttgtgggagacgggcgggtgtttgattaa

SEQ ID NO: 45924 - DNA, 1029 bp, Heterodera glycines
  Genomic contig location: Contig_ID=SeqID_25344; Location=479..1507; Strand=+
  SCN-specific regions: Sequence locations=1-157,197-452,474-570,593 -598,620-843,941-983,1024-1029
atgtatgctgacgatgttaaattatattatgcccatgaaaacgatgaccattcaaatcagttggataaagcgattgaggctttggaaaaatggtcaaaaataaatgggttagaaatttcaactgaaaaatgttttgttctttatttggggaaaaataacaaaaaagaatattttattaactcaaaaaagatttcagaatcggaaagtgtacgtgacttgggaattataattgactcgaaacttaatttttcagaacatattagcaaaattatacgaaacgcatatcttagaattttccaaattttgagagtgttgaaaagcagggaaataaaaactctaacagcagcctataaaacttttgtacgacctcaattagaatacgctaccgaagtttggaaccctaatttaaaaaaagatatagataaaattgagcgtgttcaaaaatttttcacaagaaaagcacttagaaaatgtggttttgtgtacaaaaaatatggggaaagactaaaaatcacgggtttacacaaattggaagaaagaagaaaaatcaatgatttaacaacagcttttaaaataatcaaagggttcaccagcctcgatgctggaaaaagtttctttttctcagaaaggctcaggaggcctttacttttacgggtaaagcgccacacggccaaaactcaaaataattttttcaatagaatagtaaaaagctggaataatcttccagtggtagcggtgcaaattaataaggcaaaggaattcaggggtttactaaaagcaatgagttctgagtaggaatattcatgtgccatattttacattccatatttaatcacctgtgattttttacatttaatttataatttattttttactctttttattacggtattcattttgtatttttattttgatcaaatttatttgttttgttttctttttggcaccatgtaagagcactaatgtgcctttggtttgctcgataaattaaattaaattaaattaaaattaaattaaattaaaagtaaa

SEQ ID NO: 45925 - DNA, 1168 bp, Heterodera glycines
  Genomic contig location: Contig_ID=SeqID_25351; Location=125..1292; Strand=+
  SCN-specific regions: Sequence locations=1-114,137-346,379-627,649 -747,770-839,862-1106,1130-1168
  Gene Ontology: Mol. function=protein serine/threonine phosphatase activity; Cellular component=nucleoplasm; Biological process=protein amino acid dephosphorylation
atgacgaccatttggcaactgtgcgaggacgcgaccaatgtgctgcgggaccaggcgtcacttgtcgagacgaaaccaccgctggtcatgtgcggagacatccatggccaatttgtggacctgaagaggattttcaacaagatgggctacccgccgttcaccaaatacatgttcctgggtgacattgtcgaccgtggcaatcaaagtgtggagacgattgtcctgctgctgctctagatgtcgtgccgtgccgcgggagggagaatttgatcattttgcagggccaatttccctccccccccccaattttaaggtgcgctacccgaccgaattctatatactgcgcggcaaccacgaatgtgccagcatcaacagaatgtgagtgctgtggtgccgtcccatgtgtcacattttaactcaatttcagcaaaaaaaaaatcccccccccattttcagatatgggttctatgacgaaataaacgagcgttatggacaccacaatgtgcggcctctgtgggagcggttcaacatgacattcgcctggcttccgttcgtcggattggtcagcgactgtattctgtgtgagttttttgccgttgatcggctgtctgatcgatcggacgaactctaatccccccacccttttttaaggcatgcatggtggaatcgcgccggaaatgaccaacattcagcaactccgcatgctgcgccgtccgtacatcgacccgccagttccgtccctggagctcgacctgctgtgggctgatccatcaaccgttgtggaaggcacggcacccaacccgcgtggagtgagcatcctgttcgatgccgatgtcgtcgccaatgtttgcaaaaagctcaacatcgaattggtcgtccgcgctcatcaggtggggctggagaatcggcactgcacatggacgactgtttatcgaagcgattttttttgttgcgcgtaacgcgttgtcaatttttcgatccgcgttttgcctatttttagagggaatagtgggatttgtgtgatccggaaaatttgtctaaggaatttcattcgccccactttttcagtgtgtgccattcggtgtctcattcttcgccaactcctacatgctgacgctgttctctgcgccaatgtatcagactgaaaagaacgtcggagcggtgctgg

SEQ ID NO: 45926 - DNA, 1389 bp, Heterodera glycines
  Genomic contig location: Contig_ID=SeqID_25354; Location=279..1667; Strand=+
  SCN-specific regions: Sequence locations=1-74,96-316,338-657,680 -734,763-980,1002-1246,1268-1271,1294-1389
  Gene Ontology: Mol. function=enoyl-CoA hydratase activity; Cellular component=mitochondrion; Biological process=growth
atgaatatcccaaaacaacaacatggagcaatgccaattatctacaaagaccaactgtgtgaaaaattattaaacttttttaatgcattttctatgtccctctccccattttcaaggagtttggctatcttactcaaaccacacagtcggaggcgctcatcggactcttcaaaggcatattagcccaccaatagataattgatcaatttgacgctttaggacaaaccgagtgcaaaaagaacaaacacggcgaggcgcgcaaaacggagtgagttggccggtggaaatttttttaaattgttttttttggtttaatcgggataatagagaatagaaatgttgtttcggacttttttttgttgttgcaaaaatgctgttttttaatgtttttcgttcaattttttgattgtctgtaataatataaaggaggccgggttcaagtgtttgccagaaatttgatttttttttcctcacgtagaaacaagaaaatatgtgaattttgtagtaaaaaattttttttttggactttttcaggcgtttgggcgtcatcggtgccggtctgatgggcgctggcatcgcaaatgtcagcattgacaagggcattcatacggtgagactgacacacacaaatgggtgggggggggatgggataaatttaatacaagaagaaacataactaaataaattcggtggcaaattttaagtgcgcaaaaaaaatcgcttaatttcgaacgaattaaaaaaacataaaaatttttttttgccgtttccatttcagactcttgtcgacacgaagcaggaggcgttggaccgcgggctgaagcaaatcaccgcccaaatggaggggcagctgaagcgcaggaagatcaacgctgcagagcacgccatctgtctgtcaaagctgaagccggtgagttggagaaacaattgcattccaagaaaatatataatttatattagggcccgaatttttagggacgaaaaattccaatttaaaaatgtcgccaaaaaaggtaaccgctggagaaaaatctttgtagcaatttttagccttctcacttaataggactaattttttgccatttgagtcaaattccaaaaatatgacaaaatgggggttctggcagcacggaaaattttgaaaactttaatgcacttaataaagtgagtcaaattttaaaaaatgttagccttttttttaatttttatttcggcggagtggaaattccctgctctaatgtaatttaaaccaccataaaaaatacaagaccataaaaaatttaacagaactaattctttgaaattttgcagactaacagaggattcttgggacaatcgaatcatattaagatattttgtattaaaatttgggttcaactacaattttaa

SEQ ID NO: 45927 - DNA, 1610 bp, Heterodera glycines
  Genomic contig location: Contig_ID=SeqID_4891; Location=208..1817; Strand=+
  SCN-specific regions: Sequence locations=1-489,561-774,796-1081,1103 -1117,1139-1211,1233-1399,1421-1507,1532-1610
  Gene Ontology: Mol. function=DNA binding; Cellular component=nucleus; Biological process=mismatch repair
atgcgtctgatcggccagttcaacaacgcgtttctcattgtccgtcttcgatcggacgtgttcatcattgatcaacatgcggcggatgagaaatacaattttgagcgtttgttggcacacaatgtgatcaaatcgcaaacactgatccgcccgaaacgcctacgccttggcaatgtcaacgcggcactgatgcgcgacaatttgcacgtgttccatgccaacggattcgattttcaattttacaacggagcgacaagcgaaaatgccaaatggtgctgggaaaacggagcggcggcggccggcaacaaagacgatgccattgtcattgaagacactgagaacaatgatggtgtgcgattattgatggcttttgcgtcatagaaaattggggcgttaaaagatacgaaaatgggagcagttcgttccccctccggccggttcctacccctcttccccctggatcagcccccccccctcccccgaaaaatgtattaaaatttttaatgattttttcaaaagtttgagtttttttttataagaattttaatataaaattttttggaagtttctaagatattcgggcggatagcgcacaccaaggcaaaatataatgacaaaaaatgcggctctaatatactgccaactttttctgtattgtcttacaattagtgccattttgtgatgtccgctcatacacaaaaatgcttgaacgattcatatataaatgttcgaaatcaacactaatcattttttcagttgaacccatccttcttaatgacgatgattatgatgacaatgacgaacaggagaggggtgaggacgagttggacaaacttggcactgttttgttgactgccgtgccggtgctccatggctggcagttggaccgtgatggtcagtcagagatcagaagcaatgattttttggaatttggaatgccgattttggacatttttgcagacattgaccaattgttgtcaatgctctctgaactgcccggcattgtgcaccgtccaagcaaagtgcgcaaaatttttgcttccaaggcatgtcggcactcggttatgtttggaaaggcattgacacaacgtgaaatggaaacggtggggagacagactcattttttgatcatttaaaaaagccgcttaatttttcagataattttcaacatgggctccatggaccagccatgggtaaaacaattgaaattgaaataataatttaaaataattgcatttctaaattttcccaaagaattgtccgcacggcaggcccaccatccgccatttttgtacggttgagagaattatgagttgaatgatttttctcgagtaatctttgcttttattctcgattacatgttttaattgttaccatattctttttttttgtttatacttttcaacttaaaattttgacaattgtacaatttggtgcatttgcataataattttgcaacattttctcctttttttaatgtgtgggcttcgtttatttatgcttatccttcaaaaatatagatatatataatgtttaatgttttcgtactcaattgtttaaaaatacgaattaaaaaacaaaacaaaaattttattcactttttaactaaa

SEQ ID NO: 45928 - DNA, 1057 bp, Heterodera glycines
  Genomic contig location: Contig_ID=SeqID_554; Location=406..1462; Strand=-
  SCN-specific regions: Sequence locations=1-369,392-1057
agccctctaaaattcacgaaggtgtttttgctattgttcgtaaagttggtggtgaacatattcgtttgtgccgtttgataagtgggcaacgcgtgctaattgaacgactgagttttaatccgaaagacgcaattggacatttttatgggattttcgaagtatttttcatataacaataattgtttgaatatcagtctgacaacacacttctgcttaaggtcagcaatggtggtgacatgctttgccccattgaattcgcctcaaagccatttaaaaccgaattttcaaatgggaattcagcaggagataggggccacggaaatggtaatggaaattaaaaaaaaacgccgatctaacatgcattcttggaatttttaataatattcagaaagcactcaacaacttacaagcaatcaaattatgagcttaaaagaggatggaatcactacaaacgaattagtacatctttttttttaactttcctcttcattaatattcagcaaaattcaattttaaggtttccaaattggtcagcggaaattgccatttccaatctcgtacaaaattttcaaaagaaaaatatatgcgaaagaaagttcaaaagcattcggtttgcgactgttcttttctttccaaagcttttttgtttttttaggaccgggttgttattttgcagcccaatattcgccttttggccgactgttactaccgaaaggaccccgaacgactcggacatttgaggttaaaatttactgaattatactggtaatcaaattaacaatgagccgttagaattgaccagctcggactgatgcttcagctttccgggcttcactccggcaaatgcaatgcttttgtcttcgaccaagttggtcaccttatttttgggcatttgattcccatttgatgactttcttcctttcggttctcggattgcttggcgctgctgtgttggaacggataaacccttttggccactgcatttttcttcaccgcggcgattggccccaatccattccatgccttgactcattcactactgacgctcaggtcaaaa

SEQ ID NO: 45929 - DNA, 899 bp, Heterodera glycines
  Genomic contig location: Contig_ID=SeqID_4899; Location=2817..3715; Strand=-
  SCN-specific regions: Sequence locations=1-326,348-899
atgatcagactaagtcaattggttgttccgtatttggagaagacgaaaggaagcattgtgaacggttgtttcttttgcattaattgcaattgcctaattatttggtttagtgagtagcatcgctggcatttgcgcggttcgttagccattcctttcaatttgccgttttatatttaaattctattgccaattcattttttaatttgctccggtagtttttcggggttgttgaccacgaatctaacatcaattttgactaattctttatccaaatttttttttgttaaaatgtcagggatttatgtcattttcgtgattagcaacctgaaaacctccagaagcaagtttcacgattagaccattttcctacaaaaaaatttggaaaccgaaagtgtccccccttttgctttttaatttattcaaaattggtcatttatttgtaaaaattagcgtttatttttcctcgttcagtttcctgctgtgacttactattgcatttcaaaagctgccgttgacaaatttacggaatgcctttccatggaattggcaccgaaaggcatccgagtcaatgccgtcaagtgggcgagggacccaacgggtcaatgaccagtgtttgtcttatttaagccctgcactaatcgtcaccgaattgcatttgcgttcgggaatgcccgaggagcagtacagtgatgtgagtcttgctcaaaatgcccttcaattattcttttttcttcgactttcagtttgttcgtcgcggtgcccaaactcacgcactcggccgagtcggaacgccggaggaggtggccagcagcattctgttcttggcacgggatgccaccttcaccacgggacagctgctgaaaatcgatggcggaaaagcgctgatgacaccgcgttga

SEQ ID NO: 45930 - DNA, 1594 bp, Heterodera glycines
  Genomic contig location: Contig_ID=SeqID_25406; Location=1..1594; Strand=-
  SCN-specific regions: Sequence locations=1-531,553-767,844-972,1051 -1092,1116-1189,1212-1594
cgctccatttaagggtgccatttatgcggcggagaagttcagcacgtgctcccaagtggtcgagaatgcaaagcaaatttccatcacattcccgccgccaaatgtgtcgccggcatgtggcactacaattaaggtccaaaagcaaggaaattagtttattgctcttctcctgatcagtttctcttcaaagcattactttgaatttgatcagactgaataagccatacaatcaatcagtttctgatttaaatagcctcagctttttgcaagaagagcctatttagtagcaacaatgagctttttcctttttctggcaatgcgctctggagacttgtggcttgttgataaatttgaatttaaataccaataaatcatttggtcactgattgggggagggtattattgaccaaataaatcataaccagatcataaaattatacatttgtcctataattgcggacaaaagccaatcagacccattgtctttttttgatcaaataaatataccaataggaaatgggtgcttgatcaaaatcagatataaatttgtccaatcattgccggtaaaagctgatcagacctcctctgtttttttatcaaaacgaattgctttatcaaaaatctttctgtccacaggacggcaaattggaggcgttggtggtcgtctcgttggacggagtgttgccgcaccaggtcaccacggagtgggaccgcttctaccgcgtgtcatgcgacgtgaacatggacattgaccgcttggtgcggaccagcaacagcgctggcggtgccgtagtcagtgccggaggcggcggcggtggtgccggaggtggcgatgccgccggccaagaacccggctttgagggcacagtgatcgtaaccaccatattcgagacaaagtttgtctgtcagtcgggaaacgatagtgcgtttagaatattttgaattgggccacggggaaccagcccagttattatgaattaactaatttaatacttaattaattaacataacaatttttaaccccactcattaattagttgactaattaataagcactggcttcattggcaaatttcatcccaaaatcattcgttaataattaatttaattaatttgtataatccagcttgctgaaaaatggcctgaactaattaactcatacgacaattttcacacccaccaacttattaattagtttaattaattaattgagcgctacattggcaaatttccattcaatgtccaattccaacccaaactcattaattaattcttgtgtttatttttatttttttgtatccgactactaattaattaacaatcctattaattgtttgtccacccatcaaagggaggccgagccccaagtgctgagcgccggcacaccgccgccgatcactgcgcaactgtcgttcctcgacaaggacaaccaaccgctggagaaggcatccatcggtgatcagctgcacttggtggtgaacagcgagcaggccgggccccacaatatgatggtcaccgaatgtgtggccactcgggtgggcggcgaaggcgagccagtgccattcaccatcatcgacaacgggtgaggaggagc

SEQ ID NO: 45931 - DNA, 5721 bp, Heterodera glycines
  Genomic contig location: Contig_ID=SeqID_4906; Location=1..5721; Strand=-
  SCN-specific regions: Sequence locations=1-239,261-463,485-1272,1294 -1495,1517-1567,1590-1816,1864-1957,1996-2005,2027-2426,2450 -3124,3155-3242,3264-3439,3461-3483,3506-3719,3751-3866,3888 -4250,4297-4372,4401-4505,...
  SCN-specific regions: Sequence locations=...4533-4763,4786-4889,4911 -4967,4990-5158,5180-5223,5246-5721
ggtggtttggttaagttccaccgtttcccacgcaccgtctcttcgacgaaggcgaaccgaaaatcggggggagggaaatcgcataatttcatttggcgaattgcccaaaaaccccccaactgccatattctcgttttgtacacattgtggaccgaccatggagacgaggtcggtggcaatgaaacctggttgggacccggggtcaaaaaagacgggggccgaagccggagttggaccattattgttaaaaatctcaatttccttaatcattaaatatgcggtcgggcggttttgcccctcaacaccgaactccgtgacgggtggaaaatggccactttcagcgaccgccgaaataatttgacgcgattccggctgattcccttgagggggagtcacgtgaggggttcccctgccattatgcccttcgttagggattcgcggacccaaaggaattgaattgctaccccttgccgggggccggtccgggccgggacagaccaaaacatggtgccttcccccgcatcggaaacaattggctgcccctgggcagaatttctgattgtgcccctcccgggcgcagagagaacaccgtccttgctcggacagtctcgccctcctctgctccacagtacgataaaccacacagtttgatggtttatggccatctctcaggcacaaagagcactcgggcttgttaaccctttttgggccttcagacactacggggaaggcgcgccgaattggctcaggcgggcgcgggggaggtttatggatttgttggggtgccggactatgcgggatgtcccagggagcatgtacggcttccttaagccgtacgacttttgcaagcctctccctccactgttttgaggaccatggcgccccctcctccatttctttgtcgtaaagttgggccttgatttctgtggggagtttttccttaattgctacggtaagaaaaggattatcgtccaaattagtccccaaactttctaactgccgacaaattcggtcgacattttcggaaaaggcccttagtgaggcggaattacccgtgggcttgaccaaatgaaacagctcgctccggagccggtcggcccgcttgacctcatcgccgtaacgacccttcaaaaggtctacgacgatgggataattatggtcagtgagagaaaacccatccaccaaagtccgggcactgcccctgaggcgacccaccaaataagtcagtttttgggacccggtcaacgaagtattgtcatgtatggtgtgggaaaaggctgcccaaaatgagggccaattcccgtcattcccatcgaaatcgggaagttgaagagagggcaaattaataaggggccgaatcgggggaggggaggctggagcagcaggatggggcgctctcgaagacaaagcgcgtatcccgtcaattttcacatccaatttggtctgcatttcacacccatttgcaatgatgtcgcctgggcatgcccctcccaccagaaattgggaaaaaagcttattttccccgtctcttatttccttttccggggagcccaagatgacggaccattccctcaaaaggccctgggccaggagaattaggcgagacagcttttcagctgtgatgctgatggcctctaaagatgaagaatcgtttggtaaggcctcgaggttaactccccgatttgtttcagaggaaatagccgacagtaaagggaaaagctgttgtcggataatggcggacatttccgcaaagtgtaagcaaaaaaaaaggggggggggggggtaaagccaaaagaaaggacgaaaaaaggactatgcccggttagaactcagtctggtgagagcaccagactcttaatcccactgtgttggacaagggggtaaatgccttgccaaccaggaaaaggagaaaatgggccgggggttccgatttgggtcccgacaagccaacaaattgtaaagccaagttcaaaatgggactgagtccctgtaagccaatggagcaaaagggtgaaaaatgggtaaagcaaacggggggggggcgagaagcaatgggaacgagggggaaatggtaaagccaacgaaagcgaaaaagcctagaggcaagacttaaccacaaaaaaagggtttattaacgaaaaaacgaatggaaaagcaatgaaaaataagtggtttttgggttttgtaaagcagaggaaaaggtcgtcgaagcacaaaaaagtgataggtaggagacggaaatgaagaagaaaaagcaagtcccaagtcttggctcatcatttcttttatactcgctcgggagggcagggcatcgttgggtgggcggatcgtcgggagggcagggcgtcgttttgggcggattgtcgagggggcagggcgtcgtttggtgggcaaattgtttaggcgagaacagtgccggaggggatgatcagccaatggggagactaacagcagaaaggcacgccatcgcacagaattggccccgatagcatcagcgcgagcgtccaaattcctcagcgccccaaattcaccacttcactttaggggattaacaaaagggggggggggggttgggggccgtaggccctgattacagattagtggtttatttggaactcaacaaattggcccattggcaaaagttactaatccccgacccaaaaagttattaatgtgaaaagttatttttattgttttgcaaattatttgtttttagtttgttttattttgttttttaaataatcaaaaaatatggcgtagacactattcatcactaggaatcactattttggagcttcgccactaaaaaaaactatttcggaagttagccactaaaataattttttgccactattttggcgtttcgtcattatttttgccactattttggcattttttgtaaaatttcccaaaaaatgcaataaaaacgaaaaatacaccccaagaatcgacctaaaaaattttcaaaaatacacccctaagaatcgacctaaaaattttcaaaaatacatccctaagaattggaaaaatttcacaaaaattcttcccccaaatttttttttcttgttcaatattttctaagaaaatattttgtaactgcaatcagtgaataaaatctttttccttaattttaaattattttcaaattaaaaaacagctatttaaaaaattacacccctaaatttggaactttttcgccactatttttgccactattttggaatttttttctcactatttagttaattattttgggattttttatcactaaaaatccgatccctattcatgtgtgtgcaaaatttaatttgaaattttattcattttcgcttcatccataataaaaggctgcgaatattccctactcaaaacaaactcttttgaggaaaacgataggaaacagaaacattattaaattggctaaaaccttaaatccaatgcaataaacaaaatcgaattatcaaaacgctttaatacacatagaaaacaacaaaacaaagcaaacggctaaatacaacaatatttttttttcacgctacgggcgcgcgttacgagagaggtcaacagcgctacgagagcgcacaattgggatatactgttgcatgtcaaaaaaaaggtgcaattggtcgtacaacaacttcaaatcaatgtagagctcaaagacgttgagtcggatgttgtcgatgtggatctgcagcccaacttgactcgtcaaactgaaaaattttaaaaatttataatcaaatttatcgggtggtttttttttaacttggtgtccttttcaaacttgtccaaaagtccaagcagcagcggcaactggcggctaatcccagtgagcattcccttaacaaaaacaatttgttgctgctaaatgcacacactgatttaatgcagccccaacctgaaagcgaaagacgtccgcttgcgaccttgcgtcgtcaacgttctgcaataacgttctgagggccagcaattgtccatccaacgacaattgaggcccacttgtgccaccttaacatgttaaagcatttttaaaaaatgaaagaagtgacttcagacattgcgacttacttaaaccagccaaaagtgccgagcaatgagttgaaaagacggcgcgtgtatcgacacgtgaaacgtccagagcaacgagctgcacatggaagtgattcagccacacgtatgcgacatggatgcgatgaataggcgtaaggtccatttttgaagtcaaataaaaacaaaattgaaagagctataattaaaatgtaataaatttttaataaagtatattaaataaatgaaaagcactttaaattgtaaatgcatttaaatttgtaggatcacacgcagattttgagaattgcgaaaaaaatagatatttaaatttgcttttcatatcatttttgtggcacgctttttcagaacagggtggtccggcagtgtttagcatttttatataccgtatatactctttttatatgccagtctccattaatctgccaggggggaaaatataattttttaataatttatttggcacattttccaaaaaaaaattaaactcaattcaacagtaagaggggctaataaatgaacaattcgtcgtcatctccgactccatccagccctgcatcatcatcagagtagggtcggttagccgacttttgcgccgcggacatttgcgccgcactatttgcgccgcgacacttgcgccgctcagcaaaacgacatcaattaataacagttgtggaagattggtatgatgcaattattaatggaaaaaatgcggactgtatttatattgattttcgagaaagcttttgactcagtgccccataacttacttttatacaaattggaaaaaattggtatacggggcaaacttttaatgtggataaaaagctttttgagtaataggacttttcgtgttaaaattggggatgctttatcctcaaataaaaaagttggctctggtgtcccccagggctctgtcctgggccctttactatttttgatttatattaacgatcttcctgatgctttgccatcaggagtgaaaataaaattatatgctgatgatgttaaattgtatatatgctataaagcaagagcagatacagaaattatgcataaagcattgcataatttatcagaatgggcaaataaatggcaaataaaagtttcagttcaaaaaacttttgtattatatttgggttcaaaaaacccaaaagaaacatataaatttgatggaaatacaataaatgctgtggatacaattagggatttaggagtaaacattgataataaattacaattttccgatcatgtaaacaaaataacaaggaatgcgtatttacgtatgcgttccttgtttcgaataattaaatccaaatcatctaagatttggattacgttatataaaacttatattaggcctttattggaatacgctccggaggtttggaatccgtctcttcaaaaaaatattaaaaaaatagaaaagtgtcaaaaatatttcaccaaacgggtattttttaaatgcagccttccgccaattccataccaaaatcgattaaaatacctgcaactgccgacacttgagaataggcgaaagctatttgatctgttcatggcgcataaaattgtttatggccgaacagatctgaaactattttcaatttttaatccatcgacacgctttaacatccccttttacagatttaa

SEQ ID NO: 45932 - DNA, 283 bp, Heterodera glycines
  Genomic contig location: Contig_ID=SeqID_25433; Location=382..664; Strand=+
  SCN-specific regions: Sequence locations=1-79,104-283
gctggtccgatgttcgcttcctcaccgctgcgcttcagcgggctttcgacgagggaggcgatttgggtgcaattttcacatatttaaattaatttaaatttttgttttgttttaaggttcgttgacatatttgcgcgactttgacagtgcgagccaaaggcgaaatgggccgattatattcgcaattgactgtctaaaccgactttactcgaccgaccaccccttttgcacgttgttccgttccgttgggctcaacattttggaccggattcttccggccaag

SEQ ID NO: 45933 - DNA, 1906 bp, Heterodera glycines
  Genomic contig location: Contig_ID=SeqID_4916; Location=2644..4549; Strand=-
  SCN-specific regions: Sequence locations=1-350,376-1848,1886-1906
atggcggacgatgcgccatctacgaacgttcagcaacaatcgaatccttcctcgactctttcaccacaatcgattatttcaaatgttccttcgtctattatggtccaagacgtgatcattgtgccgtcctcgagccaacacaaacaacagaatgccacctgtccccttccttgcttcatgaagtcctcttgccagtcctgcattgactcacagtgcatgtatagtggcgcaaatcccgcgcaagcttaattttaggaaattatttaggtggtgtccgagcaatcaaagatgtgtgtcgatggacacatacatggtcagttttccatacggtcaatgccaaagttgggtgacggcagcgaacacacacaaagcatgtcaaacgagtgagtaacatttgttgggattgttttttaaaggagaatttgtcacatttgagaccctttcgcgtgcgaattacaaaaaacttgttccgactgtcagtccattggcccccgttgtggctggtgcgatgacgggttttgccgcgttttatttccccttttgtatttgtccattttattagatctggtacagggttgggcaaatgcgtagaagggaccaattcgggcgcattggatccgagccaatgcccagctgagcgttggtacttcacaggcgaacccggtcaagttttattggtaattgtgtttagaaagggagataaacgtgatttatcatcagaatgccaatgcaacgggcacagcaattgcacggaaaatgtcacttatcggcgattgcgatgtacgaaatgtcagcatagaacgaggggtgaacattgtgaactttgtgagctcggcttcttcggcgacccacggaatggtgggacctgtcaaggtacaattcgtacgcattccaatcgtttttaggtgtcattttttagaatgccaatgcaacggccaagcggcactttgcaacccagtaacattaataaaaaacaattagatttataaatgaccatatttggtgttcttttgtcagctaaacggcgactgtttttgttcgacaaaaggagtaattgggccgcggtgtgacaaatgcgagcctaaatatttcggagacccgaaaaacggcggcacctgcacatgtataaacaaatcttggcttctatttctgcgaattacatcgttatgatttagatgaacttgccattgacttcatcttcacttttaagctggacagcaatgacattcgggacaaatacgttaatcagatcaactttttcagcgtgccttacaaagtatgccttgcctttttcttgcagaatataaaaccggggtcctccgattaattttgtcggaatttacttcggtaatgcatttgcgaacttcaattattccttctgctaaactcaagaaagcatataatttattaatttactgtatagcgtgacacggacgttcaattctcgatcacatgcgaaggcgacaccggcgcaaaagtgaccattaacctgaccactcagttgctcgaaggccgtccgcctcacacaaagcatttgatggccggtcagttgtgcacggcttcagggataaagcgcacttacagctcaacagatcccggtaattgtcccatcaattgggtggaaggcgattaatgtggtggaaaatgcttaaggatttgcattcggaacagaaacaaatacgacttttcacgttcgggttaatgatttcgagacaccaattaaggtataaacaaaccgggaatttttttatccaattctttttcagatccaaatttcatttgcacaatcattgccaatcaattggattttgttttttgttatttttgcagcgtaagctttacttgacatttagaaattacattattttcagctgtttcattgttcttctcgttgttgcgggattga

SEQ ID NO: 45934 - DNA, 714 bp, Heterodera glycines
  Genomic contig location: Contig_ID=SeqID_25455; Location=96..809; Strand=-
  SCN-specific regions: Sequence locations=1-220,242-291,313-714
  Gene Ontology: Mol. function=snoRNP binding; Cellular component =nucleolus; Biological process=growth
aattcgttggatatcaaatgcttacacaatagcgcagtttccgaattgatgcgctcaatccgtgcaaatgtcagcagtttcttgggcgaagaaacagcacatgaaatgaatgcgatgcgattgggtgtcgcccattccatcggccgttacaaagtgaaatttaaccccgagaaaattgacacgatgatcgtccaggtgaagagaggcggcgcactttgtggttttataatttcttttttaaggctgtttctcttttggatgatttggacaaagaattgaacaattatgtgatgcgttgtcgtgaatggtatgggtggcattttccggagctgggaaagctaattgcggatgctcaagcgtatgcgaaggtaatggggaattaatacattgtttaaaattaagttcattaaacattgtttcttcagtgcgtgaaagcaattggaatgaaagcgaatgcgcaaaacgccgatttaagcgccattttgcccgaagaattggccgaaaaagtgcgacaggaggccgaaatcagcatgggaacggacatttccgagctggatttgatacacattgtcgagctgtgtgaccagatcgtagaattggcacaatatcgcgcacaattacacgattatttgaagaaccgaatgaatgcacttgcgccaaatctcacagttttgcttggagaattgatcggtgcgcgtcttgtttccaaagcag

SEQ ID NO: 45935 - DNA, 699 bp, Heterodera glycines
  Genomic contig location: Contig_ID=SeqID_25470; Location=64..762; Strand=+
  SCN-specific regions: Sequence locations=1-141,186-192,214-237,259 -332,354-699
  Gene Ontology: Mol. function=chromatin binding; Cellular component =polytene chromosome; Biological process=establishment and/or maintenance of chromatin architecture
aaaatcatctcgcgcagtgccagggctggcctccaattcccggtgggacgcatccatcgcttcttgaagaagcgcacaacaagcaccggacgagtcggtatgttttggcgaattttcggggataaaatttgaaaaaaaaaattttttcaaaatttcccaggcgccaccgccgccgtgtacagcgcagcaattctggagtatctgacggccgaggtgttggagctggccggcaacgcgtccaaggacctcaaagtgaagcgggtgacaccgcgtcacttgcacttggcaattcgtggagatgaggaggtgagggggcggtgaaacaacaaaactttgctaactttaggattcccttgaatcctttttttggtctttcgaatttaaataattttgataatttccctgtgtcttctgaaggcatcatccgttatccgtcttaattttgctttttccgttcagttggattcgttggtcagtgcgacaattgcgggcggcggagtcattccgcacattcaccgttcgttgatgggaaaggtcggcgcaatgggcaaatagaacaattccacccccgtacggttgttttccttcagcctccgagtcaactcaatcacagtcagcagcagaatcattcgcagcagcagatgaccaacgttggcaatggcgacaactgattttggccaaatgaatatcgttctttca

SEQ ID NO: 45936 - DNA, 1283 bp, Heterodera glycines
  Genomic contig location: Contig_ID=SeqID_25486; Location=270..1552; Strand=+
  SCN-specific regions: Sequence locations=1-45,67-431,453-577,599 -775,800-801,823-1283
  Gene Ontology: Biological process=reproduction
gctggttcggctttggactccaaagaggaaaagtcgtcggacattttgtggaaaatggaagaaaagttgcgcattaaagcggacgatgaggactcgcgtttgccgaccagcacaaaatgggacaaatacttcacgaaaacgttccaatttcagcgctgccaaataaggtgacccaaggaaaaatgaactggatgtgccaaagtttcccttctgtttcccagcaagtccaccttcaatttggttgtcgttctgcacgatgtgttgcgcgcggctgcggagacggactcggagatggaggcgagtcggctggtcaccacagcgcggaacattgtcgaaatgtttgccaccactgcgcccgaataccaccgactcactctttcgtccgtcccgcacatggccggtgggtgtttcagctgttttccatgggaatgtcctttttctttcattaatttgtgcctttaatttcagctgttttcttcaacaattgtcatttcattgtgcaccgattgagcacactttccgccgacattttgcagaacattttgacagtttcgaaggtttttttcaccgttaattttgtaaaatttgacagaaatgactcattcattgctgcctatcaattatttttcgtaaatttatcattcagatcactgggcaggactgcgcgttcaccgatttgttcaccgaactgcgaattttggctgccacgactttggagcagcacattacgcaagcgcgacgccaactttcagccacaattggcgaacacgacagtgagtgggaggagggaggggaaggaagaggcacttcattcctaaaaaagccaagataagccagaccaaatgcttcccagatgtggcacccaaagccctgacaaaatgattgcaactttggaaacccgaatgaaacagaaaatacttttcaaatgtcatggtcggaattttagtttttgtcggtttgcgtgacgacagaacgaacaaacactgtgtaaagctgctcaatggctgtgtgatgcaactcgagcagactgcttcagtttggcgagaggtgtgggaaaagagtgaatttcttaataaaatgccaataaacgcatcaattttgccgcattttcccaggtgctgtccgatttcgtgctgacgcattgtgtcggcgagttggtttcgtatttgttgtccgcaatggcgaacataatcctggccaaggaggacatcgcctccagcgacgcggagatttcggccaatctgctgaccacgactgtcgaccgctgcaagaaattgatggag

SEQ ID NO: 45937 - DNA, 1413 bp, Heterodera glycines
  misc_feature (1176)..(1176): n is a, c, g, or t
  misc_feature (1309)..(1309): n is a, c, g, or t
  misc_feature (1344)..(1344): n is a, c, g, or t
  Genomic contig location: Contig_ID=SeqID_25495; Location=475..1887; Strand=+
  SCN-specific regions: Sequence locations=1-234,272-423,448-463,485 -555,579-1070,1092-1413
atgtctgacaagtttaataacaaaaaaaaacagcacttttctagtttactcacaaaaatccaaaaaagaaaaagaaaaaattatttttagagcaaattagggactataatcaaaaaattttgtacaacctgaatctgaacccgatactcgaatataaaaccgaagaatttttattttatattagagcggctcaaaaatgcaaactaaattaatgatttctttttgattttaagcaaaaaataattaaaatattgtaataatgatttaaaaacgtggtacttttccgtttggaaccgcacattcaattttttttttgtccaaattgctgctttcctctcaaaaagtgaagcgctgttctttaatattcagtgcgcaattgaatttatttaattcagttagaagttaggaattacatttttactctaaaaatatttttttttaattttagcaattattttgtgatataaagcagaaaagtaccaaagaagcgaacttctcagaattctcccaattctgctcaattttaattgtatcgatcagactgagaaagtcgcgaatgccattttttaaaaacataatcgcttccttaacaaatttaaagggattaattaatattggtcggttggtcccatcggttacctcacagcccaaaatattttgctgaattcggcagatttcgtacattgaatcgactgatgcttttagagtgtcgatgcagtagctccattctcgggcttctcgaattttgtcagatatggacatttgaaattgaagtaatatttgtatttttcgttatttttttatttcttaaatgctttaagcaattccatatttttaattaaatttggcattatggcattctgaatctttttaaaaaaaagtcagccaagtgattgaagattttatgctctcatgtgatttgtaagcaaatttttgtcaaaatgagtcatgacaatggtaacaacgcttttcccgccgcctcgtccatttacccctcccttccgtcggccctttgcgatgaaaagccttcccccgccgccgttttgtcccattgcgatgatatggaaggcatcagtctcttggtaaaagctgcggattttgcagctcgtagacaccgtttccaaaagagaaaggacgagcggacgccttacataaatcacccaatcggagtcgccnctctgctgataaggtaaaacttttgccaggctaattcgaacaaagcgaagtctgccgcttttgcagcgttgccaaagtgtacgaccccgccacattggctgctgcttatctgcacgatttggtggaagacacncaaacgacgtttgaggagttggaacacttttcggnagagagtggcggaaattgtcagagaatgcaccgacgacaaaaacttaccgaaagatgtgcagaggaaaa

SEQ ID NO: 45938 - DNA, 745 bp, Heterodera glycines
  Genomic contig location: Contig_ID=SeqID_25497; Location=1021..1765; Strand=-
  SCN-specific regions: Sequence locations=1-257,280-312,408-496,520 -627,664-745
  Gene Ontology: Mol. function=transcription factor activity; Cellular component=nucleus; Biological process=regulation of transcription, DNA-dependent
aaccgcccaactgagcgccgctcccccaacccattatcggccgagcgagcagaagaagcgcaaaaaccaaacggctggcagctcaacgcaacaggcggagaaaagggcctccgactccgtgacgcacttgcggcgttcgaacggcgcttcgaatcgatcggcggacggagtgaaggaaagcggtggtggcaaagagcgctatcagtgccgatactgtcaaaaagtgttcccgcgttcggccaatttgacgcggcatttgcgcacccacacgggcgaacagccgtacaaagtgagcaaaatgagaaatgagcggagggggagggggggagaggagagagagaatagggagggagggagagagaaggggagagaaatagagagagaggagcgagggggagagagagggaaaaggtttacattttggactaatttcccatatttgcagtgccaatactgcgaacggtccttctccatcagctcgaatttgcagcggcatgtgcgcaacattcacaacaaggaaaagccatttcggtatgttttttggcagaccagttaaataactgtgattagattgtttaattcagtcggtcaaattgctccattctgcaattaataaatcgatcaaccgattgattggtttattgattgattgatcaattcatttgcttcagctgtcactattgcgaccgatgcttcgggcaacaaacaaatttggaccgacatttgaagaagcacgagaatgaaa

SEQ ID NO: 45939 - DNA, 1770 bp, Heterodera glycines
  Genomic contig location: Contig_ID=SeqID_4934; Location=1009..2778; Strand=+
  SCN-specific regions: Sequence locations=1-602,626-646,669-691,713 -1035,1058-1477,1499-1513,1541-1694,1716-1770
ttaatgggttttgtgcccgtccaggacaatccgataagcgaatgccgaatggccgagttggtccggcactttttcgccttgggttggatgtgcgacaacggcagcggaatggcggtccgagtgaaagacgaacggacgggcgaacatttgattctgaactcgtccaattcgttggagaaggaaattttttcggagtaattagtgccaattaagcacacgcattaatttaacatgggcaattaagaaacgatttatttgtgatgaaaatgaacggcgaaattttgaaaagcccgtcaaaatcggaccgatctccgacggcgccgttttatttactgcgcgacaatccgggtaaatgggaataacattcaattgataaaggagaaaattgcagatttggcctgtgtcattcacactcactcaaaatgggcaaatctgatcacccaactgatcagaggagacgagttcaaaatttcaaaccaggaaatgattcaggtggacaaaaagccatgctgagggggtaatttgaaaaagccatggattagtagaaattcgaagctaaatccgcaactgtgtggtgagatcagagaaactatgaaaggattaatttaagaataatttcttaaataagttacacatttaattattttgtttgttgaaaaattaaataagaattatttttaaacaatatgctatcacattgctttccttgtccatgtaataatttcgtaaattttcacttttttcctttttttttgttagggttgtgaaaatcgtctcacaaaaggccgtctggataacattgacgtgctagtggtgccaattgtgcagacagagatcaatgagcatatgctttatgtaagcacagagagaggaaaatgaaaagggagtccattaatctgattaatttgttagccaattctgctgaggacactgaatcaaaacgcgggggcaagtggcattttagtgcgtgggcacggctttttctgcttcggcagcaacagttggcaaagcaccaaaatgatgttgaaaattggcaataaatgaatttatagaaatcatttccattgtcaggttggagtgctacgagtatttgttcgaattggcatgcgaaatgcttaattacgatttgccattggtcaaaagtccaacggatgaggcgggaggagaagaagcgaatgacaaattggcacaaagggcgcaagaagcggcgtaaagaggacggacaaaatgccgaaaaataagggacaaaatgagacggacaaattaaataacaaaatgaaaaaataatatttgaattttcaataattggaggcacaagcgaaattggggttcgaaatttcgtaaaaaataaatacggacgacggaccaaacaggtagtaacagtaaaacccaaaaataattggaatttgtcggttgctgattcggtcggtctttgtccatccgtcgcacttttacaaatcaatcagctgattctaattaaatctttgatggatgaaaatagagaaatttaaataggcaaagaaataaaaataaacaaaggaatttatatgttccccgactccagttggcgaagcgggtcaactccgtcgcgccaactccgtcccagccaactccgtcccgccaactccgtcccaggccaactccgtcccgagccaactccgtcccgccaactccgtcccaagcaaaaattcaagaatttttttaaaaataaatttgagtttaacaaaattttatgaatgggaaacaaaaaatgataaattttggctttat

SEQ ID NO: 45940 - DNA, 2393 bp, Heterodera glycines
  Genomic contig location: Contig_ID=SeqID_4935; Location=963..3355; Strand=-
  SCN-specific regions: Sequence locations=1-18,85-125,149-231,284 -325,454-612,641-714,736-878,917-1161,1183-1330,1361-1465,1487 -1493,1515-1993,2015-2083,2105-2393
  Gene Ontology: Mol. function=UDP-glycosyltransferase activity; Cellular component=endoplasmic reticulum; Biological process =metabolism
acaaagcgtgtgaaagtgaattaataattaattaattgggaaattgaatttacaaaaaaaaaaaaaaatattttaagaatttatcacctctaatccggatttgattgaatcgctgcgcaagcagaagttcgacgtggtcatcgaggagcagctgaacttttgcggtgccgggctcggccatttgctggccattcccattcacattctcatcagcaggtccattgtttgttgttttattaaattttaatcattcatttttaatgaatatttaattaattaatttgttctaaatccattccttcgcttttaaagttgttttggtcagttttttattttattaattttataactaaattttaattaaccactttttaaaattaatttaaaataattttctttttttgttagtaaattcattcttcgttttttaatttaaaaaaaaaattaatttaacttcattattttgttagtaagcccattccattttttaattgttttcgtccgtttataattactttgaattaatttctttttgttagctaaattttaaaattaaccatttttaaaatgaatttaagttaatttgtttttgttaatttgtccattccttcgttttttaattttaataaattttaatttaccatttcccttattttccgacttccttctcagctgtcctctccaagagcacgtcgcttctcttttcggccttccttttcctttttcttatcttccttcgctaatggacgcggatttgcccgacaaaatgtcactctctgaacgatttgacaaccttttgcgcacctttgtcggttacgtttatctttggcatggcattgatccgctgacgaatattttccgaaaacatttcgggtcatttaaatgctttggtttaattaattcattttatttttgctttcaacagaaacgatttccccgaccttcgcgacattgtcaaaaattcgccgtttgttttcgttagtgtggacgaactgctcgattttccgcgacctctcttcccaaatatggtgaacatcggcggaattggcatggacaaattggacaaaaatgccaaattggaggtattctgacaaatgagcagcccaccgaaagagtgcttttgtgataaagcaacattttgagttgttttccagcggtgtttttcgggacattctgggatgtcttcgctaggatttttcaacattaattctaaaaccctaaaaagtgacgatttttgcataaattatccaattttctgtggcaccgctcctccattctttcttaagaatgtacagttttacaaatgagctctaattaatttttaggagccatttaaaagtgaaatgagcaaaggaaaggaaggcgttgttttcgtttcaatgggcaccatcattcgctcatcggaccttccggccaaatttcggcggaaccttctcgaaacttttgcaaaattctccgattatcacttcataatgaggatagaaaagggggacaatgtaataaattaaataattaagagccatcatttcggtttttagtattcagcggaaattgcagcgaaattcggaaacatttttttgacgccgtgggcgccgcagccggccattctcggtaatgcaatgggatgcgtttatttgcggcgtatttaaacccttttgttttcatacggtatcaatgcgcataattttttcccatttcattacgatacatcccataattttgcccatttttcattgtccattatctgctttacccaattggtcggtttgcagctgacccacgtctgaaactgttcatcacccacggcggctacaacagtcttttggaggcgacgcgcggcggagtgccggtgctggcgatgggtttttttgcggaccaacaccgcaacgcacgagcagcggaacggaacgggtgggcacgctcatttgacaagttgaagctggtcgaaggcacggcgcagttcgaggcgctgcttggcgaaatgctcaataacgaaaagtaaacacaaaacaattttggcacaatcaaataaaagtgccacttttcaaaccaaaagatacgctgtgggggcaaaaagaattcaaaatttaatgagcactaaagtgagttattagcaaaccacttctttttgcatagaaagcctttaagccattcccggccgaagaacgactcaccaaaagcatccgatttctcgaacaaaatgggggaaaactgccggaattgctgagcgaatcgagaaatatgggcacaatttcgctgtacaacatcgacttggcgcttattggcattgttttgttggtacttgcattcgccctcactttttttgtgtgcaaatggattttggcattaattgcaaaattaatggacaaaatgaggggacaacaaaggccaaa

SEQ ID NO: 45941 - DNA, 323 bp, Heterodera glycines
  Genomic contig location: Contig_ID=SeqID_4937; Location=1797..2119; Strand=-
  SCN-specific regions: Sequence locations=1-56,78-190,213-323
gtcgctcccgctgaactcgaggatttgctgctgtcccacgcgggcatcaaagactgtgcggttgtgggggtggcggacgaactcgcgggggaagtgccgaaggcatttgtggtgagggcggatcagacactgaccgagtcggaattgaagcgatttgtgaggggtacgtaagcaaattagcaccacttttaagattcattttcatagaaaaagtggcctcctacaaacagttgggctcggtcgaatttgtggacgaaattccgaaaagcgcctcgggaaaaatattgcggcgagtgctaagggaaaaggacacgaagaaatcg

SEQ ID NO: 45942 - DNA, 739 bp, Heterodera glycines
  Genomic contig location: Contig_ID=SeqID_25547; Location=703..1441; Strand=-
  SCN-specific regions: Sequence locations=1-192,215-276,308-320,342-739
  Gene Ontology: Mol. function=endopeptidase activity; Cellular component=proteasome core complex (sensu Eukarya); Biological process=proteolysis and peptidolysis
atgcttatgatctcgaacgacgacgaaaaaggcgcttctgttttttccatcgatccagcaggacattacatgtaatgtaattttgactgaatctcaaaatattaagtttatctgctatgatataatttttcaacatcctaatagattctgttaaaatagatgaaaaattaacggtcccagggatcaaagttcgaaataactttcattttaaaaagctttctaccaaaatacagttctgttcgtggttacggcattggagtcaagcagcagcagatcaacggttttctggagaaaaaactcaaatcaaaagaccgaaaattcggtgacacggaagtgattcaactggcgcttgaggcactgcaaaccgggctgggaattgacttaaaggctgacgaggttgaagtgattgttgctacaaaaacggacccgaaaggagtcaaagtgagcgacaaaagcattgaggagcatctgacggcaattgcggagagagactgaggacgaaagtgatttaaaaacaacattttgtggtgttatttttcgctcttctaattatggttttaacagaaaaaaatttgtttttcttcagttgattatggattttctattttgggggggggggggggggtgggttaacgaaaacattttttggggtattaggtagttacaatttttaattgacggggttgatttccatttaacagctttttacacttttataaatgcgcgatgacagaataaa

SEQ ID NO: 45943 - DNA, 2341 bp, Heterodera glycines
  Genomic contig location: Contig_ID=SeqID_4941; Location=1838..4178; Strand=-
  SCN-specific regions: Sequence locations=1-424,446-724,746-766,789 -1045,1075-1334,1356-1374,1399-1564,1588-2069,2091-2198,2220 -2222,2244-2341
atgtgttttacgtaacatgaaattttacatgaaaaacttcaaaacttgaaaacaaaaatttaaatatatagttgacacaaaggcaacaatatttcgtaaaatctcattattgatttctttttgtttccttacatttaagccggttttagaccaaaaatgcaaaaatagaaaaattgcaagttttgcttttttgttcgaatttgggttcgattgggtcgaatggatacaggattcggattctccgaccgtgaaaacccctaaaatgactttaaacaaatattttctatccgaatttcagctcttcccacgcttgggattcgtcgcacgcgtggctttctggggaggagaagtcccgacttgaagtcgttcagcgggaatggcgcctgagtcggacagcgagcgcacaagcgaaagtggaggaagaagtgccaataccagcgacagctttgaagccacagacatcgctagagctagacgaggtcaagaaagaggcggaatcacgacgagaatccgctgaggattacgacgaggactatgacgaggaaaagcccattgacaaatcgcctggtaattagcgggagggaatggctcaaaggtcaaccacaaatcgtttctttagataaccgatttttgaaatttgatgaggaattgggtcgcggttcgttcaaaactgtttaccggggtcttgacactgaaacaggcaaatgcaattgttcacattggcatcacatcactccacaattcattcgtttctgcaggtgttgctgtcgcttggtgtgaattgcaggaacaaaagttgaacaaagcggagcgccagcggtttcgggaggaagccgaaatgctgaagggcctccaacatccgaacattgtcaaattttacgactattgggaacggacggacgggaaaaaaaagttggttggctttccattttattttgtttggggccgtcgattcaaaaatgcaatttgcagatacatcgtgctcattacaggttgtttgtgcacacaatttccaaactgtcctttccttttacattcattgggcaaatattttccattttttcccattatttaggtcgatttgtgcattagtctttttagtgttccctccgcttacaattgctttgcttatgctttgccccattcagaactcatgacttcgggtacgctcaagttgtatttgaagcgtttcaaacgaatcaatgtaaaagtgctcaaatcgtggtgccgccaaattctaaaggtgataatgccatttagattccctgtcatttggtttaatagctgctttaatggtctgacttatgcaaggatttcttcgtttcagggtctctattttttgcacacgcgtcccacgccggtcatccatcgggacttgaaatgtgacaacattttcattactggcacaaccggaagtgttaaaattggtgatctcggtaggtcgaggaatgctgaaataaaatattaatttcgaatggtttcgaacgtgacctaaacgccctgacaatccttttcaggtcttgccaccctcaaaaacaaatcgcacgcaaaaagtgtaattggcactcccgagttcatggcgcccgaaatgtacgaagaacaatacgacgaaagcgtggacggtcagttatgcgtaaagcatacaataacacatttaatatgtttagtttatgcatttggcatgtgtttgttggaaatggtaaccggggaatacccatacaggtaattgttttgatgctttatttgcacgctttgcaaaatgagttaagcgagtgccaataccccgcccaagtctatcgaaaggtcatttcggtaagcgattcaaagacagcaaaagcgagtcgatcgaattgatcggccctttcttctgtttagggagtgaagcctgcctgttttgaacgcattcaaaacccggagatcaaagaggttgttactccactcctttgtttgactgtgttttgattgcccaattctgaacagataatcgaacgatgcattcggccgaagagagaggaccgatcgaatgtgcggcaattgttgaacgacgagtttttcatgccagtccgtcttccattttttaatcaatttttcatgatattctttcaggaggaacaatttggcattcgagtggacattcagaacagagaccaggatttgagcagtgccagcagtgaggtgatgccgttgaatgccgcccaccctctttgatttctgtggatgaattgaatgaaattgccaaatttatgtatctgcgtcgctaaacaaaaatttttaaatttttcgactgactcccttttttcatttgcttaatttttccaattacttattccactataataaa

SEQ ID NO: 45944 - DNA, 756 bp, Heterodera glycines
  Genomic contig location: Contig_ID=SeqID_565; Location=608..1363; Strand=-
  SCN-specific regions: Sequence locations=1-23,46-190,242-407,429 -569,591-615,644-756
  Gene Ontology: Mol. function=DNA binding; Cellular component =nucleosome; Biological process=nucleosome assembly
atgccaccaaagccatcgggaaaaggggcgaaaaaggcagtgaagtccaccaagacggtgcgcacggctgacaagaagcgtaagaagtctcgcaaggagtcgtactcagtaagtttattgtgccccggggcgtgagtctgagtgttatggccagcacttaaaacccctgtttttaggtctacatttaccgtgtgctgaagcaggtccaccctgacaccggcatctcgtccaaggccatgtctattatgaactcgtcggtctttatgaattttttaaattttcgcttttcttttcagcttttaagaggaatttcagtatttaaggctcaaagatatgaattctttttcgagaaaatcacgccttcaatatttgacatttcaatgctcaaaaaagggatttttgcggtcaaaaatgaatgaatttatacattaaaaccaaatccaatagctaatattgcatttttattcaactaaatgcatttttccaagcaatttttcgctaatttccaataacctaactattttgacacccaaatttaatgcaattcaattttccctgcctttttttaggtttgttaatgatgtgttcgaacgcattgctgccgaagcatcgcgtctggcccattacaacaagcgctcgacaatctcttctcgtgaaattcagacggcggtgcgtctcatccttccgggcgagttggcaaagcatgccgtttctgaggggaccaaagccgtgaccaaatacacctcgtcgaaatga

SEQ ID NO: 45945 - DNA, 934 bp, Heterodera glycines
  Genomic contig location: Contig_ID=SeqID_25605; Location=694..1627; Strand=+
  SCN-specific regions: Sequence locations=66-77,99-122,168-225,251 -280,322-337,427-427,451-672,695-696,735-794,820-900,923-934
  Gene Ontology: Mol. function=protein binding; Cellular component =endoplasmic reticulum; Biological process=cell cycle
atgcttccgtctaatcctgacgacaaaatagatgaggtcgacaagattctttcaaaacttgatgggtaaatacttcatttattcattttttgtgtttattagtattaaaatttgtttattaagaaaaattgaacgtaaaatggaccctttgatgtgtcgccataacccaagacagaaatgcacaaattgtctcccattggacgtaccttttctaattcagaaatgaatattaatttatttatattttaatcaaaagtccttttctctcattcatttttagccctacgatgaaaaatttctgcatgaaaaggacatcaaacatttgtcttttcatgctcatgtgcacaaattgaccgatttgcatggccgagggacgcgttcaaacaatgtgttggagaatgtgtgctgcaaactgcgcccgaactgcgcgggtggccatttgccatacccaaaaggcatttgcacgcgttgccgcccctcaacattgacactcaacagacaggtcatctccattttggccatttaagcgaggaatgagaaaattgggccattaatatcaaatgccaattccgacacaaaaaagaacgaattaatcaaattgtccaactaactggcatttttgcggtggcacagcaaactagggtaatagttaagatggttgcccctatttttgtcggaaattttcaaaatttaaaaagtcctttcaaaacaagtttttagaggttttcgaggtagttgatcacgattctggcatccatttcgcccaatttcgaatcccggacccgaattcgaacaaaaagtcgaaaattcaaattttcaagtttcgcatttttggtctaaatatgacttaacttttagaatgttttcatgtatttaaaccgatattgaaccaaaaatgcgaaatttgaattttcgactttttgttcgaattcgg

SEQ ID NO: 45946 - DNA, 579 bp, Heterodera glycines
  Genomic contig location: Contig_ID=SeqID_25630; Location=1..579; Strand=-
  SCN-specific regions: Sequence locations=1-21,43-579
  Gene Ontology: Mol. function=GTP binding; Cellular component =nucleolus; Biological process=rRNA processing
caaaaagggaggaaaggttttgaagaaaaagagcagaaagagtggggatacgacggcacaaagcggcaacaacccaaaggcgttcaaatttcgctcggcgatcaaagcgcaaaaactcatccgaaggcgggcgaaggacccacggcgcctttttaccaagtcattttcagggctgccgatctcagcgagaagaaaaagcacattccgattgtcgaccgaagtcccgacgtcctcccgccactgctcgttgcccttgtcggtcccccgggggtcggcaaaagcacactgttgcgctgtctggtgaagaattacgtcaaacagagcctatccgaaataaaaggtggcaatttgttttacctttgttggccaatgtttccatttttcctaaggcccagtgactgtggtgaccagcaaaaagagacgggtgaccttttttgaagtgccaaatgacataaatgccatggtcgacgcagcaaaaattgccgatttggtcggtttttgtggatatttggataaagaattctttcgattttctaggaccgcattatcatcgatgcctctttcggctttgaaatggaa

SEQ ID NO: 45947 - DNA, 1277 bp, Heterodera glycines; identical to SEQ ID NO: 25689
  Genomic contig location: Contig_ID=SeqID_25689; Location=1..1277; Strand=+
  SCN-specific regions: Sequence locations=1-1277
  Gene Ontology: Mol. function=TAP2 binding; Cellular component =mitochondrion; Biological process=positive regulation of growth rate

SEQ ID NO: 45948 - DNA, 1780 bp, Heterodera glycines
  Genomic contig location: Contig_ID=SeqID_25690; Location=1..1780; Strand=-
  SCN-specific regions: Sequence locations=1-418,440-698,722-811,853 -920,942-1235,1258-1780
  Gene Ontology: Mol. function=protein serine/threonine kinase activity; Cellular component=membrane; Biological process=asymmetric protein localization involved in cell fate commitment
caacaacctccacaatcgtcctccgcgacccatcaaggaggtcatcatcgccacacatcttcaggccatcaccgttcgtctggaatgactgcttcttcttcgcgtgctccgaataggacacgtaccggagatgacctgcacattggcaagtacaaactgctgaaaacaattggaaaaggcaacttcgcaaaggtatgttattgcggttataagtttctaaaaaattaatgattgataggtcaaattggcaaagcacgtgccgaccggagtggaagtagcaatcaaaatcatcgacaaaacggcactgaatcagagcagcttgcagaaggttgtctgtctgtttaatggtgaataactgaagtaatgagaagttttttcctagctttttcgtgaagtccggatcatgaaacaattggatcaccccaacattgtcaagctgtaccaagtaattgagagtgagacgactctgttcctggttatggaatatgcgagtggtggtgagttgtttgattatctggttgcccatggacggatgaaggaaaaggaggcccgggcaaagttccgtcaaattgtttctgccgtccaataccttcactcgaagaatgttattcatagagatttgaaggtttctaaactaattcttattggaacaaattttgtggttaaggcagagaatttgttgctcgatgccgacatgaacatcaaaattgccgactttgggttcagcaacacattttcaccgggcaacaaactcgacacattctgtggcagtccgccctatgcagcgcccgaattatttcaaggcaaaaaatatgacggtcctgaagtggatgtttggagtcttggtgttatcctttacacgcttgtttccggcagtcttccgtttgatggccaaaaccttaaggtacacttaaacacacaattaaattcaaattgaactttttgttaggaacttcgtgagcgggttctcagagggaagtacagagtccctttttacatgtcaacaggtccgaaactgtgcaattcattgaagaatattatatctaattttagactgcgagaatctcctgaagaagtttctcgttttaaacccgataaggagaggaactttggagatgataatgcgggataaatggatgaatatgggctatgaggaagacgaattaaagccttacaccgaaccgacaaaagacgttcgggatgaaaggcgcattttgaagttgcaagcatttggctacactctccagcaaatacacgagtcgttggaaagagaaaggttcgacgaaattttcggcacgtatttgctgatgaaagaggcaaaaaagcacgacgcgcaaggccaatcgttgggagggagtggaccaaatgcgacggccgaatcgccgtttaatcaatcgatgggtccgaccgtgccacaatcgcatggggtggccaagtggtcttggctttccatgtgataaatcaaatttattaagccaacggtgtcaaatgcgaagaacagcagacgctcttcttcaaatgccgaacaaatccaaccacaacaacatgccataacatctcacagcgtaataaaccaacagtcggctgctcccatccaacaaatttcggcaactccacaagcgattccttctcgtcaaagtcaaactgctccgggacaagtgacgttcagaacggcacaattcaccagtcgccaaccgactctcagcgttcaaccacaaggtgaaacgactgaaattatcaaagaacttataattatggtattattttttgtttcttttac

SEQ ID NO: 45949 - DNA, 1368 bp, Heterodera glycines
  Genomic contig location: Contig_ID=SeqID_571; Location=4580..5947; Strand=-
  SCN-specific regions: Sequence locations=1-1368
atgagcgtaattaagaagattgacaaagacagtgttgagggtctagaaggaagtctgtctttattttctctaccgccaacaaatgtggccataaacaagacaaacgttcgtgaattgctgcctctgtctgctcttaatcaaacaggtccctatttgtttcgcttgttctcggacagccaatattgtgacttgagcaaaacctatatgtacctgctcagctcaattgaacggaagaatgatgcgggagaatgggtagcactcagtgacacggacccaaatgataaacatgttggggtcatccaaaactttggtagcagctttgtccgctcgctgaaggtcaacatttcaggtattgaggtgtttgacagttcaatttattatcactaccgtgactacataatgaaggagttgggctattcacaggaaattcgtaaggctttccacgaggcatcgtgctactaccccgacgatgatgaccagaacagcgcaacaaacccaggttttaccgcacgtgcggcacggttttcaggcggtaaacagtgtgagacaatggtaaaactgaattttgatttggcacgtcaaaatgcattgatgttgaacaatcaggatgtaatattcactattcaccgcaacaatgattcattcctcttgcttacgcccccatacaaaaaaccagatggtacactgcaggaaaataagaaagagtaccgtatacgtgtgcatgacatgcgtctctatgtgcgcactgtggacgtcacaccgagccttaaccttgccattagccgacaattggagtccacttcagcaaaatatccgttgcgtaaaattgagatgcggtctatttttcttggcacaggccggaccgagttggcacacaacgtgttcacctcaacgttgcctcgtcgcctaatttgcacttttgtttcaaccgacgcatattccggtaaccgaaaaatgtcgccctacaagtttgagcacgccaatgtacgttcaattagtgttgaagcgaacggacagacctttcccagcaccccgtatttgctgtccttcgatggtgcacagccccgttttgttcgtgcatttgtagacatgtacgcaggcctgggtttggatgactccgacaccaaaacggtctcgattgggatgcagcgttttcttaatggttgggcctttttcgtcattccgctgacctccactctggaggacacacctggttttgagctgatcagacaaggcacgtgcacgataaaggtgcaatttgagcagcctataaaagcggatggatatgagatgcttgtccttggcgaattcgattctgtgttgtccattaatgcagaccgggttctgagtacagacggaagtgtgtaa

SEQ ID NO: 45950 - DNA, 2251 bp, Heterodera glycines
  Genomic contig location: Contig_ID=SeqID_4981; Location=37..2287; Strand=-
  SCN-specific regions: Sequence locations=1-305,327-1588,1618 -1632,1655-1888,1910-2020,2042-2251
  Gene Ontology: Mol. function=protein tyrosine phosphatase activity; Biological process=regulation of actin polymerization and/or depolymerization
atgaaaaaaacccaccctccacagattgtgacgattgaccccaatttggcggcgctcggtctgcccgcctacccaccgttgccgccaacgacagagccggccaaagtggaggaaatccgacgcactgtttatgtgggcaatttgccaaagggatgcgacggcgaggaggtgctcaacttcttcaacgcgtgcattggcgaggtgagagggccaacgaaagccccgcgggagggggggggggattggaatttaaaacaactaatcagaaaaacatcagagatagtttttttttgcacaccgttctgcagctattgttttcaaaacagttagctttttgttaatagttttctcaatttctcaggtgatgtatttgcgaatggcggccggcaacgactatttgccctgtgactacgcttacgtcgagttcagtcagcagtcgtcggtgccattggcactgcaaaacagcgactcattggagtttcagggacgtccattaaggtcgaatgggatctcccaacattgtgtaaaaacaggataatttataaaagtagggtttcatttgttagatttttcattggaatctggaaataagaaaactaaatttattagagcactcggaattttgacggaacaggcgcaggatccatgagtttagagatggacacggacatgcttgccaggattaaaatcctaatttaaacggcatattcaattagtttaattagagcttcgggtactgagttgggattctcgctcgaactcaaaaaattctcaatgaaaatcttcaaaaatttctcaagaatatctcccttaatatcattagggcttgccaaaaatgaacaaaactttccgggcctagttttaatccactttttaaatatgatcccctcagaatccaacattccaaagttgcgatcataaaaccgcaacgcaaaacggctgaccaggcacttgaggaggtggaggaagcgatcaaaagcggcagcgacgggcgcacaacgacggacactggtactaacagtatgttattaggggaatacgccaacgtggagcaattggagacggagcagcgcatcaaaacggcactgaagcaaatcatgcaaagcgtggacctggacgacgtgtaaaagcggaaaaagttgaaaaaatacgtaaggcgccatttgcaggacgagtcaggacatccgccggcggttgagcgaacaaatttcggtggatcagcggcgctacaaagagttcatcgaccaccaaatgctcgtcatccttggtcagatataccatatctgatcctgaatttatccacacttattttccaggtcaattggatctgccctcaaaaatcttcgattacctttaccttggcacggaatggaacgcgtccaattgggaggagctgaaggcgaatgggtgggccaaaaaaaggggcgtaaagatggagggggaggggtttggcttatccccccctcgtcgtatgaggcctcggacaccccccccccccctcgttcgtcgtaaggggggcggctgtaaaagagggagggggtcgtaacgaagcaggaaaaatttaaaatgtgcacaatttccttagcgaaatcaatacaaaattttaaaaattttcccggcggcgcctatcggcaccgccggaccgcccgccaccccctttcccaaaagttttttttggaaaaaggcgccgcaaaaaaaagatggtttgaatagcaacaaaaaaaggtcatcgccggagaaaattgtggaccttcgtatgaaaaatcggtcccgagacaccctccccccctgtcccaatcgtccgtcgtatggcccttggtctgagacaccccttgtatatgtatgtttttcagtgtccaatacattctgaacgtgacgaaggaagtggacaatttcttccccactcagttcacttacctcaaaatttgggtgtccgacgagacgaccaccgaacttttgatgcattggcaacgcacctacgactttatcaaggaggccaagtgggcaaattgccaaaaatatgccaatttgaaattcaaaaactccacagagaaaagggtgccaaagtgttggtccactgcaaaaagggcatcagtcggtccgcgtccactgtcatcgcttacgcaatgaaagcgtacggctggggactggacgaggcgttggagtacgtcaagcggaagagggactgcatcacgccaaaccccggcttcatggagcagttgggcacattccatggcatgatgcaggccgg

SEQ ID NO: 45951 - DNA, 704 bp, Heterodera glycines
  Genomic contig location: Contig_ID=SeqID_25713; Location=527..1230; Strand=-
  SCN-specific regions: Sequence locations=1-25,47-106,128-203,226 -395,418-504,526-704
atggagcgaacaaaatatgaaaagcaaaagggatttgctgctgaagcacaaaaatgggaggaggacattgaccgatttatggaggcattggcggagaggggaaaggtgggcgtggtgttaattttttggatcattgcccacttttaatccgtctttgaagcaaaaaaaaaaaaacggatttggccaagaatttgtgttatttatccacccttttttctttcctttagaatgttcgttcctccaacagtgaaaaaaaatttgactttgaaaaatggtgcgaagaaattgataaacatcctgcatttgcacgcgatttgaaaccgaccgaagacggacaatattcaatggaaatgcaagcaatacaagtgaacaaaaagggaacaattgggggggggagaagaaaatatattatttgagtgaaaaaggaaagcaatttcaggcaatgaaatacgacgaggacaacccaacggaatgtgccaatgcgtacaaagaggagggaaatcggcactttgagaagagaaattatcggtgggcgattgatgcgtacacaaagggtaattaattaaacgatgaattcatcgcccgtcgttccaaacatttgcgcttccttaccatttgcttcctttttcaggtatcaaattgcgttgttccgatgttcgtcttaactctgttcttttcgctaatcgttccgctgcccaccggcg

SEQ ID NO: 45952 - DNA, 1310 bp, Heterodera glycines
  Genomic contig location: Contig_ID=SeqID_5000; Location=269..1578; Strand=-
  SCN-specific regions: Sequence locations=1-347,376-376,449-455,477 -677,701-969,1007-1310
  Gene Ontology: Biological process=body morphogenesis (sensu Nematoda)
cgtaatgagcacactccgatgtcactttatcgggtcgtttcgcagctggcgcaagaaggcttcgttgacatttttacgctgttcactttggtattcatttttgatttcctactttgtttttccaattttttattgagtttagattgctccaactcggaaggaattgttggaggagcacaaatcgctaacggacctcgtcaaattgcggtcaaaccgtgcggaaacaatctcttcgaatgtggtaacgatatttgagaaatattcgttaagggtcgatttttagagtatgtaagaaaaattggttatatgaaacaatataaattaatcgatccactttttattttgctaaattcaaataaaaatttttaaaaaaggtaggtcctgcccggattcgaaccggggttattggattcaaagtccaatgtgatcaccactacactacaggaccgattgatataggctttcttaattaccattttctcgttttaattaatcctcaaaatttaggtcggtctgttggcgagtgtcactgaaagctttccgatcgcgtcgattctgaacgcggcaaatgattcttcgttggaccaaccttcgccagcttcggccatttctttttccgccgcgactcagtgccaattgaacgaagaccgaaaattggcgggctcacgttttgacgatgtgaaaagaaaaattataataattaaatggagtttttttagactgttttgaacaaaaaccaaaagctcggtttgctgtgtgctctgttggaatttggcgacttggaaaaggctcagaaacttttggaatttttccccgacggatatccctttggtgtttggttcgttttgctttgctttttttatttgcatatttcaataatttttctatttttcagtcaaagaatttcaatggcatttgctaatattatcggattttgcattgaaccgttctaccgtctgtatgtcccactttttaaattattattatattactttaacaattatttcagaaaggctgcttcgaactacgaatgcttacccaattcttctgcaacgggcgttcgaatgaaagaaagttgggaacggttcacatgtcatccaaaacaggcaaagtcgaccatttgtttttaagcatttgatttttacaggtttccgattggctatcttttttcgctgatgcttgtccgatcgcctttcaactcggcccatacattggggcccgtcacgaagtcgccatcaaaatgatcagacttttaaacacatattatagcgatgaggaagcacaaagttcggtcaccgaagtggacagtg

SEQ ID NO: 45953 - DNA, 647 bp, Heterodera glycines
  Genomic contig location: Contig_ID=SeqID_5003; Location=49..695; Strand=-
  SCN-specific regions: Sequence locations=1-131,153-647
  Gene Ontology: Cellular component=mitochondrion; Biological process =embryogenesis and morphogenesis
atggcttcaacaacaattcgcttttgctcattgttcaagcgacttccagcaaagacatttgttagttgcaggactttgtcaacgagtcggccgatgtttggtatgaacaaattaacttactacacattataaattcttctaattgtactttcttcgttttgttcgaattcaattccagcattgaccttaaatagcatgataatcacccaaaaacttaggagtcttgttaaaacttgacttcaatgttgtccctggctatatcgacgcttttctgatccgagttttcacagttcggctttacccccgcttcccctttcgttaagtgtgccaatttgccattttttgcgtttttttataatttaaaaccaaagtaccatgattttagcaatgggttaaccaataatgtttggttttagcagatattctctacacggataaacacgagtggctttcgttggacgaggcgagaagtgtcggcaccgtcggcatcacaaaccatgctcaagttgggattgatttgttgactatttggattgtttaaatgccaattgtaggaatctctgggcgacgttgtttacgtggaattgcccgaaattggcaaaaaattggacagtggaggcacagcgggtgccatcgaaagtgtgaag

SEQ ID NO: 45954 - DNA, 2507 bp, Heterodera glycines
  misc_feature (706)..(706): n is a, c, g, or t
  Genomic contig location: Contig_ID=SeqID_25777; Location=1..2507; Strand=-
  SCN-specific regions: Sequence locations=1-770,792-1369,1391 -1484,1506-2047,2069-2417,2439-2507
gaatgtgacaaatgccattcaaggtaatttttgagaaaagcatcttctcacttttttcttgaccaacaaaaaatttatcagtgcaaaaggaaaataaataaaaaataaatctaccgtaacccgttacagtatctcccttttttgagattttagaaaatttaggcaaatttttaattagaaatactgacgcattttctatgtgccctttttgggctgttggtggagcagtataagaactgtatgccaggcatgttcatcgtcgggctgccgtttgccgtcaaaattggcggatggtgtgccattctcgcgctgaccggcgttgcctggatttgctaccgcactgttagtacttttttgttgatttgccgtcgggtagcgtctgatgattctgatcacttttacctggacacctatcggcttagttttttgttaccgaaggcaaaaacctggcacttttctccatcggtcccagtcccaaatattctaccgttcatttgcttatcattttgccagggtctgattctgatcgagtgcctttacgaggactgcccgactgatggcactgatcactcatcacagcagaaaataaagaggcgacgaaaagtgagacggaggtgaaacgttgggcagtagcagaaggcactggagatcaggggatggcacagaattccgattttccaaaaattttgtgcctcggaatgccatncctgctggagatgttcgagagtctatttttacctaagagaacagagttgcccagaaacgacactgaaatccctaaaaattcagttatcgggaagtggccgaggcggtgcgaccggggcttggcaaatttgtactcatcgcgcagctgaccgaacttgcgagcacgtaagcagacgaaacgcaaaatgaataattaataggacatttaaaaaaacttccccccatttttggcacttttttaaaatttgccaattcttttacctatctttttgccacaccgatgtgcaacaacctaagtatccaacaaattaagttgcattctgtacattgtactggccggggacctgctccaaggctgcttcccgagtgtcggtgcgtttgcttttcccattttttgttgttgatcaaatctgtaagggacagtctgtgaccaaatgatcaggccaaatatgggggggggggcacttaattggctaacaattagtggcataccaaacaaattatgccgagaattgatcaaacatgtgacaaaatacaagcccgattgatagtgtccggtcaaaactaaggccgaaaactgctctaaaaacccgaaagaaaaaacaatttaaaattttggtcgaaactctcgaccgactgggtttttttcactcattggcattcgctctgatcactttgttcatccaatgcttttccctcagatcgtcctgcttggatgatgctgaccaccgttgtgcttctggccaccgcctttttggacgacctgcgcgtggtgtccaatctttccatggcaaatgctgtctcccatttggtcatcaacggcatcatggtacactgttttttgcgataatgccatcatcatgtaataatgtcaacccaacctgttcaaggtgttctactgtctgagtcaggtgttttgctggtggctctgctatttaatcacttcccccccccgtccgcttctcacagttttctgagtggcgcttctcctcactgccaattgtgccaaactttcgcctcttccccactgtggtgattaaaaggggaattgaatttcgacacaatcacataatgatcagagaaagttgtatggtcataggtaaaatcttatagcttaatctgacatgggcttgtcacccccggcttttccttttactctttgaccgattattaattgggggagagaaagtcggccgttttggcgccaaatgaatactttcttcccttatcaactatattaaataaacctaataaaatttgaaagcgcttaactaactctattagccggaaaattagttaagattattgtctgttttacatcgcgccccttttttggacgggtaaatcaaaaaagattaaaccactttaaaaatggtggcgccaaagaaacggatcgactctaattcccctccctatccactaattaattaattgcccccaatttccgatcggcaccgtcgtgttcggctacacctcacacatctttttgcccgctctcgagggctccatgcaggtccgtccgtccatgttttaatgccggatatcacttctccttaccccaacccaaaaaaggatgccgacgagttcaagccgatgttggcactgtcccacagcgctgctgccgttttcaaggcgctgttcggcctgatcggctttctgacatttgccgagttcacgcagaaggaaatctccaattcgttgcccaatcagggcttcaaagtttggagaagtgccatttgggataatgcaaaaacggactcaatcccggccatgtttaaggctctatcacgatttttttcttc

SEQ ID NO: 45955 - DNA, 828 bp, Heterodera glycines
  Genomic contig location: Contig_ID=SeqID_572; Location=1580..2407; Strand=-
  SCN-specific regions: Sequence locations=1-385,407-828
gattacgggccccgcgtcaatttcaaataccaacgcgtgaacagtgctaaattcttcggcttgcccgactatgttgaccatttgttgcttcggatgggtcaaatgcggggggagggcgtcgcgcgacttttcgatggtttccgtccggtggaattgtgcaatttggactactccagtgagcgactttcatccattgacttgcataaggtggtcgttgttgctgctcatttcctttgttttaacgaacaaccgaagggttatccgtttgagagggaatccgaaaaccgacaaattggaataagccgttttggcgtttaattggcaagataagttaaatgagaacattgccactgaattttatggaatgtcgggctggggaccctttaaattgtctgaatttttattgttgcaattggttaaatgcactctctgcttctcaggatgacgaatggatatggggcgagcgacttgtcaggtagatttgatgaacatccgggtattacagtatttttctctcctttctaccgtattcccccttcctatactgtatgttgctgcttttacagtgtctctctgaactcggattgtgtgttcacacttgaacaccccggccgcaaattgctcgtcttcgtcccggtcccgcgccgttcccttttgtgtttgtccggtgaagtgcgctccgaatggaaccacggcattttcccgtgccatattttcggccgaagagtggtcattacactcagagaattggccagcccatttttggtcagtctcttcctcatttttgacttgatttgtgatctttttggctttaaggatgaccccaaa

SEQ ID NO: 45956 - DNA, 907 bp, Heterodera glycines
  Genomic contig location: Contig_ID=SeqID_577; Location=305..1211; Strand=-
  SCN-specific regions: Sequence locations=1-81,106-488,510-611,633-907
  Gene Ontology: Mol. function=estrogen receptor binding; Cellular component=mitochondrion; Biological process=negative regulation of transcription
ctgatcacccaacgtcagcaagtgtctctgctcgtccgaaagggtctgattgagcgtgcgttggacttcaacatcattctcgacgatgtggccatcaccgagttggccttctcgccccaatacagtgccgccgttgaggcaaaacaagtggcggcacaggaggcgcagcgggccagtttcatggtggagaaggccatccaacagcgccaggagaaaattgtccaagccgagggagaggcgcaagcggccaaattggtaaaaaaaggacggcatttccaactataattttcgttgtttgtgacaaaataagaaatccaaaaaattttgtttgggtgttttacacgtagaaatgggttatacataaggagttcataccgtaccaagtaaaaaacaataaacatttcctgtgatggaattccaaaaatttataaaaatgttcttttacattggcatgaccatgtactttcttaattccaaaaacaaatcgtttcttcatattatttctttattgtctttcataaattttcgtctctgttcccctttggctataaaaccggttccccattaattgaaaaagacaattttcgcttgccattttttctggcggggtcttttgccctttaaaaataaatgcgttttatagacataccataattaattgagttttaaacaccctctcctaacccctcttaattactcacttaaatactctgtcatttttaagttgggcgagtcgatgaagaatgaccccggcttcctcaaactgcgaaaaatccgtgcggctcagaaaattgcgcgtttcattgccaactcgtcaaaccgcgtctatttgccttcggacggacttttcttgaacttggccgacgaagactatttgagtttggcgaccaacaaagggcgccgttga

SEQ ID NO: 45957 - DNA, 539 bp, Heterodera glycines
  Genomic contig location: Contig_ID=SeqID_578; Location=21..559; Strand=-
  SCN-specific regions: Sequence locations=1-539
  Gene Ontology: Mol. function=estrogen receptor binding; Cellular component=mitochondrion; Biological process=negative regulation of transcription
atggcttctatagacccgaaggatttcttcaacaagtttgccaaaccgagcaaaggtgccggagtcggcgctggcttgatgactgcagctgcggtggccggttatgcgctgtacaagtcgatgtatacgagtgagtttttgcgcagacaatggctcctaatgcttctcataaatttattacacaagtataattgtgtgtttcagttgaggctggccatcgtgcgataatgttcaaccgaatcggtgggctcggcgacgaggtgtaccgggaaggactgcactttcgcattccatggttccaatatccgattgtctacgacattcgtgcacgtcccaaccaaattcggtcgccgaccggcagcaaggatttgcaaatggttaacatcgggcttcgtgtgctgtcccgaccggacccggggcagctgcagacgatctgccggatgctcggcaccaattgggaggagcgagtgcttccgtcaatttgtaacgaggtcacagatggcgtaataatggggagagactcaaacaacataatttaa

SEQ ID NO: 45958 - DNA, 1998 bp, Heterodera glycines
  Genomic contig location: Contig_ID=SeqID_578; Location=1940..3937; Strand=-
  SCN-specific regions: Sequence locations=1-49,71-87,109-327,350 -1165,1187-1673,1697-1998
  Gene Ontology: Mol. function=electron-transferring-flavoprotein dehydrogenase activity; Cellular component=cytosol; Biological process=apoptotic mitochondrial changes
tgaaattgaccgattttacaagagggtcgaagaattggaggttcagcgagaagatgaacacgaggaattggtccgtttaaatttaattgcttttttaatgattagtcattgtagaatgaacagtcggcactccgttcggacatcgaaatgattgacgaacaaatcgagcggtggaaaatggtcaacgaactcgagaagaaaaaggaaaacattgtcgagtcggtggcaaccaaatttgagcaaaagccgaactttgaccctgtggaaatgtctgatgacgatgattccgatattgttgattttgataggataagttggagaacaaaagctttttaaaggataaatttttcgaataaatcgccgttacgactgaattaattgttgaaattctttgtagtatttcactcttttaacatggtataataattttgaaattccagactttgttccgttttgcacaaatgaattttatgagacgtgctttcattgcttcaattaatttcccacgcctgaggaataatgtgttgagaagtgtcgtcccatacgtcctcattggtggtggtaagtcatggttattgccaatttcgtgcctcataaaaatttagtagaatatagggtattaatttgattctggatatattgaccctaaaatcgagaaataaaaagcctcaaatggtacaaatttagggtgaggggtggcaacaagctaaaagcatgttcaccacgatattggtgggagggtggcgacaatttataaaatctattagttcgaattatgaaaaaatatttttggcactgcgagttattacgcgtcgttgtcaatccgtgcgagggacccggacgcaagagttttgatcataacggacgagcatgaaacaccgtacaaaagaggaccattgtccaaaggtatggggaaacaccgcagggaatgaaagggtgggaagggacaattagcttcggaataaccttttcaacactaaatttcaagagctttggtggtttgccgatgaggcgagcattgactcgctgtcccacacaaatccgacgagtagcaccggacggaggcgttacgctttttacgaggcggacggcttttacctgccaccggacaagcttgatgagtgggaacatggcggagttgggctaatacgtggcgcaaaggtcgtcaaggtggacaccgagggaagctttgtgctgttggaagatggacggaagatcgaattcggcaaatgccttatcgcgacaggtgagggcacgcaaactgttggcaaattgtgccaaattaatgctcagggagtgacgcgtggttgcacacacagcttgaacaccttcctgaactggatgactttgtcacaacacttggaaaggttgattagtgagaagaaattaacaaaatcgaatttaaggcttccgactttcggaaaatttattccaaagttgacaaaatggctgtcgctgaaaacggcacacaaaatgttattgttgttttgggaggcggtcttttgggcacggaattggcctactcgctgaaccgacggtacgctcgtgaccaggaaaaccctgcgctgaaaattgtgcagctgtgccaagaacccggtggggaagagaatcggtgtaattcacggagggcattggagtttaattgggtctaaatttatactttctttgattcatttttatgctttttcaggaattttatccgaaattctgcccgatgctctgagcgattattcaacggatatgctaagataccaaggaattgaagtgctgacggacactcgcattgattcggcatcggttaagggaagggatgagaaaaggcgccgaatttgtctcaacacaactgcagcaacgacaagcgacggtccgaaggaaaggaagcaagttatggccgactttgtaatcattgcgttgggcgccgaaccgaacatcgaattggtggacgaaaagagcagcattaaactggacaaagtgatccgtagtaaattcactaattga

SEQ ID NO: 45959 - DNA, 1563 bp, Heterodera glycines
  Genomic contig location: Contig_ID=SeqID_5022; Location=1175..2737; Strand=-
  SCN-specific regions: Sequence locations=1-176,198-250,272-1125,1148 -1391,1427-1453,1483-1563
  Gene Ontology: Mol. function=protein domain specific binding; Cellular component=nucleus; Biological process=protein targeting
atgagcgtcgaactcaccgaagaagagcgcactttgctgtccgctgcgtaccgaagggcgatcagcactcgtcgttccgcgtggcgtgtcatcgaatcccatgtgaaaaagtcgaccatcatggacaaacagaagcaaggtgtcaaggtgctgcagaagaaggtggagagcgaggcggaggagaagggccgtgaaattttggtcagtgcgtccgtccgtgcggcgttttccccggaaagaatttaactccaaaaaattttttgaaatttttcagactctgttggacaaccagctcatcccaaaggctgccgacccggaggccaaagtgttctacatgcggatgaagggcgacttccaccgctacttggccgagatcaaaccgtcggaagcggatggtaaaagggcttcgaaaatgctaaaattcaacaaattcccccctccccaattttcagatcttcgcaaggcacagaaggcgtaccaggaggcgtacagcattgctcaggaaaaacttcgaccatcgcatcccatccgtcttggtgtggcgctgaacttttccgttttctacgaggaattactgaaatcgacggaggaggctcgccgaatcgcacaaaaggtggttggaaggatttcattgttttagagaggctgctgttcatttcatttttgcgcaggcttacgacgatgcaaatgcggttatattgacggactcgagcggcaacgaaacgctgatggaggcactcgcaatcattgagaagctgcacgacaatctggcggagtggaaccagcgcaaaggtggagctgaatagaacgccgctgctgtgaatggagatgaatcgcgcaattgatatgggtgattaaattccgatggattaactcaattgtacacatatgtatgtcatggtgttgtgtatatgtatatattgctgtattatattgtataggctgtataaatgcgtcaatcgacttttaggcgattaatcaatgaccatcgtcaatttcttagggcataccttattttttcttacttggtcaatgttgtgtatttgggtaatactaccgatggtaggaatgaaattcttaggccacaaatttttcttcatcagtgtcaacatttcttggttacgcttttttagtatatcataattagggaacggatttttaggggcgaaaaagtttcaaatataagggtgaaatttattaaaattgcagtttttgtataaaataatttaaaacataaaggaatcaattttaaattacaaattttgattaaaggctcaaaattctttttaagtccattttcaacacaaatccactcaaatttatatcaaacaccgtttgttgatcagtgacaagaaaaacgaaaattaagggtcaaaatgatcgctttttgtttcaacctacctatttcacaaatttcattttaggaacaattcgaatttaattaaagtcgggaatttatttacctatttatttatttaattagcccgttttttcctttgaaattcgtataaaagacagagaacataataattgactgtcattctctgcaaaatcataaataaa

SEQ ID NO: 45960 - DNA, 2781 bp, Heterodera glycines
  Genomic contig location: Contig_ID=SeqID_5030; Location=1838..4618; Strand=+
  SCN-specific regions: Sequence locations=1-1210,1232-1314,1336 -1629,1655-1720,1742-2117,2140-2169,2191-2494,2516-2781
atgatgagacacaaactccaaaatggtcttgatgtgattgcaattttgttttttcttcgtgaattcaccatgagacaggattgcacgttgacaatttttcgtaatgagcacagagagatttgcagttggctctatccgagtggtggatcgtcaactctcctcataacaatccaattaacgttgttggaaaagcttggcccatacgcgtttgtcacgtaaccctaatttttcaaaagaaggaaaagcactcctaaatttagttttgatcttcattaaggctgaaaggggatcatgtgaaaaaaagaatatttgtgcgttaatcatttctttattgataaacttggaaaaataattgatgaattttttggtaattggtaatttcgcaaatcatccatcatctcattggcatcacactgagaaatatgtcctcttctcttgagaaaatttatcaaagaataccagcataaaatgaaaacgggaaaagcaatgagatagtgggcaagcaatagaagttgtatgaggaagttaggatggtagcttttgttttcaaatgttagtacttgtatctctggctttaaactggcgttgactgtagtgtttattaattcattctccaattaattcattctccaattaattcataaattatcacgtgacaaattcctttacaattttcgtaatgcactgaaaaaatttcctaattttccacagttcatcaaagttcgcagggatatgacccaaagcgaactcaaaattttgtactccctgcggcaacaagcctatcaggccaatactgccgcaggtgagtacaaatattttgtggtcgatttggagatcaaatctctgaaaaccccccgcccgctcagaactcgctagggatacgcgagcaaaccaaacaaaaaaattaggaataagggagaaaaaagtccctgggtttcctgcctattaataaatgcccgatcaatttcaaataaaatatctgatttagaacatatagcacaaaagtatgatccatcaatattcatcatcaatgagacctggttaaaccccagaaatacaattgaaaatgaactatctataaatggtagatatagagtaatgcttgcgaaccgaaatgagaaaaagggcggtggatcagcaattctaactaaaacaaatattccttatcagacactattctctgggacaaaattccaaagcgaaattttacacattaaattactttttaaaaaaccaatccaaatcataaatatatatcgtccaccgaattgtacagttcagaatactaaaaagctactcaaatttatttcggaccagagtaattctgaaaatatcatatattgtggggattttaacaccccaaatatttatgggatgaaaataaggtaattcaaagaaatgaccctgtgtcaaatttattgattgagtttattgaccaaaaacaattgaaacagcatgtcaaacaaccaacaagaaaaaaagctattttagatttagtaattactagtgaatcagaaataattaatgatttaacagtatttgaaaatttttcaacttccgatcacaaaatggtcggattcaaaataaagggaaaatttagtcgtaataatcacagagtttatagaagagattttaaaaatattaattttgcaaaattaaatctagcgatacttgaaaatcgaattgatttagcaataaactcagtatacaccgttgaacaaaaatataaagaattcttaaataaagtaatgaaattatatgatacgtttatacccaacagatctctaaaatcgataataaagcaatcatatcctcaaaaaaataaaagatttattttcagagaaattacggttacataagcttgtaaaaaagtttcccgataaaagtgagattattttaaattacaaaataatttcaagggaaatgaaaaaacaattgaaccaatttagaaatgaaaaagagtcaaaaattatttcccaagggcaaaactcagttaacaaatttattcgaaataaattatcaaaaaattatgaaattcctactttaatcgatagtgctggaaatatgtattccagtaatgagcaaaaatgcaaagtattagcagaaacatttcaaaaatcatttttagaaaattcaattgttaatggtccattaactcaatcagcacagaataaaattaaactttttgacattgaattgaatgcggaataatttggaatatattaagaaagctccccaggcgaaattccacttcaccggataatgttccttacattttattaaaaaattgtgcagagccaattaccaaaatattagctgatatatttagattgattttggtaaaaacgatggacgatatatataattcgatacaaatgaatcagcaaattgacatcatctatattgattttgtcaaggcgtttgattctgttccaattgatttattacttcaaaaaatcaaaaagattggaattgaaggaaaaattcaaaattttttaactaactttttaaaaaatcggagttttaaagttaaattggcgaagaattgtcagaaagtttcaaaatattttcaggagtgccccagggaagtgtcttagggccattactctttttaatttttataaatgatcggccgtcctttattacaaatgaagctgcatcagttggcataaaaatgtatgccgatgatgttaacttatattatgcccatgaaaatgatgaccattcgaatcagttggataaagaaattgaggctttggaaaaatggtcaaaaataaatgg

SEQ ID NO: 45961 - DNA, 840 bp, Heterodera glycines
  Genomic contig location: Contig_ID=SeqID_25871; Location=326..1165; Strand=+
  SCN-specific regions: Sequence locations=1-440,481-606,632-741,763-840
atggaccgaactgccaaactgtggcatttgcaccgcaacgaatgcctgtgctcctttcagcacattgactttgtcacttgtttggcatttttgccaaaggtgtgtttgttttcaatgatctataattggctttcaatctaatggtccaattgcttttgatttgttcgatttccttttcatcgcccaatccattttcaggatgatcgttatttcatttcgggctctttggacggcaaaattcggctgtggcacattcccgagaagaaagtggccatttggaacgaagttgagcaggtggaggacgaaatttatatgactaaaatcacaaattcctaattttcaggttaacaaattcatcacggcaatgactttcgtgaagaatggcaaatttgtggtgatcggaacttttctgggccgatgtttcttttattcgaccgatgtatttattttgtttttttttagtatttttaaatttaatttcctcatttagcaactcaaatatcacactgtcattgacgtgcgctcgtcccgtggcaaaaattcggttggacacaaaattacttcgttggccgtccacggagacaaactccttgttgcggtgcttccaataaaaatttaattttaaaaatttcaatgtttttttcagtcggatgactcgcgaattcgaatatacgacttgcgtgacatggatttgtgctgcaaattcaaggcattcaagcgttcattgctttatccgtttattttggccattattttcatttttccctttttagggtgcccaaatcagtcagagtttaatccgcgctgccttttcgcccgatggttcgcatgtgatcagtg

SEQ ID NO: 45962 - DNA, 1838 bp, Heterodera glycines
  misc_feature (12)..(12): n is a, c, g, or t
  Genomic contig location: Contig_ID=SeqID_25892; Location=536..2373; Strand=-
  SCN-specific regions: Sequence locations=1-423,470-514,536-537,634 -1420,1442-1838
  Gene Ontology: Mol. function=solute:cation symporter activity; Cellular component=integral to plasma membrane; Biological process =transport
tcaggtgtatcncatcgacctggtgaagacgcggatgcaaaatcagcggaccggctcttaccttggcgaagtgatgtacaaaaacaggtgagtgatcggttgttgttatttgacaccaacaattgctcttttcttcagttatgactgcttcaaaaaagtgataaaatttgaaggttctacagaatttccttcctttttttacctattaatctgttcaggtgttctcggtctttaccgcggacttttgccccaaattattggcgtggcgccggagaaggccattaaactgacaatgaatgattttatgcgcgacaaattaacttctgacggtcgcatttcgctttcgtccgaaattttggctggtggctgtgctggggccagtcaggtggggaaaaccagggacggtcccagtcatatcgctggaaaataaaatctttgtataaaatatttctaaaatataattttaattggaggctgttcagaatttttaaataacttagaaacatcttgctcatttttgtaattttcatttctttgaaaattataattttgttttttcaaaataaaataaatttatttacttccattttttgaaattttattttaaattctatctttaagtttaaaaaatttccaagaagttcaaaaaatgatattttttattgtcgaaatttaataaaaagcatttttttaataatttaagaggaatttttggaaaaatttacctattaagatcgaaatctttaaattttcaaaaatttcactcaaaaaaattcttaattcgaattttttcaccgccggatcccaagtttctttttttttgccataaaaactcattcactgtcagtattaaaattttaacatttaaaattgctcattttgaggttgtcttcacaaatccgttggaaattgtgaaaattaggctgcaaactgcgggagagatcatcaacggcccaaaagtgaatgttttcaccgttctgcgcgagttgggcttcggcggcctctacagaggtgcccaggcgtgctttctccgcgacattcctttctccgccatttatttccccgtttatgcgcatatgaaaatgaaaacagccgatgaacaggtcgtatggtcagtccaatgattgtatatcaaactcagttctttagggttacaatcgcccttggtctttgtttgtctccgcttttattgccggggcgcccgccgctgctttggtcacccccggttagatttactggtgttgggttttgatacggcttgcacttttcatttaagctgatgtgatcaaaacgcggctgcaagtggccgctcggacgggccaaacgacgtacaacgggcttatcgactgctcaagaaaggtgctaacggactaacattgctcctttagacttgatcaattttctgtttaacagattcttagggaagagggaccttcggcattttggaagggcgcggcaggtgtcatttaatgttaattaatagccgtctcctgtaccaattgttttttaagctcgtgtttgtcggtccagtcctcaatttgcggtgactctcctcacttatgagctgttacaacgcattttttacgtcgattttggtggtactcggccaagcggttcggaagtctgttttttatttatcacttttttagttacaaaattcccagcccgaaataaatattcaatttgatttcgtttgacaggtttcgacccacaccacaatattggaccaagcatcggaaaacccccaccacatcggtggatacaaattggctgcagcaaccttttctggcattgagcacaagttcggcctgttcatgccgcgatttgagcccaaattg

SEQ ID NO: 45963 - DNA, 2178 bp, Heterodera glycines
  Genomic contig location: Contig_ID=SeqID_5038; Location=2232..4409; Strand=-
  SCN-specific regions: Sequence locations=1-41,63-609,631-638,660 -681,703-707,731-774,801-859,881-886,912-1188,1217-1751,1773 -1862,1884-1888,1910-1946,1972-2178
  Gene Ontology: Mol. function=structural constituent of cuticle; Cellular component=extracellular; Biological process=cuticle biosynthesis (sensu Nematoda)
caagtgcacagcatggcacgctttgcacacaacgacttcgccttctgtgaagtcacttctcttaattgcttatccattaatccctttgccaattaatccttccctttcagcggtctgtcaatgacatcgaaagtgcagcgccaaatgcggcgtttgtgctcaaaaaccgcacgcgacgtgaagcggactacgcgggatatagccccagcattttgccaacgaatgggccactctttcaggagtgtccgggtaagcgatactcttgtaactgactgttggcacacccaaatatccttaaagcgtgttgcattccgggcgaaagaggccccaccggcgaccccggcttgcccggtttacctggtgccccgggccctgacggtgcgcaaggtcgtcccggcacgacgccgaatgcgtcgtgcattcccgagcgcgtgtttgagcccccgccgtgtttgccatgccctcagggtcctcgagggcctccaggtgctatttggcattttgggacttccgatatttcaatttaaggtcaccccggattccctggagaggtaagaagtgttccaagtaagtgttcgagtttttactcagcctggcgatcgtggcataccgggccgacctggccaagatggactgcctggcaagccgggcgaagacgggccgcctgggccggacggagcgccaggacaaccagggccatacggcgacaaagggcccacccctgaggcgcacataattcctggcccaccgggagacccgggcgagacgggaccatggtgaaaacattattttcttttcaataaaagagatactttaaggggtccgcccggccatcctggacctcctggcgaagacggataccccggaggatcgggcgaaaagggatggcccgggccgccggggccgcccggtccgatgggaacaccgggactgccggggccaatgggagaggcgggccctatcggtaagagagtaaggagacaaacaaaagaaaacacctttcgaaggcactcccggcacatgcgtatgccaagacactgaagtggtgttgaccgagaaaaggccgttgtcgccgtcgcttccgccggcggagccgacgggcgacgcttacggcgtggggaaaatgggcgcattgacacccccggccttggagagcgcaaatacagtgacggatgagctgtacaagcggaagaagaagaagaggaagatgaagaagcgcatctgattgattggtcactgatcagaggacggaacggaaattggcgaatgattagagccaaaagaagcgattgactgcccgaaggcattccccggcaatgccaacaaacgctgccgtccctttgttgcctctttttccaaatcttgtgccaaatcgatctttttttgtttgctatcatttgatttgattattcgttcacttttgtgcctttccattgctcaccctttaattatgcaattcaaattttaataaagaaataggcaattaattcactccaaattaatgcacatattaatttcaaacacttttcatttactgtatttacctacagtactcgaaacatttggttaaaagaagtagatcaattttgtaatttttgctaaataattggtaaatatttttgtcaaatttacaaatgatataattaattgatgtgactttttggcacatcaaagtttgtctgaatccaacataaatggatgagatgaatacatgagttaggaaagctttaagcgaaaagttgggggccggcaaagtttgggtgtttttgtttcccgggccaatgttttttccgaccgaccgaaccaacgcccattccctcccccccccccgcccaattgctttttttgggggttactttttaacacattcaatcaaatgtggtcgtccattctcccatcctttgtttgttccttaattgtcaaaagtgtctcccctttctttgatttgtccgtgtctctctctgttccttccgtccgtttcgtttcgttttcttcggctgattggtcgtgcgcttcgccccccccccgtcctccgtctgtcccccgggggaagggatggactgtcgccgtccgtcgcccttcgtcggcgccctctgcctttgaacagttgctcatccacccttagtttctgatcatccgttgatcggttgggtcgcgcacttttcatcatttcccaaa

SEQ ID NO: 45964 - DNA, 456 bp, Heterodera glycines
  Genomic contig location: Contig_ID=SeqID_25909; Location=378..833; Strand=-
  SCN-specific regions: Sequence locations=1-170,206-329,351-396,418-456
atggacgccgatttgaacaccaaacggatgtcgccggaagcactgagggaccgcagcttcacccagaagagcgacacctgggcctacggcgtgctgtgctgggaagtcttcatggatggcgcctcgccaccgagagtgagtgaaaagcccaaaaaagagttccaatttttgatcatttcccccttttttccagatgctgaatggacaccgactgcaatttccccatgacgcgccgcagaagttcgtcgagttcatcatgctgcacatctgggacccgaaggacaagaaccgatactcaatgggcgcggtgtacgactggctgaagcaacacaccgaagaaggcgaagaaggacgaggaaagcgcctgaactagaatatgatgatgtgtgttgtatattgtatatttgtatgttatataaaataccaaatctgagattcgtttttctgaaaaataaa

SEQ ID NO: 45965 - DNA, 540 bp, Heterodera glycines
  Genomic contig location: Contig_ID=SeqID_25917; Location=176..715; Strand=-
  SCN-specific regions: Sequence locations=1-6,28-187,209-480,507-540
atggacgccaatttgctgcaaaatgtggcgacggacaacaacaacgaccgccaatttggacaacagcaaatcctgctcggccaaactttcgattggacgcaattcaaagtgagtggaagggggggggggcaaaaggaaaaatgatcattttcgaaaccttcattaaaatttacaaattctcaatggcggagtgagggtggtcaaccaaatttttaataatcgtccgggccggaaggggtcagccaaaattgactatttttttattgttttcatatcttttttgcggcgaaattggatttttgagcaaatcatacaaaaaattgctgttttcgaaaagtttggaaaaataaaatataatttccctctcccatttgtcagaatcgtctcgcgttggaccgctgcgtgtgcatggggcacagttttggcgccgcctcgtcgctgtccgcgtgcgctgaatatccgtcgctgttcaacgcctgtgtgctgctcgacgcctggctgtacccggtggaacgacgaatgtttccggcaactgtgcag

SEQ ID NO: 45966 - DNA, 3709 bp, Heterodera glycines
  Genomic contig location: Contig_ID=SeqID_5046; Location=1391..5099; Strand=-
  SCN-specific regions: Sequence locations=1-605,628-663,685-1069,1097 -1441,1463-1762,1784-2399,2432-2531,2628-2814,2855-3292,3324 -3390,3463-3654,3676-3709
  Gene Ontology: Biological process=regulation of protein activity, epigenetic
gcgtcaaaccctggccaatttgagcagcccgatcaggatttgaactggcgccagggccaacatggctcgttggccttccctggccaagtgtgcatcggcgccggcggcgacaaaccgatcgaaaatgcctctctgactgtgtacgggaacatcgccacgaccggcaacatcacacgcccatcggaccggcgcgtgaaggaggacattgccgaggtaggccgtgtgcttgccaaggctcgagactcgcatcagttaattaataattgacccacttgtccaggtcagcactgccgaagcgatggcccgggtggcacagatgcgcctcgtcgaatttgcctacaaaccggacattgcccaacgctggggccttaccgagcaggacaggcaccgggtgggcgtcattgcgcaggcgagcatttgatatacattcccaatgatcagtgctcttattctgatcggccttttttaggagttggcagaagtgttgcccgaggcggtgaaagacaacggcgaatttcttacggtcgatgacactcgcgtgttctacgatactgtagcagcagcgcaggaattataccggtgggagaaaaattaagagaaatgggcaaataatcagagaaatgtgaacaggttttaaactgtggaatgaccccataattatgcttattttttgtaacaatttagtttgaccggcaatttgggcagtaagcttgaccaggtcgagaaaatctcgcaaaaattggcccgctacgcacagaaacggcggcaactcggctcaatggcatcgggtgagactattggatgcttaaaaggatgtaattttaatacaattatgtcttttaaggcctcagcgacttctccactttctttggcacaaaatcgctcctcgatggtgccggcattggcggtggtgcggacggggacaagcaaagctgcgtctcctattcccgcacttcgcttgcgtcggccgtcaccacaatgccaacaacgacgcattacgacaacgacgacattgtgcaagaaaaggcgaagaaacaacacattggcagtggcaaaaggttgcccgacagtcacataaaatttaaattcaaaatttggcgccaaaaaagcattttgccaactctcgaaccattggataattgccaattctcgaaactcgaatccgagaacaattaatcttctgtgtgcttttttcagtcgaagaccatcatcatccgaccgttaccatcatcgttgtcgctcctattcgtcggcctcggcatactgtaaccggtcccattacggtggcgctggtggaggcggtggtccgtgcactcgtcgtcgattcgccgttgtgcacctcaaagttcactcagggcacaattgtaacgcttgtgatcatcatggcactttggtaaggatgatgccttttttgtaagatatagttttgaaaattgaaaacttttataacaaatttgctaaaatttaaaaaaattaactcaaaacactcaagtttggttcttttttagcaaaacaataataaatgggctattaagggcaaagtataaaaatacgaataaattatcctttgttattgtaaaatatgccgtgctttaaaacaattaataacctttaattagttaatcaattatcttcctcctaattgatcgtactgttacacaccttcgttcagtctggtcacaatgtgcacactgtacgtgatggactggtacaaccgtacctacgtgtttcccgtccgtctgatcgactcttacaacggcttgccccaccatcatcaccatccctcgtccccgtcctcgcctgattcggctgctgctgaccatggccggcaaccacaccagcagcaaattgagcccggcaaaatggtcaagccgtttgtggagtggaaattgcccgatcggccgcagaatgtgccgccgttgaccgtattctgtggcggcgctggcacagtgatggcctcactctcgtcactaattcctggtgacacgagaataatacgcgcattaattagcactaattggatactttacagtaccgctggttggccacggcacctgtccccattactgttgcggaataaacagcaaattggcggctacatcaaaagagaactttggtgaaaaactgtcgaagagtgtggacgaatgggtcgcattggcgtcaaaagtggcggaaaatgttgtgcctccggcgccacaattacttctgacacaagtgaatggcaaaaaattataattagataattacaagcacattgtatgattggtatatgatcaatagaggaacgaattttttggcgcatcgattagccattcgaaatgttggattaaacaaattcaaaaaaaaaagtgtttacactccaaaaattgcaaattttaatgaattgacttgggttttactttttttatattaaaaattaatcaaattttaaggatcagcagaacggaataggtcaaatgaacactttggcaaacggagcaaaatttgaggtaaaaaaaattatatggatttattcatctctgagttgattgaattttattattattttgtaatttttttcaaagttttttgctgttttaaatttataaaaattaataaaaaaaaaataacatttttcaaaaaaaaaactgacccattaataaattaatgcctaattgattttgaaggtgctgaatatgaacttcaccatcgatgcgcgctattgcttcaacgaaagttgcgatgcacggaacggttatttcaatttgtttgtgccggtctctgaacatttcccgaccattccgctgcaaatacgcattaggtgaaaataaaacgattaattaaatttattaaataattttaaatttctaatttagcactgatgatttgacgctatttgttgatgattgtggcggattgaacggcttccaatataagccatgtcaacaatatgggaacaaacagcttcaactggaggacgactcggaacgaagtcaaccgccggaaacgaacagagtggggaacaaatccaatcatcattattggcctaattagcaacagatcatttaatatgggagacattagccaaaacgatcgtccaattaatcaatcaataattgttttttgccattcaggtgaccgaaaacattttcgaactgtcggctgcctcctttttacagagcgcatacaggtcaaagaattatgttctgtgattttcaataattatcccaggaggtactgccggatgactaaatccttaaatttttaattttttttgctaattactaaaagtttattagtcgcccactatgactataaatttgaaaaattattaaaaaaaatttgagagcaaagtgcaaaaaaggctttcggattcaacttttttttagcttttaaattgaaaaaaaaatatatattaaagtatcatatagtatatatattaaagtatcatatagtatatatattaaagtatcatatagtatatatattaaagaatcatatagattccgcatcggacattccgccaacctttgcgaaagggacgagcggcaacgcgggcgcgcatttgacgaatacaacctgttcttctaccgaacatgcgcactcaaagccaccgcaacagcgacggaagcggagaatggtgctgaaacgcgtagcagaacgcggacggcggcagcggaaacggcgaaggagggagcagcacaacagaacggtggtggtggtgttgctg

SEQ ID NO: 45967 - DNA, 1932 bp, Heterodera glycines
  Genomic contig location: Contig_ID=SeqID_5056; Location=1..1932; Strand=-
  SCN-specific regions: Sequence locations=1-994,1016-1177,1202-1932
ctctcttaaggtgtgctggtctacgtgaacaatgtggagcggggtcagcccgaggtgtacgttgtgctggaagaagctcagatcggggtccgcatcagagagtcctacgcggtggacattgaccgtatgccgatgtaccaagagtccatgggcatgttggacattgccctgtcggtgccaccgcagtacggcgtggtaagtttgaggagtgtggcaatttgtttgttcaaaattttgaatttcgacagcaaccggacggggacaaaacgcgggagcaggagacacgccaacgttacaatttgccacgggtgtccggcctgatgaggccgttccccgacacgtccaccggctccatttactcgaccctgacactgaacgaagtgaactcggaggcgatacggcaacagatcatcaactactgtaggtttttcaattatacagttagcaaaattgttgggatactgtaattgtccggttactgtaacaggaaaaggaaattttggcatcttttgtgtgtggcttttgaattgacattggcatatttccgcagatcgaatcccgggctccggcgaacgcttcacggactatcagcagcaggcgttgaaccaattccaaatccccaccgacaacatgttcaccaccagcaaggaggaggacaagaagttcgaggcgttccccgaggcgtccatcaaaagtgagcccatctacaaaacggcggccatctacgaaacgtaataaataataggggaaaaataaacaaactatgagggggaacggacaaatgatccatccgacttaggcctcagtatcgttttgtgcctcggaccggcgctgtgctaatgcaaatgctgcagcagtgcaacgatttggccaaccgagagacaagtgagtttgacggggagggcaccagagtctaaatattgccaataaaggccgttgggacaggggtatgcgaaaaacaaaaaaaaattttgacgaaaacgaaaaaaggacgaaaatttaaaatttttaaattcaaaaacgaaacgaaaatattttgatggacgaaaacgaaactgaaaaagtgacgaaaaaagaggacgaaacgaaaacaacacgaaatttcgcataccctttggttgggactaattcttggtctaaacacttcgcgtcatttccaccgtctcggttctcgggataaattctcggtcttaatcttggggccaaagaggcttctcattattgaagccatttctcggctctcgatgataaatcatttctttaatatttcacatgacctatcaaagtgtcaccttattcgggctgtctcctgctgctactgatacccaactgagtacagcttgaactcttcagttggtcttcagccgtaccaaggccaaatgtactgggactgggccagccaatgcccggacaatcccggaaaaatcttgcaagaatgtggtgacaatgtgccttgtctgtacgattacacgctgctgaacgcggaagtgttgggcaacgaagtgaaggacacgtggaacgcgttcttccatgaccgttggtccgccattcaaaattgtacggcatttttggcgcaaattccaattttaaacggaatgccaaatttgttgtaatcgtcttgtccctaatttgcgcagataacagttgtggcccgatcaacattgagtacccggaatatctgatcaaaactccggcactctcctccggctacctccagggggacattgcgcgtttcgagtgcttccaaactcactggatcaaaggggatgccgagtttaaatgtgatgaaatacgatcaacaattaaaacatgggatatgagctttttgactcctttgattgggccagggactgatcaggaacaatctgatgaaatttatactgccaaattcgaattgataatttaataacggtcacagtgattggatcaaaa

SEQ ID NO: 45968 - DNA, 799 bp, Heterodera glycines
  Genomic contig location: Contig_ID=SeqID_26008; Location=504..1302; Strand=+
  SCN-specific regions: Sequence locations=1-31,68-244,268-452,485-799
  Gene Ontology: Biological process=growth
atgagtggaaatgctgaagaccatggctgtgagtgaatcattggcatttaaatttattgttggttttgtttatgtcaatccattttttcagatgcaaataatccctccgatatcattcgtgatttaaatgtcgaaaagaaaacaaagactgtctctgatgtcacgaccaatgagcagattgatataaaaccgaaaattgaggtgcgcaaaagctacgaagagaagaaaaagaagcgacaccattactcatcggaagaagaggaagaggggacggaagaaaagaagccggaaccgatcgatcaggaacaattgctggtgaacatgcgtgaggagcacaatttgaagttcaagaccggcattctgattggtcttcgagcggacgaacacataaaagtcggcacaactttgaagtttcgggcttatcaatcaattacctttcagaaaatgtcagcgatggttggaggaggagaggaaaaaacttttgaggcttttctgaaaggactggatgagaaaaaacgaagaaaattaatgaagtaaacacatggatgatagttattaatgtacaaaagtcaacatttagaaaaatcatgaagactgaagtgagcgatgactccgatatcgagaaggacaaaaaacagcgaaggaagcaaaagaaggaggaaaagcgcaaggcggacaaaaaacacaaacatcgcaggtcgtcgagtcgggagaccagcagaaagcggaaggaggggaagcaccaccgccactgaaaaggggaagcggactcattcttcggattgccgccatttgtata

SEQ ID NO: 45969 - DNA, 778 bp, Heterodera glycines
  Genomic contig location: Contig_ID=SeqID_26009; Location=362..1139; Strand=+
  SCN-specific regions: Sequence locations=1-296,319-690,712-778
  Gene Ontology: Mol. function=carboxypeptidase activity; Cellular component=extracellular space; Biological process=neuropeptide signaling pathway
cccgaaatgaaatacatcggaaatatgcacggcaacgaggcgatcggcagggaattgctgctgcgattggctcaattcctctgcgacggatggcggcaaggccaacggtcggtggtggagatgctcaattcgaccaacattcacattatgcccagcatgaacccggacggtcgcttttccttttgccatttggcaaaacgtttcatcgctgtcgcccattttaggctttgagttgacgctgaagacaaagccggaacagcgcggatgggtgacgggtcgcacaaacgcgcacggggtcgacctgaacaggaacttccccgacttggacgcgatcttttacaaggccaacgcacaacggctgccgttctttgaccatttgctggaagtgttccacgactccgacaacggccaacaggcgagtgacagcaagaaatgtggtcaaacagagcatttggtgctttagtttgagcccgaagtcactgcagtggccaattgggtgctttcgtggccttttgtcatttccgcaaatctccacgagggcgatttggtgagtcattcatcagcaggacttcggaatgttcgtcgtttcacaggtggccaattatccattcgacgaaagtctgaacccgaacgaacttcgcgcctattcaaagtcgcccgatgacgtcacttttcggttagtttttggcacttttccttgggtttttggtttagcctctgatttaaattgttcacaaagatacatcgccgagacttacgcccgtgcacacgcgcacat

SEQ ID NO: 45970 - DNA, 2111 bp, Heterodera glycines
  Genomic contig location: Contig_ID=SeqID_5062; Location=8..2118; Strand=+
  SCN-specific regions: Sequence locations=1-442,465-668,798-1036,1059 -1253,1275-2111
  Gene Ontology: Mol. function=zinc ion transporter activity; Biological process=positive regulation of growth rate
tacattattggtatcattggcaagcttatcatgtttcgaagctatttctaagctatcgcttcgcgattagactattaccaaaaaagttatacatgaaagttgcgaaaaagccgaaattagtcaaaattttgaagttttttcttagtaaaattttttccagactagaaaatttttaggttttttgaaaggctaatagagcatctgaagagctttcgaatgataccaacaatgttggatttggatgcaaatgaaaaagttatagacaaaaacataaaatatttttgaaaatctgtacacagataacatataagtaagtacctttgatttgactgactaacactcctgttaacccttcgtcttgcatattatttattaataacaagcacttacaaaactctcgtccatgaccatgttcatctccaattccacacattttcatcagatcctcatcctcatcatctgacgacgaaattgatcggccctccatttgattcaatgttctttgaggaaaagacgattgtgctgccatttataattagaaacctctctctatatgtaaaaaaatttttggcaaaaaattgtgtatttgaccaaaacagtgaattaaaaagaaaggaaacgataaaacaagcaaacgcaaaaacaaaatcaaaacattattcattcacagaagagaaaaaggagaaaaagaaagctaatttgtaaggaaaagagaaaagaaaacatttaaaaagaaggaatttaattgaaagaaatggagagagagagagatagaagaagaagaaaagggagagaaattaacgaaacgaaaaagacacgggacaaagcaatttcttgtggggttggaaagataaaccaagcgaaataataaaatttctataatctttattgaacataaatttaaactgtgttttttagcttttttatgaatgtgggtcttaaccaaaaaagaatgatgcgattttccttcactagactcctaatggaccctatcagccaaaaggtttcgcccaattgtaacagttctattcgaagctttctttttaggcatgtctttgcttcgccgtttccgctttactgatggcctttctgatctattcagtgtcggtaacccgttctttggtccttactggacttgcttggctctccgttttctcactctttgtcattttttccacaattgtcgcttttatctgtgctgccagttcgtcaaataaaaggtcactcactcgtattacaaacatttcgaagctcattaagatcttgaaatatttcaggtacacttttggcctggctcgagcacccgttttggccgttttctccaccactgttctagctcaattatccgctgtgtttttgacaaaagaggctgttgagcggttatttgattctgggcaacaccatcacaggtatttttgtaagtgttaagttttagtaacaaatgatcttaacagtcaccacggaggcgatgccgccccactcagtggcggagatattttgaaaactgaatatttgttctatccagcggctcttgcctcctcttccacaatgcttatagtggcttacgcactcgctaaccaaccattcaactacgtgcttaagcatgcccaatcttcggtgatccaggtatttgtataaatcgatgtttttcagtttaaatttcaatcaccaatgtttgtctaggaacatttcgctgatatttgtgcggcagtttgttatttcgtgccaggattggcccgtctgttgttgccgcgcattaactcgctgactttgttggcatttatatccacttgttgtgctattttcgtccattggtttcgtttggaattcccttgggttgactctgtcgcctcaatggtactttctttcacgattttcacttcaatggctccgctctcttcgtataccggacgaattcttttgcaaactacgcctcctcatgttcaaaatttgattgacaggtatttcaaatagtacttttatatttgatttctaatttttaaggtctatttccgaagcttctacaattgatggcgtgctcgagttgattaacactcatttttggcagttaaactttaatacgatcatcggcacagttgacgtattagtaa

SEQ ID NO: 45971 - DNA, 772 bp, Heterodera glycines
  Genomic contig location: Contig_ID=SeqID_26027; Location=858..1629; Strand=-
  SCN-specific regions: Sequence locations=1-39,62-122,144-207,229-772
atgatgaccattcgaatcagttggataaagcaattgacgttctggaaaatggtcaaaaataaatgggttagaaatttcaactgaaaaatgttttgttttatatttagggaaaaataatatgaaaaaagaatattttattaactcacaaaggatttcagaatcggataatgttcgtgacttgggaattataattgactcgaaactgaatttttcagaacacataagcaaaattatacgaaacgcatatcttagaagctttcagattttgagagtgttgaaaagcagggaaataaagactctaacagcagcttataaaacttttgttcgacctcaattagaatacgctaccgaagtttggaaccctaatttaaaaaaagatatagacaaaattgagcgggtacaaaaatttttcacaagaaaagcttttcaaaaatgtggatttgtgtacaaaaaatatatggaaagacttaaaatcactgatttacacaaattggaagaaagaagaaaaatcaatgatttaacaacagcttttaaaataattaaaggattcaccagcctagaggctgagcaaaatttctttttctcagaaaggcccaggaggcctttacttttacgggtaaagcgccacacggccaaaactcaaaataattttttccataggatagtaagaaactggaataaccttccagttttagcggtgcaaattaataaggcaaaggaattcaggggtttactaaaagcaatgagttctgagtaggaaatttctgtgcca

SEQ ID NO: 45972 - DNA, 582 bp, Heterodera glycines
  Genomic contig location: Contig_ID=SeqID_26047; Location=1..582; Strand=-
  SCN-specific regions: Sequence locations=1-88,110-194,224-343,365 -471,493-582
  Gene Ontology: Biological process=growth
atgtccgctgtttctccgtcttccgttgtccatttgggccttccccgtccggtcgatgcgtcccaacttttctctttggaacgccatttcctccccctgggcaaatgcggcggtcaccccgcgtggcttaaccccgccaccattccgcaaagtgcagaattggcatgccaagtgaattatttgcccaaaatatatctaacctccccctttcctttttgggtttgcggctctccgatggcatttctgctgcaagtttattgtcccgacgaaccctcccacgcattccatcgcaccattttcattttcgtctgtcggaaagggaattgttcaaaagttgggactctttcatttattttctcccaattaatttataaatgccatttctctttccatcagataaatgccaccccaaatttcgccgcctttcgttgccaattgtcccgtgaaaatgcttttttctccgctgagtcggccctttgtccgtccgttgtcggcgaagtgtccgagcctttcttcgacccctcccttttcgcgcgcctttgctaaggtgcggttgtcgcgccgccagccgatgcgcgcgct

SEQ ID NO: 45973 - DNA, 544 bp, Heterodera glycines
  Genomic contig location: Contig_ID=SeqID_26085; Location=493..1036; Strand=+
  SCN-specific regions: Sequence locations=1-544
  Gene Ontology: Cellular component=signalosome complex; Biological process=photoreceptor differentiation (sensu Drosophila)
atggtcgtgtcccgtcaattcatcgccgacatcgcttcctatttgagtcagccttcgctgaacaccgcactgatcaaaggcattggcgaggccgtgctcactcagcttcatgtcggtttattccgccattttgtcttgatcaaattgctaaaatgcactaattgtccgcctcaggcacgtgcacttgcctacgaggagcagagcacccaaatccgcatgattctggccaatgcgcttgagcgtgaccgccaatttgagcaatccgcgcggactcttatgggcataccaattgaaactggtcaaaggtgggaattcttagaaatataaatacgaaatttcagattttcattttgatttttaataaaacgaattttttatttgaatgtgtaggggctatcgccacgaattcaaaatggaactgtacttgcgaatcactgagctgtttttggaggccgacaatgtcgaggaagcggaccgacacgtgaaaagggcctcacttttgcagcaggacgtgaaggaggaggccctggtcatcaaatacaag

SEQ ID NO: 45974 - DNA, 867 bp, Heterodera glycines
  Genomic contig location: Contig_ID=SeqID_26099; Location=366..1232; Strand=+
  SCN-specific regions: Sequence locations=1-82,104-595,619-867
  Gene Ontology: Mol. function=antimicrobial peptide activity; Cellular component=lysosome; Biological process=induction of apoptosis
gagatgaaagtcaattgggccattcagccgggcactcagcagaaaatcgacaccagcagttcgttgctacctttttaactataaaaaagaaaagccgccttttagaacatttccacatttttgtcggagatctttcgcccgaaatcgacaataaaactctcaaagatgcttttgttccgtttggagatgtttcgttagtcattttttaaacatcattttcttgtttgccggtctgaccacaattcggttttagggactcaaaagtcattcgcgacccgaccactttgatgtccaagggctatggctttgtctcttttccaaagcgcgaggaagcggagcgtgcaattgagcaaatgaatggccaatggctggggcgaaggacaatccgaactaattgggtaaacggaatacgaaagatagcggactctttcacggccacccaaacgctaatatttgaaggccactcgtaagcctggcgcaatgggcggtggagttgaatattcgagcaaaccgacggtggacgaaattatggcgcagacgagtccagaaaacacgtccgtttatgttggtggtgttcctcccggtgcgacaggtcgttttaccattttttcaatggaaatttatcatctttgtcgttcagaggaagacatacggtcgactttcagacgattcggaaacatcgtggacattcgctactttaagccgcaaggatacgccttcgtatgttccaaatttttttgtgaaatattttcctattctgtgaaggtgaaatacgagaccaaattggccgccgggaaagccatccacgaaatgaacagcaacgaattcatgggccaaacgcttcgtctcaattggggcaaagtcgat

SEQ ID NO: 45975 - DNA, 299 bp, Heterodera glycines
  Genomic contig location: Contig_ID=SeqID_26124; Location=36..334; Strand=+
  SCN-specific regions: Sequence locations=1-105,142-299
  Gene Ontology: Mol. function=GTPase activity; Cellular component =membrane fraction; Biological process=regulation of cell cycle
atggaccagcgctccatccaggagttggcccgctcatttggcattccgttcattgaaacgagcgcaaaaacgcgacggcacgttgacgaggcattccatgtgaggaatttttgtaaatttatcaaataattttttttaattcgtaaaatttagacaaaccaaatgaaaacattaagattacatttgtattttttgagtttttgaaaaattaattttttcaaaaaaatatgcctaatttcctatttttctgaatttcatccccttttcaggcattggtgcgcgaaattcgtaaacacaag

SEQ ID NO: 45976 - DNA, 559 bp, Heterodera glycines
  Genomic contig location: Contig_ID=SeqID_26126; Location=1268..1826; Strand=-
  SCN-specific regions: Sequence locations=1-301,323-559
aaattatgaacgcgatggagcaggactttgacgagaacattctcagaaagtgggtagtaattgcgtataatttgcacttggccatacaacaaatgttctcccccgctcccgacagattgatccgaaaatttgacgcggacggctcgggcaaattggaattcgacgaattctgcgcgttggtgtacactgtggccaacactgtggacaaagacacgttgcgaaaagagctgagagaggcattccgactgtttgacaaggaggcgagtaaaattggaatggcatgggcagatgaagcactcataattattattattcatccattggccggatgctaattgggcctttggcattttgctataattggcaccgtttaatatttccaatttcccctcagggcaatggttacatttcgcgccccacgctcaaaggactgctgcatgaaattgcacccgatctcagcgacaaggatttggaggcggcggtggacgaaattgacgaggacggcagcggaaagatcgaatttgaggaattttgggaactgatggcgggcgaaacggac

SEQ ID NO: 45977 - DNA, 1865 bp, Heterodera glycines
  Genomic contig location: Contig_ID=SeqID_5092; Location=214..2078; Strand=+
  SCN-specific regions: Sequence locations=1-182,209-233,256-333,357 -622,645-857,880-944,975-1008,1031-1865
  Gene Ontology: Mol. function=long-chain acyl-CoA dehydrogenase activity; Cellular component=mitochondrion; Biological process =energy derivation by oxidation of organic compounds
gttttcaacagaggcgaacattcgctgccgcggtgcccaacgaaatccctgtggagccgaacaacgggcaacagcctgacctggccaacagcaaggttaaatcgtagtccctcgtctatcaaaatttcaattttctcaaaaaatccgactctgagcccactgttgtcttttggcagaggctcaaagtgcccaaaagtttttttcaaaagaattttttttcagtgccaacgttctcattcatggctaataatgtgtatttttgtaaaaaaaaaattcaaaaattagcgtttgtagggtccagacaagatttgccaattttaggggcccaaactctcaaaaattttcaaaaaatttatttttctttgagtgccagccaacaagcccattgcttataatgcgtttttgtaaacaatattaaatttttttttgcctttttacagtcgaaacacactcaatttgcatgggaattgcaaattttgtaaatattgtcatttttaggatgcaaaacccaccgagtcgttttgcatgaatttgttcctgggccgtgcccagcttggccaagtgtttccctaccctttgcggttggacgacgagcagcgcgaaacgctgcaaatggtggtgacgccgagcgccaaattcttggacgaggtcaacaacccggataagtcagtaccgagtaggatcaaaaaaaaaaattatggaaatttaaaatgaggagcatccaaaatcacggagtttcgcatattttagtggttggaattctttggcgtggccagaaatatttcaatttccatatccccccccctcgcccgaattcctcaaaaaaattttaagaaattctcaaaaaaattcttagcaaaattaataaaaataaaaattctgatactttcgagcgattttaaaaaaaatttagtaaagcattataaaattgaaaaattcgccagaaaaattttcaaaaaaaaaattttttttttcctaaatttttcggttggattgggtgttttaccgtaatttaattttttgatttgcttttaatttaaaatttccattttcctaccccccccccccccttccccaaggaatgatgaacatgccacaattccgcgcgaagtgttggcccaatttggcgagttgggcgcgttcggtgccttggtgccggagcgatggcacggcgccgggttgaacaacacgcaaatggcacggcttgccgaattggtgggcgccagcgatttgggccttggcgtcaccatgggagcgcatcaggtggaaaaagagggcataaattaataaatttgaagcataatttgcggaagcctttggaattgtacactttccatcgaaaaattttaaaaaaagcaaaaacttttttgaaacaattttcggtttctttttttgttcggaaagctattcaaaaaagcttattgatcttgcatgactttttttttaataaataaagaatttttcaacattttttttggattgaaaataaatacaacccgcgcaagcggactcgaacccaaaccccgctctctcggcaaacctgcccacaccccacttagcaaaaattttcagtcaattggctacaagggcattttgctgtacggcaccgacgcgcagaaggacaaatatttgccggacttggccaccggcaaaaaatttgccagtttttgcctcaccgagcccagctcggggtcggatgccaatgtaaattttttttaaaaccggactgcaaaaaaaaaaaaaatttccagtcaattcgaacccgagcggagaaatcggcgtgcggcaaattctacacactgagcgggggcaaaatttggatcagcaacggaggctttgcggacgtgttcactgtttttgcgaag

SEQ ID NO: 45978 - DNA, 1164 bp, Heterodera glycines; identical to SEQ ID NO: 26141
  Genomic contig location: Contig_ID=SeqID_26141; Location=1..1164; Strand=+
  SCN-specific regions: Sequence locations=1-246,268-863,890-891,916 -1164
  Gene Ontology: Mol. function=actin binding; Cellular component=actin cytoskeleton; Biological process=histogenesis and organogenesis

SEQ ID NO: 45979 - DNA, 881 bp, Heterodera glycines
  Genomic contig location: Contig_ID=SeqID_5099; Location=5409..6289; Strand=+
  SCN-specific regions: Sequence locations=1-500,523-881
  Gene Ontology: Mol. function=trypsin inhibitor activity; Cellular component=extracellular space
atgcatttgattaacttaatcgccctctttttcatgcttttcggtaagtcaattgtttaaattcattagcgggataattgggtaattattttgctaatcgtttccaggcccatccgtccagcaatacacaaaaacgccgacgaatgaggacaaagaagcggctgtcaattgtcacaacaaattccgatcgcaattggctctgggcaatgccgacaataaatcggggggcaaaaaaatgccaaaggcgggcaacatgcgcaagtttgaatgggacgaaaacttggccaaacttgcggatgaatgggccaacaaatgcacattatcgcactcgtggaacggctgggcaggcgaaaatttggcaatgaatggcggaacattttcgaacagttcgatacaaattgataattgtggctactaattgcctgcttaagaggatggcttcgagtacgcttgcggtcgctggtgggacgaactgaaccgttacgggttcaacccggatctgattatgaccggggaaaacttcagtggcatcggccattggactcaggtgaccaactcattattttggcctttctcgtcccattattgctaattagatactaattagttttctcttcgttttgttcagatggcgtgggccgacaccgaccgaattggctgtgccatggcacaaaactgcccaaataccaattggaaaacatatgtggtctgctggtattacacggggtaataatcaaccactgataaaacataattagtttactaataccccttttagtggtaattactttggtgcgcctgtctatttggccggggagccgtgcagcaaatgcaaagcaaatgacaaatgtgacaaagccacgggactttgctctcaatga

SEQ ID NO: 45980 - DNA, 863 bp, Heterodera glycines
  Genomic contig location: Contig_ID=SeqID_26166; Location=377..1239; Strand=+
  SCN-specific regions: Sequence locations=1-172,265-366,388-414,513 -793,844-863
gagaagattcaaaaatccggcagctattatcgtttccattgtgcataaagaatacagctattggcattttctcaagcgttacgatgagtacgaaattgacgaactcacaaaatataaagccaaagttgtgtatttgactgtgttcgaatgtggtaattagtaagtggaaacgaaaattaaaacttttttttattttaaaattttctattcaaaaataataattttgtgttttgcaatttaaattatttttttttaataatttaagcctaacattggatgatgatttaacattgcgtctgaaaggtgatccagttgctgttgtgtacgcaaatgttgtgatgactggtcacaaaatgctgcccgaaacattggctttattcaaaatgattgaacgatcgacagcttttgtaaaacaattaaaaatcattaataattaatttattacataattataaaattatgttaaactatactaattaattatctaattataagattatgttaaatttattccttttttctccagtattcttcaaccgtatgtgctgatttgagtcaaacaaagattgttcagcaggtaaaaacgatctgtttcaattcattcattttaattaattgacaatttaattggttcttaatttgcatcatttaaaggtgcttacgcgaccgggaatggttgagaaatttttcccgagtcccggcgaagcgccaatggtcacagcaattcgaaaaactttcgccaaaatatgggcattggataatgatgacgatgacaccaaggccattattgcggtaataaatttaaaaaaaattttttttttaatagtaatataaaattttttagcaaaatgaaacttaaatga

SEQ ID NO: 45981 - DNA, 1116 bp, Heterodera glycines
  Genomic contig location: Contig_ID=SeqID_26199; Location=17..1132; Strand=-
  SCN-specific regions: Sequence locations=1-4,26-89,111-296,318 -374,396-691,765-1116
atgaaaaaagaatattttattaactcaaaaaagatttctgagtcggataatgttcgtgacttgggcattataattgactcgaaacttaatttttcagaacacataagcaaaattatacgaaacgcatatcttagaagctttcagattttgagagtgttgaaaagcagggaaataaagactctaacagcagcttataaaacttttgtacgacctcaattagaatacgctaccgaagtttggaaccctaatttaaaaaaagatatagacaaaattgagcgggtacaaaaattttttacaagaaaagcacttagaaaatgtggttttgtgtacaaaaaatatggggaaagactaaaaatcgcgggtttacataaattagaagaaagaagaaaaattaatgatttgacaacagcttttaaaattattaaagggttcaccagcctagaggctgatctttttctcagaaaggcccaggaggcctttacttttgcgagtaaagcgccacacggccaaaacacaaaataatttttttcataggatagtaagaaactggaataaccttccagtggtagcggtgcaaattaataaggcaaaggaattcaggggtttactaaaagcaatgagttctgagtaggaaattttctgtgccacatatacactatattttaatcacctgtgaatttttaacatttgatttatttttattcatttttattacggtattcattttgtattttttatttgatcatttttatttgtttgtttttggcaccatataagagcactatgtgcctttggtttgctcgataaaattaaattaaaaatacaaaaaaggcatttaccagtgtaacttttgaattagcgcgcaaaaatttacgccaattacgttatttggcgttatgagcaattttgtctaacactgggtttgacccatagtgtgggcggaacgggccaactccgtctggccaactccgtctgagccaactttgagtcaatataactcttgaagttattgaccgaatcaaacaatcttgatatcattcgaaagctcttcacaggctctattagcctactaaaaattacagaaaatttcgaactataaaaaaagatagaaataaa

SEQ ID NO: 45982 - DNA, 1304 bp, Heterodera glycines
  Genomic contig location: Contig_ID=SeqID_26213; Location=555..1858; Strand=+
  SCN-specific regions: Sequence locations=1-115,137-311,334-374,397 -440,463-678,700-1304
  Gene Ontology: Mol. function=glutamate-tRNA ligase activity; Cellular component=mitochondrion; Biological process=glutamyl-tRNA aminoacylation
tttttacaaccgcggaagtcatttcagtttcaacagatggcgcacgaacgattggaatcggaggggtgcgtcgatgccttttggacgccgtggccgttggggggacaacaaaaggatgaaaaagtctttggcggagatggaccgcgaacttgaagtttgactcattcgtcaatttattcatttttggcttttccaggaatatatgcgctcatcaaaacacccgcgagtgaaactgaccaaagcgacggactgattgaccattcggaccaaatcaaaagtgtttgtcgtcttccttttgtcgtcttaccaaagcctctctctcccctcacttggtcatttgctgctgatgaattttcgttgatatatttcccttttgtttgttctttattttataatggaacatttctctcgaccatttgttcattttggttgtcccgtatctcccgcttcccttccttccctttgctgtttttggaatcgttttctaaacaatgaagccacagaacctaattattgaaatatggaaagaatttgttacatgtcattgctcatttattcatttttgtgaataatgcatgctcaagcaataaaaattaatcagatcaaaggaaatggtctgttttccgccttctcttatgccgtctttccaatgtttttgtgcttcctcttcccgtctcttttgctcatctgcttttgttcgacccgtccgcgtgcgcttcgccccttcccccacgggggaacttcatttgggtcataatttcaaaacaatttccataaaactgccattattaaattagccatttgaccgtttattcaggctccgttcgcactgctttgttcaattttctgtgggcacgtaaatacaacgggaaatttgtgttgcgaatcgaagacaccgacagagagcgattggtggagggatcggagcaaagggtggtctgaaggaggaggccagaaccgactttcctcttcttcagattgagcagaccctctcccactttggacttacacccgacgaaagtccgttgcgtggtggccaatttggttcctattaccaatccgaacggttgcctctttaccgggaattggctgatcagttggttgacatcggccattcgtacaagtgcttctgcagtcaagaagtaatcatattatggcttcttggaattctggtgttgttcaactgtccatcccatcgtttagcgactcgactttttgcgtcgaaaagcgaactccgaacgcattccgttccgttacgatggcatttgtcgccagctttcgacagaagaaacgcgagctcggga

SEQ ID NO: 45983 - DNA, 966 bp, Heterodera glycines
  Genomic contig location: Contig_ID=SeqID_5115; Location=3398..4363; Strand=+
  SCN-specific regions: Sequence locations=1-137,160-248,271-816,838 -840,862-966
  Gene Ontology: Cellular component=cytosolic ribosome (sensu Eukarya); Biological process=protein biosynthesis
taaaatggacatattttgcagaaaaaatccgcggagaatatcaatgccaggttgggcatggtaaccaagtcgggcaaatactgcctgggctacaaacaatcgctgaaaacgcttcgttcgggcaaggcaaagctggtgatcatctccagcaacacgccatctctcaggttttgattgccaatgccatgtggttggaattcgtaaactggtttccatttttgttaattttgcatcgcgaggaacatggcaccaaataaaaaatggcactctttgaatttaattaaaaactaacagggagaatgaccatgttggtttttaaatttctttttttgtggtaaaagtgaaaactcggaaaagtagtcaaaaactcaattttttctaattccgacctttttttttactttttttttacctttaagcacttaagatcaccaatatttttccaaattcgggccgggctaagagtttcgaattggccgaatcaaagcaatatcccaataatgagcgatgactttctcttaaacgcttgcaattcttcacagacaccacttttagaaatgaaaaattagcgtaattcttaccatgccccaactatacgggttttttacggacccgtaacccgatacgagttttacgtaatacggattttttaacccgaaacccttacccgttatccgaatacattcaaaaagatactacaaaattggaaaagtgccgaaattctccaaatttatttagtccatcccccgaaaaaattgctattttgatgagtttcgccccttcccatttagacgcagtgaaattgagtactacgcgatgttgtcaaagacgggcgtgcacgagtaccatggcaacaacatcgagctgggcaccgcgtgtggcaaactgttccgcgtttccatgctgtccatcactgacccgggcgactctgacatcattcgcagtatgccgacggaggcatgagca

SEQ ID NO: 45984 - DNA, 95 bp, Heterodera glycines
  Genomic contig location: Contig_ID=SeqID_5115; Location=5690..5784; Strand=+
  SCN-specific regions: Sequence locations=1-27,49-51,73-95
agacgcagtgaaattgagtactatgcgatgttgtcaaagacgggcgtgcacgagtaccatggcaacaacatcgagctgggcaccgcgtgggcaaa

SEQ ID NO: 45985 - DNA, 1176 bp, Heterodera glycines
  Genomic contig location: Contig_ID=SeqID_26255; Location=1..1176; Strand=+
  SCN-specific regions: Sequence locations=1-154,176-309,332-1176
cccccccccccccccccctgcgtttatccccatccgaatgtttttttaatcacttcaatttagaattcgagttgctatacatggatgaatttgtcgacaatttgttaagagaagaccattattgtgatatacagctgcctcgtctacaggttttaaaaattttttgccgattgtgtctttcggcaccgttctttgggggattttcttcaaactttacataagtctacaactttggaaggggtgagaagtatcctgttttgaatttgtctgatttctatttttgtcttttttatggacaattaatccgaatttcggggttcatactttttcttatggcttaaattctcaaaattggccattttggtgaaaatctgttatcaaaaattacacccaaaactaaatttaaaaaaattgacaaatagcgcaaaaatgtttgagatcattataaaccatggaaaatttctttttatctttgccaaaaatgagcagtgctggggggaatggattggctgcaaattttcctagaaatatttctttccgtttgaattttcacgaaatgaataaaacaaagcaattttgcataatcacaattttaagaaacggcaagcactcgaagaaaaggaccaactcgagttgtacgcttccgccttggacgaagacttagagcgtctttccaccgactccgaagatgagcaggagacgcggaaagcacggccaaatgtgagaatcgagagcctttttttgggacgataattgttagggatgcgatttttagttaaatacctaaaattttgcgcatttaatacgcacagataagcacgaaaaaagcattttccacttggttttgggtgtctacgttgagatttttttttacctatttaagtacctattctgggatttttttacctaaaaatcgcatccctaataattgtaactaaatgacagatcgtttctcggcgccgaagtcgctcgcgcagccgtggccgaagtcggagcaaatcgagagaacggagacgccgatcactttccacggatggtatcaaatcaaccctaaggacaaattgccagttggatttagaccgtcggggaggacgaagtgccgcgaaagacaccgaaagagaaattgaggagaataacgcactgagaaagaaattgggattggcaccattggagcgt

SEQ ID NO: 45986 - DNA, 632 bp, Heterodera glycines
  Genomic contig location: Contig_ID=SeqID_26256; Location=206..837; Strand=-
  SCN-specific regions: Sequence locations=1-409,431-460,482-632
  Gene Ontology: Mol. function=cAMP-dependent protein kinase, intrinsic regulator activity; Cellular component=cAMP-dependent protein kinase complex; Biological process=mesoderm formation
gagggaggttcatttggcgagttggcactgatttatggcactccgcgcgcagccaccgtagtcgcgaagacgaacacggtcaaactgtgggccatcgaccgcatcacttaccgcgccattcttatggggtcgacgatgcgaaagcggaaaatgtacgacgaattcctgagcaaagttcagattcttggtaatataatgccattctgccccattcattcttctctcttttacagccgacttagacaaatgggaaagggccaatgtggcggatgcgttggaacagtgccaattcccctcgggcacccacgtggtggagcagggtaaaagagcgaaggggaagacagacggagggcaattagcgaccatttaaggacatcctggggacgaattcttcatcattgtggagggcgaagctgaggtgctgcagagaccgaacgacgacgcgcccttcgaagtggtcggaaaattgggaccctctgactatttcggtcggttttggcactcactcctccgctgcattaattaccggctcattaaaggggaaatcgccctccttctcgatcgccctcgtgccgccaccgtcgtggccaaaactctgctgaaatgtctgaaattggaccgggcacgatttg

SEQ ID NO: 45987 - DNA, 1869 bp, Heterodera glycines; identical to SEQ ID NO: 26275
  Genomic contig location: Contig_ID=SeqID_26275; Location=1..1869; Strand=+
  SCN-specific regions: Sequence locations=1-51,73-269,291-316,338 -551,606-1159,1181-1832,1861-1869
  Gene Ontology: Mol. function=extracellular matrix structural constituent conferring tensile strength activity; Cellular component= collagen; Biological process=embryogenesis and morphogenesis

SEQ ID NO: 45988 - DNA, 548 bp, Heterodera glycines
  Genomic contig location: Contig_ID=SeqID_5134; Location=438..985; Strand=+
  SCN-specific regions: Sequence locations=1-94,117-255,294-374,397-548
  Gene Ontology: Mol. function=ubiquitin conjugating enzyme activity; Cellular component=proteasome complex (sensu Eukarya); Biological process=chromosome organization and biogenesis (sensu Eukarya)
atggcactgaaacgtatacaaaaggtttgatcgattgttgatgcaaaacactgttttttccaggagctgcaggacctcggccgtgacccacccgcccagtgcagtgctggccctgtcggcgatgaccttttccattggcaagccaccattatggggccaccagaatcgccttaccagggcggcgtcttctttctgaccatccacttcccgacagactatccgtttaagccaccgaaggtggcgttcaccactcgtatttatcatccgaacatcaacagcaacgggagcatttgccttgatattctgagatctcaatggtctcctgcactgactatctccaaaggttttctttttggattagccatttaagttggtcttgttgtttctttttattaatagatgcgaatgcttgtagtgataatttaactaaaattcagagcctcaagatttttagcatattcagttctatttttgcccagcgtttaatttttcaatttagtcttgctttcgatttgctctcttctctgtgatccgaatcccgatgatcc

SEQ ID NO: 45989 - DNA, 1277 bp, Heterodera glycines
  Genomic contig location: Contig_ID=SeqID_26332; Location=1..1277; Strand=+
  SCN-specific regions: Sequence locations=1-565,587-630,653-1135,1158 -1277
ataggccagaaaatactgctcactttgcagggttatggaaagaattcttagccaaaatatttacaactttctcctaaaaaacaataaaatttcggaataccaatttggttttgttagaaataggtctacgacaagtcaactaataacagttgtggaagattggtacgaggcaattataaatggaaaaaatgttgactgtatttatattgattttcaaaaagcatttgactcagtgccccataatttacttttatacaaattggaaaaaataggtataaggggcaaacttttgatgcggataaagggctttttgagtaataggacttttcgagttaaaattggggattctttatcctcaagtaaaaaagttacctctggcgtcccccagggctctgtcctgggccctttattatttttgatttatattaacgatcttcctgatgctttgccatcaggagtgaaaataaaattatatgctgatgatgttaaattatatatttgttataaagcaagagccgacacggaaattatgcataaagcattgcataatttattcgaatgggcaaataaatggcaaataaaagtttcaattcaaaaaacttttgtattatatttgggttcaaaaaacccaaaagaaacatataaatttgatggaaatacaataaatgctgtggatacaactagggatttaggagtaatcattgataacaaattacaattttccgatcatattaaccaaataacaaggaatgcgtatttacgtatgcgttccttgtttcgaataattaaatccaaatcgtctaagatttggattacgttatataaaacttatattaggcctttattggaatacgctccggaggtttggaatccgtctcttcaaaaaaatattaaaaaaatcgaaaagtgtcaaaaatatttcaccaaaagggtattttttaaatgcagccttccgccaattccataccaaaatcgattagaatacctgcaactgccaacacttgagaataggcgaaagctatttgatctgttcatggcacataaaattgtttatggccgaacagatctgaaactattttctatttttaatccatcagcacgctttaacatccccttttatagatttaacacaaaatacaaactgggcaaaaaattcattccctttgctgggagggtaacaaaattgtggaatcaactagataaagaactaataaaaacaaattctttatttgaacatttttggactaaaatacctgccccgaaaccgaatattctcc

SEQ ID NO: 45990 - DNA, 1051 bp, Heterodera glycines
  Genomic contig location: Contig_ID=SeqID_5147; Location=4289..5339; Strand=-
  SCN-specific regions: Sequence locations=1-149,178-429,451-497,519 -603,625-698,721-984,1006-1051
  Gene Ontology: Cellular component=spindle pole body; Biological process=mitotic chromosome segregation
atgacggagttagccaccaaaaattcgattactctgaagggttccgcacaaatggtccagcaattcttccattacggcattcacagcattctctaccagcgcggcatttacccatccgacaattttacgcggttacccatttaattatgcaaaaattgtttttaaatttttcttttagtgacaaaaagtacgggatgacgctgctggtgaacaaagacccgaagttggagcagtttttaaaccctctccttcagcacgttgaggtttcagacaaatttggagcgaatggaatttaattacgttttagacgatgttgaccaaacaaatgctgaagaagttggtgctggtcattacggacatttccagcaaagaagcgctggagagatggcaatttgacatcgaaacgacgccggaggggtaggaaaagtgggaaaatgggacgggaaatgccaattattgaatccatctttttttgcagtgaaaatggctatggaagtaaagatgagaagcgaataaagcaggaaatcagtgacgtgctcaggtatttactatgggcgtagacatgggggaggagggactgaagagaccattgtcccccaaacgaaaaatggcaattttgaaaaattatgccgctttgtgagtgtcgtcttcctttggacgcgtaaattggaatagagcctaaaaaacaatcaagaggttttttccaatttcttttcatttaggcaaatcacagcttctgtcgcctttctgcctctgcttgaacagcgctgctccttcgacgtgctcgtctacacgttcagggacactgaactgcccgaggtgagcagagggccaaccaatcgtgtggtatgaacaccgtggcgaaaaacagaaatgtcacagttttgcgttaaacaatgactacttttttgccaataaaaattgcttttcccagggctgggccgactcgagcgagtgccacattgacaatgccgagcaggtgcagctgcgctccttctccagctcaattcacacggtgcacacgcgtgtccaatacaaagccgacctttga

SEQ ID NO: 45991 - DNA, 621 bp, Heterodera glycines
  Genomic contig location: Contig_ID=SeqID_26338; Location=116..736; Strand=-
  SCN-specific regions: Sequence locations=1-621
  Gene Ontology: Mol. function=structural constituent of cytoskeleton; Cellular component=membrane; Biological process=protein targeting
atgcatgtcgagagcggaaccagcattgacatgccgggtggccaaaatggaaccaccatgttgatgatcgctgcggcctctggaagggtaggaaaaaaatgtgtctcgaaatatttcccatttgttaaggtggactttgcgcgctacttgctcacccgcggtgcaaccgttggacgcttggacaacaccggtggatttttgtaaaatttctgaatttttttgtccaatatttgttgttcccgtttcaggaagcgttttcgcactgatcctagctgccgagactggtagtttggagatgtgccgtctgctggtcgaggaatgggcagctgaagtcaaccagcaagcaatcgatggcacgacacctttgatgggcgcgagcagtgagggacgcctgaacgttggtgggttgaaaaaaattagaagatcgatttatatacctacctaactacctgattttctcttcattttcagtgacttatctcatcgatcatggcgctgaagtccaacacacggacgccgacggatacaacgcgctgatgcacgcggtgaagaacgggaagactgaagtggcacgacatttgctgaccaatggcgcaagcactgaccaaatgggcaccgacg

SEQ ID NO: 45992 - DNA, 10479 bp, Heterodera glycines
  Genomic contig location: Contig_ID=SeqID_595; Location=811..11289; Strand=-
  SCN-specific regions: Sequence locations=1-447,469-1948,1999 -2557,2579-2623,2648-2908,3096-3162,3184-4157,4205-4233,4259 -4547,4612-4619,4641-4842,4865-5038,5060-5398,5532-6576,6611 -6875,6902-6904,7033-7254,7442-8253,...
  SCN-specific regions: Sequence locations=...8275-8382,8438-8856,8878 -9041,9063-9201,9232-9236,9258-10365,10387-10479
  Gene Ontology: Mol. function=transmembrane receptor protein tyrosine phosphatase activity; Cellular component=integral to plasma membrane; Biological process=transmembrane receptor protein tyrosine phosphatase signaling pathway
cgccaacacagcccaacggtccgctgcaccattacacggtgtacttcgcgttggacgacgaagcggccgatgacgacagttacaagcggtggactcggctcacagtgccattgcgggcggacggaggcggacaggtgatcacgggcgaggaggatgactggcatttgcctgactcagtcctcgggcgctgagttggcccaattcgacgaaacctaatggttcctgatagaaatgggatatccaatcatggattaatcatttactaattaggccaattaaaggggcaacagattggcacaaaatcggatttttcaggtggtgttggaccgtgagacgtacaacattctcgcgcaacgtgaatatcggcttcgtgtgaccgcagcaaacgacatgaacgaggggccgccttccgcggtggcacgctttaccaccggcacaggcgaaacgccaccgacagtggccattgtgccggcggacaacccggccgaagtgcaaccattagatgactattcggtgcgatttggaggaaaagaaacgtgattggcagtcgatcgattcaattggttagggaactgacacaaaagtgatcagtcgatgaattaggattgatcggaagccggccgggtttcagaaaaaggcgtttaggcaccattgaagtgataagtgatcatattaggtccattgcgatgccaccggtggcattccgccgcccaccctttggtggactttgggcaccgacgaggaacggcagccgggcggcgcgcaccttttgttgcgcaaattgcgcaaagatacaacggtaattaattaattttatcaattgctaattacaaaaagcaccgcccctcattaggcgacgtgtcacgcggaaaacaatgcggggaaagcgcagctggtgctggaggtgaacaataacagcttggactttgttgtttatagtaaaataacaacaaaatcatggaaattctattagtattttaactttttagtctgatttcgaaattacaaaattcagttgcgcgtcctcggccccggcacaccgcccaacgaattggtggtgctgccgatgcccgaccaagtgctaaacgtcgagtggacagcgccggacgaaccaaacggaaaggtgggggcagacaaattagcaatgacgggtgatggtcgagagtcttggaagccaaaaccaccaattctcgactaacgggagatttcagtctcgatattatttcataaagcaagagatttctgtaatccaacaaattcttgggtaaaggaggtgaaatctttgaaagacggtccacttgtgattgtaattccgctcttgactctcgtacaatttattaaatgttgagtcccgatcaagcatttgtgatttgctttgaccattcagctggtcggctacattattcattatgccgaactggcggacggacaattggagccgccgtcggacgcttggcaacaaattcgcgtgggcgccgacgtgaacagacaccgactgacagaattgagaccaaaagtgggtactgttgatcggaagagacctttctttaattatcccactcattgaatgccattgtctgtttagaccatttataccatacggcttcaagcggtctccgaccgtggcccgggtgtactgtcagatccggtgatggcacgcacattgccattggcaccaaaggcgcccgaaggtcgttaattatgctttctcgagagtaaattgcccaattgactgggaggagcaaatgatttgttggcactctctgttcagtgatgccggtgatggtgcatgacaacaacactgtgatggtccaatttttgccgtctgacgatccggaggaggtcggcaagaaggtgcagacgtacagaatacactacaccaaaggcgacccgtcgttggaggatgcccaatggaatgaggtgatcagagagaagtgatcgggggagggagaaaagaattggagaagaggggaatgaaaaagggatcagagaagagtgatcagggggagaggatatttagcttagaacccattaaagctaaatttgatcagtttggccatcgcaattaggggtgaattgttgactcattataagccaaagagaagagcattgattttaagaattctaatgaaaattgactgatggagaaagaactgatcaattgggaaagtcaatttatcactgataattaatcaatcaaagttgatttgaattgatgataaaatattcggcggagttaaattgagtccaaaaatcataaattgtgccaaaatagctaaaaaacgttttttttaatagatgacttggtcaattcccccgggcgcggacacaacaaaagaaatgaatgtgtttttggacggcgagaatttcgagccggagacaaaataccacgtgcgagtcatcccaattggcgtggtaagctcacggggattaatagaaccattcaaagccatcactgccccaagcttgaaaccaaatctcagttttggctttgaagatcaatctattctcgggattaaattattgtaaataaaagagagtctcgaaattgtgacgagaaaaaagccaaaggggggttacccagaaaaaaaattgacttttaaaaaaccaaatgagaagacacgagaaaaggaagaaaagagagaaacataacattttacgctcacaatagaaaagggttggtcatagaagaatgggacaatcctctcccattttttttctgttacttaggcagactctctaaccacacactctctcacctttcctctctcgtttcttttcctcacatttcgcacactatttttcctcacttcatgcgtatctctgcacaccattgaccaggaaaatgctccccatatattttcgtttcgttcttttcccctttcacgtaccattttgctgttccggcatcgcttctcggccttttggctaagatcaaagtgtagttacagttctttacggcttaatctccgtaacgacccccaccggggtccaagagattaaccaatttttggaaaatggtcgttgtcgggggcttgctcccgctcgaccgagcgttggcccgttattgcacttaactacgggaacggcgcatctcccccgcgggggagaacaaaatgagcttgaattttttttctcaaattctaatcgttttagtatttcgttaaaataaaaaattttataccttaattggatataccaaagcagtggttgtgatagccaaatttatccattgcagattgaaggaccgccgtcgcaacccaaagactttgacacaaaattgggcgttgtggcaccagacaaaccgatgatccacgtggacgtggaggacaacattctccgagtgccggccggcaccgattacaccgtggcatggcaagctcaaaaatggcacaatgggtaaaataatgctttttagcactgctaacggatttccggcaccgcaaataaaatgggtggacaaggagggcaatttggtgaggataataaaaagggattaaattccactagttacaccgatcactttgatcatcctggcggttcttttttgattgtcaatctgatcagatcactcatgatcagcttgtcatatccgatcactttcttaattcctttgacagatcagtgagggcggaatgcttcgcgtgtcggacattcgccaggcaaaggactttgtgtgtgtggcggagaatgagggcggacgcacggagaacggattcacaatttttgtggccggcccgggcagtgcgccggagaacatccgactggcggcgacgaggccaaaaagcatttcagtcacttgggatccaccgcaaattgccaacggaaacatcacacgatacatgtgagagcaaaacagttaactaatgagtcaacaagtttggcacaattagtgccaaacggctaggaagagattctgttgcgtaatagtcgatcacaaaaactatgatcagttgaccacaatgttccccattcagcatttactacattgcgcttgatgaccagagccgcgatttgctggtcggtcaagtgccgagcaaaccgatcagcgaatggatgagtaaccacgtgatgggcaaggacttgggagtgggcgagaagcaggcactgatcactgactttgtggaggcggacacggtaagaacacaagaggtggggagagagaagagagagagagatagagagagagagagaggggagagagttagagaagaagttattgtctgatttcggatggcattttttatttgctttttataggcatacgctgtggtggtacaagcagcgaaccaagacgggcctggcccctactccaaccagcacaagtgagtgccgttgacattaatctcggctttcccatttcgataccgttttctctcatccatgtacagtaagtattccgtctatttacagtatccggacaatgtctcgagcgcgtgccgccccgccaacacagctgcaggtggagccgatcaatcaaacgtcggtggaagtacattggaaaccggccgaagtgctggaggagtcgccgctcagttatgaggtggaaaattaattttaaaaattttaaaaacatttaatcattttccactaaaaatttatttatttttaggggccccaaaaataaaaaattaaaaaatctgatcaaattaatttcaaaaccaacgaaaaccttctagatttattacgtgccagccgagaagaagattgaagaggacgagctgctgagcttgccaaaatggtcgaaagttgaagtgcccgacccgagcaaaaacagtcacatcatttggaacgcgttggagccggacacggaatacgtcttcaaaatccgggcattgtgagtctttgtttcttctttttgtctaacttatcccacgttttacactgatttttttgatcagatatccgagtggacccggcattttctcggagccgtgcattgccaaaacgttgccggagggtgacgcgccgttcattgtcgtgtcctccgggagcagaggcactgcgggcgaaagcgtcattcagctgctgcccgtaggaaaactggggaaaagcaaagcaaaaagcaagggaaaagtcaatattaagcattaaaactcaaaagtgaaaataggaggggtgggcaaatcccaatgatctaaaaaaatacgtccggaagtttggagacggcttaaatagggattaattaatatccgaaatcacctcctcccgcccacagggaagtgattacactgtattctgccgtgccagcggaagacctcagccggcggtgcgatggatccgcggcggagacattccgattgatccgtccacagtgaaggaggaccacacgggcaccaaatggtacagacatggcattagctgatcatcccgttagccgaatatttttgtctttgtttctctctccctttctctctctctctcattcatctcttctttttttctctctctctttgtttctcactatttcctctcttcctttttctctttccgatcacttttttctctttctccctctctcccccttctctatgcttttgtttttaaggtcactgttcgtctccaacatcactgagccgtccacgttcaactgcgtggctcgcaatccgctgggcgtcgccaattggaccattcggctggaaatgatgtctgatctgtccgccgactggcgcgatcagctggtccgagtggaaagcagacggggccaaatttacctgcactttgccgacactttgcccaattcgttgcgccgtgccaaccaatggacacttcgctacacggacgacccgaacaaagagcgcattctgtggagtgtgttggagagcgaagaccgaacgttggaggtgaaccggggggggggagggtaatccctgatcagccgaagcatatcgaccccaattgatggcatactctcgggggaaatgccatgttttgcttaatccgtcggccaactctcaaaattgatgccaacttcattgccccatcggttctatcctccgaatctttggcataccctggaaaacccaaatttgtcaatttatgatcaagtccaagggatgagtcaatccaagacaaatctttggcatacaaaattgtcaaaaattaaatcatgccattcttcgttaaggagatcccaattcgcgcgccggcagcgccgatggagccgggcgtcacttattacctcgtggtggagaatgccaacgagggagtgcgctcgcccgtgttcaccattttggtgcccaaggcacccggcgatctccgcgtcgggtcgaacatcaatgacgaaatggtcggtgtttgtgctgatgttggtctccgcaattctttcatttatgccatactatttttttgtgccattttggggtccattttcaaaaatatggcaaaatgggtgtccgacggtgccgttaggcgccttttaaataggagtgtttgatccggcacttaacaactcactttctcaggtggtggacttccgtccggccatcagcggtccccagcagccggtgcgcgagtattcggtacgctattggcccgcggaagcggccaaggaggacgaagcggcaccagcggcaggggacgaagcggccgccgctgctgccgccgacgcggcacaaatgagcacaatccgcgtggagggcaaccgcaccgtcggcattcgcgtgcccgatctgccccgcgatgtcgagttctatttccaagcggtggccgagctgagcgatggccaagagttggccgggccaccggtgcgcatccgaacgccggccaaagaaattcgctgcgactgttcgcacgcgtgcaaactgttggagacggactctgtgcaggtgaaaaaaaggggggggggagggaaggaccggaactgaatttggcactggaaaatgaaataaataaaaagggaaacatattattaataaaataaaataaaaaaccataaatcgattatatatttatttaatcaaaatcattacaaaaacaattattttaaaatttaatttaatatgaatattttaatgtacataaattaattttgatgaaaatacataattgatttatggtttttttaaataacgatttcgccctttttatccactaactctctcatctttcctctctcgtttcttttcctcacatttcgcacactattttccctcccttcatgcgtatctctgcacaccattgaccaggaaaatgctccccatatattttcgtttcgttcttttcccctttcacgtaccattttgctgttccggcatcgcttctcggccttttggctaagatcaaagtgtagttacagttctttacggcttaatctccgtaacgacccccaccggggtccaagagattaaccaatttttggaaaatggtcgttgtcgggggcttgctcccgctcgaccgagcgttggcccgttattgcacttaactacgggaacggcgcatctcccccgcgggggagaacaaaatgagctgaataattcatttgcaaacatctgttaaagcgcataattaaatcccgcttcaggtgcgcgtggagtgttactgtccggacgggtggttgttggacgaggacgagaagacgtgcagccaagtggagccaaccggcggggccggcacagtggtcgaggtgagaaacaatagagcaatcgaagtaactaactgatcagcagaaaataagcaaaaatagcgcatgaaataaaccaattagaaatacataaaaagtgatcattaattcgctggagacgcaaactttgatcagaaaaatgatcaataattgatcaggcttctttccgtcaggttcagaaaacttaaaacctgataattaaaacaaacaaacatttcataatgcccattaaacaaaaaatgtgacaaattggagacaattagagcataagagttaattatgctgatcaaacgctccctaaaaaccaatcaatgaatgcatcggaaactaacccggcccattcaggtgtcgccaacattcgaacttgagcaacaacgtcccaaagagttcgatctgttgaagccgaggccaaccggcagagtgccgccgccaacgccggcgggccctgtcgaagcggagccgtacccctcactgaggccgaccgatacgttcaaaactgaggccggcgatgacctgggcgcaacagtgcacgtgttgccaacggactcgttgggccgagaaattcggccagtggtgatgttcaacggcactccgctgcggacggacgggcacggcaattattacgacgccatggaacggaaggtggaaagggacgaagagcagcgggcactcgggccggacggacaggtgctgaagatgaactcggacggaaattgggtgtacccgccgttggacaagtgagtacggcacgaaaaggggcggagaaagcataaagagagaaaaagggagaggggaagagaaagaaacggagagagaatagtgatttgggtaccgtacccactgatcagatatggacagccgatgcccactggtgccaacatgtaccccatttactcggtggtggacgacgacggcgtttcaatgagacgagacgaagaggtgcggatttggggattctccaaatagcagcacattctcattttttacggcatactttttccgttgcacatgcaaattaactttaattctgagcggcataatttaatttttatcgtcattttttgtggcattaattgataatttttctttaattgcctaatattttacaattactcaggggaaaattctcgaccacgaggggaaaccgttgccgaccgacgcttacggccaaccgatggggcccgacagttcgccattgccgaccaatttctatggccaatttgtgcttggccaacggctggaggaggaggacaaagtgttgcccaccgacacaatgggcttcccaatttacccaatcgtttatccggacggacaattgctgcccactgccagttccgggcttttcctggactcggaacgaggggacgaagtgcaacgggacgagcagggcattccggtggacaccgatgtaaagcattggcaaaaaaggacaaaatgaatggcacggggggggggaaggcaaccaacatattgtgaaggagttcaagccatgtaaatcaacgaactctttttttttcttggttttcacaacatttaaagaggggaggggacggcggtgccgataaacgccgtctgggaacaaattggaattttttaattaaaatttgtttagcttagaccaaaggatttgtaaaattcagggtaaaacgctgccaaagaatgaggagggaatgttcgtattcccccggccaccgtcggaatttgtgccggaggcggagggtgccgcggccgcccaaacgactgctccgcccattttgacgacctcttccgaagcgcctccacccccaacgtcagtgccgaaggcgacgacaacgtcgacagcgcgtccaaccgttgtggaagtgattgggccggacggactgccgttgtcgaccacgcgggaaggactcgtgctggaccgtgcgggcagtccactgccaacgcgcggggacgggctgctgatcggcgcggacgggcaaccgttgccaaccgattcgctgggccgttttatacatgtcactgtgccgccgggcggcgccggtgacggggaggaaacggtgccgcaaacgctgcctaccgacgactacgggcacgacattcacccgatggtggatcagttcggcatcgcgatgccaaccgacgcgtctggacactacgtggacgcgggtggtgcacaaattgagacggacgagtttggtcgcccagtggactcggccggccacctcttgccccagggcgagcaaggacaattcatttacacgcgtccggagggtgccggtggtggcgtcgttggcggcggcggcacattggaaccggccgcgaccgcccggggccaaattgtggtggttgacagtgccggacaaccgctggaccgggacgagcaaggcggttgggtgcgcgtaggaggcgagcgcaaaccgttggcgactagtgcggacggactgctgctgggcccggacggctcgccgttgcccaccaacgcggagggccaattcgtctacgcatggtccgctgagcaggagcaggagcggaaattggcaccggtgaccgactcgagtggacatctgctgatgccggtggttgatgcggaagggacgccgttggcacgcgacccggccagcggacgttacttggacccagcggatggcacaccaattgcggttgatgatcagggacgaccgttggaccgtagcggcaacgtactgtccaaaaacatttatgacgaatacgtgtggctggatgtcggtcttgtgagtccggacgggcttccggcacggacggcgggcggccgaatcggtgccgaagcgaccactgccacacttcacgacgatcacgccgtggacggggctgaacttgtgccgtctgatgaaggcggtccg

SEQ ID NO: 45993 - DNA, 1201 bp, Heterodera glycines
  Genomic contig location: Contig_ID=SeqID_26449; Location=42..1242; Strand=-
  SCN-specific regions: Sequence locations=1-96,118-491,513-585,608 -711,733-1201
  Gene Ontology: Mol. function=cysteine-tRNA ligase activity; Cellular component=mitochondrion; Biological process=cysteine metabolism
atggcattgattcggttggatttgaggaattggaacaacatcttcaagcagcactgcagcattatctcaaaaaggcatccattgaacccgacaccgacaaaagaaaactttttgtggatacggtcagtgagtggaagccgaattttaaagattatttcgtttgaacacttcaaaaattaagtgtcggattattcgagtctgtgccttgcctttatttgattgttccaatttctaatccgtaaattttcagattgccaaattcgagactgatctcgttcaattcaaaacgcgtatttcccagccagacaatgggcaatcagctgatgttcgcactgttttggtgcgcaaattgttggaaagtgcgaaggaagtgctctccgattggttggacgttacccggggaaatacggtcactaaacacgacattttcgcgaaattggccagaaagtaaggaaatccgaatatgcctttatttgagtcatgttttttaaggtatgaaaatgaatttttgtgcgatatgaatgcgttaaatgttcttgagccggacgtgttgaccagggtcagcgagtacattcccgaaatcattgattatgtgcagcaaatcatccgcaacggatacgcttatgtgtctgatggatcagtaagttttttttttgaatgcatttgatctctacagtgatccttttataaatgtttctttggcctttctttttacccaattttattccttttaggtgtattttaacactgcccaatttgcatcaaaacccaaccattcctatgcaaaactcctccccgaggcgtatgctgatgcagaaagtgcagaaaaacatttgcgagagggggaaggcgaactcagcgtgacagtggacaatttgaaagtgcgcaacaactgcacccctttttccccaattaattaattgtcgaatttattgcagtttttgtaggaaaagcgctcgccgtcggattttgcgctttggaaagcctccaaagacggagagcccttctgggaaagtccctggggcaaaggtatgtcatttattccacatcacctgttttccaatttgttttctgttcaggtcggcccggttggcacatcgaatgttcggcaatgagtggggccatttgcggggacaaattggacattcacgccggcggatttgatctcaaatttccccaccatgacaacgaaattgctcaa

SEQ ID NO: 45994 - DNA, 483 bp, Heterodera glycines
  Genomic contig location: Contig_ID=SeqID_26481; Location=808..1290; Strand=+
  SCN-specific regions: Sequence locations=1-483
  Gene Ontology: Cellular component=COPII-coated vesicle; Biological process=ER to Golgi transport
atgtccaattcttttcgaattctttccttattctgtccgctgtttctgcttctctttgttcctgagacttcacgagctctctattttcacatcgctgagactgagaaaaaatgtttcattgaggaaattccggacgagacaatggtgatggggcggtacaaagtgcaactgtacgacccgaacacgaaggcatatggggactatccaacaatcggaatgcatgtcgaagctaaggacccggaagaaaaggtcggcaccattcgctgacaaagagtgacgaatggttttgctaattaagttgggctttcttaggttattttgagcaaattgtacacgagcgaaggcatgttcacgttcacatcccattcccccggcgaacatctcatttgtctctattcaaattcgtccgcttggttcagtggcgctcaattgcgcgttcatttggacatccaagtcggagaacatgcccaggactacgagcag

SEQ ID NO: 45995 - DNA, 1174 bp, Heterodera glycines
  Genomic contig location: Contig_ID=SeqID_5202; Location=1675..2848; Strand=-
  SCN-specific regions: Sequence locations=1-83,106-306,341-709,732 -994,1018-1174
  Gene Ontology: Mol. function=protein phosphatase type 1 intrinsic catalyst activity; Cellular component=bud neck; Biological process =protein amino acid dephosphorylation
atggcagtgcccttcagccttcaagtggacggccttatctacagagtcagaaactccacttacgggcaatttcccttagatgtaattgttttttgcttttcaaaatcgtcattattcttcccttccctttttacaggtgacggagcacgacttacgccagctttgcgatgccacgatggacgtcttccggcagcagcagacactcgtcaggattcaaccgcccgtcaacgtctgcggcgacatccatggccaattcacggacctgctgcggatcttctcgacgctgggccccccgccggagaaaaaatacctcttcctcggtgactacgtggacagaggcccccaatcgctggaaacggtggtgctcctcttctgttataaggtgaatttggaaaggcaaaagaattacggggcagtaatctcattttttaaggtcaaatatccggagagtgtgacgctgttgcgcgggaaccacgagtgcagtaacatcaacagagtgtgagtcgagcaacgtttaattggcaacggatggcactaattcaaccttgttttagatatggcttctactcggagatcgagcagcgctaccaccaagcggacactcgacggctcttcgacatgttcaaccaaacttttgcctggatgccgtacgtgggcctgatcggggacaggattctgtgtgagatcgacttgttgtttcattttgctcaaattaatttttctcttcatttcaggcatgcatggcggcatttctgacaggatcaccagcttgcagcagctcaacgaattacgccgcccgctgctcaccctgccgagcccgtcgttggagatggatcttctgtgggccgatccaatgctcgacatccgcggtgtggagccgagcccgcgcggggccggcgtcgtctttggcgaggacgtggtcttccggatctgcgagctgctcaacctcaactacataattcgggcgcatgaggtaggcagggtggacagatttattttcttcaaaagtttcccattttttcagctggtgcatgagggcattgaatattttgccgacgaacgtcttgtcactgtgttctcggtgccgcgctaccacaatcaaatgaacaccggagcagcactaacaatcgcggaggacctgagccacgacgtcacattcttcccgccaaattga

SEQ ID NO: 45996 - DNA, 1412 bp, Heterodera glycines
  Genomic contig location: Contig_ID=SeqID_26538; Location=37..1448; Strand=-
  SCN-specific regions: Sequence locations=1-449,474-1348,1370-1412
  Gene Ontology: Mol. function=U2 snRNA binding; Cellular component =snRNP U2; Biological process=hermaphrodite genital morphogenesis
ggaaatatgctgattggcgtccccgggggccatgacgggccgagtggagtgatcgtttgctgcgagaattatttggtgtacaagaatttgggcgatcagccggacattcgttgtcccattcccaggcgacgggtaattgccattgcattttcattttgcatcaaattgccaacattcagaatgacctcgacgaaagtgagcgtccgattatgatcgtttgtgccgctacgcacaaaatgaagaatttgtactttttcctggtccaatccgagcagggcgacgtgttcaaagtgacgttggactccgatgccgacattgtcaccgaaatgcgcatcaaatatttcgatactttgccggtggcaaattccatttgcattttgaagaccggctttctgtttgtggccagcgaattcgggaatcagtgagcacaattcattaagtgtcactgtcccattttttaattggttttgttgcttttagccatctctaccaaatcgctcatttgggggacaacgatgatgagcccgagttctcttcacggatacctctggatgagggagaaacctttttctacgacacacgcgggcttcaaaatttgatccttgtcgaccaaattgacagtctcaacccgatgatcacttctcacgtgccttttaatgcttttccaacttttggcatatgttatgttctttgttcccttaagatcgccgatttggccaacgaagatgcgccccaaatttacgcactttgtggacgagggccgcgttccacgctgcgcgtgttacgcaacgggttggaagtgtccgaaatggccgtctcggaattgcccggaaacccaacggcggtgtggacagtgaagaaaaatgtggacggtacccatttatttttagtggaagaatttcgatttcatttgattttcagaccctttccatgctcacatcatcgtttccttcacaaatgccactttggtgctgtctatcggtgaaactgtggaggaagtgaccgactcgggctttctcggcaccaccccaacccttggctgtggtttgattggtgaagattcattgctccaagtgtacccatccggaattcggcacatccgtgctgatcggcgagtcaacgaatggagagcgcctccaaaacgaccaatttcaaagtgtgcgatgaatcgaagacaggtgagcggaaatatagacatccttactaaaaaggaaactgttgtgcttttgaaggtcgtgatctcactgcttggaggcgaaattgtgtactttgagctggacatgaacaaccaactcagagagtattccgagcgtcgggagatgacttcggaagtgttgtgcatgagtctgagcgaagtgccggagggggaactccgctcgcgatttctcaccgttggaatggcggatcggaca

SEQ ID NO: 45997 - DNA, 1931 bp, Heterodera glycines
  Genomic contig location: Contig_ID=SeqID_5212; Location=1..1931; Strand=-
  SCN-specific regions: Sequence locations=1-147,169-378,403-652,675 -899,921-994,1017-1280,1302-1379,1443-1451,1473-1538,1564-1567,1595 -1701,1752-1931
  Gene Ontology: Mol. function=calcium-transporting ATPase activity; Cellular component=integral to plasma membrane; Biological process =calcium ion homeostasis
atggagaacgctcatacgaaaagtgaagacgaattgtttcggtttttcggcacagggccagacggactgacagaggaacaagcagacgaattgcgggataaatatggctataatggtatgaattggggacaatttaggtaattgttaaaattattacatatttaattaagaaatgcccgcggaggaggggaaaaagctgtgggaattgattctcgagcagttcgatgatctccttgtaaaaattttactcctagccgcaataatttcttttgtaagtttttcctttttttatttgtatattttggcttcgcttcacttccctctcaggtccttgccttgtttgaggagcacgatgaccagacgagtgcagtcactgcgtttgtggaaccttttgttattctcctaattctcattgcgaatgccacggtcggagtttggcaggtcatcacttttttatcatttgtttaatatacgaatagaaaaagggaatttgcaattaaaggagagaaatgcggaaagtgcaattgaagcgctgaaggaatacgaaccggaaatggcaaaagtcatccgagcgggcaaacacggcattcagatgatccgtgcaaaggaactcgtcccgggcgatctcgtcgaagtttcgggtgggcatttggaaagagaagcaaattgtgccaaatttcaattttctgattaattgttatgatacaataatttgaagatatacagattttctcaagagatttcgtacatttaaattccgttcagttggagataaaattccggccgatttgcgacttgtcaaaatttattcgacgaccattcgcattgaccaatccattctgacgggagagtctgtgtcggtcattaagaatttggacgtggtgcccgacccgagggcggtcaaccaggacaagaagaactgccttttctctgtgtgtttcctttattttttttttattttcccttccctttggccttagggcacaaatgttgcgtcaggcaaagcccggggaattgtttttggcaccggactaagtacggaaattggcaaaatccgcacggaaatggcggaaaccgagtcggacaaaacgccgctgcaacagaagttggacgagttcagcgagcagttgtccaaagtcatttccataatttgtgtcgcggtgtgggccatcaacatcggtaggatttcaaatttcgattaattaatattagtgccttttcaccccttatttgaccccaggccacttcaacgacccggcccatggcggctcgtggctaaagggtgccatttactacttcaaaattgcggttgcccttgccgtggcagccattcccgagggtttgccggccgtgatcaccacttgtttggcattgggcacccgtcggatggccaaaaagaatgccattgtccgctcgttgccttccgttgagacattgggctgcacttcggtgatttgttcggacaagactggtgaatcaattccaatggccccaccacaaaatgtggaaatctttaatgctcaattaaattacatttaggaacattaaccaccaatcaaatgtctgtgtccaaaatgtttgttgttgaacatgcgcacggcgaccaaatcactttcgggtaatgataatatacattttgcaattccctttaaaacggttggtttttatttgtttttttcatttcagcgaattcacaatctctggctccacctatgagccgactgggcaaatcatgtacaacggagtccaaataaactgtgcaaccgaccaacacaaagcattgacagaattagccaccatttgttcactgtgcaacgactcttccgtggattacaacgaagtctttgagcaatttgcttaaaatatatgaacatttcaattctttcctctcagatgaaacacgcttatgaaaaagttggggaggccactga

SEQ ID NO: 45998 - DNA, 955 bp, Heterodera glycines
  Genomic contig location: Contig_ID=SeqID_26558; Location=442..1396; Strand=+
  SCN-specific regions: Sequence locations=1-63,85-248,272-414,436 -616,639-686,708-814,836-955
  Gene Ontology: Mol. function=microtubule binding; Cellular component =spectrosome; Biological process=body morphogenesis (sensu Nematoda)
atgaaaaaaaaatttgtacgttgatttgtacaacaattaaaattttattctatagctaattgtcggaattaaaaattcttttaattatttccttttcagttgctcgcccgtcgtcggcatttgatggatcggatggcacagcgccgggagcgtctcaaggagtcctaccgcctgcacagctttgaccgcgactgtgacgaaatgctaggatggatccaggtgaagctgaagacagctaaagaccaggtcaaaaaatttattaaaaaatgatcaaaattttctggtcacttcttgattttttccgatcacttagtctgaactggtcgagcgattctatctctctctcagcctttgggtttgagtttttcagatcaaatcagaaattaactgctctaacagattaagcaatcataatcattttaacttaaatgattattcttccctttttgcagagctatttggacccgacgaacattcgcggcaagttgcaaaagcacggcaactttgagcaggagttgcgcgcaaatcgcaaccgactggacgaaaccaatgcccccgggcaagaactgatccaatctgggcactacgccaacgaacacattcaggtggggaaaagaaaaataaaattaataatataaggggtaaattatctgatctaatgaatttttctcccacggcgcctagttttaaaaaataaacttgaaaagatttatttccagaaacttttttcgggtttctcgttcgtcactagtactggtttaaaaaattgtttatcgcttttgtaaagttaggaatagctcttaaacatattgctttaaaaattaacatctttcctttgttatttgcaatcaaaattaggatttattgacgattttgcctgtttattttgagtgttttaaaatttttcgagttcgcccgcttaaaacatccttttcataaccattttgtgcatcta

SEQ ID NO: 45999 - DNA, 1143 bp, Heterodera glycines
  Genomic contig location: Contig_ID=SeqID_26587; Location=123..1265; Strand=+
  SCN-specific regions: Sequence locations=1-518,540-589,611-746,768 -864,887-1143
  Gene Ontology: Mol. function=atypical protein kinase C activity; Cellular component=apical cortex; Biological process=signal transduction
ttggataatgttctccttgacgccgaaggtcacatcaaactcactgatttcggcatgtgcaaagaaaacattggccctggcgatggcacttcaactttttgtggcactccgaattatatcgctccagaaattttgatgggcgaagagtacggttttagcgtcgatttttgggcccttggtgtgcttatgttcgaaatgatggccggaaggtcgccattccatctcccaacaacggaagaggacgaacaaactgctgaggaccttctctttgtgagtttttgctggaaagggcggggaattacgtgatgggtgttttacgttcgccccttccccatatcattttcctgaatcagtccctcgaatttctcacaatcagtaaaaaaaatttccggcgggaaacgatacgatcctgataagcaagtcaaattcttacggggattcatggcaattcgcgaaacttttgaagaaaaccgaaattttaatgaaattggatttttctgaggctcatcgacacctcaggaccccctgccttccaaaatattttgaatcacggccaaaaattactaaggaaaaaactgtcgcagaaaaaatttgttgtcctttttaaatttagctaaaattttgaccgcgatgtgggaaagtgagtcgaagtcctctccgatacagccccatagaaacattagggcaggggggaatgtaaggggattagaaacattaacatggaagggggaataattaaaaacaatttagaaaatgataatggaacatcaaattcgcattccacgccatttaagcgtgagggcagcgaatgtattgaagggatttctaaataaagtatgccaacatcgcttaagggaattgggatgttttccttttggttttcagagtccttctgagcgtttgggctgcaaaaccgacttggaggagggactggcagacattaaaatgaacagtttcttcaagtcgaacatcgactgggaattggtttgccggaaattctccttttccccaattattcaattcaatgctttgagcttgaacagcgacagatagcgcctccctataatccaaatgtgtccggagacagagacttacaacgatttgacacgagtttcaccaacggaaatccttccctaacgccgg

SEQ ID NO: 46000 - DNA, 2209 bp, Heterodera glycines
  Genomic contig location: Contig_ID=SeqID_600; Location=522..2730; Strand=-
  SCN-specific regions: Sequence locations=1-461,483-868,890-1979,2005 -2165,2188-2209
  Gene Ontology: Mol. function=chaperone activity; Cellular component =cytoskeleton; Biological process=cell organization and biogenesis
atggtgatcaatcgtttggagaaacttttcgtcaccaacgacgccgtttcgattctcaatgaactcgaagtgcagcatccggcagcccgaattttggtgatggctgcacaaatgcaggaaaagcaaattggcgacaacactaacactgtggtcattttggctgcatcgtttctggagcacgcactgcaattgcttgacatggtttgttattttctgctgattaattaaacaatttaagttgtatcgctttcagggaatcaccgcagtagaaattgcgtcgggttacgaattcgcgcttcaaaaagtcgaggagctcttgccgggattggttgtttccactgctgaggatttatatgacattgtcaaagttcgatcctatctcaaatcgtcgcttatctcaaaacaaacggaccattacgagttaatttctgatcttgttgcgaaagcttgtggtaaattaatacttatttaataaactttaaagtattacaatttttctatctccatttctcgttgttttagttcaaataatgccaaaaaacaataccactgcgttcaatgtcgataacattcgaatctgcaaaattcttggcgccggagtggccagttcgtacgtgacaaatggaatgctttttcgccgtggtgctgaaggcgaagttaaaggcgcgtcaaatgcgcgtgtggtcgttttcgcgtgtccatttgaccttacgcaaaccgaaacaaaggttcgcttttgggcaaaaatgaaaaaaaaaaacaaattattttgcatttaattaaaagcatcggattccttttaggggactattttgatgaacacggcggatgatttgttgcaattcagcaggacagaggagtccgaagtggaagcccaagtgaaaagtctttcggatgtcggcgttaatgttgtggtcgctgccggcaaatttggagacctttacgtgcattttttgaacaaatatggaattatggccgtaaggtgtgacgatagaagttttcggaagccattcaatgatttaagattgacttcgaaattcgatttgcgaagactttgccgaactttgggtgcccaggcgcaggcgcgcatttgtgcaccgtcagaagaagcaattggccattgtgacgaagtgtttcttaaggaaattggcgacactcaggtggaaagatgggcaaaaagttcgaggagaccataacaaatttataggttgtggttttcgataagaaaagcgaagttgggaaagttgccacaattgttgtccgtgggtcttcccagtcgttggtggatgacattgagagggcaatcgacgacgcggtgaacacttacaaagcgctgactcgagacaacaaagtgagccaattccgcctaattaatcgagaggggggggggggtcttcattctatatttgtaaatggatttaaatattcgatttatctttatttgatggctcgaatgaaacattatcatttgtttgttcagctgttgccgggtgctggtgcaactgaagtggaattaagccaccaaattgaaattattggcgagaaggaatcgggacttcgacaatatgcgatcaaaaaatacgctactgctttggacattttgccaaaacaattggccgaaaatgcagggcttaaggtgaacattttttaaaagtgacaaatcgtttaaaaggaattttagccaactgaaacactcaccgatttacacgcagcgcaccaaaaggggtcgaaatgggagggagtggacgcggtcagtggaaagttgtgcaacgcgatggaagcgggcattttcgacctttactccgggaaatcgttggcattaaaattggcgacgaacgcggccatttctgtgctgaagattgatcaggtgacaaacatttgcgggagcatcgctttgtcaattaatggccattcattctatttagataatcatggccaaaccgatgggcggcataaagccaagggcacccaaagggcaggacgacgacgacgatgacactgggatggcttaatcagcacagtcacagaactcattgccgagtttttgctttaagaaagtattgttgctgcttcatttttgttaattttaatacgtaaatacactttcagtaatgcattcagttaatttcttgcccaatttcataaaaaaatctcttctacttacaaaacaactgatttttaaaagtccaagtcgccaaattctaataaa

SEQ ID NO: 46001 - DNA, 450 bp, Heterodera glycines
  Genomic contig location: Contig_ID=SeqID_603; Location=3183..3632; Strand=-
  SCN-specific regions: Sequence locations=1-90,118-450
  Gene Ontology: Biological process=cell differentiation
gctttacttacttctatcaaaatgcaaaacgacgcgggagatttcgttgatttatatgtcccgaggaaatggtaaatgctttcttgaatcttttgtttacttttatttttctttcttgtcagttcgtcgtcttctcgaatcatttcggctaaagaccacgcttctattcaattggaggttgtcgaggtggaccaggcgactgggcgaatgattaccggcaaaacgacgaagtacgccatttgtggaaagttgcgcttcatggtcagtcgttcgtaattggaagggatttatattaaaaaaattcggtttcgcagggcgagtcggatgattgcattctgcgcttggctcagagggatggaataattccgcaaaatttgtgaacgttgattcttcacagggatgcggcgttcttttgttgattttgttgcctgcagaatgataaacactgtt

SEQ ID NO: 46002 - DNA, 656 bp, Heterodera glycines
  Genomic contig location: Contig_ID=SeqID_603; Location=3796..4451; Strand=-
  SCN-specific regions: Sequence locations=1-656
  Gene Ontology: Mol. function=NADH dehydrogenase (ubiquinone) activity; Cellular component=membrane fraction; Biological process =morphogenesis
atggcctccctcaaagggcatcactcgcccgaattcacaaattttattttcgcttgtggcttggacgttcctacgcgtaagaaccgttttgaagtaatttacgctcttttgtcgcatcgattcaatgcgaggattagagttcggacatacactgacgaagtgcgtttttctaattggtttttcaccataacaaattcgattcattgtccaggttgctccaatcgattccatcactccagtcttttccggtgctgaatggtatgaacgtgaaatctacgacatgtacggggtttggttcaacaaccacccagacttaagacgtattttgaccgattacgggtttgaagggcaagtttattttattcattttcctttttgtatttatatttgtttatggcgttgtcacttttagtcatccccagcgaaaagacttcccattgtccggatacgtcgaactgcgttgggaccacgagctgaaccgagtgatttatgagccaaccgaaatgacacaagagttccggaagtttgacttgaacacaccgtgggaggttttccctgcatttcgtgacgaatcgataacctccggatacaatgtcattcaaaaggcaggcaaaattgaggccaaaaagcttgatgatgcttccaaaaaaccgtaa

SEQ ID NO: 46003 - DNA, 2153 bp, Heterodera glycines
  misc_feature (29)..(29): n is a, c, g, or t
  Genomic contig location: Contig_ID=SeqID_26622; Location=98..2250; Strand=-
  SCN-specific regions: Sequence locations=1-407,439-468,490-1695,1719 -1816,1840-2051,2083-2090,2113-2153
atgcattggacagacatttgtacaacacntcaaggtgggtgtcccacagtcctcatgactgcaataaccagcatcaaatttaatcaggttgaggtccaaaacacggagttatacgacagcggaaccctctacccctacaaggcgtacctgaccaacgaactgtcctttccgaacagtgcaaagggacactttatggccagcgcgggctaccacccatcaaggaagcacgacgacgcgacggacgccggttttctggcacgctgtgcgcgcttcgcgggcggtcgtaaagcacgcttcctttctcggctggacttcgacctgggcaaccaggagctgtatctgttgaacaacatggacgtcctgttcaccatctatcgggcaaaggatgcgttcctgttacaaagtctagcgccagcggcagcagcagcagcggcgggccaacattacgcgctgtacctacacgacataaagctgtacgtgaagatggttgaggtgcaaccgtcgctgaacctgtccatctacaagacgctggaaaagcagccggccacctatgcggtacggaagacggaggtgaagtccgtgtttctgaccgccggccgtaccgagatggatcacaacatattttccgccgccatcccgcgtcggctgaccattgcattggtggcgaacggagcattcaacggccagctggcattgtcaccgttcaacttcaagccctacgcgattcgtgagatcagcgtgcacgctgccggtcatgtgtatccggcagtgccacaccgcatggacttctccggctgtgcctacattcgaccatttgttgacatgtacgaggcgctgggcatggccaactcggagcgctccatggacattacgctggagcagttccacgacggatggaccatcttcgtggtgccaatgacatcgacgctggacgacagttgcggctttgaactgctccgctccggcaccaccagcattcggctcgcgttcaacgaagcgataccggcaggcggcgttgagatggtcgtgctcggggaattcgatcagttgatcatgatcgactacaaccgtcatattgtatccgactcaaaaattgcataaaaaggagcccatattatgattaacaacacattgctcaacgctccaaatttgtacctatcaacaaagtgtcttattcataaacctcacacaaacataaacatatattgtctgcccacgataaacatgccaaacctaagctgggtgattttgtatgagccacgaggggacggactggtggcgccacatcccctgttcaatgccagacctgaagtgccagcacgggtgattgacagtgcgccactcatttcgccattgcacagcggtcagcgtgaaattacccccaagcattatgtcaaccatcacccccagcaaagacatttgtaaatttaaggaattgcactgacgagcaaaagtgtgccatctgccgttgagatgaacgttacgatgagcgcagatggtgtggacccaacagcagcagccccagtcatgtatgtgcagatttggtccgcactgctcctgttcaccaactacgccatcatactgccgttgttcatcatttgttggttgtcggttgtacgctggcttcgtcactccggtcttattgccaccgccgtcgccacactcgtcgacgccaacatcatctcggcgtcaaatcaacaacaacaacgaacacactaaaatccgaagcatgttcagtgatggtggggagagcgggcgactgcagcaacagcacaccgcggccgtcatacgggaggccaaccgtgtgacgtcccaaatagctgcagcaacagcaattccggaaccaatgcgcagcgtgttgaacgccacggttgcaattccgatgatcgtgtccgctgcacaaactgaaggtggtggtggtggtggaagcgacgtgaaaagtgacgacggctttcgtgacgaggacattcacagtgtccgttcaacagataacgatgcgattgttaaatggggttgcgcgtttgttaaaactgtcatccttgaaaatgttcaaaaaaatttcataattaatttttttaaaaacttactgaacaatttcaatgaaaaattctaagaggaaattagaatttttgttgaaatatttctaaaataaa

SEQ ID NO: 46004 - DNA, 1187 bp, Heterodera glycines
  Genomic contig location: Contig_ID=SeqID_26627; Location=279..1465; Strand=+
  SCN-specific regions: Sequence locations=1-430,453-1187
  Gene Ontology: Mol. function=damaged DNA binding; Cellular component =nucleus; Biological process=mismatch repair
tgccttttgcctcgacggggcgttgactcggaatacgacgggacatgtcgagaaattgaacattgcaaagaacagttggaggcgtatttgggctgggcaagcaaaaagttgaaatgcacgccgaaattcgtgggcacaggcagaaattcacaccaattggaaatccccgagtcggcatgtcacaatttgacggacgatttccaattcacgtcccaacgaaaagtaaaacggaaattcgaagggaggtggaggtgacgtaaacaatttgtccatttataacgaaggggtacaaacgctacacgactaataacctgcaaaaactggtggacaagctgaacgatgcggagacaaactgtgccacgatcagtgcggaggtcacccgtagagtttttgctgatttggatgtgcggtcggttgaccacgccgaaacaaaacgcatttataattaattcccttttataaaccatcagaaaggacaaatgggcttcaattgttcaccaaattgccactttcgattgtctaatggcgctctctctgtacgcgcagtcatcgcctcacaaaatgtgttttccggagtttgtgttcgaatttgacatggttcaataatacgttgattgtttattcgaccattgttttttagccgttcgtcgacattcagcgtgggttccatccgtcgttggccgaccttaagtcggcgtcagccggcagtttcaattacattccgaacagctgtgtgctgggctgtggctcgaacacggcccacacgatgttgctgacagggccgaatatgggcgggaaaagcactttcatgcggcaagtggccacccttgtggcacttgcgcacattgtgggttctcaaattggcgaactgttctctaattaatctttgccgttcgctatttgagggctcaatggtgccggctgattcgatgcgacttacgccggtcgatcgcattttttgtcggatcggcgccagtgacagattatctgcaggtgtcctttggctaatcagtttcgtgcctgttgttttattactcgactcattaaggacaatcgacatttttcgtggaattgtcagagacgaacacaattttgtcgcaggcgacgcgacattcgctggtgcttattgatgagctcggccgacgcacgaggttcctttgatactgaaaagcacgtatagtgaagtt

SEQ ID NO: 46005 - DNA, 1268 bp, Heterodera glycines
  Genomic contig location: Contig_ID=SeqID_5239; Location=1..1268; Strand=+
  SCN-specific regions: Sequence locations=1-236,272-299,321-401,424 -909,955-1268
ccaactgatgaacgcaagttcgagctgtatcggcagtgcgattctgtgatttacacgccccccaacgaacactttggcatcgtgccaatcgaagcgttggagcagcgacggcccgtcattgtgaacaacagcggagggccagccgagacggtgttggaggacatcacggggacacgagtgagtaggggagggggggggggggggaatagggcgagaatgggttgaatgacgaaaagaatttaaaaatatttattattattaaataattaaagggggtcatagggatactaaaataactaattattacaaattacaaaccaacagaatgtgtatttctcgattttttagggtttatattgaaaaaaccgatcgaaccctttgtttggtttttgatacaaaactaaaaattaataatttaaaaatcaaatcacctgctgatcagattgccgacacttgcggtgttttgctggccaatgcaatggcatcgcacatgggccgcaaagaatggccccaactcgacaaggacgaactttacgcgaaacaggcaaacaaagcgaattaattaagccaatttaaatggctaattgccctcttttagcgcattcgcttcgatgaaaaatttagttggaagggattcggacgacgcgtggacgaagcaattgccgaattattttcggtggaccatccgccgacggaggaaatggcgcaaataatggcggaaaggcgtccccagcaaaatgaaactgtgcacgtgcacatcaacggggtaactagcaaaactaattatgccaattaattatttcctggataattcataatttatatgaatgaacactcccacaaatattcatttgaaaattcactaattgcttgagactttcctcagttacttcataagttttcgggccctaaaatattttaaatttttaaattaaaaaaaaaatttttttttttgactttgcaatttgtcccattactcccaactttcatctgctcccacccccattgttcagcacagcaaatgccaccaacagaatggcatttccgactcgaacacagacttggaacggggcatcattccccccagtcgccgtggcactctttctccccaacgtgtaaagtttctgtcgcccaatggcacgcatttgccaccgcagacaaacggaggcgaagtgccggcgacaattggcagcaaatcatcggcattttctgctgtccttacaaatggccatcggaacacggcacttcaccgacgccattcggaggcg

SEQ ID NO: 46006 - DNA, 1262 bp, Heterodera glycines
  Genomic contig location: Contig_ID=SeqID_5246; Location=87..1348; Strand=-
  SCN-specific regions: Sequence locations=1-479,501-557,580-934,956 -1128,1151-1262
  Gene Ontology: Mol. function=signal transducer activity; Cellular component=actin cytoskeleton; Biological process=myoblast fusion
atgagatttgctcttttgggtgccgccattggtgcccgtttggaagtgtgccgtctgttggtggacgaatgggcagcggatgtcaaccaggaagcaatcgacggcaccactcctctgttagacgctagcggtgagggacacgtggacgttggtgaggaaaaaaattgtgtcaaaaatttcggttaatttttcagtgaattttctcattgaacgtggcgccaaccttgaccacaccgacatggacggatacaacgcgttgatgtgcgcagtgaagaaaagaaggactgaaatggcacggcatttggtggccatcggcacgagcactgaccaaattggcactgatggtgggtacaatgttcaaattgtcctcctacttttatacgtaattaattttcttctcccatttaaggcaaacgggcgcgcgacttggccgaagaaagcgaaaatgccgaaatgagagacattttccgtgccgtggcggctgagcagcaaagggagaacatcgacgggtaaaaagtgttttttgattttaaaaaaaagtacaaaaattcaggcaacaaaacgagcagcaacagcggcggatgtgatcggtcggatgagagaggaaatcgctgatcaaaagaattggacggatgtgccgactttcataaggaattcgatcacttatgtcttatgtatgtattgctgtgtatatttgttctcataattgaattcacttgtcatatttgtctgctataattgttcaaactgatcaggatgacattctttgtacgataaattgtaaatgaattgtgaatagaaaagtaccgaatttttatgtgctaaaaccgccaaaaaaatgccaaaaatatgtgctaatcaaatatgtttcaaggtgttcgagggctaataatgtattatcggattccgggtccaaaaaattttcgaactttgattcagatttttcagatttgtttcagaaaactcaattatcataaggcataacaaaatccattttgatcactaaggcttgtaattatatggatataaaatcgcgaaatatggccacaaaacatggacaagaaatcgtgaaatatggacataaatttgcaaaaatatggacatcaatttttcccaattgagggtacgtttcccaaaattttttcaaattcgcttaacgcaaagtaaaactttcaaaaatggctaaatatggtattaaaaatgattttagaagaaaaaaacaagatatagcttaaaattcactcattttagcgaaaaataaa

SEQ ID NO: 46007 - DNA, 1378 bp, Heterodera glycines
  Genomic contig location: Contig_ID=SeqID_5246; Location=3826..5203; Strand=-
  SCN-specific regions: Sequence locations=1-192,251-845,867-1378
  Gene Ontology: Mol. function=death receptor interacting protein activity; Biological process=induction of apoptosis
atgtgctcgtacgaaaacggcctggcccaccacccctgctggtatgtaagtaccgaaattttttgttcgagcgagattcgacggagtataaaagtgttgcatttttccctttcccattcattcattctccgctctccgttttccgtctctcattgtcttctccccccattttcggcaggcaatggtaaccccaattttttaaattttaaatcttttgaatgcaatttaattttttttttttcaattttaagggaaatgtttttggctcttccgtcgcggctgctgatgaggaagacaattttgaggagcgcactcgtcaattcttcgccttcgtcaaccagggaaacattggacaattgcgtgcgctggtcgactcgctggacgcggatgagctgagcattttgctggagatgaaccaaccggatgtccaacatgctcggcccgctctcgtgaacgcaattttgaatcggcacacagaaacggctgttttcttggtaaagtttccgccgacatttcgacgacagcaatttgatttccccccatttttcttcattcagttggagaagggtgctgatccgcatcagaccatgattggccaactgaacggcttgaacatgagtgagtagcaaacagcagcagaattggctatatgcactctttatgagttcaatcttcagtttctttgctcatacataaccttacttggtcaatgtgccaacattcttggcataatttttgtttcttggtgtcagtatttgttcttcctgtatttatgaattggccggactttagcatttttgttttatactaagaaagtaaatccgtgatcagagtctatccagaaagcccattaaaacatgttttttatgactaaaataaaaaaattcaaaaaacggggggaaaattgaaaattttctttgaaaataatttcagggggggggtctcaaaacagaaaagtaccgaaaaaaagttatgggcaaagaaaatgaagattggactgataaagaatgcaattgagccgttatttaaacgttgtgtccccccaaatttgcagatgtgacaccgctttgggccgctgtcgtttttgtcaatttggagctgtgccgtgcgctgatcgcccatggtgccaacattgaaatgggcacggactctggccactcgccactgctgtgcgcatgtttcaatggcaatttggagatcggtgaatcaatctcgaatggatgccgttttgccgctgcgtaattgccacaatgttttcccattttcagccacttttctcgtcgagaatggcgccaacgctaatctcgcggacactgacggaatgacgccattaattgtcacttccttttcgggacaggtggaagagttggatggatga

SEQ ID NO: 46008 - DNA, 524 bp, Heterodera glycines
  Genomic contig location: Contig_ID=SeqID_26686; Location=743..1266; Strand=-
  SCN-specific regions: Sequence locations=1-302,333-524
aactcatcagaaattacgcggccgaagcggtgaaaagcgaagaggaattggccgagttggtggaggcggcggtcgacttggcccacgagttcggactgatcaaacgattgtcggacgacgagtcgcgccaaaggtaagcggcacaaacacggggtatttggttgtccaaacaaatgcccgatttacttcagaaggaccaccgatttggcatccattcagccgttcagtctgttcccgtccccattccctcgttcgcttttccaccgggcgatcgccgtgcacaaagtgcgacttcaaaattcaaattaaacataaaataataattattatttgtgttttagggaatgcaaaagctgttctttcgcgtttcttgtgactatgaatttctggcaaaagcgacagaacaattggccaaaacgaataaaacgtacgaacggatggtgggacttatggaccaagtccggcgagaaggccatcagcagccgtacacgctgctgttgacacgagcggtcagttgtttttaa

SEQ ID NO: 46009 - DNA, 1995 bp, Heterodera glycines
  Genomic contig location: Contig_ID=SeqID_5256; Location=1571..3565; Strand=-
  SCN-specific regions: Sequence locations=1-281,303-346,369-851,881 -948,978-1140,1162-1296,1325-1490,1536-1936,1963-1995
aacttttaatgtggataaagggctttttgagtaataggacttttcgagttaaaattggggattctttatcctcaagtaaaaaagttacctctggcgtcccccagggctctgtcctgggccctttattatttttgatttatattaacgatcttcctgatgccttgccatcaggagtgaaaataaaattatatgctgatgatgttaaattatatatttgttataaagcaagagccgacacggaaattatgcataaagcattgcataatttattcgaatgggcaaataaatggcaaataaaagtttcaattcaaaaaacttttgtattatagttgggttcaaacaacccaaaagaaacatataaatttgatggaaatacaataaatgctgtggatacaactagggatttaggagtaatcattgataacaaattacaattttccgatcatattaaccaaataacaaggaatgcgtatttacgtatgcgttccttgttccgaataattaaatccaaatcatctaagatttggattacgttatataaaacttatattaggcctttattggaatacgctccggaggtttggaatccgtctcttcaaaaaaatattaaaaaaatcgaaaagtgtcaaaaatatttcaccaaaagggtattttttaaatgcagccttccgccaattccataccaaaatcgattagaatacctgcaactgccaacacttgagaataggcgaaagctatttgatctgttcatggcacataaaattgtttatggccgaacagatctgaaactattttcaatttttaatccatcaacacgcggagggtaacaaaattgtggaatcaactagataaagaactaataaaaacaaaaattctttaaatcaatttaaaacaaaacttaaaagttcattaagacaataagaccggaaaaacttaaaaaatggctacataatatttaaaaaattttttttttataagtgatttggtaattgtgatctctttgactttgacctcattttatatttttcttggcgattttattttatttgtgcttgtataatccgatacttttggacgattaatgtatgtatatgtccacaaagtaagtggatttatcccttttgtggactttttcttttctttataaataaataaataaaaggtgtacaatgtgtttaacttcactcgaaaattttttaaaattttctaagttagaaattttcatccaacaacattttaaaaaactaaagaataaacgaagggagaaaaatcaaggagtgaaaaattggtagtgagaaaataaaaaatttaaaaaaaaattaatcagtagtcacactgaatgagagaggaaaaatcaaaaaaaaaaaaatcccgcaaatttttttttaaaaatatcccacctgttcagcgtggtcagcaaagaatgtgaacacgttgttcatgatgacaacatcagcattggccaaaatgtcagcatcggcatgaccatcaaaaaaaaaaagaaaaagtaaataaaaattttttttttttaatttctgcttttcaaaaaattatatgctgaattactaatttttttttaaattttccaaaattacttaaattattctcgagtttttttgcatgtaattttcttagaaaaaaatctcatgtttttcttgtaaaatttcagcttgttaagttttcgggggtgggaggagttaggggaagcgagctgctcgcgggttcgagtcctaatgaatggcgcactttccattttactgctgaaatggaacgcacatggttcagttggtaccaacagtataaaatgttttatatgaaaggccctaaagttcgaatcccaatggacgcgctttgattggaagtgagtcggtgtggctcagtggcacccccacaaagtgtccaagccacgaaatgtccaaaagagtaaaaacccacgaaatgtccaaaatttttcaaaatttataaaaacaaaatgagtctaatttaggattttta

SEQ ID NO: 46010 - DNA, 606 bp, Heterodera glycines
  Genomic contig location: Contig_ID=SeqID_26728; Location=113..718; Strand=+
  SCN-specific regions: Sequence locations=1-150,172-606
gccaaaatcaccacgttatttggaagacgatgtgttcgtgtgcgaatatcagatcgatcggaaccagcgcagctttgagaaaatcccgccgaagaatcgctactacatcaacactgagccatttgtgttcaactttttcgagaagaaattgacgatgaaaagggattttacggtaggtgggtggtggatcggaaagagtacggtagattgacagttatgttgttcaaacattgtaaggattacggtaattaaccgatacggtaaggggttcatgcagcggcgggtgttcacattttcactatgctagcatatgttgtgttcatttagctgacttttccaattgttacagcctttcaaaatcaccgcttcttccaccgaaaacaaaacttcgtcctcatcaactgctagcaggacagactgctgctgcacaacaacatcgccgctgttcaccaacagtctgatcagacaacggattttgcagcagaatttggagtccgtttgctcaaagatcagtgcccaaaaaattgcggttggcattggcaccagcaaaagcattgcttaaccatcatcactgatcagcagcagcagtggccattgatcgactga

SEQ ID NO: 46011 - DNA, 3960 bp, Heterodera glycines; identical to SEQ ID NO: 5269
  misc_feature (3930)..(3930): n is a, c, g, or t
  Genomic contig location: Contig_ID=SeqID_5269; Location=1..3960; Strand=+
  SCN-specific regions: Sequence locations=1-329,351-725,747-1392,1418 -1620,1642-2178,2201-2607,2629-3053,3075-3296,3327-3960
  Gene Ontology: Mol. function=RNA-directed RNA polymerase activity; Biological process=positive regulation of growth rate

SEQ ID NO: 46012 - DNA, 3377 bp, Heterodera glycines
  Genomic contig location: Contig_ID=SeqID_5271; Location=1..3377; Strand=-
  SCN-specific regions: Sequence locations=1-148,170-580,605-613,653 -784,873-896,950-975,1014-1057,1122-1266,1298-1399,1422-1986,2009 -2586,2669-2670,2692-2790,2814-2870,2895-2914,2936-3078,3215-3377
  Gene Ontology: Mol. function=cell adhesion receptor activity; Cellular component=cell wall (sensu Fungi); Biological process =agglutination during conjugation with cellular fusion
agaatttcaataaacttcccatttcacatcggtagtgccttttaaatttgtaaaaatttctgttgcccaaaaaccaataaatgttggtattggcataatttgttatcaaatgttctaaaaaaacaaattcaccacgtttcctaaatctttcaaaaatttggccaaaaaattcattcaaaaattgtagtactttgcgcttattttgaaaaaaaaatacaaatcaccgtcttagattctctgggcctgaatttcaaatttttattgaatttttgaaaattttttttcagttttacttttgaaaaaattgatccgggtcaaattttggaattcggaccgtaagttgtaaagcctatttttaatcctgaatccggtctggatccagttcactaatgctggttcgaatcggtaatttttcaaaatttcagtctatactaattactctcaacaccaaattgaccaggacaaaattcccaattatagaattagaaatgtccctggtgtttgaataatatgcatttgtgaaattgacggatctgacgtaaaaaatagtcaaagtaagcaaacccaaaaagaaaatcacataaattaaaattataaaaaaaaagattgatgttttaatgccaaaagaattcttgaagtaattttgtttcttggaaaatacggctaagttgcgaagagttccttgggatttattgaaagacacatattttatatttttatccgcgataaaaaggaacaattgtcaagaaactcggctaaattgggtatttttcaaaatgaaaagattttatttttttaaatttgattataaattatatatattttatttttatgaaaaaattaatttatttaataatctatcttttttatttcctttgcaagattttaaaatgaacattttaaaaacaaacaaaatattaattatttaagtatattttaagtaaaaaatgaacttccataatcggagtaagaaacaatatattttataaataattttatttaattatttttttctctttagttgaataaattgaatcatgcttacacaatttcatagaataaataaattatgtttttaaataataaaaaattaaaacctaattagattaaaaaatttataagatgtacttaaaattaaatctttaattctaattaagatatgctttttccttaaaatctaagctctgttaattattaaacaatgtgttaatttttgaagtaatattataagcctaacattattcactccgatcccgtcataatggcaaataaatattaaatgaattaaatttttaatgtgttggcttaacactcgtttacataattaaaggaaaattcgtcaattcgttagaatgatagtatttattgaaacagcttaattttcactaatttcggcaaacagttgggaaagtttttaaaattaagcggaaattgttgacgacttttgacacttttcaccattaacgtggaaaaaatgaataaactaattagtttgtttagttgttatattacccgctttatgtcgtcatggaccaatataaaagcggtggaaatattcacaaaaaatcactttcgaattattcgactattcaattaaacaatttcaattgaaaatgaattgccaaatatggttcggccaattgatgtgcattatgttgctgatggtgtccacggattatgttgtatcccaagacgattcatctacatcctcaagctcgtcaacgagtacatcaacttcaaccagtactagcacgagcacatcgaccacgaccccaagcacaacttcgaccagtacgtcgactagcactgcaaccacgcccacttcgacttcgaccagtacttcgaccaccccaacttcaacttcgagcacgtcgaccagcacttcaaccacgcccacttcaacttcgaccagtacctcgactacgccgacttcaagctcaaccagtacatcgacatcaacgagttcttcgacatcaacttctacgagcacctcaactacaacacccacttcaacttcgaccagtacttcaactacaccgacttcagcaagtacatcgaccagcacttcaaccacaccaacttcaacttcaaccagtacatcgaccagcacttcaaccagtacttcgaccacaccgacttcgaccagttcttcgacttcaacgagtacttcaacgactacaccaactacgaccagcacttcgtcaaccacaactaatccgtcgtccagcagctgtaccaacgcggccggtgacagagcgtgcaacttttacaagaataggtgcaaccgattttcggcatggcttaaacagcattgtgccaaagcatgcaacatgtgcccatcaacgaccagcagcacttcaactacaacctcgacttcaacaagcacctcatctaccacgaccaaagcttcaggtggttcatccggtagctgcattgaccgtattggtgcccgactgtgcagccgttacagtaggatgtgcaaccgttttggcatttggatgagactgttctgtgccaacacttgcaaaatgtgttgaaaaaacaatgaaaactgatggatgtgaggaggaatttgtgaagaaaaagataaaaattaaacaaattgaaaagatatttatttgttaattgaattttatacacaatatatatttattatttaaatttttatgtttgtttaaatgggataaaattatgaaaaaattgttttctaaaaatgctcgtttttgaacaatttatgtgaaaatttaatcacgatattcaaaggtttttttcttaacacgatgattgtagaactttttaatattttattttctaacaacattcttcaataattgacattttttcgaataatgtaaaatccagaaagccatcttaacaatttgattaaatcagtaaaaatataaactgattaattaaatgtcaaaatttatcaaagatgtacttttgaaacctagtgatttgttggtttatagcaaataatttttccaaaaaccaagcggaaaatgcgtttttcatgcttatttacacgtattaagtgcgcaataaatttaggcatttgcctaaaaatcgcatccctattaaaaataaagaaaaattaagtaaatggaaaataaatattcagctaaagaactgtatataattaaaaagaaaatatgaaaaattgggatgaagatgaattagaaataatagtacaaacacaaaaaaataataataattagtaaaagacattgccattttcagaaaaaaaaacaaatacagtcaggtgcaaaagtatggaaaataatttttaatcgaccaaaattcaattttatgttgacgtaaaattctgaaaaaaatcctccttgtctaacttttggtcctgatcaaaaaagtctttt

SEQ ID NO: 46013 - DNA, 728 bp, Heterodera glycines
  Genomic contig location: Contig_ID=SeqID_5272; Location=180..907; Strand=-
  SCN-specific regions: Sequence locations=23-214,387-529,698-728
  Gene Ontology: Mol. function=cell adhesion receptor activity; Cellular component=cell wall (sensu Fungi); Biological process =agglutination during conjugation with cellular fusion
tttcaaatatttattttgtaaaaccgtgttagttttgttgctgtctttgggtacaacactggtttcatcccactggttctcttctcattcatcggaagaagaaacgacgagcacttcgtccacatcgtcatcgagtacatccacaacttcgactacgacaagttcaactagtacaccgacaggcacaacttcaacatctactagtacaagctccacgacaacttcaacaagtacatcaacaacaccaaccacatcaagttcaagcagtacatcaacaacaccaaccacatcaagttcaagcagtacatcaacaagcacaactttaacacctactacatccagctctacaacaagttcaaccagtactgccacagcaccgacaacaagctcaagcactacgactcctaccatgacaagctcaacaagtacaacaccgacaacaagctcaagcactacgactccgacgacgacaagttcaacaagtacttccacaacaccgacaacaagctcaagcagttcgtcgacgagcacaacttcgacaactacttccacaactccaaccaccacaacaagttcaacaagtacgtctacaacgccatccaccacaacaagttcaacaagtacatccacaactccaactacagaaagtacaactgagacaacactgaccagcactagcagcagcacaacaaccacattgccgtcaagcagttgtaccgattcggctg

SEQ ID NO: 46014 - DNA, 1407 bp, Heterodera glycines
  Genomic contig location: Contig_ID=SeqID_26784; Location=1..1407; Strand=-
  SCN-specific regions: Sequence locations=1-86,126-149,171-345,378 -516,686-770,819-878,917-946,968-974,1198-1407
  Gene Ontology: Cellular component=synaptic vesicle; Biological process=synaptic vesicle priming
tattttttatttttagggtggccttgttagtgcacttcaggacgacactttacacttatggaattttaggtgcaaaatatggtgccaaatttattcattattttgataaaattaaaaaaattattgctttttttaaaaacacattttccgagagtcttttgcttttggcattttgccaaaccttttatctgctggtatccattatggtccgatcatttctctccttggctttgtcctaaattaattttttcatgctattgtgtctaatgggccaaaataatttctgatcattactttttttaattattaccctttttaccaaccaaaatttatgatcattacatctaaaaataattttaaaaaaacatttttttaaagacaacgaattcccgaaattgcccattcgttgcgcatgtcaaaggaacgaatttcgacgatttatttgccattccaaagtcgatggttgtatgttggcacggaaaaggtatttgtggcatttttgcatcatattttcggatttttaattaaatttttattataaaattttaatgttcaatttaatataaatgaatattgaatttggcaaatatttttaattatttaaaaaagcatacaaaatgataataataaaattattttattttaaaaatattaaaaaaacataatattatattttttaaatttagggcaacgtttattttgtttgtttggccacttttgaactctccacttatgtaattcaatggaacaaagcagttgatatgtatgacaaaattattttaaataaatatattaataatttaaattttttaaatttagaagctgtcggactcatcctggtgccattaaatccctcgaggtattttgccaaacaaaacaaaataatattattatttatttctaaattactaaaattgaatagatgcttttaaaggttttttaagctattaacagaatttaattgtcagattgactaaatatttttaaatttaatttaaaaaataattttttaatttatttatcgaatagactaatatttttattagtttatagactaataatttaattttatttaagtaaagaataataattatttaatctagttatccaaatgactaatatattttaaattaaatacaaataaaaattattattaatgatataataaaatgatcggattaattccaattaattgatgttctctaatttggacaggtctctcccatcgacccgaccaagctgttaattgtgttctaccgtggtcaacttgtgctgtggaatattcagacccgcgaggttgaccggttcaggttggatgatcaaccgaacagtccggtgaccgcggtcagctggcacttcgacggcaaacagttgatggccggacaccacgacgggagacgatactgt

SEQ ID NO: 46015 - DNA, 1052 bp, Heterodera glycines
  Genomic contig location: Contig_ID=SeqID_26801; Location=26..1077; Strand=-
  SCN-specific regions: Sequence locations=1-219,242-245,268-799,821 -906,930-1052
  Gene Ontology: Cellular component=nucleoplasm; Biological process =mRNA splicing
atgctcgttttgctgatgcaacggccgaccgacgattcgattgaagtgactgtgactttgctgaaggaatgtggggcaatgcttctgaaggtgacgccgaaaggctcaatcggtaataaaattgtttcatctgttttttggcacagttcgcactttataaaaaaataaattatggagaattgaatagtcggacaaattcatgttcaaatcagcactcctccccaaaatttaaaaccttggactatcatttgtcttggccatttatttgtttccgataatgccgttctattcagctgtctttgagcgtcttcgtgccgtgctcaacgattgcgactcaatccatgaacgtactcagtacatgatcgaaacaatgttccatattcggaagaccaaatttgaggttggaaattgaaattagttaacaaaagccataaaatcaatttagaactatccgacaatgttggaagagttggatttgatcgacgaagacgaccaaattgcgcatttggttcagctaaatcccgaagacggaaggccctatgaccccgaaataaatttaagtacgacattttcaattaaaggaagcaaaaccttgggaaatagattttttactcattgccttggttcaattcagatgtgttcaagtacgaccccgactttgagaagaatgaggcggactatgaagagattcggaaggaaatcatcggcgatgctgacgaatctgagggcgaaggggccgacgaagaggaggagggggacgagcaacagccagcggaaagtgagtgccaaacggaggacattttgaaaagggaacacaaatttgcgtttagcgaccaccggcatggaaattttggacatgacggaacaggacatggtcagcctggagcatatcacggtttaacaatcgaaggcattttcaggtggcatttcgacgcaacgtttatttgaccatccaatcgtcattggacttccaagaagcggctcacaaactgatcaaaaacgaattgaagcccaaattagaggcaatggaaggctttcgggcatcattaatc

SEQ ID NO: 46016 - DNA, 1357 bp, Heterodera glycines
  Genomic contig location: Contig_ID=SeqID_5291; Location=343..1699; Strand=-
  SCN-specific regions: Sequence locations=1-169,196-457,482-947,969 -1357
  Gene Ontology: Mol. function=damaged DNA binding; Biological process =mismatch repair
atggattcgagcaacggacacccggactcccgggcaaatctcttcgaagctgacaaatataacaaacgcaaaatcaaagatttgctcattgtcctcgatggtctggaagacactcggaaactaatgcttttattcgaagagataaactcgcagggcgaatcgaagttcgtttttaaaaatgaaaaattaatttattggtgtacttttttacgtattaatttcagtgcaccgcctcttttaaacgaatgtttgagtgccaattacaaagaaatggtggaagatttgggcttctttaaggtcattatttggtttggcattttaataacaaatgggcaaaagcttttttttctcatttaagcgttgcctgttggaaatatttattggaaattttggcacagagcaaaaaaaaaacttccccccccctcccctccgaattttctgattgtgagcactgcatcacttttcattttcagggtgcatttgaccgtgagaatgccctcgagcgtggcgttattttgcctcgacggggcgttgactcggaatacgacgggacatgtcgagaaattgaacattgcaaagaacagttggaggcgtatttgggctgggcaagcaaaaagttgaaatgcacgccgaaattcgtgggcacaggcagaaattcacaccaattggaaatccccgagtcggcatgtcacaatttgacggacgatttccaattcacgtcccaacgaaaagtaaaacggaaattcgaagggagggggaggtgacgtaaacaatttgtccatttataacgaaggggtacaaacgctacacgactaataacctgcaaaaactggtggacaaactgaacgatgcggagacaaactgtgccacgatcagtgcggaggtcacccgtagagtttttgctgatttggatgtgcggtcggttgaccacgccgaaacaaaacgcatttaataattaattcccttttataaaccatcagaaaggacaaatggtcttcaattgttcaccaaattgccactttcgattgtctaatgggcctttctctgtacgcgcagtcatcgcctcacaaaatgtgttttccggagtttgtgttcgaatttgacatggttcaataatacgttgattgtttattcgaccactgttttttagccgttcgtcgacattcagcgtgggttccatccgtcgttggccgaccttaagtcggcgtcagccggcagtttcaattacattccgaacagctgtgtgctgggctgtggctcgaacacggcccacacgatgttgctgacagggccgaatatgggcgggaaaagcactttcatgcggcaagtggccacccttgtggcacttgcacacatt

SEQ ID NO: 46017 - DNA, 988 bp, Heterodera glycines
  Genomic contig location: Contig_ID=SeqID_5291; Location=1756..2743; Strand=-
  SCN-specific regions: Sequence locations=1-96,118-988
  Gene Ontology: Mol. function=damaged DNA binding; Biological process =mismatch repair
gatcagtgcggaggtcacccgtagagtttttgctgatttggatgtgcggtcggttgaccacgccgaaaacaaaaacgcattttataattaattcccttttataacaccatcagaaaaggacaaatggtcttcaattgttcaccaaatggcactttcgattgtctaatggcgctctctctgtacgcgcagtcatcgcctcacaaaatgtgttttccggagtttgtgttcgaatttgacacggttcaataatacgttgattgtttattcgaccactgttttttagccgttcgtcgacattcagcgtgggttccatccgtcgttggccgaccttaagtcggcgtcagccggcagtttcaattacattccgaacagctgtgtgctgggctgtggctcgaacacggcccacacgatgttgctgacagggccgaatatgggcgggaaaagcactttcatgcggcaagtggccacccttgtggcacttgcacacattgtgggttctcaaattggcgaattgttctctaattaatctttgcgctcgctatttgagggctcaatggtgccggctgattcgatgcgacttacgccggtcgatcgcattttttgtcggatcggcgccagtgacagattatctgcaggtgtccgttggctgatcagtttcgttgcctgttgttttattactcggctcattaaggacaatcgacatttttcgtggaattgtctgagacgaacacaattttgtcgcaggcgacgcgacattcgctggtgcttattgatgagctcggccgaggcacgaggttcctctgaaaagcactcgttaattaatccctttaatgtcaattattcagtacaccgacgggactgccattgcatgtgccgttttcaaacacatcatgcggagcattggctgccgaacgctcttttccacccattaccattccctgtgcaactttgtggccactgacccgaggattgcacttgcgcataaaaa

SEQ ID NO: 46018 - DNA, 2049 bp, Heterodera glycines
  Genomic contig location: Contig_ID=SeqID_5318; Location=749..2797; Strand=-
  SCN-specific regions: Sequence locations=1-12,34-458,480-485,507 -804,828-847,870-950,972-1245,1270-1641,1686-1844,1916-2049
accaaatgaaatcactttcaatggcaagtcaaacatcgccagaaaattctatccaccggcaccacctcaacagtccctcctcaacaaatataattacctcattagccgcctcagacgactaccaaataacttcacctcaaccgccgcttactacagcggacaaatccatgctaattcaacgccagaattcgtgcggcagttcaaagcgtttttttgtctcccgggtacagtaccctgctgagcaacaacagaaacagagcgcctacggtagccattctttgaggatcaaaattgcggagaagcaaagcaaagcagtggcagcagttagtggcgatagcaaagtaggacaaccacaacatctacaacggacaaaacagcagcagcagcagcaggaatttgtcaccttccgttacacttggccagtgcgaataacggaacggtggtcactttattataaagtttttaaacacaataattggcgtgacaaatagctttttaaaacagttacaccaatccaattgatttattgttgtccacactgttcagactgatcggtgccggtgaatctgccattttgaatgtcagcccggcattttgcactgccttcaatggtgggtcatttttttgttgtttgttctccaaataataaatttaaaatgccttaggtgtccaattcacttggcttttgcgcatttgcgaggaggaaatattgcctgcggacattagcgaccaaagtgagggcgacatttcgatggactcgtcgtatttcgcatcgggcggcgatgacgacgaattggagatggtgcagcaacaacagcagcaaaggaaagtgaacatcaccctctactacaaggaggggccggcacgcgacgttaagctgagcgggggaaagtaagccgaaaaatggaaattattcaaaaaataagcaaattggcacgcccaaatgccaataaattattgaaatttaaaatgttaagcatttccattcgaaactcggagggcattctcttcgacaatatgccattgcgcaacttggagtacacaaagggcggcggatggtcgccgataagcgacgaagggctggggggacggcagagggacgagcagcgcaagttcagcgagttcatccacgaccacgtcggcaagcagatcaccgtacgggtgcagatgaagtgaggaagaaacggaactgtattgcatgacaaattatgattatttatcatttttagtgatgtaattagtgtactgtgtatttatttatttacttacagtattcccttcctttttcagaatgcccgcttcgttgttccaaccgctgcaatatttgcccagcattgagtcgccgcaaagtgacaaactctcggcactctgtgccgttgttctcgacgaaatttcgccaaaataaacttaaagtcccagacgttgaacatttcgacttcaaagtactaaaccatacttccatactttgattataatgatttttctaatttaaaactcacaatcagactgacaaatacactctctaccgacacgttttccaatttgggtgttcagaagtttttgaccgttttttgaagaatctcaaaagttttggcgatggattggatgaaaaggaattgctgggaaagatacaaaatgtagaataattaatttgtaatttttacacttttattttaataaatttaggtttttgcacattattatttcaacacggttattgtccgggaggccgaatgttttgaagattttttggaggcgctggacgcctcaaggcatgtccaattccccgctcttcggcgagaatgcgaacgattcatttgcaccgaagtgatggcggtaaattcaaaattttgttttaaaattaatttaaaaacgtttaaatattaattataaagtgaaatttgaattcaaagaaccaatgatcaaattattgtgttaatttgagctttttaggaattcgccgatttggcatttgtaaagaaaatgctgctgcttgctgaacgctttaacctgtccgttctcaaaatggtacatgctcttgcgaattaa

SEQ ID NO: 46019 - DNA, 387 bp, Heterodera glycines
  Genomic contig location: Contig_ID=SeqID_26937; Location=47..433; Strand=+
  SCN-specific regions: Sequence locations=1-153,175-336,358-387
  Gene Ontology: Mol. function=methionine adenosyltransferase activity; Cellular component=cytoplasm; Biological process=amino acid metabolism
gtttcttacgcaattgccatttccaaacctttgtccatcacagtcatttcttatgggaccagcccactcactgagcaggaactgctccaaatcgtcaacgacaacttcgacctgcgcccaggcgtcatcatcgagtgcgccttttgcccttcgcttcccttttcctttcctctcaatttgcccattttcagggaactcggcttgaagcgcgccatttattcccgaaccgcggctaatggacactttggacacgccgatttcccatgggaaaaagcgaaaccgctcgaaattcgtcctgagctgatggaaaaactgatcgcctatagaaagtctgaacacattccgaatggctgcttcaaagggacgcacattcacgcgcaccactga

SEQ ID NO: 46020 - DNA, 324 bp, Heterodera glycines
  Genomic contig location: Contig_ID=SeqID_26962; Location=434..757; Strand=+
  SCN-specific regions: Sequence locations=1-18,58-58,103-226,260-324
  Gene Ontology: Biological process=cell cycle
atgttccaaattttcgtcaaaactctcaccgggaagaccatcacccttgaagtcgaggcgagtgacaccatcgagaatgtgaaagcgaagatccaggacaagcagggaattccgccggaccaacagcgcctcattttcgctggtacatccgcttgatatgccgggatattaaattttttcgcgtaatccttatttttagggaaacagctcgaggacgcacgcaccatggtcgactacaacatccagaatgagtcgacgcttcagcattgtctgaagcttttcgggggcgcaaggacgggcaaaacagcacactactcgcggagc

SEQ ID NO: 46021 - DNA, 995 bp, Heterodera glycines
  Genomic contig location: Contig_ID=SeqID_26984; Location=199..1193; Strand=-
  SCN-specific regions: Sequence locations=1-691,753-995
  Gene Ontology: Biological process=glutamate metabolism
atggaattcctggagaaaagccaacgacgtcgcgccggcgatgatgtccaatgggaggggttggacccggcgggaaaacgcgtgattattctcggcggaggtgacaccgccaccgattgcatcggaacttcgctgagacttaacgccaaaactgtgcaggccttcgaaattttgccgcagccggcagagataagaaagctcgaggtaaataaatggggtttttagcttctttggttgtttaccccttcgacctttttagaacccttggcctcagtggcctctgattttccgagtggactacggacacgaggaagcgaaggtgcgggacggaaaagacccgaggacttacgcaattagcacaaaggtggggagaaatggtgcgggacaagcagcaaaaccatatgatttacaggaattcatcactgaagagaagaacggagtgcacgtgttggtcggcttgaagacagtgaacatcgaatgggagaaggacgagaatggggcttggaaaatggtggagttggagggcaccgaaaaggtgtacgactgcgacctgtgcattatggccatgggtttcattggacctgaaaaggtaaaatggcagttcctggcacctattcacacattaaatagccaggaatttttaagcaaccgggcatttggtctaggaaaacggacttaggcggaactccgtaacaaaaaccctgatactttcaaataaattttttaaattcaaaatgcatttaaaatttgtgcagactgtcatcgatcaactgaggctggactatgaccctcgtcaaaatatcaaaactccgaacgaaaagtacaacaccaattgcgcgcgagtgttcgctgcgggtgattgccgcaggggccagtcgctggtggtgtgggcaattcacgaaggacgacaggccgcccgacaagtggaccactatctgatgggcaaaacgacattggccggttacggaggcattgtgttggcaccaattgcatag

SEQ ID NO: 46022 - DNA, 768 bp, Heterodera glycines
  Genomic contig location: Contig_ID=SeqID_5338; Location=2739..3506; Strand=-
  SCN-specific regions: Sequence locations=1-18,40-407,429-547,573-768
  Gene Ontology: Mol. function=calcium-dependent phospholipid binding; Cellular component=synaptic vesicle; Biological process=synaptic vesicle fusion
atgccaatgcccgcgcctgaaaagggaatggtcgggcccaataaagcgacggcggacgaacgaggaaaacttttgctggcggtgcaatacaacattcagcaggggtcgctgtttgtgagcatcagacggtgtgcggaactgcttggcatggactcgaccgggtacgtccccaagggcgtggccagggaaaagcgcggttggccacgcccttccgcctgcggaatgccgtcgaaaagactgtcggaaaagccattttcagcttctccgacccgtactgcaaagtttcactgaccccgctttcaacaaaagcccatcgtcagagaacgacgatcaaaaagcgaacattgaaccctgaattcaacgaggtgagggaagaaagccgacggacggacggagaacggcggtccctttcagaccctccaattcattgtgccgttcaaagacttgccgcgcaaaacattagtcatcggagtgtacgactacgacgttggacggcacgacgattacatcggtaaacgagaagggaagggacgaattgcgaagacattcccccgcccgcctcctcctttcaggtggaattgttctgtccaccgccgcacccgacgaaaggggccgacaatggcaacaagtgatggaaaacccaggcaaaacattcgaacattggcaccgattggaagtggacgagtgagcggacgacggcacgaaagaaaagcacaccgaacgcggagcagcaaatgccttcaacaaatgagaacacccattcgctaa

SEQ ID NO: 46023 - DNA, 380 bp, Heterodera glycines
  Genomic contig location: Contig_ID=SeqID_27025; Location=15..394; Strand=-
  SCN-specific regions: Sequence locations=27-78,108-114,139-226,272 -275,298-333,361-380
  Gene Ontology: Mol. function=translation factor activity, nucleic acid binding; Biological process=protein biosynthesis
atgggaaaggaaaagatccatatcaatattgttgtgatcggtcacgttgactccggaaaatcgactaccactggtcatctcatctacaaatgtggtggaattgacaaacgtactatcgagaaattcgagaaggaggctcaggaaatgggcaagggatcatttaagtacgcttgggtaagtcgtaatccaatcatgttcacgttaaaatatacttttctaggtgcttgacaagctgaaagccgaacgcgagcgtggtatcactatcgacatcgctttgtggaaattcgagacaagcaagtactatgtcaccattattgacgctcctggccatcgcgactttatcaaaaacatgatcacaggttcagttttgcaataccttt

SEQ ID NO: 46024 - DNA, 4097 bp, Heterodera glycines
  Genomic contig location: Contig_ID=SeqID_5349; Location=1521..5617; Strand=-
  SCN-specific regions: Sequence locations=1-90,149-281,579-581,605 -616,639-815,880-932,975-1004,1026-1116,1172-1198,1233-1279,1301 -1305,1342-1409,1436-1445,1528-1632,1686-1703,1744-1813,1916 -1928,2007-2203,2242-2301,...
  SCN-specific regions: Sequence locations=...2323-3006,3028-4021,4044 -4097
  Gene Ontology: Mol. function=metallopeptidase activity; Cellular component=extracellular; Biological process=embryogenesis and morphogenesis
ggacagtcaaattggtcgtgacgtggagatcagactttcgcgaacattccaagtgaagaaggcgtggattcgcaaagctggcctggaggcaaatatatatttttttaatttttaaattattttaaatatttttaaacaattattttttgttagggacgcgttgagccggcgaacaatggcgttttccagcaagatttgctgctaacggaacagcaggcgaatgtgctaattacggagatcaatcagaatgaggcaaaacacatttaataaaatattcttccttaaataaatatttattttaaattgaattaaaagattaaccataaatatttcatttaattaaatcaatttattttgcaattttatataaaattgaaaatactatttgtatattgtaaattgtttaatttataatattttttaaacaaattatttaatattttattgtaaatttttaagtttttaaatatttaatttagaaatatttaatggtttaataattattttacttttttcactaataattttcagagtttcttaattgtaaatattttaatttattaaaaatattattttttgccatttaataaattatttaaattatcctaatcttccatttttcattttcccatttgttttcggttggcgttggtgccgtgccgccttctgacaaccgccgtttcagtcgtcggcacaatttcaatcgccgtcgtttcactcgcgccggcaattcgctgttctttgaagcttctcccacccaaaaatggccagtcggacaaccaattctgtacatgttcgatcagtccgttcgtgggtttaaaaagaaaattaattatttaaaaaataataaaaattattatttttttttctaaaatatttccatctcagcggctttcaacaccttgtcaaatggcatttaattctccagaaattttttaaatactgtaacttttttgatcaaaagaatgaaaaaggcccaaaattgggacaatggcagttcgtgtaaacatttttaaaatttcatttagaacctagaatcttacacaaaaaataaataaatttttctctagaaaaacttaacaaaaaattttctgctaatttatttgagtttagttcaaattttttgaaaaataaatttaagaattttttaaaagtttttctataaaaaaatcattctgattttttgagaaaaaattaaagcttttacttaattttaaattaaacaacaaaaatttataggaattgtacgaacttccattgtacgaatccatgacactccaaaattatttatttaggaaataaagcaaattaaataaataattaatttaaaaacaataatttgctgcctaacttaagcggaaagtgacaaaggttctgttcgcgcggcggttcaggtgatttcttggatgacaattaaaaatatttttatgaaaattggataagggattaaatattaataaattatctctttaacattttatacattttttgtctgatttaatttaattttgaatttataaatttattgccaggaaatccaatccaaaagttgtctgagcttccaagaagcgtccagaaaaccggcaggaaaccatctgtactatgtgaagatcaacaatccacaattgtaagaaattaattaaaaaataagaaattaattaaaaaaattatttataattaaaattcactccatttcaattacctaataaatttataaaactcaattttttaataattaaaattgagtttcaactcgcaaaaaacgaataaatgaattgattttttagttttttatagctgtttaattcattgctaactaattaattaattacgatttcctaattaattaatgatcgtttaattaattacttaattgatgacttataaaaaattaatgattgctaattaattaatttcatgcttatttctaattattaattaatttttgtttgattgtaaataattaattaaattgctaatttgcaataatttttatttatattattgactatttgttttaattatttggcatctttcagttgtgggctcagttatgtgggccgaatttctccggcaaatccagtttatttgagcttcaatgcggcaacgccgttggcattgccatccatgagacaatgcacgcgctgggcctgcagcatgaacagctccgagtcggtgggttggcaatggcacaaaatttggcataattttatttaaaatttttttcaaatttctaaatttctggattaaatttctattgtgccaccatttacatatgtaggtagaaaaaaaaattcgggcggcatgggctttgtttcagtggtggctctaattcagggggggggctgaattacaagaaatcctgtagttttcattctgtacaaattggttgcttctttatgccttttttgtgcccaaacttttctatgttttttctgctattttccgattttcctcccttaaaatgccatttttattttttaattcatttttcatttccatcatcagaccgtgatctgttcatcaacatcaattgggcgaatataaatccgcaaaactatgacacatttgcgcgctcggagctggtcaaatacactagctatggcgtccgatatgactacgggtgaacagtaattaattagggttaagcgttgattcttaggaaaaaaatcggagaagaaattccccgacaaaatttgtcgtatgggaagaaggctggacaattcaaaaaaatgtcgggaagcaataaatactcccctcgtggttgagaaattttgataaaaagtcgaaaaaaataaaattttctaatttcaccggttcgagtcgggaaggaactttaatttaaattacaattaaataattgcaatattcctctctgatcaatcaattcctcagttccatcatgcattacgccagcaacattgcgtccaaatcagctggactgaaaacgatgacggcaaaggtatcaaatcaaatcaattagagagatagtcgagagtctcggcctattttccctattttcggcatcagtccaccaatcaatagagctcatttcaattctctaatctctcctctcgagcacatcctttgtcttaagagttaattctcccggtgtgactcgaactcacggcctttccataccgtggaattctttttaaccgactgagctgcgtggcaatcaataatcccgtcattattcaagagtcttagtttctcgaatctcttccctcggacatatcctttgtccatcaattaataaatccttagtacataaaagataactggcccggtggactagtacccacggtttttccatagcgtggaatgctttttaatcgactgatcaatcccatgtcctttatcccactttctccctcactccgcttccttctgccatccccataaatatctaacccatataatgaccgttttttattcaaaacaccgtaaccaaaaccaatcatgatgatttcaatttataccattttccgaccaaccccggtgccaacgatgcgcagatgggccaacggagagggctgagtgcaacggatgttgaggaactgaggcgaatgtactgcatgccgggtacaaatttggcactaattatgaccaattagcgttgggcgacgggtgtgccgaaatatgacaacaaattccgccaaattccttcaaaaattttttttgacatttaagcaatttgattgttgaggataattgccagaatttttgtatttttatgtgccattttgacaattcaatgtcatttttaaaattttatgaatcattttgacaccttttaatggattgggaataccgaaatacaaaccttttgacttatttggccctttaataaccattttggcacattttgctgaatttgtcattgtcaaaacctattgttggcatatttttcctatttttggcgcattccttcatttttgtggcacttttcccacaaattatgtcatgttttttaatacaaaggttgcgcggatgccaacgtttactgcggcgtttgggccaccaacaatttgtgccaattggccagcacgaggccgtggatgatgcaaaactgtcgcaaatcgtgctcactttgt

SEQ ID NO: 46025 - DNA, 362 bp, Heterodera glycines
  Genomic contig location: Contig_ID=SeqID_27038; Location=733..1094; Strand=-
  SCN-specific regions: Sequence locations=1-278,308-362
  Gene Ontology: Mol. function=dihydrolipoamide S-succinyltransferase activity; Cellular component=alpha-ketoglutarate dehydrogenase complex (sensu Eukarya); Biological process=energy pathways
cacgtgacaacaaattggcgattgaagacatggagggcggcactttcaccataagcaacggcggtgtgttcggctcgttgttcggcactccgatcatcaacccaccgcagtcggccattctcggcatgcacggcattttcgatcggcctgtggcggtggatggaaaggcaagtcgagaaaagatcggacaattcagtttgttttgtagcaaaaataacgcattgatttaggtcgaaattcgtccgatgatgtacatcgcactcacttacgaccatcgcctgatcgacggcagagaggcggtcacttttctgcgcaaaatcaaacaggcggtggaagacccgctgaccattctgttggatctc

SEQ ID NO: 46026 - DNA, 1047 bp, Heterodera glycines
  Genomic contig location: Contig_ID=SeqID_27042; Location=320..1366; Strand=-
  SCN-specific regions: Sequence locations=1-951,975-1047
atggctgaaaattttctcttggaatttttcaacttttacgacggtccaaatggtgaacagacgcgacaacaattgttaaatgcatacgacgcaaatgtacgcaaaatgggcaatgttaaatttgagtaaaattcgcttttaaggcgacgtttacctattcgatgtgttttctggcggatacccatccgaccggaaacagagacagaagtgaccatcagtaagtgctaatggagtaccaacacccataagcagtgggttacttaattattctacccctccggaacccttcgcaaatacttcaggttgatcccccctcccccctgttcccttctaattttggttccaattcattttctgtctctgttcagagagttgatcggcctgtacatccgttcttctcacaacatcatccaacaacacaaatggcaatcctatcgtgacaaaatcatttatcgtggacctatggatatagcagtcgctctgagcaaattacctccgactgagcacatcaaacaatcatttctactcgacttcaatttcacttctgtgggttattaattaaattgttgtttgtccattcactcaaattttctgcttaggaatttattgcttttcaggacaatttgatcgtcttatcgctgcaaggaatttttcgcgatgggaaagaagtgtcggatgggtctaccaactttttgaacatgaaatttttcacccgacagtttgccattgtcccaaaaacggaggggtaatttatcttggtcaacataaaaaaacctttttttgccatttaggatcgcgataatttcggatattctccaaattacaccgattagcaatgctcggatggaacggtacaacaatttgctcaagaatgcgactgtggcgcaggtcataaaacatttcttattttgttaatgagaggattttcaggtgcagcaatcggctctcgtccctggcggtgtcttggcttcggctgtccaacaacaaattgatgggatggccccaccgcctccgagtccacagacacaacctgtgttgatgatataa

SEQ ID NO: 46027 - DNA, 618 bp, Heterodera glycines
  Genomic contig location: Contig_ID=SeqID_5358; Location=509..1126; Strand=-
  SCN-specific regions: Sequence locations=1-192,214-257,279-380,402-618
caacgttctcaacgatcacacatcaagcacccacaaagccagcccgacaacagcgacaaaaacatcaatgcgcaacttccaccggaagacatcgcaacaatgcacacgcagaaggtcgtcttcaacgcgccgttcgacaacggggggaccgcctgggtgcgggtgcgtttgggcatggtgcacgtggcatgcggttaacccccgttttaaaatttaggtgatcaaccctgggacggagcgcatcggctacgccttcaaaaccaccaaaccgcggcgcctcggcgacgccgtcaagaccaccaaggcgcagcgcatcaacatcaacccgccgaacgggacgggacgatcggcccaaagaagttcgtcaacgtgggcatctcctgcgacgccttcgaccccggcaccgagggcgaccgtggagtggacaaacacgccgcacccagacgccaccgtgttcaagcccgagtggttccagggagacggatggtgcgccgcaagaacttgtcaatcgagtacaacttctgatggaaggatgcttcgtcaccacaacatggacatgataggatcccatcccaccgtcccaaaattgtcattttgtcccccgtcatttaaattgtt

SEQ ID NO: 46028 - DNA, 723 bp, Heterodera glycines
  Genomic contig location: Contig_ID=SeqID_5362; Location=114..836; Strand=+
  SCN-specific regions: Sequence locations=1-723
  Gene Ontology: Mol. function=protein kinase C inhibitor activity; Cellular component=cytoplasm; Biological process=signal transduction
ctgatcaagttggacccaaatctgaccctggaggagcgcatttcgttgtcaacggcttacaaaggtgcgatggcttctcgtcgtacgtcctggcgtgctttggtctccatcgaggaacggaccggcgcgagtttgagcgatgcacaacaacaggtggcatcatttggccacaaattctgatcaaaattggcccaataatttcccccaaacaattttcaggtgttggagaactatcgtgagaaggtgcagaatgaactggtgaacacttgccaagaacttttggtgagtttctccgttttccaccgattttttccaaatttttaatttccccaatttccaatttagacatgcatcaacgaagtgctgtttccgaaggcgtccgacgtggagcagaaggtgttctatctgaagatgaaagccgactactaccgttacatttccgaagtcgcgacggacgaagaccgatccggtgggatttgagaggatttgtgcccgattttcaggcattttgtgatttgtgtgattcctcaatcaactaaccatcctctgttttttacaggtgttgtcgaactcgccaaagttgcctaccaggaagcgattgacatggccggcgacaaaatcccagcgaccaatccgactcggcttggccttgcgctcaacttcgccgtgttcaactacgagatcttaaattcggtgaccgaggcacgcaaagtgatccaaact

SEQ ID NO: 46029 - DNA, 2297 bp, Heterodera glycines
  Genomic contig location: Contig_ID=SeqID_5364; Location=1998..4294; Strand=-
  SCN-specific regions: Sequence locations=1-448,470-920,947-964,991 -1022,1044-1138,1171-1383,1412-1456,1492-1637,1659-1930,1952 -2020,2043-2043,2068-2212,2239-2297
  Gene Ontology: Biological process=growth
aaatgttcggtcagtgggcctcggcacattttggacaaattgagcgagtttcgtgccgattttttgcactcaaaaagtgcccgattggcttcgtctccgtcctttgtgcaggtcattcaatgttttttgcacttttatttgcaatattttgctctttttaggtcacttttttgcaattggttgccaaacttttcccgtcagaagcgcgtttccatccaattcttacgcccacaattgcatttgcttctgaactggtcggaaagtgcgttttttcatcaatattttaaaaaattcaggggtttgaatttttcattttttggaaaaattttattttttcacgacaaatttctcgaaagattatttattgcgaaataaaatccatccactgaattttttcttcaacaattgccttttttgggtccattattcccccccccccttcaaattttctcattttcagcactcgcatttgctcggttgaccaatgcgctcgtctgatttttctgtgtgcccaaatgtgcgattggttttgtcgtcggtctgtcgctgccgccgttttcgtcatttttttttcaaaatttcccaattttctaaaaatttaggcctcgtttcttccccgaagtgttggcctttttgttgggcgctcttcagctgtgctgtgagagcaaaaatgaggcgaaagaagtgccatttccgtcgatgaatttcccaatttcgctgccccatcgccaaatgctttttgtcgcgccaaaggttggttattttatgggcacagcgatttggttccatatttatgccaacaaattgactgatgctgttccaatttcatcatggcatttttttgaaaaaataaatttttacctggaacgactcgtaatagctattttcgatgtcaacctattgaaattcaaggttttagcaaaaaaaaaaaaaaaaaattttttttgcctttgacacaaaaaagtttttaaaaaaaaattaaatttatttccttttcacggtccatcaattttattaaggagtcaacaacaacatcaacaaccggcacttttggtaatttgtcacttggacaaattttccacccaaacattggcgatttggagacggaaaatggtggcattttggatgaggaagagaatggtggtggtgccaccagcacagacgaggacaaatgccgtctccgattggccaccgttcgcgcactgttcgccacaattggccaatacgcgcgcaaatacggcaccaccaccgccgccgacgaaagtgtcgccgccgccggggaccaaccgacaaacgacggcggcacaatgtgtcccgcgttcaatgcctgttttgggtacgttctttttaggatttgggtcgtcggatccatcctaattgctgattttttgaaatttatttaattttttatgaaaattcctgcttccctaatgcctccaatccgtagaattttgaggaaaaaatggacaatttgtttttggacattatgtcccatttttttagactttaatatgcttattgttaaccattttttcatttctcgtgaaaactgtatttgtttaattcaatccaacgtttaaaaattaatgaaattttcggaatttgatggaccgattgccttatttttttttttgtacttttcagcaaaattccaaaaatttgtgtctttttaaaaaaatcattggaaccaccgttttttttgacagccataccccatcaaataaaaattcaatatcgaagcgagtttacaataatttcttcatgtacgatttccacccccaattttcagtccgttccatcgcatttgtctccatttgcccgtggccaattacccggcccaattggcggacgaagcggcacgactcacccaactgttggccaaactgatggcacagaatgggcgagtcatgcaaatgaaacgcatcagcaaaaggggcacaacaacaacaaccaacaggtgggtaagggtaggggtttccaagtccattgccccgaggggatggcattttttaactcctccaaaatttgtttgaaaattggggctaattttttattaaattttttaaagctttgacgtaatttccttgtaaattttttgaaaatttggctttattcaatagcaaaatccgttaaataagcataaatttttcggatgtgccccgattatttcgacattcgaaattttacacaaaattttgcctaaaaaattggcaaaaattatttattttaattttttaagaataccatccgttgaaaatcgctacgaaattccatggattcggtcattttccttttaa

SEQ ID NO: 46030 - DNA, 2680 bp, Heterodera glycines
  Genomic contig location: Contig_ID=SeqID_5366; Location=469..3148; Strand=+
  SCN-specific regions: Sequence locations=1-351,385-389,411-466,488 -655,689-721,838-1094,1132-1724,1879-2223,2246-2281,2304-2680
  Gene Ontology: Mol. function=glucose transporter activity; Cellular component=membrane; Biological process=glucose transport
atggagaagtctcggctgctttatgttgtgctgtttcacaccgttttcgcatcttttggcgaaattgaagctaatttgctcaattacttaactgtgccggtgcgacagttttttgccgactcacttttgcaacggtacggtattgtcccgtacagtagccagtttgagtttgtctactccatggtggccagcattttcttcatcggtgctatttttggcggcgcaattatgggcccatgcatggagcactttggacgcagagcaaccgcagtttacctacggtaatatgaggcatcacccaaagcctataaaatactgtaagccacaaaactctattgaaccaaataaccgaataccaaaaccaataaaaaatatattattaagctttcaataatttaaaaatgaattatagctcatttttgggcgctctttctgccatttgtatgctgttgtccaaatggcttacaattgttgagctgtttgccattggtcattttattgccgggataattgcggcatggaaaattgccatgatcatctacttggctgagtgtgctccggaccattcgcggggtatttatttagtgaaaatttatcaaagaattttttgaaatattaggataattaatgaaaaattatttaactttaccttggcaatttaaattatatttaattttaaattaattttggttttttattttgcagaataaagtatgcaaaatatttttaatattatatattttttcaatttaatttttcaacattatttctatttagtttttttcattttatttttgaagttttttatgcgtttttttgctgttattttaacttttacatattctgcaggttggtcgacaagcctcattggctctggctcaacattggcacttttgttcatggcttcgctgtgtttgccttccgtctttggcactgcccaactgtggtggcttttgccggcatttgcattgcttttgtccacctttcatttgtgcttcgctgcacattttcctgaatcgccaaagcatttgttctgcggtgatcgtcgaaataaaacaggcggaaattgccatgagcgtgccaaattatcaattaaggtaattaaatatgaaattattagtctaaattaattttaatgtttttctacttagttttatcacggatcggcaacagatgtttttaaagtgatgaaccaatttgagcaggaacagcagttgttggccagccgggagcactttagatggagtgatttttggaaaattcccgagctaaggtatttgggaatttaaaaaaacctttggaccagatttagcagaaaatggtaatttttaggaatttttgggattatgaaaaattgtcatttcttaaatccatcactatgtgcatcatcgacaaaaaaactttgacaactttaccaaaaagccccaaattttttgtaaattggatttcgaccccaaagtttcggaaatctcaaataagaaataggaaatgggtatttcgttaagtcccaaatatgtacgcatttgaaactctattaaaaaattcattttttctcttttttgattcagacattcattgttcatcacattgctcacctcttgggtatttgctttttcgctgagtaacctaaagagccaatatttggaatcaatgctaatgcgctatggcttgactcaaacgggtgcaatgatttcaactatggtaaaaaaggaaaaaatcaaacgaatattttttatattttactaaaatttgatttatttttattacaattatactcattaattaaaattaagatactttggcgctaaatcttattaatataattattaaaatataaccccgttaataattaaataaatcaaaattttatttaaaaaaccagtaaaaggatttatccaaaaactcccaaaatatgtgctaaaaactcaaaaagagaaaatctctgccaaaaattgcaataaaaaactcaataaattcgagattttctcaaaaaaaatctcattaattatctatttagtttgctagcacgcaaatcaaattcattccagtgcatttaggtgtaaagcttcagggaactttgaaatccaatgtcaaattaaagattttggtcacttttgccaatgatttaaatggtaaaaagcaatggaaaaaaaaatcatttttttcagaaatttccaaaatatgtgccaaaacaacccaaaaatgtttttgtgagccaaaagtcccaaaaatatgttgttttttatgtgtgctcaaaactagctataattaaaagaaaatttgagcttttcatgtaaaaaatatatattcgcaaaaaaattatataagaacacagaaatcactgattataatttaatttcaggcgatgattgcagtgacagctccatgctgttttctgtcaccggtgttgatcgaacggtggggacgccgcccactatttttgctggtcacatcgttctccgtcgctgagttggcactgatcactggtgctcagtttgccagcgaccaaacggcgtctggtggcagcgctgcgacagcggcactggcactgatcggcttcacattgggccaatccagcgccaaccttggcattttgtatatgacgccaattctggtcggcgaattgattccgcacgctgctcggtcagcaacgattcaggtgcatcttatggctgagtaa

SEQ ID NO: 46031 - DNA, 840 bp, Heterodera glycines
  Genomic contig location: Contig_ID=SeqID_27088; Location=667..1506; Strand=+
  SCN-specific regions: Sequence locations=1-255,290-840
atggcggaattgagactatccgataaatacttggagcagcggaacaaaatgttgcggaattacccactgccgaaggattgggtcgaaatttacgacccagggatgcaccgccattactattggaaccaaatgaccgacgaagtgagctaaaaacaacaaaatggggcagattttgaaagcactaccaacttttaggtcagttggctctccccaaaacacccaaaggccgtcatttcggaggcggcagcaaaatcggcaaaaggtttttgtttgtttgttttatcaagaatttttctgttagaagcatggaacatgagcaaaatcgagcgcagtgaaggcgaaagaggcgggcgaagaggggggcgagagggcgacgaaagagagggcactgagcggaggggcaaagagcggtacaaaggcaaacggacaaaggcaggcacaatctttgtgggtaaatatatgtctgacattgaatttggcaggattatgaaattgctttgccggacagtgatgaggaggagggccgaggccgagctgtggttgaactgagtgaccgcgacagactcagtaatcctccattttgtcccccatttctccatttgttccgcaatagaacgtgcaaagcggcgtggaattgacccgatggacccgtccgcttacggagacgcaccgtcgggtggctggacaaccggactgcgagaagtgagctaaaattgggacatacccattaaatggcaaaagttccctcttttctgaccctgagcgtgtgaataacctaattgcattccattttaggaccaggaagtgaagactggcgtggatgtgacggcgtctgggccg

SEQ ID NO: 46032 - DNA, 741 bp, Heterodera glycines
  Genomic contig location: Contig_ID=SeqID_634; Location=1115..1855; Strand=-
  SCN-specific regions: Sequence locations=1-48,72-700,724-741
  Gene Ontology: Mol. function=DNA binding; Cellular component =nucleosome; Biological process=nucleosome assembly
atgccccgtcatcgtgcaaagcctcgttcttttcatgccggattgaaattccccgtcggtcgtgtccatcgcaagatgaagaagggtatgttggaatacaggacaacaccatattctgattttgtttcattcacaatcgaatcatacattccctttcctgttcacatccacaggtccgtatgccaaacgtctcgcgaacggagtgccggtctacatgactgctgtgctggaacacatcacgggcgagctgctcaagaaaattggcgagatcacgcaggccgaaggcatgaagcgtctcagtgcatttcacatccgaactgcagcgcgcgatgacgacgagttgaggaaggtcagtgattgagtggcagaggttttgcggcacaaggacagacagcggcacatcaaaattattggcatttcagctgttctctggcgtctctcttgccgaggtgtgcgtgctgccggagctcgaatcggatgtggagcaatcatcggaaggaagtggcgagtccgactccgatgaagaaagtacggaagggagcgcgagcggaagtcaggagggtggcggtgctgctgctgcgcagcaatgagaggaggattgaattctcgagatcgccgtgataacattgactgccaatttaaaagaggatagattgtgtctctgtctgtgatatatacatttattgtaaatatgtccatgtctctttctgtgacattgtcttcttgctgctgaataataaa

SEQ ID NO: 46033 - DNA, 999 bp, Heterodera glycines
  Genomic contig location: Contig_ID=SeqID_5395; Location=360..1358; Strand=+
  SCN-specific regions: Sequence locations=1-314,359-543,579-751,773 -924,946-999
  Gene Ontology: Mol. function=structural constituent of ribosome; Cellular component=eukaryotic 48S initiation complex; Biological process=protein biosynthesis
atggctgatcgtgcggggttccaaagtggatttggtggtgctgctccaccgtcggcgcgtgggcgtggtgggcctcgcggtcgtggccgtggcgctgccagagggcgaggacgtggaaaggacgccgagaaggaatgggtcccggttactaagcttggccgtcttgtcaaggatcgcaaagtccttacgattgaggagatttatctccactcgcttccgattaaggtttttactttcttttctttttataaagcttatctactatttttttatcattttaggagtttgaaattatcgatcttttgctttctggactgaaggacgaggtgctgaaaattatgccagtgcaaaaacagacgcgagcaggttggtgaaattgcattgggggcatagaagacgcccaaattaaggacagcgaactcgcttcaaggcttttgttgcaattggtgaccacaacggccacgtcggactcggagttaaatgctcaaaggttttgccattcaatcattaaattaaaccttggagatgaagctttgttttcctaattcaaaatccaaataaaaatttctttgttgatcttccggaaaaatttttgctgcggttttaatactgatcaacaatcaacatcctttttggttaatctgtacactacccaatttgaataaaaaaagaaaattcgattgtttccgagccggagtacgtaattaaccaaagtggacatattattcctaattcatcgacccttgctccatttaaaaatattctaatttaggaagttgccactgcaattcgcggagcgattatcgccgctaaattagccatcattccagtgcgtcgtggctactggggcaacaaaatcggaaaaccgcatacggttccatgcaaggtttctccttcatattcagtagtattctaatctgcaatttctttttgctgaagtttaaattcattagtccaaaaaaccgctccatagggccaaatataatgcggatttaggta

SEQ ID NO: 46034 - DNA, 638 bp, Heterodera glycines
  Genomic contig location: Contig_ID=SeqID_27193; Location=217..854; Strand=-
  SCN-specific regions: Sequence locations=1-553,575-638
  Gene Ontology: Mol. function=dynein ATPase activity; Cellular component=fusome; Biological process=mitotic spindle assembly
atggttaaatgggcaagggctcaactttcctacgcaaaaatgctgaacaaaatcgaaccgttgaacaatgaattgaagcgtctggagaaagatgcggaagaaaaaacagtgaaaggcgaagaattgaagcacaaaatagaagcgctcgagaaccgaattcaggaactgaaggtaactgccaactgaattacaggtacaaaatattttcttaattgcaggatgaatacgcacaactcatcggagaagcggaacacatcaaacaggacctgcaagttgtgcaggaaaaagtcaacaggagcatccatctgttgaaatctttgcgggtggaatgcgatcgttgggaggccggcagagaacgatttgctcagcaaaatgagacattggtgggcgatgttcttctttctgccgcctttctttcttactctggctactatgatcaactgctgcgcgacacaattttcaaaaatggatgggaatatgtgattcttcacaaattatgttccgtcatgagcttgctcgcattgagtatctgtcaactgcggacgagcgcttacaatggaacaataatggaatgccgaaggacgaattatgcacggagaatgccattatgctcaggcagttcaaccgtttcccgttga

SEQ ID NO: 46035 - DNA, 1178 bp, Heterodera glycines
  Genomic contig location: Contig_ID=SeqID_640; Location=805..1982; Strand=-
  SCN-specific regions: Sequence locations=1-343,365-782,818-1178
  Gene Ontology: Mol. function=ATPase activity; Cellular component =extrinsic to plasma membrane; Biological process=synaptic vesicle priming
gctgaatcggctgctgtacggcggtctttgcctgtggggcgattgcgtctcgcgagtgttggaggagggacgccttctgatcaaagagaccgctgcgcccgacacgcgcgggttcgtccgagctttgctaacaggtaaaaggcagtcaatcaccatcaccagcatatttattaatccgtttacaaaattaattttatacaattgagggcctccaaacactggcaaatcctttttggctgcgcaaattgccaaggattcggagtttccgttcatcaaagtttgcactcccgaagagatggttggatacagtgaagcggaaaaatgtgccaaaattcggaaggtgaaatttgaggagaattttcaattttgaaaatgatttgacagattttcgaagacgcgtacaaatcgccgcttagctgtgtgatcatcgacaacgtcgaacgactgatggattactcaccaattggaccacgctattcgaacatggtgttgcaaacacttcttgtactgcttgcgaaacgaccgcctcaggcaacttcttgctccaaaatttctttatttgattttcgaaacagaatcatcgtctgcttatgttggccactacatcgaatgagcagtttttgtacgaggccgacatgctcagtgtgttcagcaaagtgatccgagttgaacagctgcacactgtcaaccacgtcatggcggtgctgggggaggccaacattttcagcgaggaggagatcagacaaattgaggacgaactccgcagcagagagtaaaaaatcaaataataaaatttagaaaagtaagggagccaaattcgaatcacctatcgagatcagggcgctgtgaaaaatcgggttttgattacaataactcgcaatttgaattatctaaaagctcgcaatttcagcaacccaaaatttacttaaaatacaaaaatctaatttacttaaataaatagaatttttgatacggctgtcccgttcgggaaaaaagattcatttaatcatatttaaagccttaattattcggcaattaacagcgatgtatcgattgggatcaagcggatgctcgaactgctggactttgtgaaacagagtgagcaaaagcaccgagtgcagctgcttctggacggaattcgtgaagcggggctgtgaaaatatttttgatttgtaaac

SEQ ID NO: 46036 - DNA, 1880 bp, Heterodera glycines; identical to SEQ ID NO: 27297
  Genomic contig location: Contig_ID=SeqID_27297; Location=1..1880; Strand=+
  SCN-specific regions: Sequence locations=1-308,330-951,992-1057,1079 -1681,1703-1711,1734-1880

SEQ ID NO: 46037 - DNA, 488 bp, Heterodera glycines
  Genomic contig location: Contig_ID=SeqID_644; Location=54..541; Strand=+
  SCN-specific regions: Sequence locations=1-488
atggccacacaattggcctcaattttggacgcgatggagcaggattatgacgagaagacactcagaaagttgcgaattcatctgaattaaatatggaaaatcaaatgatgattaagactgatccgcaaattcgacgccgacggatcgggcaaattggaatttgacgaattttgtgcgttggttttcactgtgggaaattcggtggacaaagaaacgctgcgtaacgaattgaaagaggcgttcagactgttcgacaaggaggtcattctttcattcggtctttgaccatttgtccccttcgatttgttgaccatttgtccccttcgatttgttgaccatttgtccccttcgatttgttgatcatttgtcccttttcagggcaacggatacatttccacgcagacactgaaggaacttttgcacgaaattgcgcccgacctcagcgacaacgaattggacgctgcggtagacgaaattgacgaggacgg

SEQ ID NO: 46038 - DNA, 654 bp, Heterodera glycines
  Genomic contig location: Contig_ID=SeqID_645; Location=211..864; Strand=+
  SCN-specific regions: Sequence locations=1-574,616-654
atgttcgaccgaagtcgaaatgggtatattatggccacacaattggcctcaattttggacgcgatggagcaggattatgacgagaagacactcagaaagttgcgaattcatctgaattaaatatggaaaatcaaatgatgattaagactgatccgcaaattcgacgccgacggatcgggcaaattggaatttgacgaattttgtgcattggttttcactgttggaaattcggtggacaaagaaacgctgcgtaacgaattgaaagaggcgttcagactgttcgacaaggaggtcattctttcattcggtctttgaccatttgtccccttcgattttttgaccatttgtccccttcgatttgttgaccatttgtccccttcgacttgttgaccatttgtccccttcgatttgttgatcatttgtcccttttcagggcaacggatacatttccacgcagacactgaaggaacttttgcacgaaattgcgcccgacctcagcgacaacgaattggacgctgcggtagacgaaattgacgaggacgggtcgggcaaaatcgaatttgaaggcaaagcaaaatcaaacaaatacaattacctaattaaaacccaactttaatttacagaattttgggaattgatggccggagagagcga

SEQ ID NO: 46039 - DNA, 1403 bp, Heterodera glycines; identical to SEQ ID NO: 27361
  Genomic contig location: Contig_ID=SeqID_27361; Location=1..1403; Strand=+
  SCN-specific regions: Sequence locations=1-46,86-340,362-560,582 -837,860-1158,1201-1255,1277-1403

SEQ ID NO: 46040 - DNA, 501 bp, Heterodera glycines
  Genomic contig location: Contig_ID=SeqID_5441; Location=8..508; Strand=-
  SCN-specific regions: Sequence locations=1-29,57-68,91-116,154 -264,446-501
  Gene Ontology: Biological process=N-linked glycosylation
atgccaggtagagaaaccaaatttacttaaataaaataataataataataatagtaccaggaagggtaattaaaaactttaaatttgtatctcattaaaatttttagatgaacccgattttttaaaaaatttttaatgaaaataagaattttagaaaaacaccatagaagcattgcgcacaattattttaagaacagttacaaagaaaacaaattgaagcaaacgcgaaagataatggaaaaagaggaggcagccgagttggccagagaaaaaaagagggaagaggaagaacggaggaaaaagaaatgggaagaagctgagagagcattgcgagaggaagagaagagagaggaagagcatagaaggaagcttgttgaagagagaaagcacagagaaaaagcgatgcagagagaatgggagcagcgagaaacagaacaaatgaaaaaacatcgtgaaaaaacttataaaattggaggaaaaaaaaaaaaagacaaaaaatga

SEQ ID NO: 46041 - DNA, 946 bp, Heterodera glycines
  Genomic contig location: Contig_ID=SeqID_27390; Location=573..1518; Strand=-
  SCN-specific regions: Sequence locations=1-27,49-333,355-708,753-946
atgctaacgatggtttgtcttgtggccaaaaatggcatgacaaatgaagaaaagggtaaaattaagaaaggctttttttggacgggcaattcgaagggcacacatcataattcagcatatggatgtctgtgagtttgttatgacactagctataattaaacaactattatcgcagagggcgcagaagtgggtcgccaatactcggcacaaagagatatggaagtcgaatcaaatggaagagactttacatatttaatgcaaatataatccataatctatctattttctctatccgtgtgaaaatttaaaacagaaattttcacgggcactcaaataaattaatttatctaatccatcattcatattgttacttggctttggaacctctagtggtccatcctttctcagcgtgtgcaatgactcctttcccctccccccctccgaatttgcatatttattagcaaagaaagggtcgtccggcttggattgagacagatctactggggcagattgtggtgtagaatttctcgttggatcacccgcgcacctccgccgaaaatggacagaaaagagaaatttgcgcggggaaaaatgaaaaaaaaaggaattcgaatattttaaagacattggagtgaattgggccaaaactataaataaaaaaggtaaaataattctttgtagggagtaattaaaaaaaagttcactgacaacagtaaatttgtagtttttaagatatagaaattttgaaacaatattatcgttagaattaaactgaaaaaaaatcaaattgcaatttgaaaagagatttgattttttcaggtctgatccaaatcaacaattggaagccgatcaacttcgagacaatcactgacaacccggaggaattggtcagcaatttgttccgtgaaatttccacacacatcacactgaaaatattggcaaaacg

SEQ ID NO: 46042 - DNA, 1484 bp, Heterodera glycines
  Genomic contig location: Contig_ID=SeqID_27397; Location=349..1832; Strand=-
  SCN-specific regions: Sequence locations=1-152,183-578,600-683,711 -801,855-912,936-992,1025-1060,1110-1134,1157-1241,1263-1397,1419-1484
  Gene Ontology: Mol. function=carbamoyl-phosphate synthase (glutamine -hydrolyzing) activity; Cellular component=cytosol; Biological process=arginine biosynthesis
cccaagttggggaaacctactttaaataagccgtagaccctttattgtttttaagtgatgtattacctaaccacccctaaaatccgaaatcatggaactctgtcacttgctaaaagtttacgattttttacgcttccaaatcagttgggtcgaataatttttttttgaaattttaaaaatttgtaccgaaggcttttggttcctttctattgaactccttgattttgtggtctggatccggcaatttaaaaattcccctctgtttttaggccatcaaagcgctgaaggagatgggcctgcgcaccgttttggtcaacccaaatgttgccactgtgcaaacaacgaaaggttttgcggaccgtgtctatttcttgcccatcatcaaggaatatgtgaccgaagtatcggacaggacaaatgggcccatcctttgaaatttgattgaattgtaggtgatcaaaaaggaacgtcccaccggaattttgtgcacttttggaggccaaacggcgctgaactgtgccgtcgatttgcacaacagtggcgtactgtcggaatacggtacttttacaattaattggctttacagtattcaaatatttcgtcatagtaatccccatattggcaattcattaccatatttcatattaaatgttccaaaaaaaaaaattttgggtgccaaaatctttttttttattttattaattttttttcttgaggtgtcactgttctcggcacgtcgattgagacgattatgcgcacggaggacagagaattgttcaaggcatgtccaaaagacttttgaaaaattaaaattaaaaaatataaaaccatttttaaaaattttgtttttttaaggaatttgtgctgaaaattggcgaaaaagtagccgattgtcgtgcagcgaacacaattgaggaggctgaaaaggcagctgaacaggcgaggaaccaaaaacaaattcatccccctccctcgagaaatattttcgaaagaaaaaaataaataaattttctaaaaaaattttctatttgtttgtaagcaaagaaattaaaaaccgaagaaaaattcttttaaatataaaaatttttttgaaaattcttaaaaaataacgaaattgatgggggtttaaaaatcgtataaaaaatgttaagaaaattttagtttttataataggaaaaaaatctttgaaaaaaatctaatttcctgtcattgttttttttaatcccatcccatttttttatatgtcctcattttttccaacagattggctatcccgtgttggtccgtgccgcgtacgccctcggtggacttggttccggttttgccgagacgcgtgacgaacttatggcaattgcacgccaagcacttgctcattcaaaacaagtgctgatcgacaaaagttttcaaggctggaaagaggtgagaggaggcgattgaatgattatatttttttgtcgcgaactgcgaacaatttccctaatttg

SEQ ID NO: 46043 - DNA, 821 bp, Heterodera glycines
  Genomic contig location: Contig_ID=SeqID_27404; Location=162..982; Strand=+
  SCN-specific regions: Sequence locations=1-468,490-674,696-821
  Gene Ontology: Mol. function=ATP dependent RNA helicase activity; Cellular component=nucleolus; Biological process=35S primary transcript processing
atgacgatttttgggaattatttttggaggtttttaccaaccaaattggtccatcatggtatcattcgaaagctcctggtgaggagaagctttttctaagcggatgctaaccattttgaagcattagaaaaaagttatgggcgtttgaaattttgttttttgaataacttttctaatcgacccattttcaaattaatctgacctatcattagatgcagaaaatttttctctatcgatatataaaatttggttggatttaacaagtagaaaaaattttaaacaggatgaagcaaattcggtttttctctattaatagagatgaagaaatagtatgccaaaaagagagatatctttttctctgcactctctatttattggtacacatctcgctttttcggacggtgtgggaggaatcatatcattcttaaaaaatcaaaattcccaggtccgtgtgctgatcgcttgtgatgtcctttcacggggcatcgatgttttggacgtcgattgcgtgatcaattacgacctgccgataaacgaacgcattttcgttcaccgagctggtcgtactgccagagcaatgaaagaaggactactcgtttcactgacaacaaaagaagaagtgtgctaagtgactacattttcacattttactttcccacatttttttccctttagaaaatgaaacttaaaaagttgctgtctccgcacaacctttgggagagcattcaagaaacaaagtccaatgactcggactttaacgaagaatgcatgcaattatatgaaaacgcgctaagaaagttgaaaaaacgatttgaacaaaa

SEQ ID NO: 46044 - DNA, 803 bp, Heterodera glycines
  Genomic contig location: Contig_ID=SeqID_27421; Location=54..856; Strand=-
  SCN-specific regions: Sequence locations=1-329,353-424,446-607,629 -637,667-672,694-803
  Gene Ontology: Mol. function=cleavage/polyadenylation specificity factor activity; Cellular component=mRNA cleavage and polyadenylation specificity factor complex; Biological process=mRNA polyadenylation
atggcactgacaaccatttcgctgcattccattgaggacgaatttttgcgcgacggttacaccgatgagaacattcatcagcccgaacttcgtgccgaccctgaacatcggtgttgtgcatttacgggtgcttaaattattgtgtttttcaaaactgaaatgtctagaggcttttaggggacgacggtttaataaatgtgtcaacattcgaacaaattcgaattcaattatgaaatactaatcttttcatcgtttttttaatccgtattgactgacaaattccaaaattctggcttttcacattatttgaatacatgggttctttacgaatataaaattttcaatccaagattcgtccgaaccttgatttccaaggtttattttgctaaaatttcaaatatcatcattttccaaattttttggggtgttcgtttttggtgttttgtcaacccccagtctcatctctataaatttcatggactaattggacatgattggatacgttttttcgtatactcctaacttacatctccctgttcagtgtatggacgtcatttggctgttgtgccgtttaacatcgtcgaattggtgcgccaacaaccgtctgcagtcagcagcagggaggaggccaagctgtacaaccagcagcaacaacagcaacaaatgttgttgcaaagttacaccatcaaaatgcgtttgttggacgaacggttggacaatgtgctggacatgtgctttttgcatggttattatgaaccaacattgttgttcctctacgagcccatccaaacaaccgcgggacg

SEQ ID NO: 46045 - DNA, 2560 bp, Heterodera glycines
  Genomic contig location: Contig_ID=SeqID_5455; Location=2571..5130; Strand=+
  SCN-specific regions: Sequence locations=1-495,517-608,631-1556,1578 -1794,1816-1863,1897-2395,2417-2521,2543-2560
atgggacgggggagcagtgcccggcggactattggtgccatgtcggagcgaacgcggagaccaccgtttgctgcagcggaggtgggaaaagctcgaaagcacgagaaaacaatggttgttcatttgtgcagccactcgcgtgtgcgcacttccgctggccgaaggcgtcggccacgctttgctgtcgcggtggtatttcagcgccaaagacggaaattgccaccgctttatttacaagggcatcggtggcaatcaggtgatggtgattagaagggggacgacacaatttggcatttgataaatcccttacggggataactgatagcttaaccctccatgcgcataatattctacccctctgtagaacaactacgtggactacgagcagtgcatgaacgcgtgtcccgatggcactttgtcttccgtctcttaccctcccccctcaacgtcccctcttccatcgccgcgtccttcgtcgtcccttcagccttcgtctcttctctcactctctccgtctccccctccgccgtcggtcaatccctgcggcattggcactccgttaacagacagcgaaggacaaaagccgcgcgaatgttctcctaatagccgttgtcccatttcacacttttgccatatcggtggcgaccctttggcattgccaaatgtttgctgtccgaaaagtgaggcccaaaaatactaaataattaaagtgatcagcagaccaaaatttgggtgggaaattgatagatttcaaaaataatccgttcacaaatcattgtttgggcgacgagctcaagacttactgatgatattatgatatccatgttttaaataatcagcagatggcgacccgtgtgaacagcctttggctgaaggcattggccaattcaaattgacgcgtttccatttcgacgcttcttcgaggcgatgccgcgctttcgtttaccgtggcctccggggaaatgccaacaattttctgttagcggaagactgtgaattggtgtgccaagctgagccaagtgggtgtatgccattgctatatattttcacaaaatgccaatgcttttcagcgatgccgtcgttccgtgtgaatccgtgcccacggggaattccgttgacggacgaccaaaatgagccattagtttgcggcaacagtttggccgcgccggacctcgcacagtttggtcccctgacagccgcgcatcagaatcaattggagacggggtgcccaaggtggaggagggatcagatttgagaccgatggtcccgagggaagcgggtttatggcataattggtggacttttgccgatgggaacctaatcacggccaattaacagtgactaattgctttttgagtggtttctggtgccatgttggctcttctccggacacgaccaactgctgccctcagcttgcggatggtaataattaaggcgacgtcttaccatttttttcattcgtgtcattttccccgaaaggtggcaaaagaccgtgcgatcttccgttggaatacggtataccgatggaaatgggttacggtggccaatcacttctcaaattctttccttttgccttaggcactggcgaacagaaattggacaggtggtacttcgacgtcgattcgcaaatgtgtcggcatttccgctactccggtgggtttttcgcttttttggtcatttccttcatttttctttcaccaaaggaatcaaaggcaatgcgaataatttcgtgtcgcgcgaccattgccagcagaagtgcccttccgacccggtcaatttcggcactgacagcgaccatcagcagcagcagagacagcgcacttcgccgccgccctttgcggtcggtcgctcgcggttttcgtcctcctctcctctcccctccttctcctcctttccatcaacctcaagtccgactccaacaacaaactcattgtcagcagttgtgccacttcttccaaatccgtgcctttttggcgatttgttgcgggacgaagacggaaatgtgctaaaatgtaagcaaaacgaagacaagggatgtccagaggacactcacttttgccacgtcggccaccgcctcactcaaagcggctgctgtccccggacaacgacaacaacaggtgaaacaatgtgcaaaacggcacacattaaatgctctttcgtctataattttggtcagacccgtgtttgttgcccgtcagtcgcggcattggcacagtcgcgcacattcggtggcatttcaacgccaacacaaaacactgtgaggcgtttgactacgcgggacaaaagggcaacgagaacaattttatgacgaaaagacaatgcgaggaacaatgcgaccagcagaaaaagccgcagaaaaagaaaagtggggaaattaaatggaaaaaacactcaatgtttttctttagttaatttttgcccgcacggagagccgaaatgggagagaaaggcatggggacatgggcagaaaaagccgcaaaagtgtgggccaaacaacgaatgccccgagggattcgtgtgccatttgaacagtgacattggcatggcattgtgttgtgag

SEQ ID NO: 46046 - DNA, 1464 bp, Heterodera glycines
  misc_feature (70)..(70): n is a, c, g, or t
  misc_feature (79)..(79): n is a, c, g, or t
  misc_feature (108)..(108): n is a, c, g, or t
  Genomic contig location: Contig_ID=SeqID_5456; Location=1..1464; Strand=+
  SCN-specific regions: Sequence locations=1-219,241-457,479-1013,1051 -1057,1079-1183,1205-1464
  Gene Ontology: Mol. function=extracellular matrix structural constituent; Cellular component=extracellular matrix
acagtgactattgcttttgagtgtttctggtgccatgtggctcttctccggacacgaccaactgctgccntcagctgcnggatggtaataattaaggcgacgtcttanccatttttttcattcgtgtcattttccccgaaaggtggcaaaagaccgtgcgatcttccgttggaatacggtataccgatggaaatgggttacggtggccaatcacttctcaaattctttccttttgccttaggcactggcgaacagaaattggacaggtggtacttcgacgtcgattcgcaaatgtgtcggcatttccgctactccggtgggtttttcgcttttttggtcatttcctttatttttctttcatcaaaggaatcaaaggcaatgcgaataatttcgtgtcgcgcgaccattgccagcagaagtgcccttccgacccggtcaatttcggcactgacagcgaccatcagcagcagcagagacagcgcacttcgccgccgccctttgcggtcggtcgctcgcggttttcgtcctcctctcctctcccctccttctcctttccatcaacctcaagtccgactccaacaacaacaaactcattgtcagcagttgtgccacttcttccaaatccgtgcctttttggcgatttgttgcgggacgaagacggaaatgtgctaaaatgtgagcaaaacgaagacaagggatgtccagaggacactcacttttgccacgtcggccaccgcctcactcagagcggctgctgtccccggacaacgacaacaacaggtgaaacaatgtgcaaaacggcacacattaaatgctctttcgtctataattttggtcagacccgtgtttgttgcccgtcagtcgcggcattggcacagtcgcgcacattcggtggcatttcaatgccaacacaaaacactgtgaggcgtttgactacgcgggacaaaagggcaacgagaacaattttatgacgaaaagacaatgcgaggaacaatgcgaccaacagaaaaagccgcagaaaaagaaaagtggggaaattaaatggaaaaacactcaatgtttttctttagttaatttttgcccgcacggagagccgaaatgggagagaaaagcatggggacatgggcggaaaaagccgcaaaagtgtgggccaaacaacgaatgccccgagggattcgtgtgccatttgaacagtgacattggcatggcattgtgttgtgaggtgattttgatgatggagaatgcgtcggcacatcctcttttcagaacccggcacatttttgtctgcagtcgcgcgagcgcggcccctgcggcgcgagggaattgcgctacgggtacaatccgctgacggacacatgcgtacagtttcactacggcggctgcggggggacgctgaacaatttcgaaagcatcgatcggtgcagggaaatttgttgtcggcaataccaaagaaggaattgaaag

SEQ ID NO: 46047 - DNA, 1288 bp, Heterodera glycines
  Genomic contig location: Contig_ID=SeqID_27440; Location=1..1288; Strand=-
  SCN-specific regions: Sequence locations=1-226,248-378,413-892,914 -929,951-985,1007-1147,1188-1288
  Gene Ontology: Mol. function=positive transcription elongation factor activity; Cellular component=chromatin; Biological process =histogenesis and organogenesis
cattgccaatttccacagataaacgccacgacacagtgattgtgcccatttttggcattccgacgccctttcacatttcgatgatcaaaaacatcagtcagccgaccaatgagggcgacttcacctatttgcgtatcaatttcacccaccccggctcccaaattggcaaagagagcgcacagtttcccaacgcattcgccaaatatttgaaggaactgtacgtggttttgtgtgtgtgttcttcagtttaattgtctgtccaatttcagcactttcaaaagtcgcaatgtgcgcgagccgggcgaacgcgagacgcccagcgtaaatttgcagacggccgctcgactgatcaaggagatgcaaaagcgattccgcacccaggaagcggaggagcgggagaaggagggcgcggtcaaacaggacaaactgatcatttcaaccaacggcaagggaaacccgaagctaaaggtgtgacatccgggaacggggggatttgagaaatgattgttgaaatgcacatccaagactttgttcaggatttgtacgtgcgaccgaacatcatcgcaaaacgcatcagtggcacgcttgaggcacatgtcaacggtttccgttacacgtcgttgcgcggcgacaaaattgaggtgatgtacaacaacatcaagcacgccttcttccagccgtgtgacaacgaaatgatcattctgttgcacttccatttgaaggtctttctttttgatttttgatcaattcgattggtcacacagaatccggtgctgtggggcaaaaagaaatattcggatgtgcaattcttcactgaagttggcgagatcaccaccgacttgggcaagtaccatcacatgcaagacagggacgacattcagagcgagcaggcaatttaatttaatatttaattgcaaaatcttacgttttgaatttaatttttaataaatgcttaagatggaacgcgaaatgcgcaagaagctgaacatggccttccagaacttctgtgacaaagtgtttcggatgaccaatgagcaggtggactttgacacgccgttcaatgacttgtcgttcatcggtgccccccatcggtccaccgtttctctgaaaccgacctcgtcatgtttggtgcacctcacagaatgggttcattttctgaatattgagaacagaatttggcattttcatttccgttttagcctccatttgttgtcacacttgacgaagtggagttggtgcattttgagcgtgtgtccagcaacaccagcacattcgacacggtcatcgt

SEQ ID NO: 46048 - DNA, 1072 bp, Heterodera glycines
  misc_feature (1005)..(1005): n is a, c, g, or t
  Genomic contig location: Contig_ID=SeqID_27455; Location=138..1209; Strand=+
  SCN-specific regions: Sequence locations=1-9,38-294,316-800,823-1072
  Gene Ontology: Mol. function=ATPase activity; Cellular component =nuclear condensin complex; Biological process=mitotic chromosome condensation
atggaaattgacgaagaggacgacgatgaggagggagagagagaaacgaacaaccaattggacaatggccaaagagcgacgaaatcgaccgctaaagtcgttgctaacccggacaacctcaacaaactctttatgccgttgcccaaacttaacgaacagcttttacgtgatgaagttgacgtggaccaattggaacatcaattgacggagttggaaaagcggaagcggaaacaatctgttgccaacctgacattggtgctcgacttcttcgctaaggttgacggactgacacgtaaatgtgtaagactcattttagttgaaaaaataccaaactgagttcaaagaactcgccgccatcactgagcaacgcgatttacaccgggcctttcatgatcggctgaagaagcaacgcttgcacgaatttatggaaggattccgagagattgcgacagaattgcggatcacttatcagatgatcaccatccaaggagatgtatcacttggtaacgttcctccttttatttatttttttactgtttttcatccagaattggttgattcgcttgatccattcgccgaaggcattgccttcaatgttcgtccccccaaaaagtcatggaagcagatcaccaacctttcgggtggtgagaagaccctcgcctctctttcactggtgttcggtttgcacaagtataaaccgactccattatacgtaatggacgaaattgacgcggctttggacttccgaaacgtttccatcatcgccaattatcttctggtaaatcttcccactgtagcacattttttaaaattaaatttaatccgccgtcatttattaaggagcgtactcggaatgcccagtttattgtgatttcattgcgcaatcaaatgtacgaaaaggccaaccgactgatcggcatttacaaagtgcgtgactgcactaagaatgtggtcgtcaatccgtctgccatgagcaaggcttttgaacaggacaagaaacggaanagcaacccttaaccgataaaccattttccgatctcacttatttaactctttggttctctctttgcaa

SEQ ID NO: 46049 - DNA, 947 bp, Heterodera glycines
  Genomic contig location: Contig_ID=SeqID_27468; Location=423..1369; Strand=+
  SCN-specific regions: Sequence locations=1-12,42-126,162-947
  Gene Ontology: Mol. function=protein binding; Cellular component=cell wall (sensu Fungi)
gggttacacatttccccttctcctctttcctctctgttgttatcacaacacaattccaattcgtcaacagcttcttcactcatcgacgagatgacttcttcaagatcggtgatcccttccacccccttttttcatccgctttttccttccctcctccccccattcagcgaacgcgtcgtgcaacttccaatactgcttcaactactgctactgctggccgtagacgcagccgttcaagacgccgtacacgtgcagaacaagtacgagaagcgactcgccgcgcgttacgtcagaacaacggcggcaacgcgaccaggacgaggaagaagcgcggggcagcgatgcgtcgtccgcccaagctcaaaccgctccgtggaaggccgaggggatcgcgcaaatcgagggcggcgccgcgcactgctggacaaaagcgtggccgtggacgtccgaggaccgtgaaaaaaggccgtgcccgacgggggaggagcgctgcccagcggcagacgacgacgactgcggatgcagccaccaacacggacgcgcactgggtaactattgcggagttgagggcggcgaccaacactgaggtgaccgctgcgactactccggcaacaatgacgacgaccgcggatggcgctgtggcgactaacactgacgcaaccggagcgacgactgcgacaacggacgcggcgaccgctgcgactactccagcggcaacaacgaccgcggatggagcgacggtgaccaacgccaacgaacccggtgcgactacggcgaccaacactgaggcgcccgctgcgactactccagcgacaacgacgaacgcggatggagcgacggtgaccaacgccaacgaacccggtgcgactacgacggctgcggcgaccaacactgagacgaccgctgcgactgctccagcgacaacgacggcgaccgcggatgggacg

SEQ ID NO: 46050 - DNA, 1055 bp, Heterodera glycines
  Genomic contig location: Contig_ID=SeqID_27479; Location=903..1957; Strand=-
  SCN-specific regions: Sequence locations=1-310,335-610,632-812,834 -850,872-1055
  Gene Ontology: Mol. function=RNA binding; Cellular component=nucleus; Biological process=mRNA cleavage
tttcgggcagcaacgattttacgctgaaaatgttcgattattcaaaaactgcggttaaaagggcaatgaaaacgatcacggtaagtcatattctgaaagaattttacaatgaaatgtttggaaggaggtcgagccgatcactgcggtcagttttcatccgagcggagagttttttctatgcgcaactcggcatccgaccttgcgtctttatagtgccgaaacacaggtaccatccatatttttagattttaatttgtttaaaatcgctttcaatatgttcttccgtttttaaatagcatagaaaacattttttacatgattctgaaaacttcatcgaatctgtttctttagcaatgctttgtttctacaataccgaaggaccaacattctgattccattacggatgtgtgctattcggaaaatgcgcgaatgtttgtcacgggaagtcgtgatgggaatgtaaaaggtcgattattagacataggtcatatatggaaagaggggcgagggagtcgactcattaaaaccattcttcgccgataaaaggtcccaaaaatggaggtttttagaattaggttttcagcccttgtccttctccctcacggcccccttcttttttgtcctttatttcacttttttttttagtttgggacggagtttccaatcgatgcattgagacttttacccgcgcgcatgacggagccccgatttgcagtgctcagttcactcgtaatggaaaggtattgcttcattatgcataaattttcccagttaattactaaagtgtcattgctgttaattggggtcggtcttacgattacatgactttttccgtccgtacattttcgactagtttcttaaggtccattttcgtcatgtgataaaatatcaaatgtatgaaaattaattcggatggtaccggacctgtgtggtaatcttggcttttagcgattgggaattccgattaattgccctgtttcattcgtttcagtacgttctcacagtaggaatggacagtgtgcccaaattatgggaattgtccaccaatcgctgtg

SEQ ID NO: 46051 - DNA, 1135 bp, Heterodera glycines
  Genomic contig location: Contig_ID=SeqID_5486; Location=1009..2143; Strand=+
  SCN-specific regions: Sequence locations=1-281,303-1031,1053-1135
  Gene Ontology: Mol. function=translation elongation factor activity; Cellular component=eukaryotic translation elongation factor 1 complex; Biological process=translational elongation
atgcttttaagttggccaaagaaggctggacagccgccgcagaaagtcgtttcgaaagacagtgcaccaccggcaaagaaagccgacgccgaggtatgaaatttgcccattttccaaacaatggcatttctttaatcggttttataccaaatagtggttcgatgaacacgaaaattggaaatcgcaccggtttcacccatcctgattaaaacaatccaaaattcgaatacatttcgagtaaatgaaaatactcggagaaggctcatattttcaaaatatgcacacacaattgaatacattttgttacatgttcattaattaaatcgcaatgaaagagttccccaattctcaaaatcgaattaattttggcagttttgcattgaaatgccgaaaaagtgttggtgccatgtcatgccaaaacgctgcattttaggaagacttcgacctgttcggcgacgaggacagcgatgatgaggagaagaagcgcatcaccgaggaacgtctgaaggcgtacgcggagaaaaaggcgaagaagccgggcccggtggccaagtcgaacgtcatctacgacgtgaagccatgggacgacaccattgacatcaaggacattgaggccaatgtgcgctccatcgaatgcgaagggctcgtgtggggcacgtcccgaattttgccggtcgcattcggcgtgcagaagttgcaggtatatatatggcctgcccgcccgtttaactatgtgtagttgtacaagaattgctaattttcggttttggagtgcaaatattccccccccccccgaaaaataaaattttaacggttttttttaatttttagggagtcggggtaattgtacaacctcctcccattttgattggttaacagaaatcagacacttttaacatggagggtgtgtttaagtttgttcaatgtaattgtgcaactgcagaatttgtccatccataaatgtatgcctagaatttatttattttttgtctgagccacgggtgtatcggaagtggctcagttaaacggagtaattaattttcttcccatttcttagattggatgctgtgtcgtggacgagaaggtgtcgacggattggctcgaggaacaaatcacaggcaaacattataactaa

SEQ ID NO: 46052 - DNA, 575 bp, Heterodera glycines
  Genomic contig location: Contig_ID=SeqID_27545; Location=1..575; Strand=+
  SCN-specific regions: Sequence locations=1-575
  Gene Ontology: Mol. function=protein binding; Cellular component =transcription factor complex; Biological process=signal transduction
ctctctgttttcagatcgccgatttcggactgtctcggaactacggtctgcatgccaccttcaccaccgaggtggtcaccctgtggtaccgtagccctgagctgctgctccagtgcaagtacggtactgcggtcgatctttggtccgccggttgcattttggcggagctgtacacgcgcgacgcgctcttcagaggggatacggaggcggagcaattgcgcatcatttttgagtgagtttttcaaaaaatgctgccgcaaaaaatgttttttttttcaattttattgccctgtcgagtagaatatttcttcccccccctcagaaaactcggcactccgtccgtctctgtttggcccgccgatgcaattgtccctcattctttctacgccgaaaactctccgcacataacacctccgtttgccaatcagatgccccaatatttgcccgcctccggtgttgagttgctcacggcaattttgcaatttaatccgcacgaacggccgactgcggttgaatgtctgcagcacaaatactttgtctgatcactgatcgcgggaaatgttcatttccgcttt

SEQ ID NO: 46053 - DNA, 1071 bp, Heterodera glycines
  Genomic contig location: Contig_ID=SeqID_5497; Location=236..1306; Strand=-
  SCN-specific regions: Sequence locations=1-90,113-292,315-535,560 -562,585-728,750-854,876-878,900-1071
atgggcgtcaaagttgccatcaccggtggcagtggctttctcgccgctcatctcatcaaacgcctgagggcagacgcaaatgtggacgaaatcagaaccatcgacagaaagccgttcagacagctcggaacaattggtgggtaatttggcaggatgtaaggacagggacggcccttttaatgtcgtttttaccttcccccctcctaatttcagtttgttcttcttcagatgattgccctccttcctccgtcggttttccctcactcattcatttccaatgcgatttgctggatattgccaaacttgaaaaggcattggatggtgtcgacgtgttattccatttggccagaaaggctttcgaatatattttcttcgctgatcaaaaagcactgaatgatcgctacagcagagacaatttggaaggttttcgattgaattggcacactttgccattttaataatacttaagccactcattcgcttctcaacaccattttcaaatgctccgttccgcgattggtccatgtcggaggtgaataaaataaacaaaataaaaatagtggacctaacgtaaataatcatttgcaaaatgaaaaacggaactcaaatcgaattttgccaaatttgtctatgtccgtccattggcactttcttcctaattaattccaaattccttcctcctttttcacattttttctctccctttccgatgcctttgccaacattcccccgggcgacaactttggaagcgctgagcacatccatcgcggattgccctccaaatttttgcttggccattacggagagacgcggataaaggccgaattggccgggcgagaaaaatgcgggaaaatccttccaaacggtgcgaagtgaaaataaatatggcaaattattaattatgacaaattgccaatttgttaaggacagcccttccacgcacttttcctccgtccgacttttgtgtacggcgaaggggagaagagattgccaatggcacttaaaaaagttgcggaacggcacggacagatcaacgaaattgccgggccatcaaatggaatgttgcaatat

SEQ ID NO: 46054 - DNA, 1517 bp, Heterodera glycines
  misc_feature (11)..(12): n is a, c, g, or t
  misc_feature (29)..(30): n is a, c, g, or t
  Genomic contig location: Contig_ID=SeqID_27552; Location=421..1937; Strand=-
  SCN-specific regions: Sequence locations=1-116,138-537,561-1147,1170 -1272,1294-1329,1351-1470,1492-1517
  Gene Ontology: Mol. function=ATP binding; Cellular component =extracellular space; Biological process=proteolysis and peptidolysis
tgcaggtcacnntttcccacgcgcggacnntcgtcgatcggtcggacacaacgccaaactctcacaggataaagacgtaattcgaatgaacgaattccctttcgcttcagtttcactttcccctttcttctcagattgcttatgtggaacaaatgactggtcagtattattgacaaattcaaacaaaaagccaacaaaatccgaataaaattcgaaggttataagcgcttaaaacgcggctaccgtccgctggctgaccgtcttcaaaaacagctcgacttcacttcaggtgggcggggaaggacgccatgttaagggtgggcacttctcccatttcagttcaatcgcccaccgaccctttgtaccctttccaatggtatttggtcagtcatttgcccttcgctttgcccccccccctccactgatcagtcacatttcagaagaacgacggccaatcaaatgggaaaccgcggcttgatctgaacgtggagaaggcgtgggctctcggatacaccggcaaaaacattacaacggcgataatggacgatggggtgggaaaaggatgagcgaatgttggggaagggtttatgtccatcaactgatcgaatgtgttgatcacttctgctgaaggtcgattacatgcatgccgatctccgcttcaacttcaatgccgaggcgagttacgacttcagctccaacgacccttacccgtacccgcggtacaccgacgattggttggtggaggggggggggggtggagggcatccgacggattgtgccattcgtcgcaggttcaactctcacggcacgcgctgtgcgggagagatttcagctgctcgcgacaacggaatttgcggggtcggcgttgcctatgacagcaaagtggcagggatacgaatgcttgaccagccgtacatgaccgatctgatcgaagtcagatcgaatggggagcaaacgtacctaggctttccctttgaaggccaattcgatgggccacgagccgaacaaaattcacatttactcagcgagttggggaccaacagacgacgggtgaagagacagagagacggggacactgaaaaatggcatttcaggaaaacggtggacggcccaagaaacgcgacaatgcgagccattgtaaagggagtgaatgaggtggggtgggaagataagaaggggataatgataagggataaggggagataaagtggaaatgtcaagagagacaaaagataatgaggacacaattagtaaaagtgaatcccgttttgctactctatacatatatgtatttgctattgtgcctttccaaagggtcgtttcggtctcggctccatttttgtttgggccagtggcgacggtggcgaggacgacgactgcaattgcgatggatacgcagcatcaatgtgagaaggccggagactcatccttgatcaatttccgcatatatcaattcttttaggtgggccatttcaatcttttctgcctttcacctcggcgaaaatgcccattatttc

SEQ ID NO: 46055 - DNA, 1102 bp, Heterodera glycines
  misc_feature (18)..(18): n is a, c, g, or t
  Genomic contig location: Contig_ID=SeqID_27568; Location=153..1254; Strand=+
  SCN-specific regions: Sequence locations=1-528,551-797,819-828,852 -857,879-1102
ccgcccgattggctgagngtggacgagttgaaacggatgattgttgcggaggcggaacagagagcatttgcgcccattccggagtgctttttcgagctgtccaacctgttgatgctcaacgcgcgggaggatgtcgagcagtatgagcaggttttttttaagtgtccgctttttcaatgaaataggttaaaaatgccaataaacatttagggtataattgccaccgtggcgtagtggtgtacaaccccatctctctgtcggcagttcaaataccattggagggcgccaaaaactagaaacaaaacaaaaaaacattttctctaacagaagagactccattcactagtcagcagacactgtgtgttaaaaggtgtcgctcacgccgagtggccccttttatgcatttgtgcaatgtttgtgttacgtggatggaaaagcgaaccccgcgaaagggggacgaaacgcgagagtttgtgccggacacaaaattaaatgtttggtgcattagtgctgtctcgaacaatccgtaaaaaactttttgtttgaaaaattcatcgtattcctctacccctcctacagaaattttcaaacccatccaatcgaatttttttgtatgcattttccccaagggtttaatggagacataaaataggacactttgaatccgaacttaaacatttttcgttgccaaatttacattttcaaacaaatttgaattaattttttccattttagttgaaaacacttgtcaaggacttgtgggacaaacgggaggccaaaatgcgcacgtcaaccatcaaatttcttggccaggcaagtcttgtgaaaaaatttctaaaattgcttttaaattccaagtttttgccccaatttttggggttggacattttaaagggggtcgaatttggtgcaatttgtggggccgtttcttaccatgtaaatcatggacatgaataaacggggcatttttcagtacgaaattggacatgcccaactggacaatttgacgcgcatggaaatttgttgtgcccgtgccacgctcatcgagggcagcaaacagcttgaccggctgaccgccacgctgcattccgtccgggactga

SEQ ID NO: 46056 - DNA, 2371 bp, Heterodera glycines
  Genomic contig location: Contig_ID=SeqID_5502; Location=1671..4041; Strand=+
  SCN-specific regions: Sequence locations=1-443,465-507,529-736,760 -864,906-1620,1643-1949,1972-2371
  Gene Ontology: Mol. function=endopeptidase activity; Cellular component=26S proteasome; Biological process=proteolysis and peptidolysis
atgacctcgcaaggagttgaaaattatttaaaggaccaaacgatctctgacattccgacgatcgcggaaggctttcaaaacttgatgaatctttacatcaacaagtaagcaaaagttaggtgcaagtttatgcgtccaataatgactagagctgggaatttaagtcaaatgacttttttttttgctgactctaaatggccttaaaatgacttaaaaagtgtttctaaactttttttttgaagcttctaacatgcattttttgtgactttttttgacttttttaaactttgggatttttatgactttcgagtttttgcgacttttttcgtgatttttttgaagcaaaatttgaattttagcgaagaaaattccgaaaaataaaatttcgatcgataaaaaggcaatgaaacctggatgaattttttcttaattgttggaagaatcttttttatgcctattttaggacctatttataaaattaagtgcctaaaaatacgatcaaaatggtattttataaattattaaaatggaatttttttaacgttggcctaatttttcaggacttttttgcatttttacgtgtttttttggatttttttgtgctttttggctattttttctggacttttttttatgacttttttagtcgactttttgaagatttttaatgacttaaattcccagccctaataatgacatcctcagtttcttagactataactttttattacatctctaaatattttgtttattttaatgcttttccaggctttggaaccaactctccgccgaggccagtcagctcgtacgtaacaaattgtttgtgtcgacagtgaatcttttccaattttacgaggttaatgcatttatttttgaaaaatataaaataaaaaaatgaaaattttgctcgttgacaattgaacgttttctttccattttaaggaatttgtcagagacttcgagcggcgcattgagccattgcaattaattgagctgattacgccaattgccgaggacatttttgaaaggggtgagcgacaatgatatttccataaaaaattaacaatttgcagacagacaatcggcctacacttttctggacaacttcgataaagtgatcaagcaggacaaaagggccatcgttcggctggaggccagcaaaattcagctccgtctcagagacaaaccgacggccgaggcgaaatgttgcaatgacccggcattggttcgggtaaaatattagcgaatgttcccgaaatgacaactaattattgtggtagaaaatgttggaagaagcgaagacaatggtcgaccaactcgtcgaagtcggctcggtccacgccgcttactacggatgttcggcggagtaccaattccaaatgggcgaccacgaccgttactatgaagaggttggagttttgttcatttttaattgaaaatgcttcaaaaacccattaggcccttcattatctcggctgtgaagacattaacgtgaaattgagcacggaacagaagcgacaacaagccgagaaaatcagcatttcggcactccttggcgaaaacgtgtacaactttggcgagctggtcagttgttcataaactaatccgttttgccattccctctgcttcatttgtaaaattcgggttttttttattgaaataatttttaatggatagaaaatgatttaaaaacggaggagtagcaaaattatgcaaattattacaattttatgctaactaattcctcagtgatttttcttttttgagttggcccatccaattttgaacgatttgtccgacacgccaaacgcttggcttaacgaacttttgcacgcggtgaacgccggcgattgggacggttttttgaaggtttgtcaatggaatagcaaagcccagctattttctactattttcttttaagcacaaagagaaattggtcgccgcttattcggaggcagggcaaaaaattgaggcattggaacggaaattgcgcctccaatgtttgatcgaggtaagtgttgttttgggagattgtcgaatattgtatttattattcatttctgccaaattaaaattgcctcaattttcagttggcgcaccgattgccggcccaacgacgtgacctcaatttcggggacattgctcgtgttgtccgagcggatgaggacgcggtggaactgttggtcatgaaggcggttgccaacaaactcatcgatgccaaaattgacgatccttcgcgcgtggtcaacgtcagctgggtgcagccgcgggtgctttccattgaacaggtgaaaaacgatgctgggaatgaagtcaaaggggtggaataggcttttcctcactttagggacaattaaaatttcgtataata

SEQ ID NO: 46057 - DNA, 3225 bp, Heterodera glycines
  Genomic contig location: Contig_ID=SeqID_5515; Location=296..3520; Strand=+
  SCN-specific regions: Sequence locations=1-163,185-239,264-319,342 -411,434-435,483-538,568-619,658-1088,1122-1296,1325-1333,1355 -1522,1544-1794,1835-1978,2006-2371,2403-2458,2500-2633,2747 -2861,2892-2983,3014-3098,3137-3225
  Gene Ontology: Mol. function=structural molecule activity; Cellular component=collagen type IV; Biological process=negative regulation of cell proliferation
gccaacctggcctccctggcaccaaaggagagcttggcatgcccggcttcccgggcacaaagggtgaaccaggagtgcctggacgagacggatttcctggcatggatggtgaaaagggcgatgccggatatccgggacagccgggccaatacggacctcaaggcctacctgggccaaaaggcaatgctggactgccaggaatccctggattatcaggtgaatgcatttgttgactattgtccattttgtttaaatttaaaattgactttttaaagtgtaacaattgttaattaccatgaagagctagttaattcttctgtaattttattaattttaaaaaactcgataaatacaacaaattgcatttgatagacattcgaaatttgcgacgttttaggccctaaatcaagattaattaaaaataatgtagtcaagaataattaagtaaaaaattattaaaatattttctcaaatattaattactaaaaacccattccattttcgtctaaaacccagggtttttggacaacttgctttttgtaacttcttttattcttttcagaatgacttggaactttgcataaaatattttttgatagagaataaccgaatataaaataatagaaggttttataattttttaaatcctaaaatttatgaattttgcctaattaactatccaattcaaggacaatcgcttgggggagtgaaaggcgagcctgggttgcccggactgcctggccgagacggtgtgccaggaccatcgggtgaaaagggcgactcgggtgtgccgggagtgcccggcttcgatggtgaaaagggatccgtcggagcgcctggatttccaggacaaaaggtcctgaaaacaacgcccagttcaaggacagattgataactgatcccataaaattttagggagaatcgggattgcccggcatacccggacaacgtggccaagacggaatgcctggatcgcccggatttcctgggcctgtcggagagcctggcccacttggtgaaccatgcttggctggcggaccaggcatgcctggacagcccggatttccggggaccaaaggtagacggcgtttttaaaattttaatttatttttttaaatttaggcgaacttggcatgcccggctttcccggcgagaaaggtgaaccaggctttgcgggccaacctggtgttcctggcctgcccggtgctaaaggcgatgccggattgcctggacatcctggacctcagggtcatccaggacaggacggtcctcaaggcccagcggtgagtgaaaaagaaaataaattaatatttaaaattaaatactaaaacagagcactatgaaaaacaccaaatcggattcatcgaattaaatctccgagttttgggattttcccaattccaacatgtcgtcactccgtgggtgtcccactacttccaacaaaatccggatccaatcaaaccatgaaaatcagcccagcttcagacttaatgtcgagctctattaatagccgaaacccaagcttaaaattaaccaatttttattagaaaacttgtaaatttcttgccagccgttgtatccgtatattttgatgaaatttttttgtcaaaaattgtggactttaggttagattaaaatagaatcaaatatttttttatttaaagggtatggccggacctgagccgttgactcagcatgggcagaaaggactgcccggggcgccaggtgttcctggactgcgcggtgaaaagggacagcccggattggacggaccacctggaccatcgggttggctaaaaatattgaatttttaaatatttttcttaaaatttttcaggaattcctggctatcggggcgaaaagggcgagtcgggctatcctggccaacccggattcccgggcgaaaaaggcgctgccggcttaccaggctttcccggcacggagggccagtctggacctcccggtctgacacattatctaattattatttttaattatttattatggatttttaagtaatttttcggattcgctaaattgagacggtgttatgagcgttacttcaaaaaaccatcaaataaaaaaaaaattttccataaaactttgctcaaaagcaattcaattttattctttatatcgttcgatagctttaattattttctattaccctgaaaaatatcgaatgttcttaagatttctctgcgaatttatgaataattttttgtctatttttttacaattcaataaaacttttttgatcgttgaaaggctaattcaattaatgaggcgcgagcgatctttgattcagagcaatttatatattcaaagttctttctgaactaatttttggacaacagttgaacaatatgccaaattaaaaaaattttaatgatttattttaaggtccatcaggccttcccggtggcccggggccagccggacccgctctcagagatggtaaaataaacaataattaaattttaaaaaatttatttaaatcaaggctttgttgtggtcacacattcgcagacgacgcaagtgccgaactgtccacaaggcactgaaaagctgtgggacggcttttcattgctgtacattgaaggcaacgaaagagcacacaaccaggaccttggtaatattatatatatttttcatattttttttaaattcacattttaataatatttaaatcggatttatattttacaaaaattttcaaaatattgacaaaaaatttataaaaattgaataagcatggacaaaaaactcaaatatgaacaaaaatggataaattttttgaaaatattgacaaaaaaaacgaaaagatggataaaaattggcattctcagaaaaatcatttgttatttttaaaaatttttaaatcttattatcaaaatgcaattcttgaataaaaacttatttttttaacattgataaaaatatttcaagcctgattccataaaaccgaaactgtgcattaacctttaattataatttatttaatttttttttactcaaattaaggcgatgccggctcatgtcttccccgcttctccacaatgccattcctgttctgtgattttaatgatgtttgcaagtaaaaaatatttgaattaattaaattttttaaattaaacgcattttatttttcttttccatttttaagttatgcttcacgcaatgacaaatcgtattggttatccaccggcgaagcagttgagctga

SEQ ID NO: 46058 - DNA, 214 bp, Heterodera glycines
  Genomic contig location: Contig_ID=SeqID_27625; Location=485..698; Strand=+
  SCN-specific regions: Sequence locations=1-214
atggagctgactcggctgggcgatgagccgaccacccggtggacccttctgaacatccgaattctcgtggaaagtgccgaagtcggagagggacagcaaatggtccatccgctgcaagtaaagaaagcagcgagaaaatagggcaatttacaacattttaaagatcaatttcctccatcaaatggtgcaggaaaaactcgacacagcaaacgaa

SEQ ID NO: 46059 - DNA, 2616 bp, Heterodera glycines
  Genomic contig location: Contig_ID=SeqID_5522; Location=410..3025; Strand=+
  SCN-specific regions: Sequence locations=1-85,107-167,189-196,230 -369,403-2616
  Gene Ontology: Cellular component=integral to membrane
atgaccatttcctacactttggacgtgtccaagtccacttggggcggctttttccgtattctctcgcgctggcgcggcagcgtttggaaggcggtgatgggccaattgatcgtttggaccatcatttacatgctcatttcgttggtctaccgacgcctgctgaacacacgaagccaagaggcatttgggaaaaacgaaaattaattaaaaatattttcatttattttaagacatttgaacacctcgtgcactatctgaactatggacttgactcaacaattccgctgacttttatgctcggtttcttcgtcacacaagtggtcagccgatggcaatctgttctgaacggactcggctggattgacaagcaaattttaaatttaattattattaatttaaaatgctctgtcatttgcctgccttaagtcataattaagttggcaaatgccattttaatttcgagtcttgtaaatcgcccagctgctgctgtgtcttggcagctaataattatttaattggcttttagttgtttggctaataattttaattaattggcctttagttcggcaatgaattttgccaattatatccgcgggacggacaccgaaacacgaatcactcgtcgcacgctcatccgctacatggtgttgtgccaagcactcgttctgcgtgacatcagtgtgcaagtgcgcaaacgattcccaactttggacactctcgtcgcagctggtgaataagagcatttgaattaaatttcatgaaaattcgttttaatttcactaattaggcttaatctccaagccggaattggagcaattggacagggaagtccacgacaaatactcgcgttactggacacccattcactggtgcaactcaattttgtatgaagcgcgactccacggcaaaattgccagcgactttttgttggactcaattataaatgtaatcaattaaaaacaaatttcaatgcctaaatattatgcaacaaaaggacattcaacactttcgccatgggttggcttcgctgatgaaatacgattgggtgccaattccgcttctttaccctcaggtcagtcagtcgatgtccgtccatcgctaatggcacaaaaatttggcccctcctttttggcatcatttccgccattatatttatcgtcatttacatcaccggtgttcctcttgaatttctgaacgagctggggaagcttttgagggaaaaactatgggacgggccggctttgaaccggcgtctctggctttccggaccattgttctaccagcgccgaactaccgaccctgccctctccagatccccattttttctcgatcatataggatcaattgccgcctcaattgatccattaatcttcctctcggggaagcttcttctctatctccctctcattttcatttgcacagatcgttttcctcgctgtgcgcctttactttctgatctgtctgatcagtcgccagtttatttaccgaaaagaggctaagcaccacgcggagattgacctgttcgtgcccatcggcacaatgattcaattcattgtgtacgtcgggtggatgaaagtggccgaggcgttgctgaaccccctgggggaggacgacgacgatttggagtgcaattacgtgattgacaaaaacctgatcacgggtccgaattaaatggggcacctttcattcaaaaatcaccagcccattctgcgccatttttaggcttttcactggtggatttggccacaaagcgaacgccggagcagagtcgcgacgtgttctgggacaacgatcacattgcgccgttgtattcgatggaagcggcgcaacgcaccgtccacccactgatcggatcagcgtcaaaaataaagtgcggaacaaaatgaaggaggacataaaagatcaattaccgtatttacgtatttactgaattagaacccccggaggttctatttttcaacccctctcgaaaggggggggggttctaatacagtaaatacggtacactgatttggcatttctttttggcagcatggcaaagggcaaaaaaaccattacgatggcgcctcataagagcaaactgagcaaaatggacgaacggacgcggctggcacacattcggctggtggacaccatggaacataacgtaaagcatgcggaggagctgaaggcggacaaggcgaacaacgaaaacaaagcgttgggcgaactgcgcaagagacagtcagtggggcgaagggaacgccggcggaaaccaaattttataggcactactgataagctttacccccggaaaactaaaaaattgaaaatttgcacaaaaaattatatatccaaaacctaaaaaaaaattgacgcctcactccgtaactttggattaccgttaatgccaaaattgacttatttaccactttggagtattatggggattaattgcgcaaataacgcagaaaaagcgggaaaatccgcgacggtcggcacatggaagggatgccgtcgacgcgaagtgcacccgatttggaacgcgacgggttccatcgccttcgcgagagcagagacggcgaacattcgccgtcgcaccatcggccgaacggcacgagtctcacgtcgccacac

SEQ ID NO: 46060 - DNA, 1124 bp, Heterodera glycines
  misc_feature (12)..(12): n is a, c, g, or t
  Genomic contig location: Contig_ID=SeqID_27658; Location=319..1442; Strand=-
  SCN-specific regions: Sequence locations=1-36,58-749,771-1124
  Gene Ontology: Cellular component=extracellular space
ccgaaaatattnttggtattttagaggaactccttcattattttgttaaattgcgttcactgattgagcaactttaccacgcaaatggcaaccgcaaagtgatcgttttggcgcatagtatgggaaatccaatggccaactttttttacaataaaattgtggacaaagtgagaaaaggggcaaaagtggtcagaagaggaaggaccaaactgaatgttgttcagaattggaaggacacttttctgttgtctcacatttcgttggccggcgcgtggggcgggtcggcccaaatagtcaaattgttcgcctcgggtcagtgacacttttggaaatgcgcggaaattataattggggtcactttgccccttttcgggctacaacatggactatttccgcgttcttttgcccccctcgcggctccgtgccatgcaacgctctttcaccagctccgcttttctctttccgtccgccgccctttggaaatcggacgaaattttggcgactactccaaggcaattaattaattgctaattggcaattagggaatgcggcaaaagagtgccctttttaggcagaattacagtttgtccaacttggacaaattcttcgcggacattcagtaccctcaagggtttgaccagtggaaaagtgccagtgaggcgttggtactcgaacccccgggagtgaaggcgagtttaatgggcccgggaaattaggcatttcgtaactgtttttttttgggaggggaagggaattcccaaacacaaattcgaccattttcagcggcattttgagtgaccttcctcttaaggtccattgcatttttggcgtcggcgtggacacccccgaccaattccaatgggctcacaattggttcttccctgactatcagccgtacattcggtgagtaatcgcttaattggcgtgcgtgctaatatttttgaagttatggcgacggcgacggaacggtaaacatacggtcgttggaagtgtgcgaacggtgggcgaaggaaacggcggacggaacggtcgaagtgcacagagtgaacggcaccgatcacatgggcattctgaacgaccagcgcactttggaactgatcagagacattttgacaaagggagaa

SEQ ID NO: 46061 - DNA, 4901 bp, Heterodera glycines
  Genomic contig location: Contig_ID=SeqID_5524; Location=1..4901; Strand=+
  SCN-specific regions: Sequence locations=1-56,140-237,319-416,471 -588,614-694,850-922,948-997,1053-1159,1183-1215,1244-1271,1293 -1462,1484-1674,1706-1838,1872-2127,2159-2438,2462-2490,2512 -2551,2574-2606,2662-2667,...
  SCN-specific regions: Sequence locations=...2690-2911,3031-3557,3579 -3889,3934-4078,4103-4164,4198-4211,4258-4633,4655-4734,4757 -4842,4880-4901
  Gene Ontology: Mol. function=transcription co-repressor activity; Cellular component=nucleus; Biological process=regulation of transcription, DNA-dependent
ctaaactctttacgcgctgtcactttcacatttatttctctgttctcctctattaatctctttgtctctctctttctctccgtctcgctctccactctctctctctctcttccatacacacatacacacactctcttttcaactctctttctttctttttttgaattttttttatatttctctaaactctttacgcgctgtcactttcacatttatttctctgttctcctctattaatctctttgtctctctctttctccgtctcgctctccactctctctctctctcttccatacacacatacacacactctcttttcaactctctttctttctttttttgaattttttttatatttctctaaactctttacgcgctgtcactttcacatttatttctctgttctcctctattaatctctttgtctctctctttctctccgtctcgctctccactctctctctctctcttccatacacacatacacacactctcttttcaactctctttctttctttttttgaatttttttatatttctctaaactctttacgcgctgtcactttcacatttatttctctgttctcctttctctctttattttctcacccatctagagcagctcggcatatgctcacctcttctcacattgaacaccacatacatcttctctgtctttgcgctctgtgtctgatcttttcctttttttcttttccttaatttccttagctttcttactttctctattttctctgcctatttcttctatttttctatattttattcattattttgtcattcttttttttcactcactctttctctgttttcatttctcttccattccttgcaagcgatgcacacaaaaattgataataatctacaaatgcgacagtgcccagcctacacatttgtccatttttcatttggcatttttgtttgtgttggcactttctgctgacgctttttatgcactttctctaagtttgtcattttcattttttaataaaaatttaattttattttttgaaattcaattagttaattatattgtaaaatgtttgcaactgttgtcaccgcattggagcaccaaaagttgaaaagtgcgcacaacgcactgcagcaaaaagttgaacaaatggaagaaaagttttcgcagaaaatccaagaaaaggaaaatgaggtggaatctttcatttttacttttttaaactctatatttaatttattattttatttttatgggaacatttaagtgacctctctaatcacattaaaatacaatttaaaatttcgtcaatttttcatttttaataccctttaaatttctgctgaagttttttacaatctttggaaactaaaagagaaaaaaaacaaataattatattcatatttgaaatgaagagaggaaaggttcataaaggactgatcagtataaaataacagtcagcaaaaatcagagcttttttaaaaatttaattaagcaattttttggaatgaaatttgccaaaattgaccaaaaactaaatacaaagtttttactcaatttttttatttgtatgcctaattttcacagattgctcaagtgaaaagggcaaatgagagaatgcaaaagaaaatggacgaggcattggaaagaattggacgattaaacgaattggtgaggaaaaggggaaaaattaaaattttataataatttaaaaaagctaattttcatggcaatttttcgatcagatggaaagtcaaatgatacatttttatgagcaacaacagcaaaggttggacaatgatggcacatttattgccggcattgatgaggtgggaaatggaaaatggactataaaaaataaataataattaattgataaaatgatagcacgacaaataataaataaacaattcgataggcaccgtaaaaagccaaattccgaaaaatcactcattttttgtaaaaatggcttaatgctaatttgcaggaaaggcaattggatttacgctatcaatttgagaagtttaaaaaacaatcaatacttattttaaataatttaacggtcatatggcccaaaaccaaaaatgctcaaaaaatggcggaattggtttaaaacagctcaaatgaaaaaattgcgcattttccatttttccatggaataaaaattgggtactgaagtgacaactttgaatagaaactcaattatcagcccgttgctcacaaatcagttgaacctttaagactgagttacgcgccagacgattcagtcccttttgaaagtggacacttcagtacctctttttttaaacattaaacatgccaatcggtccctaatttgcatttaaacatctttatgggcagccattacttttgagtttgggccctatgaccgatattttccaatttttgtaaaaatcggcaagcaaatttaatttaattgtctcgtctgtttttatttttaattttaaaattgaacagaattcacttcaaactcaaaatggaattatgcagcacacaatggaggacaacaaccatcacttgctttttgcgcaaaagatcaatgaggtgggaaatgaaagaaaaggtcgaaaatattctcttctgtaaaatatttcagtaaatttttcattttttttataaatttgcaaatttttctaaattttttttaaaaacgaaaacaaggaaattcaattgcttaaaccccaaattctcgaaatttgcgaaatgaattttcatttcgcccgcccttttccatccgacatgctttaattgaaagcaatcatttaaaatattgggacattaataaataggatattaatttaatacattttacactttcagtgtgtcactgttgagcaaaaagaagtgagaaaattgggaggggaagaagaaaatgagagaataaaggaagaattggaacaagaggaaaaggaagtgaatgaagaggaggaggaagaatgggaagaaaataatggaagaggggaggaggaagagcaagaggaggagaacaatggaagagaggaggaggaggaagaaggggaacgggtgaaagatgaaggaataatggcggaagggcacgacaattacgggatggaaaatggcactgaatcgacacttggcactcaatttcaggcacatacaaaattttggcacaatgagaatttggaaattaaaaaaacaaatttcctcagaataagaatttttgaagacctattttttagaattttttattaagttatgagttttagtccaagttaattgctcaaacgatcggtttgtcagttttatggcaattttgaaataaatctttgggaatcgtgatctggcggtgccatgccacacgggaaataaatgaacacaataaaaattgcgattaaataccgtttcttttttacagtatgccaacaatcctaaaacaattacgcaaaagtattcattagctgcaaaattgaatggtcgtgccaagcgaatgtggtataaatgcgcgcactgtccggaggcttttcgctggctgtcagcgctaatacgacacgaacgaacgcacacgggggaaaagccgtttaaagtgaaaaatttaaaattttaatttcgttattgccgttttagtcaatttttccttattattgcacaatttttattaaactgattttttatttcatgaaattttcgtgttttttttacttattatagtcgcagaaatagaaaattaaaaaaaacaattaccgtaaatgctctaattatcacccatgggggattatttttcaagctccccagaaaaggggggataattagagactgggggataaatggagactgggggattatttttcgactaatttgtttagtgaaaattttttattttttcatggttaataaacatttaaacaagcttcaatttagaattaaataatttttatttaaatttaaaaaaatttagaaaaattccaatttatccccctgggggataaatggagactgggggattatttttcaaacgcctcgtagactgggggataattagagactgcgggattaatagagactgggcgataattagagcatttacggtaaggacaattctttaaaataagacaaatcaagaatcccattttacagcaatttttcagtgcgaccaatgcggcaaagattttgcacgggccaacacattgaacattcaccagcgcattcacaccggagaaaagccataccaagtggcaatatataaacaattaatcaattaattactccctaattaaaattaattaattgctctcccgagtcagtgtcacttatgtgacgctcgttttacgcaggatggccaactgaaaacgcacattttgattcacacgggtgaaaagccgtacaaagtgagattaaaagaatgtaactaaatcatgattagccgatttccaaaaataattcaattaattgccctagaaactgcaatgatcatccaacttcaaaactaattaattaactgagtacctattaactgtataattaacatacctaattctctttttttacattaatttagtgcacttattgtccccaaaaatttacacgtgctggcaatttgacaacccatcttcgtcgccacaccgaaaagaagccgtttatggtgtgtagatctggaaatacaaaaaagttaaaattatttaaaatagatgaatttccatttttttttaaatcgatgaatttccattttttaagtgttcccattgtggcaaacaatttgcagagtcaagcaatctgcaaattcatctgcttacacactacagaaaacgtaaagcaaacggacaattgagcaacagaatgaatgaattagtgccacaaaaaattgtccttttttgaattatttaatttatattttttgtcaatattattattgggattacagaaatattcattc

SEQ ID NO: 46062 - DNA, 1533 bp, Heterodera glycines
  misc_feature (904)..(904): n is a, c, g, or t
  Genomic contig location: Contig_ID=SeqID_27670; Location=155..1687; Strand=-
  SCN-specific regions: Sequence locations=1-229,251-338,365-468,501 -547,583-764,800-1027,1051-1056,1114-1146,1168-1533
gtgagtccagcgtggccatcttcatcacttccatcaccgatgtcgtctctttcgctgctggcacttactccgacattttggcggtccgtggcttttgcatgatgacagccgcttgcatgatgttcacctttctctaccaggtgcccgacttgtattaacaaaacattgctaatttaataaccgtagtaataccgtatgccatgtttttcaattcaattttataaaatgcttcttttctccccatcgattagatcactttttttgctgctttgatggtgatcagttcgcgtttgcaaatgcaacaacggtattaattgattcgtaattagtttttctatttaattaattaattaactaattaattgttctccctcccattttggaaatgcttgtttgccctgctgtttgctggcgaaagacccattcgaatttgaggaggatgaaagtgtgtccagcaaaacggagcttaacaataacaacaacaacagcaaaaatgacaaatcgagcaaagcaatggattatgaagaaagagacgaaaaagggtttcaaaaaaaataaattaaaaataattaaaatttattaggaaattccaattttttcaggtcaaaacattccccatcgcctgaccatggcttctccgagtctttttcgagcacttcggccccaatttcgagcagtagctcttctgcactcagtgcgtcagaattcaatttggcaatgcgccaaaaggggccaatgggaaagtttttcaggtgctcaaattgatttataaatttaaatatatttttttatatttttaggaatttttatgtcgattttctgttggattggcgcacaaagttcgccgttggcaccattttcttcgtttatttggccatttccctgtggggcattgtgtcaatgngccaagggttggattatgaaaagcttttgctgagttcggaccctttggtgagaaaattggagtggagatcgaactgttccacgggagtgaccaggtgaaatcggagaaaagctcattttgattgcttttatcagtgtaaatatgctttaaggaaattatttaaaaacaatttattttactttaaaaaaaccaaaaattaatttaaaattccaactgatttttttgttagttttttacattttggaaatttaaaaattcaagaccattcgaataattaatctctggtgtttctctatgattaatcacaacactttggttgatcagcaactgactgtgatcactttgtctgatcagttgctcaaacgtcgcccctttcgcaggttgaaattgccgtggtccgcgcgccggacttgcgaatgcgcgagaatcgcgcgcgcgttgaacaacttgtggccgactttgagcggttgccgaacagcgtaggcagcgcgggcacagaattttggctgcgcgagtacgtgcgctacgccaacgcgactggcgcgcggctgcacgagcgcgaccattggtcgtgggtgcgcggggtgttcgactggtcacagctgttcgccttctacaaactgtggtca

SEQ ID NO: 46063 - DNA, 685 bp, Heterodera glycines
  Genomic contig location: Contig_ID=SeqID_27672; Location=345..1029; Strand=+
  SCN-specific regions: Sequence locations=1-263,287-357,407-482,504 -588,610-685
  Gene Ontology: Mol. function=protein disulfide isomerase activity; Biological process=protein folding
ttgggtgtggacggaggcgggccagcagcccgacttggagcagtcctttggcatcggcggcttcggctacccggcaatggtggcggtgaacacgcgcaagctcaaatacagcacaatgaccggtgagagagttaccgtatcagtgcatatggtaaaccgaaaaaaaccgactttttcttgaattttctctaaatttttaaatttgtttttgcggcgatgtttcggcctattccgtgttctcccccccccccacgaaaaacttcaaatttataatttttttaattttcaggaaaaatagcaactcttttttttttactatttttaaaggaaattcttagaaaatgaaaatttaatggctttttaggttttgggttttcctaaaatatttttttaattgaaaatttaaggctcgtttggccagtctggcatttccgagtttctgcgcgacctttcctacggtaagggcaaaacgtcgtctgtgccgggcgcgaatatgccgtcgctggccgacgtgccggcctgggatggccgggatgcggaactgccgccgatggaagacgtggacgacatcgacttgtcggatgtgagcctggacgacgaggaggaggaaatgtcaacgaaggaagcaaagaaaggggtggatgaagaagagaagaaaaagaaaggcaccaagacggaggaggaa

SEQ ID NO: 46064 - DNA, 444 bp, Heterodera glycines
  Genomic contig location: Contig_ID=SeqID_27687; Location=11..454; Strand=+
  SCN-specific regions: Sequence locations=1-349,371-444
atggcgctactttcaccagaggacgtcgcaacaatgccaacgcagaaggtcgtcttcaacgccccgttcgacaacaaggtcacctactacatgcgggtgcgtttggcgtggtgcgcgtggcatgcggaataacgcccccccgcccccttttcaggtgattaaccctgggacgaagcgcatcggctacgccttcaagaccaccaaaccgaagcgcatcaacatgaacccgccgaattttgtaggaagggggggggggggcgggggtggtaaaatttggcgtctgtttggtcggagggttagctcgcgtagaactcggtctgctcactccttgtaaattcaggtcaaaatgagttttagacaaaagtggtccttcctataagtctaccagtcacacatttcgtttggaattcgaatgttagccgcccaaatttggagataaactga

SEQ ID NO: 46065 - DNA, 1164 bp, Heterodera glycines
  Genomic contig location: Contig_ID=SeqID_658; Location=1354..2517; Strand=-
  SCN-specific regions: Sequence locations=1-1164
atgtacctgctcagctcaattgaacggaagaatgatgcgggagaatgggtagcactcagtgacacggacgcaaacgataaacatgctggggtcatccaaaactttggtagcagctttgtccgctcgctgaaggtcaacatttcaggcattgaggtgtttgacagttcaatttattatcactaccgtgactacataatgaaggagttgggctattcacaggaaattcgtaaggctttccacgaggcatcgtgctactaccccgacgatgatgaccagaacagcgcaacaaacccaggatttaccgcacgtgcggcacggttttcaggcggtaaacaatgtgagacaatggtaaaacttaattttgatttggcacgtcaaaatgcattgatgttgaacaatcaggatgtaatattcaccatacaccgcaacaatgattcattcctcctgcttacgcccccatacaaaaaaccagatggtacactacaggaaaataagaaagagtaccgtatccgtgtgcatgacatgcgtctctatgtgcgcactgtggacgtcacaccgaaccttaaccttgccattagccgacaattggagtccacttcagcaaaatatccgttgcgtaaaattgagatgcggtccatttttcttggcacaggccggaccgagctggcacacaacgtgttcacttctacgttgcctcgtcgcctaatttgcactttcgtttcaaccgacgcatattccggtaaccgaaaaatgtcgccctacaagtttgagcacgccaatttacgttcaattagtgttgaagcaaacggacagacctttcccagcaccccgtatttgctgtccttcgatggtgcacagccccgttttgttcgtgcatttgtagacatgtacgcaggcctgggtttggatgactccgacaccaaaacggtctcgattgggatgcagcgttttcttaacggttgggcctttttcgtcattccgttgacctccactctggaggacacacctggttttgagctgatcagacaaggcacgtgcacgataaaggtgcaatttgagcagcctataaaagcggatggatatgagatgcttgtccttggtgaattcgattctgtgttgtccattaacgcagaccgggttctgagtacagacggaagtgtgtaa

SEQ ID NO: 46066 - DNA, 1116 bp, Heterodera glycines
  Genomic contig location: Contig_ID=SeqID_27766; Location=270..1385; Strand=-
  SCN-specific regions: Sequence locations=1-241,278-463,485-599,622 -673,704-1116
  Gene Ontology: Mol. function=glucosamine-fructose-6-phosphate aminotransferase (isomerizing) activity; Biological process=fructose 6-phosphate metabolism
atggacttcacctacaacggtgagcaattacatctaatttggctcattcaactgaattttcgcttgttttagtccattgcggcatcggacacacccgctgggcaacgcatggaaagccaaaggacgaaaatgcgcacccgcaacggtcgaactttgacaacggtacgttaatccggtgctatatactatattttggtcgtaattttaaaagcctttgtcagattttgtcgtggtacacaacggaatcatcaccaactacaaggagatcaaggactatttgctgaccaagggctacaaattcgagtcggagacggacaccgaagtgatcgccaaactcacgcaacacatccaccaacggcacccacactacggcctccggcaactcgtcgaaattgtcgtgcaacaattggtcagcagtttaattgtcgcaattgctcgacttttccttttgtattctttggactcccaatttgtttttccctccgtgctccaattatttttaaattttcaggagggtgcttttgcgttggcgttcaaaagtcgccgttttcctggccaattggtggccactcgtcgcggcagtcctcttttggttggcattaaaagtcagtccaagctgaccactgaccatttcccggtcttctacagcagacgtacgttttgataccgctttgattaaattttgttttctgattcttttgttttggatttccaaacatttagtaaaaatgaaattttttagttttcattttcaattaatttcattttccattacggtggtttagttatcgacagttggttccgttcaaaagattctccgagtgccgatattaaaggcgatttaccaattttcgctttttttaagccctttcgcttttgttgcttttttgggttgcttttgctttttttgcaaaaatttgccatttttttatttttcattatttttagcacgccgtggccccgtttcgctggtgttcgacgaaagttgcaccactgcgatggaaacgccaaacaaactcaacgcttccgacatgttcgcctctttcagcgctccttttaatggttgccattgggtttttcaaattacactcatttatcttttttagacacaataaa

SEQ ID NO: 46067 - DNA, 1384 bp, Heterodera glycines
  misc_feature (1277)..(1277): n is a, c, g, or t
  misc_feature (1323)..(1323): n is a, c, g, or t
  misc_feature (1325)..(1326): n is a, c, g, or t
  misc_feature (1355)..(1356): n is a, c, g, or t
  Genomic contig location: Contig_ID=SeqID_27769; Location=1..1384; Strand=-
  SCN-specific regions: Sequence locations=1-479,501-677,702-889,914 -1017,1039-1213,1235-1384
  Gene Ontology: Mol. function=co-chaperone activity; Cellular component=vesicle membrane; Biological process=receptor mediated endocytosis
tgcgagagtcctggggtcaattcccagactaccccgaattttttaattaaatacatttaagtgtcaattgttcatatttttttttttcttaaaaatgctttagagatgagacaggcgctgtcattcgtccaatgcctcgaatcaaaaaagtgctttctgaacccgtgttgctgtaccaactggtgcagttgttgcttacttacgacccgtccattgtgcaacgagtggcaactttggtcaacgatgtcatgcaggacaacccttacatttcgagactgtatttgtcgggcatatttttctttatcttgatgtacaatgggtccaacattttgccggttgctcgcttcctcaaagacacccatttgaaacaagcattccgttcaactctttccaagtcggagctcgcctcccgttctgtgctatgcccaatgttgccagaagcaaatattttctacctcgaagtcattttttaattcgaattgctttttcaaaatttgtttaggaatatggagcggagaaatatgccgaagttttcctcggagagtttgagaatcccgaatgtatttggaatagtgaaatgcgacgcaatatgatcgaaaagattgctcttcatgtgtccgacttttcgtccagactttcctcaaatgttaaggcactttacaggtattgaaaaccaaaaacttttattgtttcaaatacaatattaatttttttgtcagatattgtccaattcctcccattgattatccacaactaaaagaagagctgttctgccatttctattaccttcgccatttgactgataatcaccgctttccgaattggcctattcgcgagcccgtcgagtttttgcgggcctgtctctccgcttggcatgatgagatcacgcgcaaaccggccaaaatgtctgttgaacaggcttgtgaacgcttggggctgtccacgacggatcccactgccgggtggaaagacgcatcggcagtgcgccgagcctacttcaaattagcacaaaaatatcacccggacaaaaacccggacggtcgggaacagtttgagcagatcaactacgcctacgaattccttacatcgacgctggtcagagccaattcctcgtcaacgccagacatgaatcgcatagtgatcatcattcgtgcacaaagcattgtatacaagaggaacttacaaggttcgccagcaatttggtgcaaaatcaatcatttataattttctttagtgctttcgccatacaaatatgccgggtatacccaacttatcanaaccatcgatctcgagtcgtccgacgacacattgtttgctcgaacnanngagggacgtggtcaattgctttgtgctgnncgtgagtatgccatggacgctaaggagt

SEQ ID NO: 46068 - DNA, 903 bp, Heterodera glycines
  Genomic contig location: Contig_ID=SeqID_27780; Location=93..995; Strand=+
  SCN-specific regions: Sequence locations=1-80,102-546,568-649,671 -780,802-903
  Gene Ontology: Mol. function=RAB small monomeric GTPase activity; Biological process=negative regulation of FGF receptor signaling pathway
atggcaaaaaagcagtacgaccttttgttcaaacttctgttgatcggcgacagcggagtgggcaaaacttgcattttgtacagattcagcgacgatgcctttaacacgtcttttatttcgaccattggtatgtcaaatagtatcacaatttcataccgaaattccacatgacacttcaatttaccttaccttatcttctgggcagaaataaaacgggccgaatttatgaattttactaacgccaaatgaatttatcagattttcaatctttttgtttgatttttccaggaattgacttcaaaatcaagacgattgagctgagagggaagaaaataaagctgcagatttggttggttttacttttatttgattgtaaaaaagaaaaagaatgttgtttcctttccgttgtgctttttttcgattatttgttaatgaaaatgcggacactccaaataatggccctaattcaagtcaaacggttagcgcttttttactattttaagggacactgcgggtcaagagcgttttcacacgattaccacctcatattaccggggcgccatgggcattatgatggtttacgacataaccaacgcgaagagcttcgacaacatcgccaaatggctgagatacatcgacgaggttttgccaaacaaaaacccaaatccattctccaagctttgctattttttcaaatggaccaactttaagcatgcctctgaagatgtcgtaaaaatgttacttggcaacaaatgcgacatgtccgaccgaagagttgtgccgaaggaacgtggggaaaaaattgcgattgaccatggcattcgtttcctggagacatcggccaaggcaaacataaacatcgaaaaggcgttttacgacttggccgaagccattttggacaag

SEQ ID NO: 46069 - DNA, 364 bp, Heterodera glycines
  Genomic contig location: Contig_ID=SeqID_5562; Location=452..815; Strand=+
  SCN-specific regions: Sequence locations=1-174,196-364
  Gene Ontology: Mol. function=structural constituent of ribosome; Cellular component=cytosolic ribosome (sensu Eukarya); Biological process=protein biosynthesis
atggttagaccaaacttctatttttatgttaacccaaaaattaaggcgaaaaaatccacgaagaagaaggtcgctgctcttcccgccgcgatcaaaaagacggaaactaaaaagccggcaaagagtactctttttgaacgacggcctcgcaatttttcaattggtatgagcatgataatattaaatatggtttttatctgtatatttaggccaggacattcaaccgaaacgggacttaactcgctttgttcgttggccaaaatacattttgctccagcgacagcgtgccgttcttgaaaagcgtctgaaaattcctccaccaatcaaccagttcaaatttgctcttgacaaaccaaatagttag

SEQ ID NO: 46070 - DNA, 2797 bp, Heterodera glycines
  Genomic contig location: Contig_ID=SeqID_5563; Location=124..2920; Strand=+
  SCN-specific regions: Sequence locations=1-218,241-284,306-432,455 -506,581-624,735-775,1009-1052,1120-1148,1253-1272,1332-1332,1387 -1561,1683-1932,1954-2263,2424-2442,2464-2476,2651-2684
  Gene Ontology: Mol. function=transporter activity; Cellular component= membrane; Biological process=embryogenesis and morphogenesis
ggaggacagaaacgcgcttaaaaatttggctgatgttgcggtcaccaatttcaatgaacgcggtgatgaacttcggaagaattggggaggtgcgatcatgtcccagcgttcgcaagcacgacaggctaagattgaaaaggctcgccagaaggatgttgggcagaaagtttgatggtagttatcaaaaattgttgtttctctgttgatgataaaatttgttgacttttggtttcaaatttacaatatttgttcataccatcgttatctcttagttcttgaaaatctttttgttatttgtatttgctgtagagatgttttcttgtacgttaaatggggtgccggaatcacacgatcttttggagaagtgtcggctgccatttggtcttcacttacagccattccgtgatttgagggtactctgtgtgcatctttcttcttttgtagttctggattaagggattgaaagtcttgcagacagtcatcacgcggtgcagatattgcaggacatatatcaacccttttgtgtttttaatggacgcccgtcattggaaatgcaatttgtgctatcgcgcaaatgaaagtattactttccttgttgcgataattttttaagccttataacagtgcctgaggatttcgcatgggaccctcaaacgaaaacttttggcgacccatctagaagacccgaactccaagaaaccactattgaatacattgcaccatctgaatacatggttagcccgtgcgaaaattttttttagaaacaacaagttaagcttcgtcctcctcaacctccgatttatttgtttgtttttgacgtcggttccgcagcaatcgattgcggttacctcaacacttttgcagaacaactttcgctggacattgacaaattgcctggccaggaaagggctttcattggctttatcggtttcgattccgctttacattttttccaattcgatgaaaacgagagagagccgaggcatattattgaatttgatgttgaaggtttaactcaaaatattaatgtataataaatacttggcttttccagaaagttttgcgcctgtgttctctggactttttgttgaacttaatgttttcaaagaggttatttttaagaaaacaaaccagtttcgcatttttttagatcatcaaaaaatttatatacaacataccatcaatttttgaacgttctatgtcatcctcaaattgtctcggttctgcacttacagttgcaaaaaatttaattgtaagttttttttatctgtctttaattttattgtttaaaagaacgaaatcggtggacggataactgtttttaccgcatctatgccaaatctcggaattggtgctctgaaatgtttggaattcaacactgcaaaagtatgcgtgagtaaattggtactttaggattttcataccccacccacatttttcatgctaaaactaaacactgacccttatttaaacgtaataccaaaccagattttctttgatttgaagttacgaaacagaaactacttctattagcatgtactaattgatttctcttttacagaagatcgcatttacacctcaaattgacttttacaaaagtttggctctcgaatgtactggaaaacaaattgccattgaccttttcgttgtcggatgtcaaaacgtagatcttcgaacattatgtgatttgttattcttttgttattcgcttctgttaaccatttatggacaagggtggagggattagagggctctgttgcagttcacacgaccataaaaatttttgcaactttagtgcaccataactgttttaagaagcatccaaattaaacatttagtatcattcggtagccctaagaaaatcctctattagcctgcaaaatttcaaatcgttgggtttcaagaaatttatggctaactaaaaatatttagaaaaccaactttgaaattttgcaggctaatagaggattcttagtgctatcgagtgatactaagaatgtttaatttggatgtttcttgaaaaagttatggaaatttatggtcgtgtgaatttcaataaagccgattagagttaggttttttgaaatttcttcaattctatatgaaattatcctacattttccttttggcaaaaaatttccatccttacactgcctttcatctttctctaatttttcgcggaatttcaatcctcataaaaaatcggaatttgcctcaacccttggctatggttcaacaattcgctgattttttgctttttaagctgatatgtctcggttcagcagtggcaccgtgtaccatttccctgaatatcatttccttcgggaccaagtcgaagtcaaacggttccaaatgattttacgacgttactttattcgaaagcttggtcttgaggccgtgttgaggatacgttgctcgaggggtactcaagcaattgattattattgttttcttatttttattgtttaaattcacaggactttctcttcacactttttatggaaatttcttcgtccgttccactgatttgctcgccttgcccaatgtgagtcccgattcggccatgggcgttcaaattaaacacgacgaagtgatcacagccagtcaagtgtgtttccaagcagctttgctgtacacctcgacgaaaggtttcccttatccattgtttgaaatgtcgaaaagtcaggtgaccgtcgtattcgcgtccacacactttgtctccccgtgctcacacaagctgcacatgtattttcttcgctggacattaactcgtcaatatcgctactttcaaagatgg

SEQ ID NO: 46071 - DNA, 1416 bp, Heterodera glycines
  Genomic contig location: Contig_ID=SeqID_5571; Location=1830..3245; Strand=-
  SCN-specific regions: Sequence locations=1-322,344-1416
atgcccggcgcaacgttcatccggaacctgaaagtgcacatcaaccagcgggaggtgtacgactcaaaccagctgtacagctacaaggtgttcctggacactgagctcagctaccctgtaacggcaaaggatcatactttggcgtggcaggctatttccgtgacagtgacccgaccaaagtaaacgatcgaaggaaaaaggcggtggaggagagcaagggctttcaagcgataagcaagctgagcgccgacatattcaaccaggacttgtacatgatcagcaatgttgagattgacattgagctcgccctgcagtcggacgattttatgatacatcaggaagccgcaaatagggacaagtacacgcttgagattgtcgactgcaggctgatagtgaagacggttgatctgatggacggtctcagccttgacattgcaaagaagttggacctggagcccgccagatacggcatccgaaaaacgctgatgaagtcgctgttcatcaccggtggacgatacgatttttctgccaatctgttcaccgaggaagtgccacggagggtcatcattgggctggtgcccaaccaaaattacattgggcacaatcagaagaaccccttttacttcaaccaccacaacgtaagtgccgctttgacatgtatttctggcagaaaaaatgttcaggtgcgggatattgaactgaccgcctctggcaggacatacccacagtttccgtacaacttggactacaagaacaacaggtacgcaagggcgtaccatgacacccaggagcaccttggcatggcctgtacaactgagagcaacgggatcagctacagcatgttcaagactgcctactgcctctatgtcttccaaatgaccaatgcgcaggaggactcgccgggctttgagctgatcaaggagggctgtacagcggtgaacattcggtttgccgaagcggttccgaacgagggggtcactttaatagcctatgccgaggctgacgggctcattctgattgaccggaacagatcaatcactagtgaccttacagtatgaatggtgagaattattcctccgattttgttcaaatgcctcctcctccaatgctgcacacgaagggattgtactgtgttttccggatgtgatcgagaagtcgccaatcaacttttttctctgcctcatctacctgtttggtgcagcaggtactgcggctgcgggattttacctgtttttgagggagaggcggattcgtcgcaggaatggacaatcggttcatcgacagagctctctttgagaaccgggcgacgagaaaatattttgttggcacttttccggccgaccgattgccaaagtgcacgaaatttccctgcagtctaattgtcaatttggtgagtgccaaaatattttcaataaa

SEQ ID NO: 46072 - DNA, 1644 bp, Heterodera glycines
  misc_feature (1024)..(1024): n is a, c, g, or t
  Genomic contig location: Contig_ID=SeqID_5575; Location=2707..4350; Strand=+
  SCN-specific regions: Sequence locations=1-456,478-506,529-658,680 -1608,1630-1644
atgtccttgcgcaatgttcgaatatatcggaaaattctcggaaatggcacatccagcactttggtggattcttccgccaatgagggctttttgctgctgcaatgtggtggcatgttaaccatcggcaaagatgtgggcaactcgcttaaacagcaatacaccaaagtctcagacggatacgcacttttgggcatccacaaaatatccaaaggcatttttaactgctaacagttgcccaattagacaaacacataaaagaacgctgtttagatgaacattttctggttgtggtgaagtccgttttgtcggttggccaactcttcaattgcgatttggtttggcaataattagccctccgttcgacgcttaattaactttaaatagcacaaaataaccaatgtccaatttgtctcgctgaatgttttgtcgaacaccgagcaaattgacgcaagaattgtggaggcatggaatacaaaagcaacattgtttgaactcatttcgactattttcagatgcaaaaatttctttcggcagggattttttactttgctggctcaaacaaagggagtaattacgacctgacgcattcacttcaacgcaggcaaacaattggcgaatttggacagtccgatttccgcttttattggtgttttttaaagttaattttgtataaattcataacttataggaatcggactttgtcttttccttttgaacgctttggagtgtccatcgacgattggctggtcaaatgcatttgtgggtcggtgcttgtgcggacgatttacgtgggtcatcggaccgcaaaagttgctttgatctcccgacttagctgcgactacgtcggcacccgtttcaacgttcgtggaataaatgtgagtttaacatttattacagacttcagttttataattgctttctttattatttttaggatgacggaaatgtggcaaattttgtgaaacggaacaggtctttgcgaactgaagagaatcgcatttaaaataaaaaatgttagcttttnaacgttcgaagaaaaagattgttcatatgtccaagttcggggctcagtgccacttttttgggaacagcccggcatcaatgttggctctcacacaattaaattgaaaccgttggaattttcaatgtttgcaatggaaaggcatggcataaataattcaacgaaccaaaaacaatccaattgttttaggcattattcatttttgaaacaattttacggtgatttattaagtgttaatttgctcggttcaaaaaagggcgaacggagtctgtcaacggcatttcaggcactattatttttttttaattcataaaatgaaatttcttttttcagacagcaataaatttgtcaaaattacattcggatgttcgattcgtttcatttgattaccacgcggaggtgaaacagtccaaagaaaatgcgaagcgattgatcagcgaaattgactcatttattgaccattgcagtttcttcttttctcatgggtaagttaatttcaccataactgcactttggttcacttttcctttgttttcagctcctttcagaagggtgtcatccgtacgaattgtttggactgtctcgaccggactaactgcgtccaaactgttcttttttgttga

SEQ ID NO: 46073 - DNA, 1006 bp, Heterodera glycines
  Genomic contig location: Contig_ID=SeqID_27880; Location=315..1320; Strand=+
  SCN-specific regions: Sequence locations=1-1006
  Gene Ontology: Mol. function=protein binding; Biological process =purine nucleotide biosynthesis
attgacattgtcgcgcgatgccaaggcggtaacaatgcgggccataccgttctggcaaatggccgcgagtatcatttccaccttttgccttccggattggcctcagaaaaggtgacccaaaaaacaaaacaaaaactaatgttgctgttgcaggtgttgaacattgtcgggaacggagtcgtcgtcaatttggacgcccttttcgaggaattggagagcaacaaaattgaggattcggcagaccgactgttcgtcagtgacagtgcccatttggtgttgcctgtgcacatcgcaacggatatcatgcgggaaaatgcgttgggacaaaactcgtaacaaacggaagattaaacatcgatcaaattatttacatttttcagaaaactcggcaccaccaaacgtggcattggtcccgcctattcgagcaaatgcttccgcaatggcatacgactgggcgaactgctcaaccaaccagagaaatttgaacaaaagttagtcgattaataaaattagttgaccttttgtcgttgtttagctatcgttcgctggtcgcccacttcaaaactcttttccctgacattgaattggacacggaaagtgacgtcaaacagttgaaggtagtttcttttttaaatttcattttgcatttgtcctttttttgttaggcccatgccgcacgtcttctccaaatgggcattgtctgcaacacgaccgttttcctgcacaaaaagcgtttggagggcaaatcgattttggtggaaggagccaacggcactctgttggacatcgactttggtcctatccaataatgttccaatttcttttaccatcgattgtcttttcaggtacctatccgttcgtcacttcgtccaattccaccgtcggcggttgcatcaccggccttggcattccgccgacagccgtccgtcgcgtcatcggcgtggtcaaagcctaccaaacgcgtgtcggctccggtccattcccgactgaactgcttgacgccgat

SEQ ID NO: 46074 - DNA, 1031 bp, Heterodera glycines
  Genomic contig location: Contig_ID=SeqID_5582; Location=2172..3202; Strand=-
  SCN-specific regions: Sequence locations=1-337,360-561,584-1031
  Gene Ontology: Mol. function=transferase activity, transferring groups other than amino-acyl groups; Cellular component=integral to endoplasmic reticulum membrane; Biological process=fatty acid elongation
ttttggtgttcctttatatcgccggtcagaaaccaattaattgcttgctctctaaagtgtttaatccttgcttctccttcgcaggcatccattatctcaagtggtggatgcgcgacagaaagccgttcgaactgcgcaactttttggtcttttggaatgccggattggccattttcagcaccttcggggcgttgaggttcagcgaggagtttctctacgttatgaagaacagatcattccaagtgggcactttcgacggaagatggccaattcgttttggctttcttttaggattcggtgtgcctttccatttcgcccactcagccggccgctctttgggcctttcttttttcgctttccaaagtggccgagtttggggacaccgttctgctggtgctgaggaaacgcccgctcatcttcctccattggttccaccattcggttgtgctgatttacaggtgagtggaacgactgacggacgcagaaagtgccattgtcatcattttgtttattttttccttttttagttggcattccgcgactgaactcaccgcaggtgaccaacaaaagcaaagaaaaagaatattctaaacggtcattccctcttaagccggccgttggttcatccaattgaattactcagtccacgccatcatgtacacttactacacattcgccagcctcggaatccgattccccaaatgggtgtcgatgactgtgaccacgctgcagaccacccaagtgggaaatggggtgccctttcttcccgcactttctccggacaattccctccgctccctcggccaattccctcctcctctgatcagatgcttatcggcgtgttcatctctctgtacgtcgcccgtctgaagcttttctcctcccgtccgacggtgtgccaacagtccgttgaaaatatgtgcatttgcttctccatttacaccgcgttcgccttccttttcatccgcttcttcgtcaattcgtatttactcggcaaaaaaccgacggcagcgaaagccgtggcgaagaaa

SEQ ID NO: 46075 - DNA, 903 bp, Heterodera glycines
  Genomic contig location: Contig_ID=SeqID_5587; Location=2306..3208; Strand=+
  SCN-specific regions: Sequence locations=1-257,283-903
  Gene Ontology: Mol. function=ATPase activity; Cellular component =nucleus; Biological process=endosome transport
atgtctctgctgaaaagcgtcgactccaaactcggcgatgaaattctcaccaccatcgtggaaacgacggacattcgactcgacgacatcgaaggaaatgcaatggcaaaattagcgctggaagaaagtgttgtactgcctgcactaaacccgaaactcttcacgggtctgcgggcgccgtgcaccggaattttgttgtttgggcctccggggaatggcaaaacgatgctcgtgggttgacttggcaaattcattggctaataaatgaaaatttaaggcaaaagccgtggcgaatgagtgcaattcaacattttttagcatttcggcagcgacaattatgtccaaatgggtgggcgacggagaacgactggtgaaagcgcttttccaagtggccagaaatgcacagccatccatcattttcatcggtaaaattaaaaaagggaaatgagtaattcaaagacatcgaacccaataacatcagatgaagtcgattcgatgctttgtcagcgttttgagcaagaggacggagcagcaaggcgagtgaagacggagtttttggttcagttggacggatgttcttcggaaaaaaaggcaaatggccacgttttggtgttggcagcaacgaatcgcccccaagaattggacgaaggcattttgagacgatttcctcagcgaattttcatcgatttgccggacaaaaaagcacgttttcaaatgattcgaaggacttttgaactgaacagcaccaacttacaaattgaagatgccgaattggagtaatccgtccggtactcatttgtcaaccaaagccatttttcaggaaaatcgctacaatgactgacaattactcgtattccgatttgaaggccctctgtcgagccgccgcaaagtttcccgtgcaaa

SEQ ID NO: 46076 - DNA, 2790 bp, Heterodera glycines
  Genomic contig location: Contig_ID=SeqID_668; Location=1005..3794; Strand=-
  SCN-specific regions: Sequence locations=1-250,280-329,372-395,417 -446,469-710,733-877,918-1003,1025-1328,1350-1462,1484-1529,1551 -1625,1651-1795,1824-1943,1965-1988,2032-2199,2290-2394,2416 -2470,2494-2573,2595-2790
  Gene Ontology: Mol. function=branched-chain amino acid aminotransferase activity; Cellular component=cytoplasm; Biological process=branched chain family amino acid biosynthesis
tttaagcataaagatttgtccattgtccgtgccactgctggacaaatgcagcccaagccgctgggaacggttgatcagatcaaatttggacatcacttttctgatcacatgatggaggtcgattggtcggacaccgcgggatggaatcaacccgaaattagcccgttgcacagtgttcagcttcatccgggcgcaaaagtaaatttttaaaaaatctttaaaaatcagacaactataaataaaaattgcgaaataaattaaatattaaaatgaaaatttgaaatttgaaatttcgaaaaagcatacaatctgaaaaattggaattcttcaaataaaaattcttaatttatatataaataaaaattttttttccattataatccttcaacacattatttaaacaatttaaattaatttgaatgaaaaatattcgaatatttctaaacaaatgaaattataaattttggggatttgtttctaattgttaatcacacaaaaaggtgcttcattatgcgattgaactgttcgaaggcatgaaggcttaccgtggcattgacgacagaatccgattgttccgtccagaaatgaacattgcacgcatgaagcgtaccgcggcacgtgcggcacttccggtaattgtacagtgccgtggcattctcacccaccattctccagccccccccccgccccgggtgcgacatttccactaattaatggcattttccacagttttgaatgtcttggcattatttttgcactcttttatagataaatgccattttctgtttctgagttccttttgagatggcatcttttcaaatttcttaggtggaatccgattttttttttatttgcactttgcccattatttatgctgaaaacctttttaaacaaatttaatttttcaaattgctttactcctcaaacccgaaacaggattttgatgcggaagaaatgctgaaggtcatcgccgagttggtccggcttgatcgggaatgggtgccctactcggcctcctcctccttgtacattcgtcccacattgatcggcactgatccaacgcttggcgtcgcacactcgcgcaccgccaaaatgttcattctgaccggcccagttggcacatttttcccaaccggcttcaagtccatttcgctgtttgccgatccaagctatgcccgcgcattccccggcggtgtgggcgcatataaaatgggatggtaggcattttgtcaatgggacaaattatcaccaaaaatgggcaaaatggaatacattggggatgatcttttgtcattggaatatgatcaacaaaactgtgctattctacaataaggaaggaagacattttgtcaatgacaatggtcaccaaaactttgacaattatacataattttggagtaggcattttgacaacgacactaattaacatagaattgagacaattgtacatataatagtgtggtaaataaataaacaccaaaatgatatacaattcacacattggaggttcggcatttttcagtgacaataaatcgaaaattaattaaaatagacaaaatatgggaactccaaaaagggctggatgaacttttaaatttctaaaaaatgaaaaacactctaaaaagtaataaaaatttaaatttatttttagcaattatgctcccactcttctgatcggaaagcatgcacatgatctgggataccaacaagtgttgtggttgactgggccagatgagaagatcactgaagttggtgcaatgaacatattcatctactggagaaatgaatgcggaggtaaaattaaaatcataatttaaaaaaaagaaatccacggagttaatttagactttttgccgatttaatgtgccaaagtttttaaatttatatggcctattgaaaaaaacaaaggaaaactttttgaaaattaaaaaaatgatattcgctttaaaattttaacttttatacagaggcttagtcacacattaaagattttttatttaatcttttaagtttaaatattttattatttaagaattggaactggtcactccgccgctgaatgacggactgattttgccgggcgttgtgcgcgactcggtgttgagcatagcacgtgagtggggcgagttcagggtcacggaacgctacccaacaatggcggaattgcgccgggcattgcacgagcggagagtgcgtttcaaaattattttaaattaaaattagaaataatttagaaataattttaaaatgatgaattaattaatttgcataaaaattttaaaatttaatgaaatgtttttaagaaaattctaaagcgataagcataaaaatttctcaaattgctaagttttattaaagtaaaaaaaagagttaaacctgcatttccctcaaaatagtttaacaaaaatgccaaaatatactgaaagttacccaaaaatgccgaaatatgagcgtaaggcacaaacaaatcaaattaaattaaatttttttttacatctttctgtcgcaatttttaacaaaaaatgtaaaaatctgccaaaaaaaataatcgatatttctttattttaattatatgttttgttgcagctcctgcaaatgttcggctgcggcaccgcttgtgtcatttcgccaatcggacgcattgcctatgttgagcgtggcacgggccgcattgacgagctgcacattccgacaatggcatccaaagcgacagtgatgcaacgcatgtacgatacaatcaacgacatacagtatggccgcatggacagaccggactgggttcggatagtg

SEQ ID NO: 46077 - DNA, 1147 bp, Heterodera glycines
  Genomic contig location: Contig_ID=SeqID_5594; Location=2912..4058; Strand=+
  SCN-specific regions: Sequence locations=1-29,51-279,321-365,388 -716,738-790,813-854,878-1147
atggtttacgggacgccatttgaaaagttagaggatgaaggaagtaaggaaagtcggtttaagcacataatttttatcaataacttacagggaatgcaatttcaaagcggcctaagggaattcaagaagaaattgtgacggacgagcgcgggaaaaggcgattccatggcgcttttactggcggattttcggccggttatttcaatacggctgggtcaaagcatggtgagtattggctgtattatactgtatatgatatacttgtttaccgtttgagattttaatcaattttgaattcaggttgggtccctcaaacattcaaatcatcacgcgaagaccgtgccgacaaagttcaaaacacagccgaagattttatggacgaagaggtactgaattgctatataattgggaacaagaaaggatgtacgaatcggtcaaaactttcttgttgcttcgatgaagtccgaattttaggaccttggagagtttgggatcgcagcacgaaaactgcggccaaagatggacttcatcgactcgctcatggccactcccggcgaaaagtgtcttttggcctgggaacgttcgtccaccactttctcctcttcagaatcaggcgccgtggctgacagcggaagtttggtggaaaaattgtcagaaatgcttcgtccggtaaggtaggaatttcgcgatcttaaatacgttttatttgaccaaaaagttattgcattagctttgatttagtgattcgattggtgttcgtcttctcaagaaaatgggctggcgtcccggcaaaggaattggcatgaaaatgagccgtcgtcagttggaacggcaaaaaggtcctctttttgttataatgttgccatttctttttaatttttgacgttcagtgatcgattcgcgcgaggctggtcgccatggtcaattcgatgaggaagccgttctcgaggtcgaagagcaattacgatcgcatttccccatcgaattttcaccggacgatgtgtcaatggtcgaactgagtgcgaaagaaaatgtgcatggtctcggctacaaaccgctggcagaaggtgccgttctgtcacaaaagtacggagtgatggaatcggcactgaaaataaccaaaaagagcaaaggcattcgtggacag

SEQ ID NO: 46078 - DNA, 588 bp, Heterodera glycines
  Genomic contig location: Contig_ID=SeqID_5594; Location=2128..2715; Strand=+
  SCN-specific regions: Sequence locations=1-60,89-183,206-209,232 -273,295-347,371-555,577-588
  Gene Ontology: Mol. function=mRNA binding; Cellular component =nucleus; Biological process=microtubule cytoskeleton organization and biogenesis
atggaaggcgttgttctagaagagactatggaagagaatgtaatggatacagaatgtaagatataaaatgaatttttatataaaattaccagtttttagtggacgacctcaaaaaaggagcagcggtaaaaaggggccgtggttttgaggggtcgcagaaaagtgctgtccaagtctatgaaactttggacgaggagggctccgtcggaggaccacagcgttctgttgaagtaaaatctgtttaaaatgtcatttaccaacaggaataaattaagggatggatagtttttgttacgaatgtccacgaagaagcacaggaagacgagggttggttgtccgatttgtcattttattttcttaaaatggatttcagtgaaagatctgttcaaagaattcgggaatgtgatgaacatgcatttgaatttggaccgtcggaccggctatttcaagggctataccattgtgcagtacgaaagccaagaggaagcggcagaggccattgccgggctgaacggctacgactttttgggacaggaattgcgagtggattggtgttttgtgaagggcgggcgcgagagaaagcgatga

SEQ ID NO: 46079 - DNA, 317 bp, Heterodera glycines
  misc_feature (313)..(313): n is a, c, g, or t
  Genomic contig location: Contig_ID=SeqID_27935; Location=767..1083; Strand=+
  SCN-specific regions: Sequence locations=1-317
caagaagtgaatgagaaattagtcgataagcaattcgccatttggcgcgttgacgccccgtggcttccgcgggtgcggcgtccgccatcaacaaaaaagggcggtgggaaggggcccatccatcactacgagacaccggtcagaaccggacgggtcattttggagctcggcgggtacatcactgaacaggaggtgatggcggtggattggtggtgctgttttaaagcgacatttactttttgaaggctcgttctattttgatgcatctctatttgcatatgccattcccagaagagatttgtcagccaagaanttga

SEQ ID NO: 46080 - DNA, 1274 bp, Heterodera glycines
  Genomic contig location: Contig_ID=SeqID_28024; Location=160..1433; Strand=-
  SCN-specific regions: Sequence locations=1-182,211-472,494-687,711 -755,777-815,845-855,920-1274
  Gene Ontology: Mol. function=helicase activity; Cellular component =mitochondrion; Biological process=growth
aacagagcgtcgattcgttgtaccctttcttcgtaaaacatgctcgttgtgtgttcccccacttggaatgtcttaaagagcttcaagtcatttctgatcttactcagccgcacaattggtaccctcttgctcgagaaatcaacagaaagatcatttttcatgcaggtgtttataaattatgcattaattttattttttttgatttttaaaggaccaacaaatagtggcaaaacttacgaggcattggaacattttaaaaaggccaaatccgctttgtattgtgggccattgcgtttgttggcatacgaagtgtatatgaagatgaacgaagcaggcaaaacaaacgtagtaaaaggaattgaaaaacgatgtttatattttataggaattccttgtgacatgattacgggtgaaaatcgtctctttgccgttgactcggacaacccatccgcccacacttcagcaaccatcgagataatgtccccagagcatagaattgaactttgtgtcatcgacgagatccaaatgctcagagacccacaaagaggtgctgcttggacaagagcactgatgggagcgcctgcggatgaggtaagaaattgggacgtaatcgtttttaaaaacatttttcctttgcgatttatcgggtttaatcaattttttttagttatttacagtaagaataaatttcttttttaaacaaaaattttcgagattttagttcaaagacttaaaaaagacgatttccttttctgcatagctttttaaagaaaaaacatagaaacagtattatttctagagaccgagatttcctttatttattttttgcctattttataagaaaaactatccttcattttttaatctaaaaaatgatttttttaattatttagttatattatacattaattaaaatttactgatttttgtgtggaaactgcccgccattgaaaaactcgtttgactggcttggagaagccggatccagactggttgaaaacagcagtttccgggtccggcctctcaaaaatcagtcaaaccgggtttatatattttcggttttctccaagactatacccatcgttgtttccataggaaaatgcttgttttacaatattcagattcatctttgtggtgaagaatccgcttatgatatcgtctgtcgtttgctggaccctattggtgaacacgttgaccttcgtcgatatgaacgcaagggcaagttggtcgttattgtaacccacggacttcgtgatctgagcttaacaaaggtc

SEQ ID NO: 46081 - DNA, 1207 bp, Heterodera glycines
  Genomic contig location: Contig_ID=SeqID_5625; Location=404..1610; Strand=-
  SCN-specific regions: Sequence locations=1-442,466-747,772-1207
  Gene Ontology: Biological process=positive regulation of growth rate
atgtacgaaaagttgggccgaatggtcggacggagttacgaggaaacgttccaatcactcgccaaatggatgaaaagtgccgaggtttgtttcgggtgacccccttctttaccttcattttctgcttattttacagtcgtctgctcgggtagaaatttggcacacaatggccaaaatggtgaagggccttggcgccggggcatttccgatttacaaagaaatttacaaaagtttggccaagtcattagcggatcgggtgagtgctataaaaaaaatttgccgtcataaaacggcggaacaaacgaaatgaaaaaatagaaaattaatttattttgcaggtgctttctgtccgtgcggcagcagcgaaagtaaaatttagcacaaattctcatttttgcagaaaaatgttgcaaatgccctaaattaattaatactttcgcttttttaaatataaaaaaccataaaagagtgtatgacccttacttcttcaatggcttcagtgtttggtttctcttgtggccgaacccgattcgccgctgtttgcccagttcgacttggaatcgatgtgcactttgtgcatcaaatcgctcaattgtgccaacttcgaagttcgccaggccattgcccaagtatttgctaaaatggcggcacgcgtcgcagcgcaaacgaaacaaagtgcgccaaatagggcatattctcttattgttaactcatctctttgggtctttttagatcggagcactttaaattttataacttttaataaaacttcccatttcttcagttgggtcgaaatcactcggccaattggccacgtccgtttcgtcccctgcgggcggcccctctctcggcccttgcggctccaagcaaactgccggcactttggaggacattcttcgctgtcttgccaacggaatgcagcggggcggagttggaggctttctgaagacggcggcgaagacggcgaccggctacaacccacggggacagcgcgagacgcgcattggcatcgccgaagtgggatagggcaccgaattagctgcctgtctaattggaaaacgtctccctctcggtgcaggcatatgtggcgatggcacacgagctgggaccacggtggctgaagaagaacattccgttttggtccaaacatttgttggaattggtcgccaaatgcgccaccgatcccccaaatgccaagcaatccgtg

SEQ ID NO: 46082 - DNA, 1123 bp, Heterodera glycines; identical to SEQ ID NO: 28048
  Genomic contig location: Contig_ID=SeqID_28048; Location=1..1123; Strand=+
  SCN-specific regions: Sequence locations=1-907,936-1123
  Gene Ontology: Mol. function=protein phosphatase type 2A activity; Biological process=cell cycle

SEQ ID NO: 46083 - DNA, 354 bp, Heterodera glycines
  Genomic contig location: Contig_ID=SeqID_28065; Location=116..469; Strand=+
  SCN-specific regions: Sequence locations=1-354
  Gene Ontology: Biological process=proteolysis and peptidolysis
actcacgcgtagcaaaaaacttcttgccacaatcaacaagaacttcgggactttggcattttgtcgccggtggttggaccgactgggcgaaaccaaatatttgatgtcactcagagacctttgcggtttgtaatagcttctattgcacactttggcaacaaaaacttttcagagaaggacattgttgcgccttatcctccgctctgtgatcaggtccaaagcccatggcaaattaacgcctttttcacatgtttcacttttctacagaaaggctgttacacggctcaatgggagcacaccattctcttacggccgacatgtaaagaagtggtgagccgtggcgaagattattga

SEQ ID NO: 46084 - DNA, 528 bp, Heterodera glycines
  Genomic contig location: Contig_ID=SeqID_28065; Location=1..528; Strand=-
  SCN-specific regions: Sequence locations=1-528
  Gene Ontology: Biological process=proteolysis and peptidolysis
ctttttacgccattttggccaattctttgcctccatccgccaattcaccaactcatccatcaataatcttcgccacggctcaccacttctttacatgtcggccgtaagagaatggtgtgctcccattgagccgtgtaacagcctttctgtagaaaagtgaaacatgtgaaaaaggcgttaatttgccatgggctttggacctgatcacagagcggaggataaggcgcaacaatgtccttctctgaaaagtttttgttgccaaagtgtgcaatagaagctattacaaaccgcaaaggtctctgagtgacatcaaatatttggtttcgcccagtcggtccaaccaccggcgacaaaatgccaaagtcccgaagttcttgttgattgtggcaagaagttttttgctacgcgtgagtctgaaacgatttagcttatacaaataaaaaccctttttttacgcattggattaacacttcacctgagaggaatgtgctcctcatggaggtcgtagttcttcatgtaatgactggt

SEQ ID NO: 46085 - DNA, 2462 bp, Heterodera glycines; identical to SEQ ID NO: 5636
  misc_feature (2129)..(2129): n is a, c, g, or t
  Genomic contig location: Contig_ID=SeqID_5636; Location=1..2462; Strand=+
  SCN-specific regions: Sequence locations=1-159,181-187,210-923,945 -1275,1305-1432,1454-1519,1541-1754,1798-1922,1960-2072,2094-2462

SEQ ID NO: 46086 - DNA, 828 bp, Heterodera glycines
  Genomic contig location: Contig_ID=SeqID_28089; Location=437..1264; Strand=+
  SCN-specific regions: Sequence locations=1-295,317-531,553-596,619-828
atggaaagaattcttagccaaaatatttacaactttctcctaaaaaacaataaaatttcggaataccaatttggttttgttagaaataggtctacgacaagtcaactaataacagttgtggaagattggtacgaggcaattataaatggaaaaaatgttgactgtatttatattgattttcaaaaagcatttgactcagtgccccataatttactattatacaaattggaaaaaattggtataaagggcaaacttttgatgtggataaagggctttttgagtaataggacttttcgagttaaaataggggattctttatcctcaagtaaaaaagttacctctggcgtcccccagggctctgtcctgggccctttattatttttgatttatattaacgatcttcctgatgctttgccatcaggagtgaaaataaaattatatgctgatgatgttaaattgtatatatgctataaagcaagagcagatacagaaattatgcataaagcattgcataatttattcgaatgggcaaataaatggcaaataaaagtttcagttcaaaaaacttttgtattatatttgggttcaaaaaacccaaaagaaacatataaatttgatggaaatacaataaatgctgtggatacaattaggaatttaggagtaaacattgataataaattacaattttccgatcatgtaaacaaaataacaaggaatgcgtatttacgtatgcgttccttgtttcgaataattaaatccaaatcatctaagatttggattacgttatataaaacttatattaggccgttattggaatacgctccggag

SEQ ID NO: 46087 - DNA, 179 bp, Heterodera glycines
  Genomic contig location: Contig_ID=SeqID_28101; Location=1..179; Strand=-
  SCN-specific regions: Sequence locations=1-27,51-120,142-179
  Gene Ontology: Biological process=reproduction
ctaattgcaagaattcaggccggtttcgcgggcgatgacgcgccccgcgcggtgtttccgtccattgtgggccgcccccgtcatcagggcgtcatggtcggcatgggacagaaggactcgtacgtgggagacgaggcgcagtccaagcgtggtattctgacgctgaagtacccgattga

SEQ ID NO: 46088 - DNA, 294 bp, Heterodera glycines
  Genomic contig location: Contig_ID=SeqID_28110; Location=99..392; Strand=-
  SCN-specific regions: Sequence locations=1-294
  Gene Ontology: Mol. function=translation initiation factor activity; Cellular component=ribosome; Biological process=translational initiation
atggctactctttcgtgccgtttttatgcggacgaattcccggaaattgacgaccccgtaatggttaaaattgataaaatcgaggaggtcggcgcatatgtgacactttcggagtacgacaataaaggtacaaaagatgcaaaatgttatttttatttacgttttgtcaaatgtttgctttttcagaaggaatgctccaactttcggaactttcccggcgtcgaattcgttctgtcaacaaattgatcaaagtggggaggagcgaatgcgttgtcgtcgttcgagtggaaaaag

SEQ ID NO: 46089 - DNA, 780 bp, Heterodera glycines
  Genomic contig location: Contig_ID=SeqID_28140; Location=605..1384; Strand=-
  SCN-specific regions: Sequence locations=1-159,181-317,341-495,528 -657,679-697,720-780
  Gene Ontology: Mol. function=ligand-dependent nuclear receptor activity; Cellular component=nucleus; Biological process =embryogenesis and morphogenesis
atggtttcccccgatttcgaatgccgcgtttgccatgcctatgccactgggcatcattttggggctcagtcgtgccaagcgtgttgtgccttcttcagacgatccgttgtgttaaaacgcaattatttgtgccaaaaactatcgaaaattggagcgaattgtcccattgtgtacagtaagtttggaaacactcctttaacattttaaagagaaagggtaacaaaataatggccaattaaaatttcagcagagaaagttttgtgccgatcgtgtcgaatggtgaaatgtttgaccatcggaatgaataaaaatggtaaaagagaaatatttatttttaattggtaggtaattaagctgtgcaattgccggagaaaaggggcggcgaccacgcgaagaagggaagggcctatttcacaaagtcgggccttctgagaaacaaacgatttgccaacaacgcatttggggtcggcattttcacttcgggataattaaataaaatggaagaaaattaaaatattttaattggtaaaatggaagtgattaaaagcattgaagatggatggatgagcagcggaggttttgaccggtcagaaaatgcgtttagtttagttgtgctgcgacggtttgcccaccgccccccgccggtcggccgattcgccgctttcctccgccgcttccgcccattccgccgattgtccctcctcctcctccgcttcgtcttcttccgcttcactaaccattcatccatcttccacttttgatcactctttctccacctct

SEQ ID NO: 46090 - DNA, 346 bp, Heterodera glycines
  Genomic contig location: Contig_ID=SeqID_5654; Location=1..346; Strand=+
  SCN-specific regions: Sequence locations=1-49,73-121,146-174,196 -265,287-346
atttgtcagatgggtgatcagcatgggctcgtgtgccaacggtggcggttattaccattattcctattcggtgttgcgcggctgtgaccgggtcatccctgtcgacatatgtcagtcattctcataaaaagaattttcttttaaatccctctcgtccatcaaccttccttaagttctttttggaaatgtccccctattttgacagtattaaaaatttgtttattgcatttccaaattgtcagatgtgcccggttgtcctccgtctgccgaggcgttgctctacggcgtgcttcagttgcagaagaaaattaagcggctcaagaaagtgcaaatgtggtatcgcaaa

SEQ ID NO: 46091 - DNA, 1761 bp, Heterodera glycines
  Genomic contig location: Contig_ID=SeqID_28204; Location=365..2125; Strand=-
  SCN-specific regions: Sequence locations=1-187,216-323,382-697,763 -893,934-1059,1082-1223,1247-1270,1294-1482,1513-1761
  Gene Ontology: Mol. function=calcium ion binding; Cellular component =endoplasmic reticulum lumen
atggacctaaactcggacggtcaagtggatgagttggaactacgggagcacatcaatttcatgcagaagcgttatgtggtgcgtatatttaagaaaaaaaaaattaattacttgagggaatttatttttttaacttagctgaaagattttaatttttttttttgaaaaatttgactgtcttcttgggtttataatttttttattttaattaatttcggtgaaattttttaatttgaaatttttgattttcactttttttttatatttctcataatcccttcatttgttttttgagaattttttaaagctttttatgtggtgcgtaatatttaataaaaatattcaaaaatttctttgatttaagaatagtatttttttaatgtaacttttgttgaaagtttttttatttcgaacatttttgactttgccattctttttagctttcccattattcctcatttggttttctgagaattttatttttggtaaaatttaatttacattttttgaaatgactgcattgtgcttatatcttttcatcgattttctaagcttcggtttaattagtttcgttttttaaatgtatttttccataagttctgctaatccctaaaatctaaacgctttttgttgaacgacggtggaaggtcagaagcaggccaaagacctgctaatttacattttaaattcgagtggctaatttataattttttattttaagtaatttcgctgaaattttttaatttgaaattttttaattttcacattctttttacatttctcataatctttcatttggttttttgagaattttataaagcttctttttgacaattttgacggccttcgttggtttacttatcttttgatcgattttctaatcttcgattcgctataaatttcattttttttttaattttttcaattaattttcttatatctgactaatccttaaaactataatggtttttgttgaacggcggtggaaggtcaaaaacatgccaaagacctgctaatttacattttaaattcgagtggctaactcccaaaattaaattcttatatcaaatttttaaatgctttccatacagtaaactcaaaaattgatttacaggtggctgactacaattcggacggtaaaatggaccgcacggaatacggctgtttcatgcacccggaggactgtgaccatatgagagacattgtggtgcaggtggattagcaaatttatttattaaaaaaaaatcaaattagattattgcttattaaagtccctttttcaatgattttcactttatatatttttcacttgtcttaacttggttgaaatatcggggatttagggcaaattcactaaatttccctaatggtaaacaaaccctcaccctaattctcatatttacccatataattttacctaattattcctaattgcttaataaataattaattgttattgatgtcctttccttaaaaatccttaaaaatttctgtacaggaaaccgtcgaagacattgacaaggacaaggacggtttcgtggacatggccgagtacttcggcgacatgtacagaccagacgactatccgggactgaagggcaaagaaccggaatgggtggagtcggaacgggaaatgttcagggagcaccgggacaaggacaaggacggcaaattgaacaaggcacggtgaaggggaagaaaaaagtggcacgaaaatggcaatttggcaacacgaggcatttctctcacccgaccattaaa

SEQ ID NO: 46092 - DNA, 3840 bp, Heterodera glycines
  misc_feature (1413)..(1413): n is a, c, g, or t
  Genomic contig location: Contig_ID=SeqID_5675; Location=171..4010; Strand=-
  SCN-specific regions: Sequence locations=1-277,304-903,926-1044,1074 -1136,1160-1204,1229-1299,1321-1876,1898-2001,2031-2403,2425 -2843,2888-3330,3352-3657,3679-3772,3799-3840
  Gene Ontology: Mol. function=kinesin motor activity; Cellular component=kinesin complex; Biological process=microtubule-based movement
atgtttttttcaaatcttttccaattcaaggttttttgtcgggttcggcctttgaatgagagcgagaagaagaacagctccacaaatatcgtcaagtttcagtccaaagacaccatcgtcgttggggtatttacaaaccgataatttctgttcaaagcggcattccaagggaaaaccgtacgcctatgaccatgtgttcgagccaagttccaaccaagaggccgtgtacagcactgccgcccgacacattgtgcaggacgtactcaccgggtacaacgggacaatttttgcctatggacagacttcgtcgggcaaaacgcacactatggaggttttacaaaactaattcggaaaatttacgatccttttggctcttttagggtgttattggcgactccgagaaacagggcataattccacgcattgtcaacgacatattcactcatatctacaattttgtgagcagctgctaaatttatttttcattgcaatctccctcctttccgacattaaatggtggtaattatttattttccaggtggacaccgaaatggaatttctgatcaaagtgtcttacttcgaaatttacaacgaacggattcgcgaccttttggatattaccaaaacaaatttggcaattcacgaggacaaaaaccgaattccatttgtgaagaatatcactgaaatgtttgtgacaaacccagacgaagtgttggcttacatcgaagaaggaaagacgaaccgacaagtggcggtgacgagtgagtgaaattcggggaaatcggaatgacaggccaatttcagacatgaacgagcattcttcacgatcgcacagcgtattccaaatacaggtgcagcaggacaacaaaacaacgctgaaaaaactgaccggaaaattgtatttggtggatttggctggtagtgaaaaggtcggctgacacaattgtcgaatttttaactttattaggtggatttaaggttagcaaaacgggtgcagaaggagcggtgctggaagaggcgaagaacatcaacaagtcactgtccgcactgggcaatgtcatctccgcactggcggagggaacggttcattttacacgtcaaaaatgaaaatttacgaaataaactccagaaaagccacgtgccgtaccgtgacagcaaactgacgcgcattttgcaagaatcgttgggtggcaattcgcggacgaccattgtgatttgttgttctcccgcttcatacaacgaaggggagacaaagtcgacgctgcttttcggacaaaggtcagctcggggaatacaaataaaataataattactaaattggccgtccattaagggccaaaaccattaaaaatgttgtggttgtgaacgaggaactgacggccgaggaatggaagcggcggtacgagcgagacngggagaaggtgacgcgactgcgccagcaagcacagcaaatggagcaggagctgcgcaggtggagggcgggcgacagagtgagcgagtcggactgggcggacttatcagcgaacatgcagcagacggacacgagtgggcaaagcatttctcattttccgtggcaggcattttcgattgtttaaatggcaattgttcagtgactccgtcaatgatgaccgattcgatggccaccttctccgaaccaccgtccaccactcagcagccgttgctgtcctctcgcgaagggcccattgtggacgaagagaggcgcaaatacgaggaggaacggtccaaactgtacgcccaattggacgagaaggacgacgaaatccaagtgcagtcgcaaatggcggaaagtttgaagcagcaactgatggagcaagagaaggaaatcaaacagcaaaggcaggacaaagacacgctgatggcagagttgcagaaggcacagggtttgccccttttttgagtttgcatattcacttcgaaccatggatgtttggcatctattgtaactaattcctcaccatggattcatttttgcattttatctttttcaatttaatcattttagagcaagtcaacaaaacccatgaggaaggggaggagttgttctcggccatccaagaactcgcactgaatcttgatcagaaaaaggcagagtgtactcaactggtgacagacaatggttgttgtttctcattccttataattaatgcttttgactcatttgaccagaacgacttgctgacgacatctccaagaaaaacctcgagtcgactttgatcaacaccaaattggaagaaatgcgtgaactttgtgtgtcacaaaaggtgcctcttctcccgattttactttgctttttatttttcacttcgcaattttagaaacgtgtttacgatagcattcaaagtatggtcaaagaaatggccgacttgggcgagaccaatttcgccttttcggaaaaggtaatttattttaaaaaaactacaacttcccttcactgacagatgcaaactgatcttgcggacaaaaacaaaccgatcgacgacgaaacgcttacccacgcgagaatttccatttcaaaactcgccagcgacttcagggccaatcgacaggtaccaccttttgacttttggtgcactttttacaaaaaatatttcagaaactaagtttgttggagacgggcactgacgacacgatgaaaaagttggacgacgtgacgaaagaattggcggactgtcgattgcaaatccaacaaatggacgccaagaacaaatcactacgggaaacgatcgatgggcaggaaaagcagaaaagacagttggagaacgaattggacggactcaacgcgaagttggcaaacgcgaaaaattcggactcggccgacgacaacagcgaactgcagcagcagcatcagaagctggtgatgcagctcagggaccagatcgcactgaagaacagtcagatcaaacagttgacggtgaattttggcattgaaaataaaggcgtcactttattggactaatttaggaatctttgcaagagctggagctgtctcgtgaacagctccagcaagactttgaacgccttaaaaatgacgagactgaaaaggagaagcgcctgaagtcactgtccgcactttctgacaaaagagaacaggcgaagcaggatttgaagggtaatttggcatgcgatgagagagtaaacgaattgaataatccgtaatgattaagggttggaagagacggtgaacaaggaattgcaaactttgcacaatttgcgcaaagtattcgtgcaagacttggcacagcgcatgaaaaagacgccgaccggacccgagggcgacgaagaattcttgtcaagtccgatccaaaagcagaagatcatcttcctggagaacaacttggagcagttgaccagtgtgcacaaacaggtggaacattcatttggatggaatttgaacaaccgttcccttttctgttcagctcgtccgcgacaacgccgaactccgctgcgagttgccaaaattggagaagcgataccgtgcgagttcagaacgcatcaaaagcctggaggtcgccctccgagagaccaaagagaacgcgatgaaggaccgcaagaagtaccagtacgaagtggagcggatcaaagaggcggtccgacagaggaatttggccaggagggggctgcaaattggtgtgccatccttttttgtccctttccactgggataatcaattttcttttcagcgaaacccatccgtcctggtcagcactatggcactgctcgccctgtgaacggtcagtgcttttcccatttgcctttggttttctttgcctccctccgttcgctgctaatccgtcttctgactgattgttcactgattcc

SEQ ID NO: 46093 - DNA, 1440 bp, Heterodera glycines
  Genomic contig location: Contig_ID=SeqID_28277; Location=39..1478; Strand=-
  SCN-specific regions: Sequence locations=1-230,252-412,435-715,737 -1062,1092-1284,1306-1440
  Gene Ontology: Mol. function=snoRNA binding; Cellular component =mitochondrion; Biological process=processing of 20S pre-rRNA
agatccgttcttcttttgctggacatcgtactggtgtcaattgcattgcattcagtgctgactccctaactttggcctctggtggaaaagactcttcaattgttgtttgggacttggtcaacgaatcgggcatttgccgtttgggtggccacaaaagtaccataacacatcttcaatttgcacaacgcgaccgttttttggtgtccaggtttgacttgaaaaccctccgaaaacagtgaaaatttcagttcaaaggacagtcaattgaaattttggtgtctgacgacaaagtcctgcttctataccttggccagcagttcatccgaagtgtacacattcgcactgattgacgatgaccgtctgctgttggtgggcaatgcggagatcgaacttttggtgttcgaactgtgctggcaaggacaagacgggtgggaagacgaacgaacggagcgaaacgaggagaacgaagacgaaggggaaaagaggccacgaacgacactcgtgggccacgaccaattgctgctgttggactctgtcgaaaagggtgatgcgtttgacacggaacagcaagcgaatgtcagtgattgtgccctcacacattaataaatgaaaaataacgaaacttttaaattaaagtagggcaatctttatgcttaattttggataaattaatgtctcactcctacaattctttctgtattaggttttgccaacgagcaaaattccatcattggcttttaattatcaacgattcttttagagaattttgcgctgcattaagcggggagcattgatcagacaagcaaaaggtcgcgcacttcaattggcggtttccagcgacgaagcaatcgtttgctgtgtggtcggtaattaatggagtaaattaacaaaaggaaaggagtgcattttagggttccgactcaatgttggacatttacaggtcaatcggaagcatttgttattcgtttactttccttttaaggcatttcactgttgaagaaagcaaaaaacggtaccaaaagaaactgcggaaactccgactaagggcggactcgcaaccaatggaaaggtgttttttaaactaatttttcacgtgaactcatattttcctacccacagtttcttttggaatttttatagcgaattttgtaaaagaacaaactttttgggactgaaatttaaaatagtcaattttctgcaataaaactgttaaaaattgcacattttcatgccccgtatgccgtttttatgcattttatcattaacgcaaaaatatttagtgagaaagaaacaaatgaagcaatggaaagtgaagtatcgcgtgatgtcactactctgatcaccagaatcggggattttagagccgattccaagctgaaatgggtcgatttatgtgaggggtttgctgaattgaacaacaaaaatgttcgagaataccga

SEQ ID NO: 46094 - DNA, 771 bp, Heterodera glycines
  Genomic contig location: Contig_ID=SeqID_28283; Location=90..860; Strand=-
  SCN-specific regions: Sequence locations=1-246,268-771
atggcattccacaaaattgacaatgacagtgtgaactccatcaccaatgccttggactttttccgcatcccgccaaccaacgtcagcgtctcatcctccaaagtgtttgaactgctcccaagtaaccctctgaccgacaccccctatcacttcaagcttcactccagtcaaaattatattgatctctccaaatgctatttactatctgagtttcgaattcgcaaagaaaatgcaaatggtcaactggttgaccttgcagctgatgaggttgctccgattcaactggttggacacacattcatccgtaacatcaaaatgagcatcaatggccgtgaagtgttcaacgcaaattctctgatggcctacaaatcgtatttttcacacgaactctcctattcaacagcggccaaggactcgcatttgaatgctgcaggttactaccgtgacactggtggtgtgcttgaggtgggagacggatgcactgcacgacgcaacctgtttgtaggcagcagaacagcacaattcattgccaaaattgacgccgatttgtttaaccagcctctctacttgatcaacttttgtgagttggacattgaaattttgcccaacgacaacgactttgtcctaatcacaccacccggtgttgctgcagccactcgctaccatttcgaagttgtcggtctgaaaatgtatgtgaagaaggtgtccctgatggacggattggcgttggacattgcacgaaaacttgagttgaagccggcacgatatgca

SEQ ID NO: 46095 - DNA, 611 bp, Heterodera glycines
  Genomic contig location: Contig_ID=SeqID_28289; Location=234..844; Strand=+
  SCN-specific regions: Sequence locations=1-94,120-208,240-537,559-611
  Gene Ontology: Mol. function=heat shock protein activity; Cellular component=centrosome; Biological process=reproduction
atgactttttcccatgctgcaccagtgcttttcatcatgtttgccattttgtctggacaatccggcgaaacctttgcgttccaagcggagatgcccctgatcatcaacaccttctactcgaacaaggttttaaaatgggaaatgctctgggagtctaattaacccgtaaagtctaatctaatcagtttttaaaatcttaatctggtttaggaaatcttcctccgtgagctgatctccaactcctctgacgctctggacaagatccactaccaggctctgaccgacccttctcagatggagagtggcaaagagctcttcatcaaaatcgtgccgaacaaagccgacctcgtcaacaaccacaaacccggaactgaggcgttcattgaggctcttcaggttttgttttttcgtttggtcaacccctaatccctaaaaaacacttttgttggtaatactggagaatctggactccacccaaaaaatcatttttaagttgtggaaaaacaacccgggattttcggcccttctgatcacgaatatgatatcagatttgcaaaaatgatttattttatcattgtctggtttttgagaccttagatttgaaattttga

SEQ ID NO: 46096 - DNA, 1333 bp, Heterodera glycines
  Genomic contig location: Contig_ID=SeqID_5693; Location=3241..4573; Strand=+
  SCN-specific regions: Sequence locations=1-736,760-1031,1053-1333
atgacttgcctacaaaaaatcagcgacagcagtcctctagcaattaacagtggcctaaacattttctcagttccaccgaccaatgtgtccgttgttcgctcattctttcgtcaggtgcttccactcgcaacaataacgcaagaatcgccttatctatttcgtctttacagtgacaatttgtggactgatttgtctcgggtttatctttatctcgaagtgtccattgaaaaaccaggagcaaacgataaatgggttgcaatagaggacggggatactcatgtctctgccattcaagggattggtcaaacatttgtccagcaactaaaagttacggttggcaacacggaagtatacgatagcggaaacctatacccattcaaggcttatatcaccaatgagttaagctttccaataaatgccaagaaaaattttcttggttcaacagggtattatcacaccgtaaaccaagatgactcaacagacgaggggttcaaagagcgttgtaaaatttttaagggtggaaaaaatgcgcaattcctctcccgtctcgactttgatttgggaaaccaagagctttatctcttaaacaatttggatttgctgttcacaatttataaggctaaagatgtctttcttttgcaaactttaaaagcaaatgattcaaccaaatatcgtttgacagttcacgatgtcaagatttatgcaaaaatggttgaggtccaaccctcactaaacatgagcctttacaaaacccttgaaaaacaacccgccacatacgcagtacgcaagaccgaaatcaagtcgtcattcatcagtgtcggtcgatacgaatttgagtacaatgtattcagtgcaaccattcctcgacgtgtgacaatcgcgttagttggaaattcagcatttcatggtgactacaaactgagtcccttcatgtttgagccgtttgatttgcgtgagatttcggtacatgctggtggcgtagtttacccagctgttccttataaactaaatttttcaaatgatcactttgtcagcgcctttgttgacatgtatgaggcactcggaatggccaattcagaacgttcatttgacatttcaatggcccagttcaaaaaagggtggaccttttttgtcattccattgacttcaacgcttgacgacagctgtggatttgagctgttgagaagcggtacgacaaacgtacgagcaacattcaattcaccaattccgcttggtggtgtagagatgattgtcttgggtgaattcgaccaaatgattatggttgattataaccggcacattgtgaccgattcaaagcttggataaattataa

SEQ ID NO: 46097 - DNA, 1177 bp, Heterodera glycines
  Genomic contig location: Contig_ID=SeqID_28316; Location=1..1177; Strand=-
  SCN-specific regions: Sequence locations=1-120,142-510,533-553,583 -1148,1170-1177
  Gene Ontology: Mol. function=DNA binding; Cellular component=nucleus; Biological process=photoreceptor fate commitment (sensu Drosophila)
aggacttcttccactccttcggcgatgggtcggcctcttccccggccggcgaaggtccgtccaattcagtcccaagcgggggaggcccttacttctcgtgaagggtcggcctcttcctctcgcctcgtccgcctcgtccattcctaccttttgttctactcggttattcgtcctcttctgccaaaacttccgccgcttcgacttcgtcttcggcggcggcaaaatcgcaagaccgaaaaaggccgtacctgtgcccgacttgcgactcgcgattcggttccaaaatggaattggaagagcatcagaactcgcacaccaggattagaaaccagttccaatggcgatggtaatcttcaaacatggccaatttcaatttgcattgaatgcccccgccccctcccgcccctccccggctaaaggtctgtcagtcgcggttcaatcgacgctccactctttggaaccataagcgaattcacagcgacgcgaagccgttcaaatgcacagtgtgccaaatgcaattcaaatggaaaaattcgttgaaatgccataagtgggaaaagaaagagaagagaaaagcacacaaccattcccacccaaacagagaaatgcatttgcgaaagaacgaattgagtcaggggacaatgccggacacggactcgcagcttctcacttatgcgacggccgcaaaaaagacaatggttcgcattttgctgctgtggcccattaattatggtagcctagggatcgctctcttctcaaatggatgccatcggtgccgctgcgtcgccctcggccgctgtgctgccccctccggcgatggctgtgcttccctactcggccgccccttcgcgccttttgacatgtgccggaactccccggaagagagcaccgccaaagagcgggggaaacggaaaaggactcaaagttggcaagacgaacgatccaatggagcggagaaaggacggcgaaggggcggacggaaacggcacaacgcaaatcgaaacggtggcggaaggacagctaacgcaattcggcattaatttgttcggaattggggaagtggcggagatgacacagctgaagaaggagtcgaaatacgcgcagcagaccgaagagattgcggcacttcggagggagcaggcacttcaacaacgccaacatcagcagcaaccctcgc

SEQ ID NO: 46098 - DNA, 1587 bp, Heterodera glycines
  Genomic contig location: Contig_ID=SeqID_5699; Location=1..1587; Strand=+
  SCN-specific regions: Sequence locations=1-43,65-518,540-585,607 -1123,1153-1172,1202-1236,1258-1310,1336-1565
tgtgcgtaaattgccctttccattggaattttttacgtcgtccataaaaatgaatgatttctcagcttccatcaacaaatagcagcgaattgcactggagctcagttcttctctttcgcgctgcttctcaacaattggagtcgtcccaattgcttcggctatttgtggcactttggccttgattggcaatgccatttaatcgctccctttctcctccatttgctcttccggcgacaaagcgtcggtttgattgtcgtcgccgttttgatcatcggttcgatgtgtcttcgtgctttcaaatgcgtctccaatggaatatgcaataaaagtgacgtggacattccggtgggttcactgctttggacattggcatactcattgtcagatagcataagactcaatgttatgtaaagaaaattgttatcgaaaatataccaagaaatcggacccattcgcttgcttaaaccatctcttcctcttccaatgcgtcagttcgtctccgtccgtcctgagcatgtgtcccttgtccaaatgtacatgcgtcccatgacaaaatgtggtccttttcttgtcggccttctcctcggtgtgttttctttgtctctcaccgattcatcgccgccaaaatgggccgaaaagctcaaaactcagcaaaaaaagcttttctgtgcgggtttttgtcttgcggtcggttgtgtttatgggattctgccggagtattggtacccaaacgacggagtcactctgtacaacactctctacacggcatccttccgaacactgttcgcttgtggcatcggactgatgatgctcagctgtctcctctccataaaaaggtctttaatatgtcgtcgagtttcccgtgccccattttttatttttgttataaaaatctgtgagctataagaggcatcggattgtttagcattaacccagccattaggtcaatcagacccaatcaaaatctaaaagcagactgacccaacgcagagatctagcagcccctcagggtaattgggtggacttaggacattgggtacagaccgaggagcaaatgacagcaaaacaaaagggaggggacgaggaaacgataaaatatgcaacaaacagcaattaaattcccttttgttcattttttccctttttgggcttattttggaggaattatgttcttataaatataatattacatttttatttacgtagcatcgaaaattttttatttcattctaaagctatttttaataataattaatagtaaaatgtccgctgtcatgatgtccatttgtccacttctgtccaaatgtccgttttctctttcttttcagcttttttcggcctcgtctcatccatcgaattttcgctgtgttcgcccgtctgactttctccgtcgctctcactcacatgcccatcgtttttctcttcacgcgtatcactgccttccaagagacagaatcaccttttagcttaatcatcgcccttccccccgcaattttaatgagttttacggtcgccacaattttctattgttttatccactggccaatttcacaaattatttcccgaataattaaataaattatttaa

SEQ ID NO: 46099 - DNA, 2758 bp, Heterodera glycines
  Genomic contig location: Contig_ID=SeqID_5726; Location=2837..5594; Strand=-
  SCN-specific regions: Sequence locations=1-106,129-713,735-915,952 -1082,1109-1132,1154-1570,1601-1710,1732-2192,2214-2399,2421 -2727,2749-2758
  Gene Ontology: Biological process=gametogenesis
atgcgaattgttctctcctcgagaaggtcatggcgttgcttagcggtaatttagacatggacaaaggaagaatggtttcgtcgttgactaccgggttgaaaggtgcgttattttctgactttttaatacaatgctttttggattaaggccttttcgtccaaaccaatcacaacgctaccaacattcaacgctttccaatcaaggggctggaaagaaaaggcgctaatgagatgcaaattgaggttgatgggaacgcctccacaattgagcagtattttaacaacaaatacggtcgtcgtctggagtatgaaaaaaacatgtttggttgaagtgaaaatatctttagctacccaaaccttcctttgattgcaatgaattcgagatttgccaatgagaagcgagtgaattactacccaatcgaggttttggacatcattgacaatcagcgagtcaccactcagcaacaaactccgacaatgattcagcagtcaatcaaagtttctttcctttattagtaaattgtgcatatatgtattctagaagtgtgccattccaccattagtcttcaagcgtcaggttcacaacactgcgaagtctattcatctctgggacagtgaatatctagatgaggcagggattaaattgactaccgagccaattgccctcgtaagtttttcattgttttgataaacgattcattcacctttttgaagagagctcaccagctcaaccatcctgaagtcaaagctggcgacggtaacatgcagaggccgatggtggaaggttctgctgcttggcgaatcaacagtgtgctggtccctcaatcggtgtttgctgacggtacttacagttggatgttggcgtgctttgttcaacttggtggtcgcggtcttagcgagccagaccttcagtatgtttccataaaaaagtttttatttatcaatttatttaagcaaatttatccaactgcttgaagaccaggcaaaaagacgaagccttaaacttccagcccttccaagggaccatttgcgactggtgaatttccgatcaaaagaagtaataatctaattcgtggccaccacaaaccttttaatttttattttaaggacatttcagcgctgttccaagaggcttctcaatcaggaattgcttttatgctttgcattcatgccgatggggatgatttggcacatcactttatcaaaaaatgcgaacgtgactaccaaattatcagccaatgtgttagggctggtactgttagaaatgtcgctgcgaagcagcaacgtctcactgtagacaatattctgaataagaccaacgtcaaactcggtggtatcaattacaatcttccgcgatctccgtgagttttagtgctgctattttcctcttaattaaattgttttaaggtttgttactagtacggacatgcttattattggtattagtaccaatcatcccggaggcggtattggcgagcgtcctatggctgaagctgaaacattacggagtgagactctttctgtttcgtctgaggagtccattgttgctggtcctccttcggtcgttggggtttgttcatttattataattttgcttttttcttactatccataattttagtttgcggcaaacgttgggccgacaaagctcccatttgatttcgttggcgattttatgtatcaggttttgtcgcagcttgttttttaaattaaatctttattttagagagctcggcgtgaagaaaaggtcaacatcatcgagtcgatcgttgggaagtgcgtgggctactttaaagaagtcaggggaagtttgccaaggcgtgtcgtcatttaccgaaacggatgcagcgagggacagttcaaaatggttttggatattaattctttctggtgtatcatttactttaagatcttgaaatttgaagttccgctgattcaatgcgctttgcgttctgccggttgtgataatgtcggtctgacattaattgtctcgaacaaactgcagaatgttcgcttcttcagcaaacaggtaatctttctttcctctgaaaatttgatatgctcaaattcaacagattcaacctaatgcgaagccccctgaacaaaacatcaaaccgggtacggtcatcgacacggctgtagtgcatccgtcaaactgcgaattctttctcaattctcatcgtactcttcaggtttattttttgtatgtgcaaaacccattaagattttttaaggggactgcacgtaccccaaaatacaccgtagtctacgacgacaacaaattcagtctcatggacctcgaggaaatgtcttaccacttgtgctttggccatcagatcatcaattcaatagtttctttgcctgcgcctgtatttaaacatatttacgactcgattctttactcaattttcaggtttacatcgcaaatgaatatgcaaaacggggccgcaatctcttcaattactatgatgctccacgtgacatggaaacgttcgctgatctgaatcagaagctttgtctggaacatgccggttggattgcacctcatcgagtcaatgcctgattttgagagaatttcttcgtacaccatttgatttccctttgtcccttttttaaatttaatttgttcccacttaagatttaaattgttcccacataagatttaaattgttcccatttttaagatttaaattgtttccactttctcatttgtttctaaattgttgtttaattattttcatttatttagatttaataaa

SEQ ID NO: 46100 - DNA, 1045 bp, Heterodera glycines
  misc_feature (466)..(466): n is a, c, g, or t
  Genomic contig location: Contig_ID=SeqID_28433; Location=483..1527; Strand=-
  SCN-specific regions: Sequence locations=1-258,290-384,406-577,599 -1045
atgaacacgtatttttccattttcgcacaggttcgcctttatgacaacaatgcggagcgcgatcgaattgacaacatggctgaactgtacgcgatggtcaacgcgttggagtgcctggagaaggtgttcagccgggattatatccacgccaaggagtacacggcggaatgctcaaaactgcttgttcaaatcaaggttgtactgtttgatcgacgtcgaaaacattggttatatccttacacctttacatttttaggcatttttaaagtattttatttaaaaattaaaaggagtgacacttatgtttttggcacaacatttcaggggtagcgacgatcttttttgttgcattttacataaaaaaaactatttaggtatgtgatttttgaaagatataaaattttttgctataacacgcaaaaatggccattttaattgcattcggaattagtactttcaaaaacanaagttaaggtggctttgcgattggttccccgcatgacaattgacgagtttttccgctcatattacattcaatgcccggccgcgttggagcgtattcgtgaggttttttttaattaaaaaagagcaaatttaattttcggattcacaaatttgtgcataaaatttaatcgttaggaccgacccattacggtgcgcgacgacaaaggaaatgctctcaaatgcattgcggacattgtggagctgttcatcacattcctggaccaattgaagctgaacattcgcgcggtggacgaacttttccccaatctgaacgacctttacgcctccatcaacgcaatggtaggatgctttttttattcctattccacatttttcagagtactttgccggacgatttcgacgccaaactcagggtgaaatcgtggtaaatttggtgacgtttttattgtctgagcatgacgactttttcaggcatgacaagctgcagggaatggctgctcatgaggagattacagacgaagttgcacgacaggtaattttggaaggcaacaaaaacagttacgatgattccctgacttag

SEQ ID NO: 46101 - DNA, 3186 bp, Heterodera glycines
  Genomic contig location: Contig_ID=SeqID_5734; Location=4..3189; Strand=+
  SCN-specific regions: Sequence locations=1-122,144-785,808-1009,1031 -1253,1275-2138,2178-2322,2344-2671,2693-2697,2719-2888,2911-3186
  Gene Ontology: Mol. function=isoleucine-tRNA ligase activity; Cellular component=cytosol; Biological process=protein biosynthesis
atgatttgtccggtcgacaattcgggctgtttcacggatttggtgcccgacttcaaagggctcttcgtgaaggatgccgacaaacaaatcatcaaaatgctcaaggagaagggacttctggtcaagcaggagcagcacaagcacagctaccccttctgctacaggtcgcagactccgctcatttaccgtgccgtcccctcttggttcatccgcgtcgagtcgcttgttgaccgactaatgaccaacaatgaagaaacctactggtctttacttgaaaaacgactcctttcaacccaataacatttttagggttccttccttcgtcagagacaaacgttttgccaagtaaaggatttttggcttcatttttgcgctaatactcaaattcaagttggttgcgtgatgcgagggattggtgcgtgagcagaaatcgcttctggggcacaccgattaacctttgggtgagcgacgacttccaagaaatggagtgtccaggatcaatcgacgaattggagcgattgacaggcacaaaagtcactgatcttcaccgagagaagtataattttggaatgtcaacgtagttattctttgctattattttaattgggttatatttcagcattgaccatcttcaaatcccctcaaaaacgggccacggaatgctcaaacgtgtcactgaagtcttcgactgttggtttgaggtgctttgggtttgatttttcctctgcattttcgcttcccttttagtcgggttccatgccttatgcccaacaacattatccatttgaaaactcagaagtttttgagcacaatttccccgctgattttattgcggaaggttaacttttgtaaattctctttcatctttgatttttctggcatttcctttaggcattgaccaaacccgtggatggttttacactttgttggtcatttccaccgctctgttcgaccgtcctccattcaaaaatttggtctgcaatgggctcgttttagcttcggacggaagcaaaatgtcaaaaagcaaaaagaatttcccaaatccgttggatgttgtcagaaagtacggagcggatgccttacgtttgtatttgatcaattcgccggttgtccgtggggagaatttgcgcttccaagaggaaggagttgccgaggtcagcaagcaggtgctgaacccgtggttcaacgcctacaaattcctcagcactgcgatgagcatctatgaaagtgttcgtttgacccaacaaataaatatacattcatttgtcattcattcttttacagaatgacaaacaatttgagctgcgaagcgccggtttttccaatgtgatggacctgtggattttgtcgtttactaacagtttgatcgcttttgtgcgcaaggagatgaagtaattatcaatcagtaaacgggatgaggactaattcatacatgtacaaggggtgtctcagcccagggccatacgacggacgattgggacagaaggggggggggtgtctcgggaccgattttttatacgaaggtccaatttttttctggcgacctttttttgttgctattcagccacacttttttgcggcgtgttttacaaatggggaaggagtgacgggcgttccggcggtgccgataggcgtcgccgggaaaatttttttgtaattttgtatggatttcgctaaggaaattgttcaaattttcccccttcgttaaccacctccctccacgagagaccccctccctcttttacagccgccccacttacgacgaacgagaggggggggggggggcggggtgtcgagacctccttgtacatatatggactaattgccaacgaattaggggaattggttttttgggcatcaatacttcggctttttgaatcaaaatgtgtcgaattttgactccaatccttttccgttccctgttgtcgtttccttcgtttaaaagtgcaaatgcttcctcatcagactgtaccatctctatgctgtggtcactccgctggtcagctatttcgagactctcaccaacacttacattcgcttgaaccgttcgcgcatcaaagggactgtcgccggtgcgtcggccgatgaccaaatgttggccctctccaccctttcgcatgtgctgttgcaaatcactcgactgatggctccgttcactcctttcttctccgagttcatgtggcaaaggctaaaaccgttggtttgtgcgggggggggggcaaaacagaaaagtcaagtccctactttctaatatttgtaaagattggcgatgctgcggaaaagtcggtgcactttacgatgttacccttggcagaagctcagttcatcgacaaagtcgtggagcgtcgggtggcagcgatgcgaattgtggtcgaaattgtcagaacgttgcgggaacggaaaggaatatctgtgaaggtgccatccaaaattgccatttcattaatttttatttcggcatttttagtacccactgaaagaaatggttgtcataaacaggtcggtatttttcgcaaataaatatcaaattgacaatccaataattttttcaggaatcagcagttccttgacgacctcagctcgctgagggaatacattctgtccgaatgtaatgttgaggaaatgaccgtttcccaggacaaacaaaagtacggtgttcagctgaaggcggagcccaactttaaagttttgggagcgaaattgaaaaccaatttgaaagcagtaacaaattatttaaaagtgatgttttctttcgattaaatgtgttccagttcaatgcctactctctctctctgtcattcagaatcaagtaactgaagttgaactcgaagcactgttggccgacgggtcgctgactgtgctgggacacgaattgacaacggaggaagtgaccgtttcgttcactgttaacccgggcaacgcgacgaaatccaatgacaaatgggaaacggcgaccgcaaattcagtgagtcattcgctcacttttgatggtttctttccattggttggtttttgcagtgcgttgtgatggtcaacacaactgaggacgactctttgctttcgcgtggatttgcccgagagattataaaccgagtccaaaagctacggaaacaggtgcttacagtgggacaattacagttttctaagattatttttgtgatggcagggcaaattggtcgagactga

SEQ ID NO: 46102 - DNA, 2297 bp, Heterodera glycines
  misc_feature (48)..(48): n is a, c, g, or t
  Genomic contig location: Contig_ID=SeqID_5735; Location=203..2499; Strand=-
  SCN-specific regions: Sequence locations=1-241,263-335,358-459,481 -1197,1219-1783,1816-1827,1850-1957,1979-2058,2080-2145,2264-2297
  Gene Ontology: Mol. function=cysteine-tRNA ligase activity; Cellular component=mitochondrion; Biological process=tRNA modification
attgccaaattcgagactgatctcgttcaattcaaaacgcgtatttcncagccagacaatgggcaatcagctgatgttcgcactgttttggtgcgcaaattggtggaaagtgcgaaagaagtgctctccgattggttggacgttacccggggaaatacggtcactaaacacgacattttcgcgaaattggccagaaagtaaggaaatccgaatatgcctttatttgagtcatgttttttaaggtatgaaaatgaatttttgtgcgatatgaatgcgttaaatgttcttgagccggacgtgttgaccagggtcagcgagtacattcccgaaatcattgattatgtgcagcaaatcatccgcaacggatacgcttatgtgtctgatggatcagtaagttttttttgaatgcatttgatctctacagtgatccttttataaatgtttctttagcctttctttttacccaattttattccttttaggtgtattttaacactgcccaattcgcatcaaaacccaaccattcctatgcaaaactcctccccgaggcgtatgctgatgcagaaagtgcggaaaaacatttgcgagagggggaaggcgaactcagcgtggcagtggacaatttgaaagtgcgcaacaactgcacccctttttccccaattaattaattgtcgaatttattgcagtttttgtaggaaaagcgctcgccgtcggattttgcgctttggaaagcctccaaagacggagagcccttctgggaaagtccctggggcaaaggtgtgtcatttattccacatcacctgttttccaatttgttttctgttcaggtcggcccggttggcacatcgaatgttcggcaatgagtggggccatttgcggggacaaattggacattcacgccggcggatttgatctcaaatttccccaccatgacaacgaaattgctcaagtgagtactctaactgttgatggaaaattccgttttgaatattttttcctttaagtgtgaggcgtacaatgacaacgatcattgggttaactttttcctccattgcggcacattacgaatcgaagggctaaaaatgtcgaagagtttgaagaactttgtgacgataagggaggcgttgaacaaatacactgctcgacaactgcgcctccttttcctgatgcacaattggacggacaatttggactacaggtggaccaaggaaatggaggaaaatacggaattagacaattatggcaaaaatgaaattgcaatcctaaaaaataattattgtcaaaatgttcagcgaatcgacgatggaacatgccattcatttcgaaaaatgtttctgcgaattcttcctcaatgtgaaggatattataagaaagcaaattaaagaagtggatgaattgtcccaggtaaaaataattttaaatgataacgaaaaatttaaaaatttcaagtgcttcaaaaaatacggtgaagaggagatggaagtgctgaacaaattcaacgcgatcaaagtgtccgtgcatttggccatgtgcgactccatcgacacacgcgcagttcttgacaaaatcaggacgatcatttcccttctgaacacttacattatggtccggaaacaggaggaagccgtacttaattgccaactgctgacaaaatgtgccaatttcgtcagagaattgctttgcatatttggcgtacagccggacgtgggcaaatacgaattctttactaaagactggtaaaatattacttgagtaagctcgatattctgcaacgaccataccaaattaataactttttgtttttacttttaaaaatttaagaatggcgcaatgattattaagccatggaatcaaaaaaattctcattttagctgcgcaacttctgacgacagagaagcgattatcatgccgtacttggaaatacttgcacagtttcgagaggtcgtcagaagcgaggctcgggcacagaaaaacattggaattttgaaagtacatttaaaccagttaatatttcaaactaagtttgctccattttccaggagtgtgacagactgcgcgacgaaatcctcccggaattgggcgttcggttggaggaccacagcaaagacacttgtgttaaattggtggacagagagacactaattaaagagagagaacagaaagaggcagcgcagagagaaaaagagcaacggaagatacaactgcagaaggaaaaggaaatgaagagacaggcgaaggaagagcagaaaagaaagacgagagagacacaacagaaaaacgaaagggaaaaccaatga

SEQ ID NO: 46103 - DNA, 1500 bp, Heterodera glycines
  Genomic contig location: Contig_ID=SeqID_5736; Location=1049..2548; Strand=+
  SCN-specific regions: Sequence locations=1-158,180-257,279-1193,1216 -1452,1488-1500
  Gene Ontology: Mol. function=death receptor interacting protein activity; Cellular component=membrane; Biological process=induction of apoptosis
tgaacgaataataaatacaacaccaaaactatcgttgacgttccttcccttttcttcatctcgaagaagtgttttctcgaggcgtttaaactgtgttttacttcaatccttcaaaactcaaaagttcgattaaattcaattttgaaagaagcaaaagaggaaagagacggagagaaaagcggcgggcgaatgcaccggcggaatgagtgaatgcatctgccgtccgtctgccgtccgtctgccgatcagacgatgggcactcactcactttccctcccagcttttcctctttcaactcgccgttcatcaattcactatcttttttctctttcaaacgaagggggaaggggaaggacagctgttatttccacaattttttccattaccaaattttgatcgttactttgtccctttcccttgtctcgtgattcattacaatgaatttgactgacattcataccatcacatttcaatcaatattaaactttgccaaattcaattggctttaacccctttccctcaggctttacacaattttattcttgtattttgtcgatttatggatttgacctcagattctattaccaacattgacattgatcaaatgctgaaacaaatcaaagcgatggttcgttcgctcgtgttcattttggttcaattattgcttaatttttaggttttcaaattggctgagaatggtgattcggaaagattgcacactttgctaaatacattaaacacggaacaattgaaacatttgctgaacgtgaaagaaccgcgagagaatggcagaaatatgcttataattgcggcacgaaacggccatataaaagtggtcgaacttttagtgagtgaattcaattaaaataaattcggaaatgccgttttaagttgaaattgggggctgacccgcatgagactggcacagtgaccttcgacggtgaacagataagtcagtgcactttaatgaatatatttgggtgctgggctaaaaaggcagttttttttatgactggtatgccattttatataaccaaattcagctcgagttcctccgctttgggccgcggcggctgcgggacatttggaagtgtgcaaacagttggtcgccaggggagtgaatgtcaaccaaacgacgagtaccaacagtacgccattgcggggcgcatgttatgacggaaatttggacattggtaattgaaaaaatggacgacattattattcattactttatttgtgaatttaaaagggcactttcacatatttggtttagtcaaattcctcgttgagagcggcgcggacatcgaaattccgaatcggcacggacacactgcgctgatgatagcatcgtaccgagaaaaagtggaagttgtgcgctatttactttcggttggggcacaaacggacagaacatcgaccaaaggttttttttgttttgttttgttgtttatgtaaaatttgaaaattgtaattattattatttaatactaattccatttc

SEQ ID NO: 46104 - DNA, 1531 bp, Heterodera glycines
  Genomic contig location: Contig_ID=SeqID_28460; Location=237..1767; Strand=+
  SCN-specific regions: Sequence locations=1-207,230-373,395-771,793 -813,837-846,875-903,925-1438,1462-1483,1505-1531
  Gene Ontology: Mol. function=transporter activity; Cellular component= secretory vesicle; Biological process=locomotory behavior
atggtgttcaaaacggagcgcgaacggcccccgcactgtgtgcatgacaatttggcattttatgtgaaggagcgacagctgcgccgattggacatgaacacgaggtgagattggatgggtatattgcatcaatgttttcaaagcctttacaattagttaacgaaaatctatccaatttagttttccattgcatttttgttcctaaattttgattggatgacacttattgttattaggtaattgcgatagttattcaaaaatgggttaatatcaaattttagcccattttcgaattgaaaactttttacaatagccgtagtcagatgtcgtgtttatccaataattaaatttactatgaaaatagtcctcctttaggggaaaaactaatttttaatttccagcaaagacgtggcgttggctcaggtgaagctgaacaagttgactcagccgtactattcgctgcattacaatccggcggagaattgctttttgctcgtcacgcgtcccgccgcaaacattgagaacagcacatacgacttgtacaaggtttctcaaaatttaaacgcatgatgaaatgaatttttggaatatttaacattttttatgttcccatatatttcctcctaaactttgcacatttttcgcacagatttcggccaaggaaggcgagttggacccgctggacgcgaaacggtcgccgggccttgccgctgtttgggtggcgcgcaatcgattcgccgtgttggacaaaacgcatcagctgaccattcgggacttgcagaaccaggaaagtcggaaggtgagtcgtcaattaacttgtttatttatttcagacatttctgccaatttgaattttaaaaatgtttgtcttcctaaaattacctagaaattttcgaaattatgtttttaagaaaaatgctttaatgctatgctattttttcacttaaatcttatattttatcaccaattggtcaaggttgaatacacgggtgccgtcgacgacattttctatgctggcacggggctgttgctgttgaagaacgcggactctgtgcaaatgtacgacttgcagcagaagcgtgtgctggccagtgtcaaggcaacaaaggtgttgtaacacaaaactgggtgttcaaaattactgaaaatttgaaaaaaagtgtttgaaattgaagttttatccaacgataaacctaaatcgtcactctgtttccgcaatgtttttgctttcaggtaaagtacgtcatctggtccaagaacatggaatgcgccgctttgctcagcaaacacaccgttaccctcgtcaccaagagattggaggtggcgttgtactctttggtctcgtctttcaatcttttttctccaggtgctcggcactgtgcaggagtcgactcgggtgaaaagcggcgcttgggacgcgggcaatgaggcctttctgtacaccacctccaaccacatcaagtacgcgttgaccaccggaggtgaccatggcatcatccgcaccatggatattccgcggtacattttggcg

SEQ ID NO: 46105 - DNA, 2862 bp, Heterodera glycines
  misc_feature (1794)..(1794): n is a, c, g, or t
  Genomic contig location: Contig_ID=SeqID_5743; Location=1625..4486; Strand=+
  SCN-specific regions: Sequence locations=1-209,231-653,677-870,894 -1457,1480-1506,1530-1628,1651-1700,1723-1752,1776-2348,2378 -2434,2456-2862
  Gene Ontology: Mol. function=protein binding; Cellular component =mitochondrial membrane; Biological process=mitochondrial fusion
atggctgcgaccattaatcatatatctgcaagcaacggaaatgatcaaaaacggcgacatttggcaagtggaaatgagccgttgcaacgcttcggagaggcaaaaaaatggatgactgatatctatgggcaattggatggacatgttggagagttactcgaattctatttgggtaagatagaaacaaattattgtagttgtaactggaaagtccaggtttggttaaaaacggacaaaaatttgttcctcccgctcaaattgatgaaattggacattttcgcgactcagtaagggcaattcgtgaagtaatcgggcgggacaagatgaaggtcgtcttcttcgggaggttgattgcgggatttctctagtgaaaatcagttttatgtggtttcagaacaagcaacggtaagagcagtgtgatcaatgcgatgttgtcatgccgagtgttgccccaggggatggggcacaccacttgctgtttcttacaagtggaaggggggtcggagcaggacaagtacttcatgatggaagacggggcgaagcactttccaattgctgaattggattcggttgggcatgcgttgggctcggaaggcatgggctccctgggacgcgactcgctcattcacattttctatccaaaatcggcgtccaaattgcttcaaaatgatgttttgatcgtggacaggtacaaaattatggctaatttgaccatttcattggtttgcgtctttcaacagccccggcgttgacctcagtcccgagtttgacagttggattgacaagcactgtttggatgcggatgtgttcgtgttggtctccaattccgagtcaacgctcactcaagcagttcgctttaatttaaagctcaacaaataaaacatatatttactgaccaattgtaggagaagaatttcttcattcgcgtcagcaaaaaattatcgcgtccgaatattttcattctttgcaatcgatgggatgccagcgctactgagaccgatgagagccgtgcccaaatccgtgctcaacacgagcaacgatttgaggattttttagccaacgagttgaaagtgtgcagtgtggcggaagcaaaaaatcgctactttttcatttcggctcgggaaatgcaagacgcaaggcttagggagaagggggaactgaccaaaacgagtgggtcagcaaacaaaacgaaagataagccatttttaaggtccctaccagcaggagggtttccaacggcgagccttggagttcaaacaattcgaagagcaatttgaggcagggcatttgaaaattcggtgattctatgcaattgaatttagaaatgcatttcgaagtcagcaattcggacaaaattcgaggcgcataatcgccgtgccaatgacatagttgaggcaattcaacacaaccttagcacagtgctcgatttggccgaccaagaacagttcaaacacctcaaaatttaaagaaaaatccctattccaaggaaacgccttgcgctggaattccaattaaaaaccaaagaattcgcaagttgtcgtgacaatttcaaatttttcgagcggacttatttcaccgaacaacagaaattacgttctgaagtgcatttgaaggtaaaatatcataacagaaggaagggggagaagaaaacagaaaattctttggtcatttctatgggcgccattgataaatttcccctccaaattttattttcaaacagttcgtttaaggtcaaaggagaaaaattcaaactaataaaaaaaaattaattattagagaattttaatgatctanaattcctcagcgtcgtaattattttttgttcttttaacaaaaaaaatttttaggtttcggctgactttttagacgaaattggacgcttagaagcgatcattgaccgtttcaacactcatttgttgatgaccccgaactgatcagcgattacaaacgccaattggccatccatgtgaatggagtgttgtcggaagggctgcaaaatcagtgcacgggcggactaatggcccaaatttggagtttggagcagtctatgcacggtgagtgatgaccaattgaaagaagcattcatcctttcattacttcaaaaaaaattagcctttgtcaaaaaaattcttaacgaacggcacgctgcgcagctggacaaaatttggcagtataaacagcccttcaaattcgcaattgtggtgaactgtcctgaattgatgtccgatttttacgaggacttggaattccgcttttcacttggagttgagaatgtcgcacgttggattttgtccataacacgaggccaaccgatcaccgccattgaccgaaacgttttggtccgatacaattttattaattaaaataatattaatttcagcggatgaacgtattgtcacgacagggacacaatgacggttgatgacggagtactaacaattaaaaagaaaaactgatactgttttaggggcccgaattggccatggacagcaacggcctgacaaacgcgaggtagacgcgttcttgtcgaacatcgttgtgcagtcggccacctatttgatgaatggttccgttggcgtgaccattgcggggctggtcatttacaagaacgttgactggcgatgggtggtcggaggagtgggactcgttgccggactatacgcattcgaacgcctccgatggaacaacggggccaaagaggagcgactgaagacccaattcagacagcacttggaacaacggcactcaattcgtttccatttgtttgaaaataaattgaaatttagcctccatcaaaccgagagtatccacaccagcagctgtgagcagcaagtgacccgggagctggaccaagtgaattga

SEQ ID NO: 46106 - DNA, 930 bp, Heterodera glycines
  Genomic contig location: Contig_ID=SeqID_28486; Location=1..930; Strand=+
  SCN-specific regions: Sequence locations=1-163,186-250,272-293,315 -336,358-379,401-422,444-930
  Gene Ontology: Mol. function=heparin-glucosamine 3-O-sulfotransferase activity; Cellular component=integral to plasma membrane; Biological process=protein amino acid sulfation
gttcagtgtcgtccaaatagtgtttctccatcggcgtttaattccaattggcatttctttacattttaaacaaaaagttatgcttgatattaaatctaccgcagcagacatgttgcatcaaaagataaaccaaaatgaaagcacagaatgggaacaaaggttggcaaaaatgggagaggaaaagagggtaaaaagggggaaggacaaagacactgatcagacggagaaccaaatccaaggggaaggacaaagacactgatcagacagagaaccaaatccaaggggaaggacaaagacactgatcagacagagaaccaaatccaaggggaaggacaaagacactgatcagacagagaaccaaatccaaggggaaggacaaagacactgatcagacagagaaccaaatccaaggggaaggacaaagacactgatcagacagagaaccaaattcaagaggaaggacaaagacactgatcagacaaccataatcgtaattcactgatctgctggttgttaaggccctcctcctccgtttctgttgccgagcggcgtctgcccgactgtctcataatcggagtacgaaagggaggcacccgcgctttgttggatgcgttagctttgcatccgcggattcgcgtggctcggcacgaagtgcatttcttcgaccggacggaactcttccgacatgggattgaatggtaccgcaagcaaatgcctttagcaaagacggacgaagtgggcagaagagaggacaaacggtgggcaaacaacggcacttttaggtggtcgtggagaaaacgcccgcctattttacgagccctgcggtgccgaagagagtgcactcgctgaacccggggatgaaaatgattctcattgtacgcgagccggtgaccaggacaatcagcgacttcacccaggcgaaaaacgatt

SEQ ID NO: 46107 - DNA, 1403 bp, Heterodera glycines
  Genomic contig location: Contig_ID=SeqID_28514; Location=1..1403; Strand=-
  SCN-specific regions: Sequence locations=1-348,370-609,653-1164,1187 -1272,1294-1403
  Gene Ontology: Mol. function=Ras GTPase activator activity; Cellular component=cytoplasm; Biological process=signal transduction
ctttcgacggcggatgaatccccaaattgaccgtgtccatcgggtggacaattttttgtccatttgggttttggaggcgaagggcgtcccggcaaagcgacggtttttctgcgaggtttctcccttttgtaaacctttctctgctcaaacggtacgcaaatttaagctgtctttggacgggcaactgaaggcacgcacttcgacgaaagtgagggaaaagcgaaacaaaataaaatcagaggaataaataataaaaacaattaaaatgaattgagtataaaatcattttttgctgcctttcctaggggatgagcgatggcatttgcttttggggcgagtctttcgagttcggctccctccctccttcccgtttgctgtgcatcgaccttttccgcgagttggacgccaaaaagacggcatcggcacggagggcacgcggcggcgccgaaagggaggacagacaaactctgatcggattggtgcacattccgttggcggaattggcaggacgacagcctgtcgagaaatggtcgagaaatgcaactgaacaattaattaattgttgagcatttgggggggggggggtccaacttttgtactagtgaattcaattattttatatattttttataatagaattacatatttataagcatccataattctatcgcaaaagttttcaacttttggctaccgtaacctccgcttttacaccgtaattattcgtttgttttttaggtattctgtcagttcaaatgagctcaacggcaatggcagcagcggcgcctcaacaaatgccaattgcgctgattctctgccgtccattcgcatcaaagctcgctaccaatccgtgcacattttccccctccgcgcgtacgcgccgctcagagaagtgccattttaattttcaattttaattactttacacttttttttcgctcatttgttagtatcttcggcttcactttttgccactttgtgccacttttgagcccattttgggcgtaaaggccaaggaggactttgcaagtgcgttggtccgcgttttgcagcacgaacgacgggcggccgaagcattggccgatttggcaatggtcgaagtggacgggcaagaaaatggtgagaaatttcattggcattctgttctttttggcattccattcacctctccctctccccttcttttagaccatctccttttccgtggcaattctctggccacaaaagcagtggaggcgtacatgaaactggtggccaacgactatctgcaggtcattcattcattcgtccattttggcactttcccctccctttggcgttctgtcctttccctctgattattcgctcgtattttcagagtgttttgggcgatttcattcgccatttgttggccaccaatttga

SEQ ID NO: 46108 - DNA, 834 bp, Heterodera glycines
  Genomic contig location: Contig_ID=SeqID_690; Location=44..877; Strand=-
  SCN-specific regions: Sequence locations=1-99,122-133,155-805,827-834
atgattgtgaagcctgttaaaaatttttttcaaaagaatgtgaccaaagtttggctgaagccgccgcctcatgacacttttattgagccttggtttccctatgctttgtatgtttttcaattcaattttaaataactttttaccttcttccattttagaattctaaagccaattggtcgagcatttcagcgtttgggcgtatacacttacaacaatttcatcgcccgaaccacttttggtctttacccgcgagaatggaacccgcgtgtccacggcccatatgttcattatcgttactacggaacaaacagtgagtttgaaacctttatttcgttaagaacattgtgctaatcatttcctctagttcattgttaatttacttttccttccaataatcgtcaactttaccccgtggattaattgactcgaaaatattagcagtattaccattccattcagatgacattccgctaatggaagtcaaagtcaatgacttggccgcgtacatcgcccgtcgtgacaaatctccgcgtgccatttggcgcgaatttatgcgcaacttctacaagcttcagtacttctacttctcggggcccgagttcggcaaccctttgacaatgatttggcgctatctcgtcattttcatcgtcggctttttcttgaccctccgagttgtgaccggcgcggacacgcgtttccgacacgctttgtaccattggtagacggacggacaaagagggccgatgagagaaaaaggaaacagagcgatagagcagaaacaccgtccgaattattgttaggcaatgtctccatattttctgtgctgttattaaa

SEQ ID NO: 46109 - DNA, 2279 bp, Heterodera glycines
  Genomic contig location: Contig_ID=SeqID_692; Location=230..2508; Strand=+
  SCN-specific regions: Sequence locations=1-500,522-603,625-955,978 -1181,1209-1292,1323-1904,1926-2214,2256-2279
  Gene Ontology: Mol. function=protein tyrosine phosphatase activity; Cellular component=integral to plasma membrane; Biological process =protein amino acid dephosphorylation
atgtccggcgctggaagtggacgccaaaagaggggcaagacggaagcaccgcgacgcccaacccgccggtcaacgcagcagactcgtcaggccgacactcagcagcagcaaaggcgtgcaccagcaacgcaggaacagagtgtgctcgcgccgcagccaactcttcgcagatgggaggacacggcagaattcttcttcgccctggaacgcttcgtcaacgacacaacgccgcgctccgtgcaggacctggtcagcgaattcaccgaactcaacgcagcgccacgaccggagccatcgcctgagtttacacggtgggttttggcgtcgttttcaatttgtgcatgtctaattttcccaattttcaattgcaggaacttggaatgcaaccgcgaccgagatgtgatctgcacggaaatcaaccgggtgcgactccacagcggacgctacatccacgccaactggatcagcacgttcggcgagaaccgcttcatctgcactcaaggcccgctcgagacgacctgcgacgacttctggacaatgatcgtgcaggagaacatcgaaggcattgtgatgctctgcgacaccatcgaacaaaatcggatcaagtgtcatcagtactggccgaccgcggacaacaaggtgggttttgaaattttacccaatttaacaattaatcgtttccccttccctcctagctcatgcgcttcgccaacaaccagatcattgtcaaattcgggcgcgaataccacgtggaaggcgcgctctacaggacggacctcatcgttggagcaccgcagatgcgacagggccacttgcgcgttcaacacttccactggcgacaatggcccgaccgcggagtgccccacagcgacctggccccgctgcgcctgctgtaccatgtgatcggcgtcccccgagcggttgtgcactgttcagctggtgagttaacggaaacaaaaacactgaaaaattaatcatttttcccattgcaggcatcggacgcactggaacgctcgtggcggtgtacttggccaaccaaacgctgcacctcggccagcctctcaacatcttcgctctcatccgtgacctccggcgccaacgatcgcaaagcatacagacgctcgaccagtacctctacatttacttcgtgattcttcggtgggttttcaaattttcatcaacaaaaatgaaattttaattttttcagttatgcacaaaacaaggcgtcaaagctgaacatcaacgtgaacgcgctcaacgccctcgtgcaggcactgaactccaccatgcgacggggctgagctgctgctgctgctgacgtcgccgggccggccgatgacggagggatcgtcaggatggaatatgatcatttgcgaatgtattgcgttgtcaccgtgtccataaactgtcataatgccccatattgtaattgtcaatacacccgatcatttgaattgtatgtatatgtattattgttgatgtgtgcgcatatataaactaatcaaaatgagaaattttcactttgtcactttttgggtgtttcggcacttctgacttatatagaggggggatttttaaaaggatcgaaaaatgactaatttggtatcatttgaaagctctagatgagatataacggacagattttcccacagccgtcaattcggagcataaccaagactggcttcggggggggggggggtgctaaagacaaaaattcgatttttaaggggtgtatttttctttttcagccgatttttaggggtgtatttttgcaccctaaaaattgactactttacgtttcttaagcatttagaaaatttctttatatatttaaatgcctaaagcagccaaatcaaacgctgtgttaaatcgtcactggatttcaaagttcccggaaggaacttattcaactgatggaaaaattaatccgggactttacaaattgattgatatcgccaaaattttcattggaggtcgggcgaaaattgataaagactgatattaaatatgatttttttttgcgtaaatacacttggtttttccaatttttagcacatatttttgcattttttaacacatatttaggccttttttttggtttttagcacatattttgggtttttttagcacatattttattacatatttcaggatttttagcacataaaaatcccagccctaattataacagatattgtaccaaaaatagtcaattttcatttttgaagcatatttttgaaatatatttcatagaatttcattaaaaatcgaatttaaga

SEQ ID NO: 46110 - DNA, 832 bp, Heterodera glycines
  Genomic contig location: Contig_ID=SeqID_694; Location=54..885; Strand=-
  SCN-specific regions: Sequence locations=1-6,28-138,160-443,484-832
atgtcttttgaaaaagcctatgctttttaccgtaaaaagaatgacacggccgctcttggagtgatcagaaaattggatggttccgtgccgcgtgtgatggaattgaaggcgcaaattctgtaccgaatggaacaataccaagaagctcttgaattgttcaagttagccaccacattacgaattctttttctgtatttcatttttcaggaagttaatccgaactcacagcgacgaatttgacgacattcgacgagcgaatctcatcgcagtcaaagcgcgacttcagtcccaaggcgactcgcaagaattggacttggccaacttggagtccttcgagactatgtacaatacgtcgtgccatatgatcgcatgtcaaaagtttgacgacgccctccgactgctcgaaaagacggccggtaagtgaaaagaatcattaaaggtagtagcatttacaatttcttccaaaaatgcttttctattcaaaaatgtgtcactaaatacagttgaatgtgaacggtcattgaacgcggacggccttggcaaagaggaaattcagcaggaaatggcaccaattttggcacagaaagcgttcacattacaaaaattggaccaaaagaaagaggcactaaaattatatcaaaatgtgctgaaaaccaagtaaattattgtcattccattctaataaataaaatctgtttttagagccttaaattggaaattgaaagcggcgattgtcgagaatttggaagcggattacgtaaaatttgggaagaaatggcgaccgatgaaaagtgcacatggcgacgaggaggagccgatggaggaggacggg

SEQ ID NO: 46111 - DNA, 781 bp, Heterodera glycines
  Genomic contig location: Contig_ID=SeqID_5756; Location=243..1023; Strand=+
  SCN-specific regions: Sequence locations=1-781
  Gene Ontology: Biological process=negative regulation of FGF receptor signaling pathway
atgaaccgacttttgtccggccgttctctgctccccaaaatcatgcgaaatttttcacacagcaatcgcctcgccgcctccgaggcggacccggaacattacggctatttcccggacccaaccgaacagacgtggggcctggagagggaaatgcttgctgcccgcctgaagggcgaagatgtgggagaaaaatttcgatttttttttgaaagtttttttgaaattttagcgctactcacccaaaatttattaccgcgctgaacattcgaccaaggatgtcccaaatgtggtgcatgtccatttggaggacaaagtcgtcggatgcctttgtgtgtgaaagttacaaatttttgcgctacgttaaaagtgggggattttgaattttattaaaaaacaggggggggggctttttctcggagacttttggggtccctgatcatgaattttacatctattttgatcagtttctaatccctaactcgaaattgaacaaaagttgaaaatccgattcgtgattagtagagctcggcctggacctggatttttcctgggtccaggtccgggtccaggtcatttttcgtcaacctggatttttcctggacctggatttttgtccaggaaatccaggtccaggcttttttcaaaataccgagctctagtgattagggattccaaaaagctccgagaaaaagttttaaattttaggcgaacacgacggagaccatgtgaattattggcacatcagaaaaggcgacacaaagcgatgcgagtgcggacattg

SEQ ID NO: 46112 - DNA, 1353 bp, Heterodera glycines
  Genomic contig location: Contig_ID=SeqID_5759; Location=2076..3428; Strand=-
  SCN-specific regions: Sequence locations=1-1039,1061-1119,1141-1353
atgacaactctcaagaaaatcgacacggcgagtgaggacggtctcgaggggggcctttcacttttcgacatccctccgacgaacgttgcaattaataaatccagtattcgggaattactccctctttcagcaataaatcaatctggaccgtatatctttagacttttttcagataatcagttttgtgatctcaataaaacttttctttatttgtcaacttcaattgagagaaaagacaaaagcaattggattccgattaccaaggacagtgaagctgaccaacacgtcggtgtcattcaaaattttgggcacagctttgtcaaaaccttaaaggtgtcaatttcaggtgtcgaatcttatgattccggcatttactatgcgtttagggcatatatgatgaatgaattgggattttcagaagatgtcaaaaagggtctctgtgaagcgtcctgctattatgtcgacgatgtcgaccaggatgattatacaaacagtggctttaaaaacagagcgtcacgttttgctgatggtgcaaaatgtgaaacaatggtgaaacttaattttgatctcggccgtcagcccaatctattgcttaataactcggatgtcatttttagcatacaccgtaacaccgatgattttctaattatggcaccgccatatgtttcaggaaatgcagtcatagcgaacccgcacacatatcgtattaacatacatgatattagaatttatgtaaaaacagtcgacattacccagtcattaaataacgtaataagcaatcagctacaaaccacctcggccaaatatcctatgagaaaaattgagatcaggagtcttttcatcccacgaggcacttctgatctctcacacaatgtttttaccagcattgttccgagacgtttaatcgtcgggtttgtttcaaccggtgcgtataccggaaatcctaaagagtcacccttcgtctttgaacatgcaaaaatacgctctatcggtgtcgaagcgaatggaaacatattccccgggtcaccctattctcttaattttgatagaaacaaatacattcgagcatttgttgacatgtatacaggactcgggatggacgacggtgaaagaacaatgtcgatcaatatacaaaaatttgtaaacgggtggtgtttcttcgtcatcccgatgacctctactctagaggacacccccggttttgaattaattcgaaacggaacgaccagcatcaaggtgcagtttaatgagcctataaaggacggcgggtatgagatgatagttctgggggaatttgattcgattctatctattaatgctaatcgtgtgctcagtagcgacggaagcatatga

SEQ ID NO: 46113 - DNA, 838 bp, Heterodera glycines
  Genomic contig location: Contig_ID=SeqID_28541; Location=1..838; Strand=+
  SCN-specific regions: Sequence locations=1-127,149-772,815-838
tgatgtcataccatcaggagtgaatataaaattatatgctgatgatgttaaaatctatatttgttataaagcaagaacagaaacggaaattatgcataaagcattgcataatttattcgaatgggcaaataaatggcaaataaaagtttcaattcaaaaaacttttgtactttatttgggttcaaaaaacccaaaagaaacttataaatttgatgggaatacaataaatgctgtggatacaattagggatttaggagtaaacattgataacaaattacaattttccaatcatgttaatcatataacaaggaatgcgtatttacgtatgcgttccttgttccgaataattaaatccaaatcatctaagatttggattacgttatataaaacttatattaggcctttattggaatacgctccggaggtttggaatccgtctcttcaaaaaaatattaaaaaaatcgaaaagtgtcaaaaatatttcaccaaacgggtgttttttaaatgcagccttccgccaattccataccaaaatcgattagaatacctgcaactaccaacacttgagaaaaggcgaaagctatttgatctgttcatggcgcataaaattgtttatggccgaacagatctagatatattaaaaattttcaaaccttctgaacgctttaatgtccccttttataggtttaacacaaaatataaattaggcaaaaaatttattccctttgcggggagggctacaaaattgtggaatcagctggataaagaaatcattaaaataaattctttaaatcaatttaaaactaaaattaaactccttaacgtataaaatgaccgg

SEQ ID NO: 46114 - DNA, 548 bp, Heterodera glycines
  Genomic contig location: Contig_ID=SeqID_5763; Location=1166..1713; Strand=+
  SCN-specific regions: Sequence locations=1-69,107-186,208-213,236 -246,346-548
  Gene Ontology: Mol. function=specific RNA polymerase II transcription factor activity; Cellular component=nucleus; Biological process =embryonic cuticle biosynthesis (sensu Insecta)
atgatttacgtccgaaagcagggcgaagagattttcacgccgcttcatttggtgccgccatcgcttgggtaaaatatttaaaaattaaaaaaaattgtttaaatttcaatgacattttttagagggttggcacgcgcagtcagcgaaaaatacaatttggacgagtcaaaaattgaggccttctacaaacagtgccaaaaaggattgaccgtcaaaattgatggtgggaaaatgactcattaaagcaattaattattaaattatattttgcaaatttaaatttttatcagaaaatttaaattattttttaatttaaattgattaattttaatcaaaaataaaaaacaaacttatgtattattttcagatgatatgctgcgccactacaccaaccaggacacttttcaaatcgagctgaagcagtccgagttggacaggtccgttgacaatgagactgggcctcgataactcaaatgatcacagtctgatcagtcagagccctcttttttctaaacctattgctttgatcagttaatttattccggaga

SEQ ID NO: 46115 - DNA, 753 bp, Heterodera glycines
  Genomic contig location: Contig_ID=SeqID_28553; Location=1..753; Strand=-
  SCN-specific regions: Sequence locations=1-280,302-597,640-753
  Gene Ontology: Mol. function=N-acetyl-gamma-glutamyl-phosphate reductase activity; Biological process=proline biosynthesis
tttctcaggtgtccgaattgcaacagactggccgtcaaatgctgatggtttcatcgggcgccgttgcgtttggccgtcaaaagttgcgccaggagttggtcatgtccatgtccatgcggcagactttgcgcgggcccgccggcatgcagacggacaaaagggcgtgtgccgccagcggaatgccgggactgatgagtctgtacgaacagctgttccaacagtacggtatcaccgtagcccaggtctgtcctgtccaaccatttgtctatccccatggaatatggtccaatttccatggtcattttgcaggttctgctcaccaaaccggacattgacgacccgcagcgacgcaaaaatctgcaggcgaccattgaaagtctgctacgtctgaacattattccaattgtgaatgccaatgacgcagttgcacccgacccgaagcttaacatggtaagcggggcgtgaccggaaaatgcgtcagtgatacaaatattttaatattaagttttgtagtattgatattgtaatacagaagtataattctataagaatattgttctgaatttcgaaccccgaacccgtattcgaacaaaaagttgaaagtcaaaattttcgaaattagtgtttttcttcaaaatcggtttaaatacaaggaaacaaactgatccatcaatccttcaataagagagcatatatgccgtttttgaaccaaaaatgcaaaattcgaaaatttggactttcgactttttgttc

SEQ ID NO: 46116 - DNA, 630 bp, Heterodera glycines
  Genomic contig location: Contig_ID=SeqID_28554; Location=24..653; Strand=-
  SCN-specific regions: Sequence locations=1-601,628-630
  Gene Ontology: Cellular component=anaphase-promoting complex; Biological process=mitosis
atgagtgtcggtttgtcctcaattgtcgatgattctcaccagcgacaaagtcacttttgggctgagattctcccgcccggcgttggtcaccccaacgacatttcgggagatgccatttggacactttcgagctgtaaggagggccttggggtgcatcagttgttgaacgaccgcgaagacacttattggtaagggggggggggggggtggcacactagacatttagtgggaagggaagcgaaactttttggcgattgttccgtcaattccttcccttcaggcaaagtgatggtcttcagccgcactcaatcaccatagaattccaacggaaaacggaagttgactttctgctgatgtttttggactacaaactcgacgagtcgtacactccctccaagtgaactttgaattttgttgcttttgcttttacctttgttttttcagaattcaagttcagaccggcgcttcggtgttggatttggacgagcccaagtccctttccttcacagagccttcggggtggcaaatgatcgaccttcgccatgccgggacgaagcgaccggcgaatgtctttgtcatcgttgttcagattatccaaaatcatcagaacggacgggacacacacattcg

SEQ ID NO: 46117 - DNA, 499 bp, Heterodera glycines
  Genomic contig location: Contig_ID=SeqID_28557; Location=1..499; Strand=-
  SCN-specific regions: Sequence locations=1-300,337-342,365-423,447 -447,473-475,497-499
  Gene Ontology: Mol. function=ATP dependent RNA helicase activity; Cellular component=nucleolus; Biological process=35S primary transcript processing
cttcagaatacatccaattttgtcgtgcgcaatttgaagtgtttaattgtcgacgaggcggaccgaattttcgacattggatttgagcaggaaatgcaccaaatcgtcaaattgttgccaaagaaacggcagagcatgcttttctccgccacatgttcgcccaaagttgacgagttggtaaagactgcgctgaaaacggacccactgaaaatcggagtgatggagcagcaaagggacccaaatgacatggccacggttgaggggttggagcaggtcagcgaatggattctagcgggactctgtcatttaattgcaattttttgttgaaattgttttgcttgtaaatattcaaataaatctttttgtccatccgatctgaaataattactttttagggttacgtcgtttgtccttccgaaaaacgttttcttctgcttttcacttttttgaagaaaaaacgggaacaaaaaggtgcttttttatgtttttctcttttaat

SEQ ID NO: 46118 - DNA, 340 bp, Heterodera glycines
  Genomic contig location: Contig_ID=SeqID_28573; Location=1181..1520; Strand=-
  SCN-specific regions: Sequence locations=1-143,168-340
  Gene Ontology: Mol. function=glyceraldehyde 3-phosphate dehydrogenase (phosphorylating) activity; Cellular component=cell wall (sensu Fungi); Biological process=gluconeogenesis
gactttctcggtgactcgcactcgtccatttttgacgttggcgcgtaagttttaccgttaattataattccattacatttgcctcccgccccctttggttcagttgcatttcgttgaacccgcactttgtcaagctggtcagttggtacgacaacgagttcggctactcctgccgtctggtcgatctgatcactcactgcgcttccaaggcatagaaagacgacgcgcaaaagagggaggacggaggaggaaaagagaaatatgctaattttgactctgcgtttattccatttctctttttttgatgccgtccaatgacgtattttcctgaatttgtttt

SEQ ID NO: 46119 - DNA, 621 bp, Heterodera glycines
  Genomic contig location: Contig_ID=SeqID_28598; Location=235..855; Strand=-
  SCN-specific regions: Sequence locations=1-621
atgcgtttgtccttgctccgtgccagcgagaaacattttggcaatttgtcgaaggtctgttttattatttggtctatgtctatttgcatggagaattcttataagtcataaccatgactgtattatcaaagcaattcaagctcatttcatgtagactcgaaatgcattcaacattttgattaagtccaaaaagttcactgtcatttagactattaaaaattaatccacgggatgcaattttctattgttttaggcttacggttggtattacgttcgcattgctccggttgaacagaaagtatggaagggctttttctttgatgcgtttgttaaggtaagaaaaatgtgccataacccacaaaatttattgtgcttttcagccggtcaaagagcagttgccccactggtggatgttcttcttccccgtagtcacttactttttggtcaccgactgggccaagaaagagtaccgtcgtctgggacggatcaaagaattcactgacgaagaatgaatgtcgaattggccattcggactgttatttgtaggaaagaccaccgagtcgacagaatataaatcgaaatgttttggtactgtcaaattgtgtgttatgtccaaataaa

SEQ ID NO: 46120 - DNA, 961 bp, Heterodera glycines
  Genomic contig location: Contig_ID=SeqID_28608; Location=366..1326; Strand=-
  SCN-specific regions: Sequence locations=1-100,167-419,471-594,616 -680,703-728,750-961
atggcacagtttgtgccctttacactttacccttcgccattcccacgcgaattgttcgaccaggcgatggatgtcaacaaagtgactataatatacggacaattttataaatttaattaacaatttttaattttaaaaatgttttaatttctctaattaatttttagacccttcttttgatgtatttccgtgcgtcgttaccgtccaattttgaatttttgaaagaattgcataaaagtgttctggctgtgagtccatcactccgatatactgctgatctaatcgaaagaaagcataaggagggcattcgacagccattgatgttgatttgcataagagcggtgggataattaataattaactaattttgttgttttcttaaatggtgggataattaattcttatgatataaggatatgataataattgatttcattttttcaaattttgtatatttattttattttttaggattatatggccagcgaagaaattgatgaaaaaagcaatgagaaaaaatatgcgctaaaacaggtaaataataattagcaaatgaacactcttttatttgttttcctaagaatcaactcttattttgatatttatttaattaatatcaacactatcaacaagaatgtggaatcgaaattctatttttaattttttttgccggaaaaaagttataatttgttaataaattttcaccaaaaattgccaatgttcggtcaatttttaaaattttcggctatttcgaagtgccgccagtaaaaatttgaaaacgaacttgttctctgtttaagattgaattgaatggcggctcaattggcggctacggcactcctcagccccttaccgcacttcatcgccgaatgctttccaatgtcggcattgacaattcaatatcggtgatgccggaaaatctgaccagcgaaatgttggccacggcaatgtacagagcatg

SEQ ID NO: 46121 - DNA, 1412 bp, Heterodera glycines
  Genomic contig location: Contig_ID=SeqID_696; Location=831..2242; Strand=+
  SCN-specific regions: Sequence locations=1-521,554-897,920-1024,1046 -1088,1110-1376,1398-1412
  Gene Ontology: Mol. function=dolichyl-diphospho-oligosaccharide -protein glycosyltransferase activity; Cellular component=endoplasmic reticulum
atgattttgatgaccgcttcatccaccgcgtactcacataaccccaacaaaacggttgaagaggtgtgttgggacaaatcagtttgatcccattatttatgccttaaattcattaaaaatttgttttctttatgacagagttttcttcacttttcagcgtccttcggctgttggcaagtcgacaattcttttgggagctttgcaggcccggaacaatgcccgtgtcattttgtccgggtctttggactttttttcgaacaaattttttactgcgacggtgaaccaagcggggggccacactgccaagtgcccaactttttttcttatattatttatttggacattttattttatttagtgccgtaaaaagtgggaatcagcaattggctgcgtccgtcctcaaatggttgctcaaagagtccggagttttgcgcataaaatcagtgaaacatcacactgttggccaaaagtccccgcccgccgagtacacaattatggactatgtggtgagaagagcgagcatttttaattattattttttatttatttatttccactcagcgatatgaaattggcattgaggaattgcagaacggaaaatgggtgcccttccaaggcaaagatgttcagttggaatttgttcgaattgacccatttgtgcgcgtcactctgaaaaacaacagtaagtcgaggaggcgggggattataatcattacatctcattggtaattaaaaaattacgtttttcatcagatggcaaattctcagctgaattcaaaatccccgacgtttacggcgtgtacaaatttttggtggattaccaccgaatcggatacactcatttgactgacgttcagcaggtcgttcacgccttccccattcgtcaattgtttctttgttcaattcattcattcatttcaggtctctgtccgaccattgaaacacacgcaatacgaacggttcagtcgctgcgcttacccttattatgtgtccgcattttcaatgatggttggggtgagcaaatttgttaaattatttttcaaaattcaaatgcgtaatttcgggttcatttttgggaatatttgggctacatatatgggttttattgtatttttttgcagttcatagtcagtcattttttggacgcatgccaaattagctaattacctttgccctttggtcaggtggtgctcttctccttcgtcttcctctacttcaaagagtcgcccccgcaaagttcgtcctccgccgccccttccgccaaaggcctccaaaaggcaaaggcttcgtaaaaggcgcatttccatcttgagaaaggcttaatgtgaatgttgttacatattattatactttcctttaacttttgctctgcttaatttatttcattgtttttgtttaagggtctttcgtta

SEQ ID NO: 46122 - DNA, 1120 bp, Heterodera glycines
  misc_feature (622)..(622): n is a, c, g, or t
  misc_feature (746)..(747): n is a, c, g, or t
  Genomic contig location: Contig_ID=SeqID_701; Location=444..1563; Strand=-
  SCN-specific regions: Sequence locations=1-271,293-357,379-571,595 -977,1004-1120
  Gene Ontology: Mol. function=methionine-tRNA ligase activity; Cellular component=soluble fraction; Biological process=amino acid activation
atgcgatacatcgaatgtttggagagggtcggattcgtggacattcaagtgaaggacgaacggaccgcgggaattgggtcggattctgacaaattgttacaggtggtctacgaaaaaatcgacaaaaaaggaaatccgaacggtgaaagcaatgcgagggaaattcagctgatttttgcacggaaaccgatgctgccgttgttggaagagaattggtcaaattgggcacagttcgaacgacaaatggcggaggaaacggaacttcgaaagttggcggaggaggatcaggacgaagtgcgacagattgcggcggggaaaacactgagagaattggagaaagaactgatggaacgttgggagagagagcagagggaaacggagaccaaccgaagcaacagagagagacagccgacagtctttgccattgacagacgcaagtccgactgacagtgaccagggccacacaattcatgccaatttttaaaaatttgtttttttagaaatttcatgataaaaatatcagaacctaatgagaaaaatttaattcctgggaaattgaacttccccattttgatggttgtttttcatttttgtgtgaattcagttcattttatatgacatnaattttttttgcaagatttactcacccatttcagacttcctttggacggacgaagaaatggttttgattgcctccgcgttgccttacgttaataatgtgccgcatttggggaatatcatttggnntccgtgtaagtgtgctgacgtttttttccacggtcgtcccaacaattcttatttttaatttgctttcgatatttttcccttattttgtggcacttttccctgtataactttcattttcagttactgtcgcatgagagagtaccaaagtcttttcatttgcggcaccgacgaatatgggacggccacggaaatgaaggcactttcgggtctttttttgcagtcgtcctcagaatgtttcattttcttccttttcagagggacttacaccgcgacaactttgtgacaaattttacgagttgcacaagaaaacgtacgattggttttccattgattttgactttttcggacggacatcgaacccaaatcagacaga

SEQ ID NO: 46123 - DNA, 428 bp, Heterodera glycines
  Genomic contig location: Contig_ID=SeqID_5799; Location=226..653; Strand=-
  SCN-specific regions: Sequence locations=1-105,128-185,209-428
aacgaaatgcctttggctgaagatttgttgtatcctgatccgcaaaaggaacgtcaaaagcacaagctcaaaagactcgtgcaacatccaaattctttcgtatgcattattataaataaattaaatactgtcatcccttttttaagtttatggacgtcaaatgccctggctgctataagattactacagtgttcagccatgctcaaactgttgtggtatcgatttattcttgccaaataatttagtgatttaatgagctaagcaaatgaatagtacacacttagaccggtcataaatgagctgtgttttgtagaaatttgcatacatttctaatttaggtctgtgttggttgcagtacagttttgtgtcagccgaccggcgggaaggcgcgacttgtcgaagggtgttcgttccgaaagaaaggacac

SEQ ID NO: 46124 - DNA, 827 bp, Heterodera glycines
  Genomic contig location: Contig_ID=SeqID_5801; Location=1..827; Strand=+
  SCN-specific regions: Sequence locations=1-194,218-827
  Gene Ontology: Mol. function=protein binding; Cellular component =focal adhesion; Biological process=integrin-mediated signaling pathway
ggggactgtgcttcgtgcaaccaagcagtgattgggcccgtggtaagtctttggctgtataaaaatgagcagtcggaagcgaagggtggcagaaatgggatgttttacgggatacgaagcaaaatgaaaggattttgaatgacaaagaacaaagaaatggaccattttatcaaggtgatagcccttgggaagatgtggcatcctgaacatttttgctgcgctcattgcggagattccattgaaaatcggaattttttcgagcggcaaggaaaggcgtactgtgaaagcgattaccacggtgattgggtcattagcttatttgctagtcaatgttgttgtttttccaagttacactttctcttttctctaagatttgttttcacctcgttgttcctactgtaacgggcccatcaaagaagtacggtggaagaattacaaattagaaaaaaaatacttgaagcaaagcaaaagcattcattttaattactcttacatagcctttttgtttagcgttgtgtaacagcacttggcggaaagaattttcacgtggaggttaaaaaaattaaccttttgaaacttaaaactttctcagcattttgtttgcgccgaatgcggcaaaagcttcggagacggcagattccatgagaaagtcggaaattttattggataaattaatgttatcaaattttaagtccaattccgcgtactgtcgcgattgtttctaccgtacttacgcgcccaagtgtcagtcctgcaaacagccgatcactcacaaattcatcacggcactcaacacacattggcaccccgaatgcttttgctgtcag

SEQ ID NO: 46125 - DNA, 1184 bp, Heterodera glycines
  misc_feature (368)..(368): n is a, c, g, or t
  misc_feature (446)..(446): n is a, c, g, or t
  Genomic contig location: Contig_ID=SeqID_28690; Location=391..1574; Strand=+
  SCN-specific regions: Sequence locations=1-145,204-423,452-482,506 -1184
  Gene Ontology: Biological process=cell cycle
atgattgaaataattattctttatgtattattttattcaatcatcatgcggctttgccaccgaataactgcaaagaaaactactttcatccaaatcttcgtcaagactcttggtggaatgacgctgactatttttgcccattccttggacaccatcgagaatgtgaaggcgaagatccaagacaaggaaggcatcccaccggatcaacatcgtctcattttttgcggtgggtttttagtgaaaatagttaaaaaacggcatttgtaattgttaaaaagaattactaaatcgaaaattttgaaactacaaattttatttgtttttattgtaataataaggaatgtaagtaagaattactaaaacatganaattagcgaaaactaatgcacttttcaggaaaaacgctcaaagatggtcaaactattgccgactacaacatccagaangagtccactctttacctgcgcttgagtctgataggaggagcgcggacgaggcggcagcaagcacaagaggtggcttaagggcactgtcttttgctcgcctgacggcgggcgctttgctcgcctgatggcgggctctctgctcgcctgacggcgggcgtatgctcgcttgacggcgggcgtatgctcgcttgacggcgggcgcttgctcgcctgacggcgggcgctttgctcgcctgacggcgggcgcttactcgcctgacggcgggcgctttgctcgcctgatggcgggcgctttgctcgcctgatggcgggcgcttttgctcgcctgacggcgggcgctttgctcgcctgatggcgggcgcttttgctcgcctgacggcgggcgctttgctcgcctgacggcgggctcttgctcacctgacggcgggcgctttgctcgcctgacggcgggcgctttgctcgcctgacggcgggctcttgctcacctgacggcgggcgctttgctcgcctgacggcgggcgctttgctcgcctgacggcgggcgcttgctcacctgacggcgggcgctttgctcgcctgatggcgggcgcttttgctcgcctgacggcgggcgctttgctcgcctgacggcgggcgctttgctcgcctgacggcgggcgcttgctcacctgacggcgggcgctttgctcgcctgacggcgggcgctttgctcgcctgacggcgggcgcattgctcgcc

SEQ ID NO: 46126 - DNA, 1779 bp, Heterodera glycines
  Genomic contig location: Contig_ID=SeqID_28708; Location=1..1779; Strand=+
  SCN-specific regions: Sequence locations=1-283,305-454,501-668,695 -1428,1450-1501,1523-1779
ctgaaaatgccaaagaaaaagaatggcaccaccgaccaatagggttgccttctgatcacaaattatttcccaattcgtaggagcaagcgcataacaacgaaggaacttgaggtttgttttattgcagttttctcgttttttccgatattaaaaacatatatatggttttcttgtgaattatacaacaattttaaagaaatttaagatgtgggccttaataaatgtggaacattttaaattctccagcaattgggcatttcaaatggaggggttattcctaccaattgtttcaaaaaagataattaaataagcattttcgctgccatggtcaaaatcgacacaaattttgcctaaaataacaaattttatgacttttggggcatattttgtcaaaattaatgcaccggtcaaatatttgaaatttgttaaagtttggatcattttcaattacccaatttcttttttctcttaaaaaatcatttccctcctcctcccatttccaaggacatcaaattgaaggagctcaaggagttgatcgacacagggttcaacgaggaccatttggaggtgtttcggtgttcggtgaaggggcgaagtgtccgtgcgtcgaaatgctttcaaaggggcgaatttgttgtggagtacaaaggttttccgggcaaaaaaaatgcatttttatttccaagttttttgttcatttaggcgacttaatcagtgtgaagacggcccaactccgcgaacaacggtatgccaaagatgagaacgtgggctccttcatgtactactttcggcaccgggacaatggtacggattggatcattggtttaggagtcgatatttcgaacaatttcgaagtcgaacctaaattgaaagttcaaagaatttttgttcaaaattacatgaatcggaagtattaatgctgttataacgcacttttaactaatttattttctgctttttttgtcgaatttggctctacgtgaattttacgggtccaaatttgagtcacgaatccttcaattattttgatcaattccgatttcctaatctaaatttgaacaaaaaatcataatttgaaaaattcaaaatttcgatttttattcgagttcgggttagggattagaaattagtcaaaatacacgtcagattcgtgattagcgacctttaaaaccccggataaaaaattatcatggtttttatcttaaaaaaattttgcaaaacaaaagggtccccccccccttttgtttcaaaaactgtcactttccatatagtgcccaaaattttagggtagtttaggccgatccattatgaattttaaaccgattttggacatgggcacaaaagtcatctaacaaccggtggtgaatttgtagggattctcaattaaaacaccgattgtggctttgaatgggatgccaaatccaaaaattttagattttgtgtaaacatcaaacaaattttagtgttttgtatcgacgcgaccgatgaaacgccgtacaaaggccgactgatcaaccacagctatttgaagcccaacctcaagacgagggtattcataatcgggcggacatgtttaataccccgatagtttcttaatccgctccatgaactccatattttcttcccaattcgctattttgccaggtggccgacttcggctgtgacggcttccatttggtgctcgtcgccatgcgcgacattgacaacggcgaggagttgttgtacgactacggggagcggcggccctccgtgctggcggttaacccgtggattttgggc

SEQ ID NO: 46127 - DNA, 1715 bp, Heterodera glycines; identical to SEQ ID NO: 28733
  Genomic contig location: Contig_ID=SeqID_28733; Location=1..1715; Strand=+
  SCN-specific regions: Sequence locations=1-818,840-1715
  Gene Ontology: Mol. function=leucine-tRNA ligase activity; Cellular component=cytoplasm; Biological process=tRNA modification

SEQ ID NO: 46128 - DNA, 1332 bp, Heterodera glycines
  Genomic contig location: Contig_ID=SeqID_5815; Location=122..1453; Strand=-
  SCN-specific regions: Sequence locations=1-127,160-271,304-661,697 -836,858-1119,1141-1332
  Gene Ontology: Mol. function=calcium-dependent cell adhesion molecule activity; Cellular component=integral to membrane; Biological process= gametogenesis
atgcccgaaaatgcgcccgtccgatcggtggttgttcaggtccaagcccacaatgaggctgatcagtcccttttctacgctttcggagtctccgaagattcgcggtttgaattttctgattaggccaaaaattaaattaattttgttttattgtttttgcagttctacaaatttattttcacttgacacagtcagtggcgaaattcgacttgcgaaagcattggacagagaaacgcagccaaaacacgtgttgaaggtgggtggccacaccattaattaattaataattaattatgtaattatgacgactctattccccaaaaggtcaccgctttcgagcgattggacccttcccaattggccaccgtttcggtgatcgtcgaagtgatcgacattcaggacaatgcgccttctttcgagaagtccacttatattgccgaaattcgggaggacgccccggtaattgaaatgaaggataattattaattcatcggcttaaatatttattaaacaatttaatttcgctgattttccttttttcagatcggcacgactgttttgagtgtttttgcacgtgattttgacgacggtgccaatggcgaagtgaaatattcgctggacaatgtgaaggaagcggcggaagttgcccatttatttaggcaaattaaaaataattaaaatcatttgtttaataatgttttaagcatcaatcccaagtcgggagttgttcagactgctgcccaacttgaccacgaggcgttgccccaacttctgttgctgcaggcaatcgccacggacggaggccaaccgccgatgcggtcgaagtcgggcagatgaaaagagataattaaactaattattcatttggcatcagtgccaatttggaaatcgccgtgttggacgtcaatgacaatgcgccgcaatttgagcagtcaaatgggaccgcgtgtgctgtgaatgttacggaagatgcgcccgtgccatcggtgattcttcgccctcgggcacgcgacgcggacgcgggagcaaatggtaattgaccaggcaattagggataattagaggcaatttgggatttgtttagggaaggtccacttcagcatcgtctccatgtcagtgccgctgttttccattgactacgaaagtggcgaagtgacactgcgaagtcgcgcgagcccaaaacagtcgcccctgacattggtcagcaagcagattaaattcaaattgatttgcttatttagctgatcagagcaaaggacggcggccaaccatctcttttttcgactttgcaatgctccgtcacaataatcgacgtcaacgaccattcacccg

SEQ ID NO: 46129 - DNA, 542 bp, Heterodera glycines
  Genomic contig location: Contig_ID=SeqID_28748; Location=144..685; Strand=+
  SCN-specific regions: Sequence locations=1-186,209-214,238-267,317 -319,341-542
  Gene Ontology: Mol. function=nucleic acid binding; Cellular component= nucleus
atggcttattctcgttcaccaagtcccaatagagaacgttcccatcgctcaactcgaaaacgctcacgcgatcggagcaacgagaggcgacacaaagcgccacgctcatcacacaaagaaagacatcgagacaggtcattttatttaaggacggaaactaagatgagctactttttcattgtgcaaagagaaaatgggtcccctttttcaccattttctaaaaattaaatccagtttttcgttaactcaacaaaaaacatagaaattacagggaccggcgcggagatagggaccgagacagagaccgagaaagggagcgccattccagtggtggagataaaaatcgcgagcaccggagcaagaagaaagacaatgtagctcacgctacaaaggttgtttgtgaagcttgtacgaacatttcaattgtttttagtctaaccctattaatgaaattgtcgatgttgatgaggacatgatgcgaatgatgggtttttctaattttgacacaactaaaaataaacatgtcgagggaaatgcctctg

SEQ ID NO: 46130 - DNA, 144 bp, Heterodera glycines
  Genomic contig location: Contig_ID=SeqID_5821; Location=3066..3209; Strand=-
  SCN-specific regions: Sequence locations=1-144
aggcgttcatcacaatggccactgaaatcaaaaatcgcatgggccctcttcaacaggccggtggcaatgcgtccgccgtgcgcattggtccgtctcagccggtgcgggacaaaaaaacgggcggatgttgctgagttagccaac

SEQ ID NO: 46131 - DNA, 954 bp, Heterodera glycines
  Genomic contig location: Contig_ID=SeqID_5822; Location=116..1069; Strand=-
  SCN-specific regions: Sequence locations=1-2,25-191,213-262,287 -367,389-390,420-524,546-828,852-954
  Gene Ontology: Mol. function=RAB small monomeric GTPase activity; Cellular component=Golgi apparatus; Biological process=signal transduction
atgacagagagacagagacacggacaaatgaacaaatgtgaacagaacattgtgctgtgtgtgatgtgcagcataatgcgaatgcgacgaaagagaagcaaaagaattgatgagttgtgaaagaagacacgaagcaaaaagcttttttatttgcattttcttaatattttttttattaatgcgcaatacagacatttcagattttataaaacttggcaaaactcttattaattgccgttaaagattgatttgaagaatggctgccatgaatcctgaatagtgagtaactcagaaatcatacattttgctttatttgtcactttctccagtgactatctcttcaaattgctgttgatcggcgattctggtgttggcaagtcgtgtctgttgcttaggtttgcggatgacacctacacagagtcgtacatttcgaccatcggcgttgatttcgtatccgaaataataattaaatcgtgctaataaattcatttagaaaattcgcaccattgagcttgaggggaagacgattaaacttcagattgtgagtgacccatatacattaaccattcattatttattttagtgggacaccgccggacaggtgggcctttggttccatatagcgcgtagcaaaaaaaaagaaaaaaaactttctattgtccaatccgttatatttacgaccatttgtttttacaaaataggaacgcttccgcacgattacgtccagttattatcgcggagcacacggaatcattgttgtttacgacattacagaccaggtccacagtgtttatacttgttttagttgttcttcattctcaggactccttcaacaacgtcaagcaatggctccaggaaatcgaccgatacgcatcggagagtgtgaataaacttcttgtcgggaataaatgcgatttgaccaccaaacgtgcgatagagacgaatgttgccaag

SEQ ID NO: 46132 - DNA, 1010 bp, Heterodera glycines
  Genomic contig location: Contig_ID=SeqID_5822; Location=1305..2314; Strand=+
  SCN-specific regions: Sequence locations=1-144,166-557,580-1010
  Gene Ontology: Mol. function=structural constituent of ribosome; Cellular component=cytosolic large ribosomal subunit (sensu Eukarya); Biological process=reproduction
atgggacgtcgtatccgagctcaacgcaaaggacggggtgggattttcaaatcgcacagcaaacatcgcaagggcccggctaaattgcgcccagtggattactccgagcgtcatggcttcatccgaggcattgtaaaagacataatccacgatcctggccgaggggcgccattggccattgtacaattccgcgatccatacaaatatcgggtgaagaaagagacgatgattgcggcggagggattgcacactggacagtttatttactgcggcaagaaaggttcgtttccacttttcgattgataattatttccaatactttggtttggctatattcaagtttacgcgtccaatcagttaccatccttagtttcttaggtgataacgttttcttactcatatattcttggtatcaatcgaagcttaaagtctacagaagtttttatatagtaaaaatctgagaaaatacaacagacaaatagttattgaatatacgcaaaaaatgatgaatttcgggtttctcattacatttttcttaatgcaagtattgcgcttatcatacatagcctaagaaactgaggatagtcactgattagacgcgtaagctggaattgagactttgttttatactagggtctgtccagttttaaatgtccatagtattttatgcgtccagccatgcttttgatattaactcaacaatttatatttttagcacaagtccaaattggaaatgttatgcctattggagaacttccggaaggtacgaccgtctgcaatttggaggagaaggccggtgaccgtggacgtttggcaaggacttcaggttgttattgtgcaccttcccttttgtcccttatgtacatccgaatgttaatttattcattatctttatcataaaggtaattatgccattatcgtcgcacataaccccgacacgaagcgcacgcgaattcgtcttccatctggtgccaagaaggtcgttccatccgccaaccgtgcaatgattg

SEQ ID NO: 46133 - DNA, 4355 bp, Heterodera glycines
  Genomic contig location: Contig_ID=SeqID_5837; Location=435..4789; Strand=-
  SCN-specific regions: Sequence locations=1-99,163-325,347-508,531 -932,975-1005,1032-1177,1199-1214,1252-1389,1448-1526,1557-1604,1627 -1695,1717-1731,1772-1900,1951-1955,1977-2080,2106-2130,2153 -2203,2226-2250,2272-2323,...
  SCN-specific regions: Sequence locations=...2366-2371,2424-2832,2855 -2942,2965-3652,3702-3852,3927-4166,4227-4355
  Gene Ontology: Cellular component=mitochondrion; Biological process =positive regulation of growth rate
atggctggccttatctacaacaagccagaggaccccatccagtttttggagaatgccattcaaaagattcgaacaaatccaggaatggcatttaaatggtaattttttgttttttattattaattgttatttaacttttgaaagaattaataaatataaattcatctttatcctttcatcgcttttagcttgaaacttttaaaattcaaccaacaaattgtcaaactattaaaaaaacatattttaagttccgaaagacgtttcagttcattatattaatgcaaaaaataagaaactgttaaaataacaaaatataaaaattttagcattttagcattgcttttttaatgaccctaatttattttaattgatccaatattctcttgagggattcttttgtgacgccgccccaaccaaacaaaatgagcgaggaaaaaacggcgacaaacagcagcgaaaaaggcgacattggcacaacaactgcttcctcagctgttgatgagaatatggggaagaagaaacggggggaggaaagtgttgcggtgaaacggcaccaatcgacggacaatgaaacggcggacggcggtgggcaaactgacaaatgagcgggaggaattttcgaaaaaaattcaattttaacttttttttaaagaaaatcaaatcaaaatcctagatatccgttcgatcaccttttaaaattctctgttagcaggcaactttcaataagttatgacgaatttttgtcaaaaaagtactaattaggctaatctccattatgacgaatttttgtcaaaaaagtactaattaggataatttccaaaataaaaatgctgttgcggaatggtccagcaaatccggcgcgggactgagaatatcgaaaaaataaatctaaaaatttgggtaaaattttatcgcgccctgtataaatgaagatttttaattatctaaaataaataaatttttgaaatttttatcattgtatgattgatttgattgtccctctcctcttattttacttttttattttcttcccggtcgatggtttgtctcacattttatttttttgcttattgttatgccgtgcttttccttcgtccaattgtttccgtcacattatgtggcaaaaggcttggacagacgaacaagtcttggccaaattttaggctcgttcctttaactcctcaaaaataacaaaaatacctgtctattaaagcataatatttaaaattaaattttttttttttaatttatcaggctctcaccctctttttccaactcgagaaaattagaaaaaaaatgctcgccaagataattaaaccatgtggtatcggatcatctatacgttttaagaaattgtactgtatttggtctaacttatttcagcctatctttattttaaaaatctatcattattttaaattttcttttttcaaatttcttaaaaattccaaatttttctccggtgactcatcgctattgaaaatatgctgctatagattttttggaataccttagctagtgaaatctttaaaattaattaaaagaatttaaaatttgtattctgaacctttttaaatgttcagttgtttaaagattaataaacaaattgcctttgtccattggaatcttcttaaataattaatgagtcgttctcggtgtttggtccaacttaaagtgcctgactgggaacgtttgttctttcaattttcttttaaaatttaattaggagccaaaattaaatattaatgattttttaaattttaaaattttagcgcgtccgcccgttgcgtcggccgttgtagcgccacatgcgacggcactcagtccaaagtcgtcaaagcgagctagcagagacgcaagtcatccatcgcggaaaaggcattgttttaaatttgaaaccttttttaaattaaaaaaagaattatttcggtaattataaaattataatttcattgctaattgggaattggattcaatgcgaaaccaataaagctgttaattatactgcccaacggttttcgccatatttttctgcggaaaatgctttaagccgacggcgcctatcggcaaaaccgtcctcaaattaattaaatttataaaattatgagaaaatttttggcgctgatgagcaaaattttttttttatttttttgcatttttgtcacaaattttaccattcgtagcaattcttttgcacttatgtatttattttgctttttaagtacctacaagtccgaacacaaaatataattaatgctaaaagttttaaacgaagataaaaatctcttttcatctttttctacatatatttatttagttcttcttttatttttactttttttttctttaaattaaaacttaaaaagcagacaaatttttcattttttcatttaatcattttttttatttaaaaatttttaattggttctattagttatataatatgttaaaaagcattgccacacaaaaaaattttctaagattgaattcatttcaatgtgtgtatagctcaactcagcagcagaatgggacaagaagtcgcgtcaattcctggtccaactcatcaaggcccagctcgctagttcaggcggctaaggacgcttgcattgctccggacgcaccaattattctattcatgggtatttatttaattgccagggcttggacgtgaggcttaaatctgctaacatatttcaaggtggcccgggcggtggcaaaacacgatacgcggccaaattgcaggaggagctgcgcgatgaagggcttgcacacatttgcatgccggtaggcacaaaaatgaatgtaataaagtttttcaaaaaagttatgactagaatcttgatcaagcaattattttcacgatttttggggtaaaaaaaaagcatgacttttaaaactcggttcaatactctcaaatgcgcatatttgttcaatcgaatttgaaaataatttaaatttttttatgggtttattgcgcaaaaaaaaagtataaaaggttctaaaagcgcgaattcgtctaatccattcccccgcccccctttttttttcttctaaggatttgatccgcacatcgattgctcgctacaaggaccgatcatcggaatggcgagtggcggccgagcgctaccagcgcggtgagctgatccccaacgaattggcccagcaattagtcaaagcggagatgggccgccaaccgtacgcaaaagcgtatttcattgagggctttccgcgcgaggcacgacaagtggaggactttgaacgcaatgtgagtgaaataattaaaaagcaattagcagattaatggatttgttggcacgaaagacggcacggcacataaatttgaatgagtggacatgagtttttatgagctcacctgcttcaacagctggacaccaattaagccacagagaatgggggagggggtggagaggctaatgaccgcataatgattatccgtaatagtctaattagcgtaaaaccctggtcacattggcttctgtttctttgccagattagctgctaacaataattattattatctcatcaatttgaatatgttcaggtcagaccggtggatatggcgttgattttggattatgatgaggatgtgctgagaaggcatatgcaaagtcgtggcctgtttcccgaggtgtttattaatttaatttattaaatttaaaaattaaatttaattttaaaatgcattaggtgattgaacggcgtatcgatgagttcaagcaaaagacattgccgaggtgaattaaattattttctgatcaaattatttgtaattaggaagcatttttttttaaaccttaccgatttatcttttcaatttcattgttaagctacaaattataaaaaaattaattagattaatcctgctatcattaattaaaattaaaatgttaaaaaaaaattttaaacattcccaccctgtttttttaagtgcaaaatattttgatgatcagcgtctgctccatttgattcccggcgaaaaggacgacgcgttgatcattgagcgaatgcgcaagttgatcgtacgcgcaatgcgtgctggcgttggcgccggagcggtgactggagcggcatcatcggccggctcggcacattcgtcgacgggcggcaccgctgggaaaacggagcatcagcaaaaaaatggtggcaataatattaaaaaaaagaatgtgttaaatttaattttcatttttaattttgtaaaatatctgttgccgaaaatcataaataattatttttaggctttggacaatcgcccgcggcaaatgaagcggaaaactcaaccaaagaagcagaaaaggtggcggcgactaaatgttctgctgctgaaagcaatg

SEQ ID NO: 46134 - DNA, 533 bp, Heterodera glycines
  Genomic contig location: Contig_ID=SeqID_28834; Location=414..946; Strand=+
  SCN-specific regions: Sequence locations=1-51,76-205,227-264,312 -340,363-456,528-533
  Gene Ontology: Mol. function=protein domain specific binding; Cellular component=cytoplasm; Biological process=protein targeting
atgtctgacaacaaagaagaactcgtccaacgggctaagctggctgaacaagctgagcgctacgatgacatggctcagtcgatgaaaaaagtcggaaaaaaacgaaaatttcgatgaatttttctccgttgaaggttacggaattgggcgccgagttgagcaatgaggagcgcaacctgttgtccgttgcgtacaaaaatgtggtcggcgcgcgccgctcctcgtggcgcgtcatctcgtccattgaacagaagacggagggctcggagaagaagcagcagatggccaaggagtacagggagaaggtggagcaggagttgcgcgagatctgtcacgacgtgctggtgtgttgaacaataaatcgaattttttggaaattttggacctaacttccgccaatttttttcaggatttgctcgacaaattcctgatcccaaaggctggcaacccggaatccaaggtgttctacctgaagatgaagggtgactactaccgctacctggccgaggtggccaccggtgacgaccgcaacg

SEQ ID NO: 46135 - DNA, 1496 bp, Heterodera glycines
  Genomic contig location: Contig_ID=SeqID_28838; Location=1..1496; Strand=-
  SCN-specific regions: Sequence locations=1-267,296-997,1019-1449,1480- 1496
  Gene Ontology: Mol. function=chromatin binding; Cellular component =dosage compensation complex (sensu Drosophila); Biological process =lariat formation, 5'-splice site cleavage
tcttcaggttccccaatttctgctggataatgcctccctttagtggcgtccgacacgcattttttgcactcagccgcgccgtctgccggcaattgccatagcaagacgcgtggccagcgaacgtggcgagcgtttcggtgccaccgttggctatcacattcggcttgagtcaaagtatggcctctgacattggcttagtttcagtttttcaatggaattctgcgatttttgtccctaattttaaaacagttttttgatcctaaagacatttatttttgaaataattataaatttagttgctccgccgaaacccttttgacttattgcacaagtggcgttttgttgcgcaaattgactaatgacgaattggccacagaagccacccacgtcattcttgtgaggttttgctgaaactaatgggaatttttaaacatggaaaatgctgaccacaaaaattcaggacgaagtccacgagcgcgagacgaacacggactatcttttgattgcacttcgcgaagcgctgaaaaaacggaaggacctgaaagtcgtgctgatgtcggccacaatgggcgacaatcggaacaaattcatgcgatactttcgcgagacgggcatcaaatgcgtcgatggttattttttaggaattttctatttttgggcacatccttttcaatcgttttgtttttgcagtgcctactcaattgttttccgtggaagtgtatcatttggctgaaatgcttgccatgaccggttatatgccgagttcccactacggcggaatgtttgacgagcgatccatgacggtgcgtttggctttggtaatttgttttttttaatattttccaatttagcagaatttccctgcccctccgcctcctctgtttccttccgctgtgcccgtcaacgcattcgccgcttcttcccaacctcggccacaatgttttggctctttttccaattctccctggggcttcacttctttcccctccggccaatgcttccccaccacacacccccaacttcaaatggttccgccggaccctttcgtttcaccgaccgctgccgccgcctctttggacggcttctttttgtggaatgattgcagtgcattttcagcagagcctgtatttttgcatttgtttcccaattatttgaagagaaaactttaagggaattaatcaaaaattgagtgctctgttgagagaccgtcccatgcatttcttgcccacctatgtgcgacgcgtgcgcgaagtgttgaacaaatgcattacgaaagacgctttgatcgaagttagcttgatttttacatccaactcataaaaagtagataattttagacttatttggatgctggtggccgccaatgggaagactccgtggattgcgaccttatcgctgagttgatctgttatctaatcgactgccaaatggaaggaggaattttggtgaacaattttaattttaaaatttgctaaatcattagtagaaaaataaag

SEQ ID NO: 46136 - DNA, 3384 bp, Heterodera glycines; identical to SEQ ID NO: 5843
  Genomic contig location: Contig_ID=SeqID_5843; Location=1..3384; Strand=+
  SCN-specific regions: Sequence locations=1-60,105-132,273-425,447 -502,555-608,630-733,756-1632,1655-2026,2058-2386,2408-2458,2493 -2623,2645-2768,2802-3384
  Gene Ontology: Mol. function=N-methyltransferase activity; Cellular component=membrane fraction; Biological process=DNA methylation

SEQ ID NO: 46137 - DNA, 1605 bp, Heterodera glycines
  Genomic contig location: Contig_ID=SeqID_28845; Location=39..1643; Strand=-
  SCN-specific regions: Sequence locations=1-264,286-1605
  Gene Ontology: Mol. function=ATP binding; Cellular component=integral to plasma membrane; Biological process=glial cell fate determination
atgggattcagcgggaaacgatgtcaaattaaggtgcttcaattggatgacattggtgtagcaaaagcgtgtcaatgccaaattaggacaatttgtgtgacccgaaccccgtgcctaaatgctggtcaatgtgtggacacgctttttgatcggcattgtgtgtgtcgacaagggtggacgggcgcattttgcgagcaggaactgaacgaatgcgagcagaacccatgcaagaacggggcgacatgtcgcgatttggtagaacaattaatttaatttaatttaattgccgttgcaggagaacggcttcgagtgcgaatgtgccccgggcttccacggctttcagtgccaatatatggtcgaccattgcgctgtctctccttgtcgcaacaacggcacttgcgtcaaccacggccccacctacgaatgccaatgccgacttggctttgatggaatgcattgcgaacataacctgaacgagtgtgagacgatgtctccgtgcgacgcgacggggacggaacgatgtgaggacattgtgaatgggtaccgatgccattgccggccgggctacgcgggcacactgtgcgaacggcacgtgaaccaatgcgagtcggcaccttgtgccaacaacggcacatgcgttgacttgggcgccggtttccaatgcgattgttcgccgggatggaagggacagcgatgcgaacagatggagtcggtgtgcgaggagcgcaagccgtgccagaacgccggcagatgtgttccgttggtggacgactatttttgtgtttgtccggagggcgtaagcggaaagaattgcgaattggcacccaatcgatgtttgggcgagccatgccgaaacggcggagtttgcggcgacttcggttcccattcggaatgcgcatgcccgcaagggtttggcggccccggatgccaataccgtttggatgtatgccgcgccggaacatgtcgtaacggaggcacgtgtgtggaagtggaggaccatcagcaacagactacggcattgccggaaggtggtccccgcgggttcaaatgcatttgtccgcccggattcaccggcaacgaatgcgagacggacatcgacgagtgccgtccttctccgtgtcctatggtcgcgcaatgcgttgatttggtgaacggctttcactgcaaatgccccttcaatagtgaggcctttcctctggccgttttacattgctttcctttctcttctgtccagtgaccggtgccaactgtgagaagcgcattgatcccgacttcgacctgcgcttcgtcgagtccgcccagcaaccgtcccgtgccgcgctttccattcctttccgtttcacttccgcttcactcactttgagcatttgggtacgctttgagcacggcgcgtggaggggcggaaggtcacttcagccgcagagggccccggcgctgtttttcggattgttcaacagcgagtaaagcggaattttgtgaacattgatcgatgacgaaatttgttcaggaatccaaaccaaccgtcgaatttgactgaactgatcagaatctctgccgatgcgctgctcgtccgtctgttccccgacaaagaaatggctccctctg

SEQ ID NO: 46138 - DNA, 1533 bp, Heterodera glycines
  Genomic contig location: Contig_ID=SeqID_5846; Location=112..1644; Strand=-
  SCN-specific regions: Sequence locations=1-166,200-565,587-744,774 -1018,1040-1533
  Gene Ontology: Biological process=mRNA splicing
atgggtgaacgcaagggacaaaatcattattacccacccgacttcaattatcaaacgcacaaaacgcttaaccgttaccatggcgtgcatgcactgcgcgagcgtggcaagcgtgcaaatgaaggcatcctcaccattcggtaagacgcggacacaattttatacctggaaaaaatttagaaaattttttccaaccttttagctttgagatgccgttcaatgtgtggtgcctcggctgcaacaaccatgtcggcatgagcgtgcgctacaacgcggagaagcgcaaagttggcatgtaagcggaacaaaacaaaaaatttttttcccaattttcgacgaaagggttaggggctaaaaaaatgaccaaatctcttacaattagaggatatttaagggttagtaaagtaaaattacttgagttttgatgtattcctaaggtttagattgattttcatattaaaaagtaaatctttttgaaaaaaaaatgttaagtaagccctctaaaaaaaattttttttttgtttgtttaggggagaggggtgggactgttatgaaggagctttcaaaaaatgaaaacctctgcttttttacagtttttttttataataatggctttccatttttgttaggtattacacaacaccaatctacgagttccggatgaagtgccatttgtgtgacaactatttcaccattcggacagacccaaaggtaaaaagttaatggtgcccaatctattttggcaattttttttttgatattaaaaattatatcaaaacttaaaagactattaatttcaactttttttcccagaattttgactatgaattggtggagggcgttcgtcgtcaggaaattcgctttgatccgtccacaattgacaatttggcaccggtggaccgaacaatgagtttgaaattgggtgccgatgcaatgttcaaggttggtttggatggagtggaattttgaaaaaaaaaaagttagagtctggctggactatgctttgtttttgctaggcccaggttctgggattttagcttacaattaaattttttatgagcctggctggagtttctatccaaagttaacaaacaaaaaaaaaatttttttttcacgggggacaactattgaaaagagttatacgccgtatacgacgggcttgaggcctagttgtcccccacccgtacattacacccccatcccgtctaagtctcctccccgtacaaaaatttttttggtttaaaaaaatatttttaggccgaacacacggtggacgacaagaaaaagttggccagtgcggacgaccaaattcaccggttggaggccattcagacacgactgtacgacgactacacggccaactcagtgctccgagggtcattcagagtgagtgggcaaattggaaaatttggcgtttttttttattgttttatcattgattgctccaaaaaatgccagaaaaagcaattggaaaatcattaggtttttttaaatttttcccaataggtcttgctgatgataattttcaataaa

SEQ ID NO: 46139 - DNA, 208 bp, Heterodera glycines
  Genomic contig location: Contig_ID=SeqID_28853; Location=17..224; Strand=-
  SCN-specific regions: Sequence locations=1-208
  Gene Ontology: Biological process=protein modification
atggttgaagtgttcgactctctcagcaaactttacgcggattatcaacgcacaacggcaaagaagttgaagatcatcgatgcttacatggtctacattttcttaaccggtgtcttccaatttgtctattgtttgctcgtcggcactttcccttttaacgcgttccttgccggattcatctccaccgtggcctgttttgtgcttgccg

SEQ ID NO: 46140 - DNA, 3209 bp, Heterodera glycines; identical to SEQ ID NO: 5865
  misc_feature (13)..(13): n is a, c, g, or t
  misc_feature (22)..(22): n is a, c, g, or t
  Genomic contig location: Contig_ID=SeqID_5865; Location=1..3209; Strand=+
  SCN-specific regions: Sequence locations=1-540,563-569,628-630,654 -826,860-918,940-1004,1073-1103,1284-1288,1312-1369,1391-1438,1551 -1745,1771-2027,2051-2052,2077-2162,2185-2221,2244-2265,2384 -2402,2449-2690,2783-2841,...
  SCN-specific regions: Sequence locations=...2863-2987,3009-3049,3071 -3075,3097-3126,3171-3209
  Gene Ontology: Mol. function=organic anion transporter activity; Cellular component=integral to plasma membrane; Biological process =embryogenesis and morphogenesis

SEQ ID NO: 46141 - DNA, 369 bp, Heterodera glycines
  Genomic contig location: Contig_ID=SeqID_28979; Location=173..541; Strand=-
  SCN-specific regions: Sequence locations=1-245,267-369
  Gene Ontology: Mol. function=glyceraldehyde 3-phosphate dehydrogenase (phosphorylating) activity; Cellular component=cell wall (sensu Fungi); Biological process=glycolysis
atggcgttccgtgtgcccactccgaacgtgtccgtcgtcgacctgaccgctcgtctggagaagccggccccgttggacgccatcaaagaggcggtgaagaaggcggccaatgggaagctgaagggcattttggcgtacacggaggaccaagtggtgtccacggtgagtgatttccttggctggtgcggtacgtcaatactcaaacggactcattttacaatgggttttgtgttccgttttcaatccaacatttcattttttgataataccatgtttttgttcctttcccttgccttgtgcttcatatatcaataatgtttttcaggactttcttggagactcgcactcgtccattttcgacgctggcgc

SEQ ID NO: 46142 - DNA, 416 bp, Heterodera glycines
  misc_feature (261)..(261): n is a, c, g, or t
  misc_feature (309)..(309): n is a, c, g, or t
  misc_feature (380)..(380): n is a, c, g, or t
  Genomic contig location: Contig_ID=SeqID_28988; Location=7..422; Strand=-
  SCN-specific regions: Sequence locations=1-104,127-416
  Gene Ontology: Biological process=intracellular protein transport
atgagtctattcggcaaaatttttggtggaaaaaaacaagaggcagctccatcgacacaagaagtattgcagaagctgcaagagagggaagacatgtttcaaaagaagcaggaatttctggaaaagaaaatcgaaacagtaattgttcgagattgaattcccctgggttaaattcctccttttaggaaattgccacggcacgtgcgcaagcggcaaataaaagggtcgcgttgcaggcactgaggcgaaaaaagggctatngaaagcaattggaacacattgcaggagtgctgaacaccatccaccacncaaagaccgcgctggagaacgcgtccatgaactctgatgtgcttggagtgataggcgaatcagcaaaagcngtgaaaaaggcgcacaatgaaatggacgcggacaaa

SEQ ID NO: 46143 - DNA, 1700 bp, Heterodera glycines
  Genomic contig location: Contig_ID=SeqID_5888; Location=99..1798; Strand=-
  SCN-specific regions: Sequence locations=1-393,416-425,448-503,535 -687,728-808,863-1024,1051-1085,1120-1367,1403-1405,1430-1537,1568 -1600,1622-1631,1655-1700
  Gene Ontology: Mol. function=GTP binding; Cellular component =microtubule; Biological process=microtubule-based process
cagcgcgaatgcgtttccattcacattggacaggcgggcgtacagatcggaaacgcgtgttgggagctgtacaaccttgagcatgggattggcaatgatgggcatctgctgaagaaggacgacggcacttgctctggggaaagcgcagcggaagatggccaatacatttctaatatgtcggcaaatcataattcaaaggcaaagtgccaggtgagtggggggggggggtcaaagaaagtgccaaattggcaaatgatggtaccttccgtaatttttcaattttttttatatcctgtaaattaatgcattttaaaccaatcggacttttcacgaaaaccctcccgaattagtttgatttttctcgttcaagtattacaacacgttctacaccgagagcagcaatggtaaatatgtgccgcgcgcaattttcgtcgatttggagcccacagtgattgacgaagtccgtgctgggccgtatcggcatcttttccacccggaacaattgatcaccggcaaggaggacgcggccaacaattacgcacgaggccattacacaatcggtgaattcaaatgggagaaagtgaaggggaaaagcattaagaaagattttaggcaaggaacaaattgatcgtgtgctggaacgtgtgagaaaacaggtgccaacagaagaagggcaaatgaattaagaataataattattaattatttttaattttcttaatttatacttttttgtaccctgaaatggcatttgtcccaattaggctgagaattgtgccgggctgcagggtttcctcgttttccattccttcggcggtggcaccggctccggcttcagctctctgctgatggaacgtctgtcggtggaatatggcaagaagagcaaactcgagttcaggtaatgaatgggcccaccaataacttatatttttgtatgactaaaattccgattcgatccccagggcctaattagatcgttaattacttttaaagcatttacccggcaccgcaagtggctacagcggtggtggagccgtacaactccattctaacgacgcacaccacgctgaaccactcggactgctcgttcatggtcgacaatgaggccatttacgacatttgcagaaagagcctagacgtggaggtgtttttgttaaaatttaaagttttattccgatttattttaaagatgccctcctacgccaatttaaatcgattggtacgttcgttcgctttttggcattacggaaaaagtggcactttttttttgtcagattgcccaaattgtctcatcaatcaccgcttcgctgcgctttgatggggctctgaacgtggatttgaccgaattccagacgaatttggtgccatacccgcgcattcacttccctttggccacctacgcaccagtgatttcggcggacaaagtaattaaaaacttagtttttattttcgattaattcacatcgtaatttaatccgtttgcttcttttccacaggcttaccacgaagcgctgtccgtctccgagatcactcacatgtgcttcgagccggccaaccaaatggtcaaatgcgactcgcgcaagggcaaatacatggccgtctgtttgctgtaccgtggagacgtcgtgccaaaggatgtgaacgcggccattgcttctgtgaaggcgaagcgtggcattcattttgtggattggtcagtg

SEQ ID NO: 46144 - DNA, 1463 bp, Heterodera glycines; identical to SEQ ID NO: 29006
  misc_feature (536)..(536): n is a, c, g, or t
  Genomic contig location: Contig_ID=SeqID_29006; Location=1..1463; Strand=+
  SCN-specific regions: Sequence locations=1-172,194-663,685-1208,1230 -1285,1311-1463

SEQ ID NO: 46145 - DNA, 403 bp, Heterodera glycines
  Genomic contig location: Contig_ID=SeqID_29034; Location=553..955; Strand=+
  SCN-specific regions: Sequence locations=1-41,63-99,123-145,167-403
  Gene Ontology: Mol. function=apoptosis inhibitor activity; Cellular component=cytoplasm; Biological process=chromatin modification
atgacaattcactctcgtaaagtggtggcctactattatgatggtccattttttaaccaaatcggtctcataaattccgttacaggtgatgtcggcaattactactacggccaaggccatccgatgaaaccccaccgaattcggatgactcacaaccttctgttgaactacggactctatcgcaaaatggaagttttcgtaagtatttattgctttttcgtttaaaattgcctttgcagagaccaaaggctgcgtcactagaagaaatgactaaatatcacagcgatgactatatgtgttttctgaaggttagtcaggttaaacacagtaacaatttaaaacgcttcagagcataaaacccgacaatatcgccgattttggtcgtcaaatgcaacgcttcaac

SEQ ID NO: 46146 - DNA, 1023 bp, Heterodera glycines
  misc_feature (112)..(112): n is a, c, g, or t
  misc_feature (118)..(119): n is a, c, g, or t
  misc_feature (121)..(121): n is a, c, g, or t
  misc_feature (136)..(137): n is a, c, g, or t
  misc_feature (139)..(139): n is a, c, g, or t
  misc_feature (143)..(143): n is a, c, g, or t
  misc_feature (146)..(150): n is a, c, g, or t
  misc_feature (155)..(155): n is a, c, g, or t
  misc_feature (161)..(162): n is a, c, g, or t
  misc_feature (167)..(167): n is a, c, g, or t
  Genomic contig location: Contig_ID=SeqID_29082; Location=1..1023; Strand=+
  SCN-specific regions: Sequence locations=1-9,31-339,362-1023
cccataatttacttttatacaaattgggaaaaaattggtcccccaggtaaacttttaatgtggataaaggggtttttgagcttaggacttttcgagttaaaattggggattntttatnntnaagtaaaaaagttanntntggngtnnnnnagggntctgtnntgggncctttattatttttgatttatattaacgatcttcctgatgccttgccatcaggagtgaaaataaaattatatgctgatgatttgttataaagcaagagccgacacagaaattatgcataaagcattgcataatttattcgaatgggcaaataaatggcagatcagaatctcaatttaaaaaacttttgtattatatttgggttcaaaaaacccaaaagaaacatacaaatttgatgggaatacaataaatgctgtggatacaattagggacttaggagtaaatattgacaacaaattacaattttccggtcatgttaaccaaataacaaggaatgcgtatttacgtatgcgttccttgtttcgaataattaaatccaaatcgtctaagatttggattacgttatacaaaacttatattaggcctttattggaatacgctccggaggtttggaatccgtctcttcaaaaaaatattaaacaaatagaaaggtgtcaaaaatatttcaccaaaagggtattttttaaatgcagccttccgccaattccataccaaaatcggttagaatacctgcaactgccaacacttgagaataggcgaaagctgtttgatctgttcatggcgcataaaattgcttatggccgaacagatctgaaactattttctatttttaatccctcaacgcgctttaacatccccttttacagatttaacacaaaatacaaactaggcaaaaaattcattccctttgctgggagggtaacaaaattatggaatcaacttgataaaggaaaaacaaattctttaaatcaatttaaaacaaaacttagaagttcactagggtaatatgtaagaccg

SEQ ID NO: 46147 - DNA, 383 bp, Heterodera glycines
  Genomic contig location: Contig_ID=SeqID_29137; Location=32..414; Strand=-
  SCN-specific regions: Sequence locations=1-223,245-383
cacgaatccttcaattattttgatcaattccgatttcctaatctaaatttgaacaaaaaatcataatttgaaaaattcaaaatttcgatttttattcgagttcgggttagggattagaaatgacatcggactacatcttcaagacgcgctaaccgaagtgcatcaacatgaacccgccgaacggagggctcggcccaaaggaatccggcaaggtggacggctcctgcgacgccttcgaccccggcagcgaggacaccaagggcgaccgagtgaccgtggagtggaccaacgcgccgaacccagccgccaccgcggtcaaggtcgaggggttccagggagacgggatggtgagccgcaagaacttgtcgatcgagtacagcggc

SEQ ID NO: 46148 - DNA, 433 bp, Heterodera glycines
  Genomic contig location: Contig_ID=SeqID_29153; Location=140..572; Strand=-
  SCN-specific regions: Sequence locations=1-433
  Gene Ontology: Cellular component=mitochondrion
atggatggacgaaccgccgatgaggcgatcgttgccactgtgagtaaagttggcgagaatattcaactcgcccgagcatctgtcatttcttcttcaccagcgaacaaactttttggtcaaacccatccaaaaggtcgtcgtatggtttttatgagtgaaataatctttgtttttagaggaatttaacggcgttcaattgggacgttttatttcgttggtgtctttgggtcacaaatcggatgagagtgtttctgactttccaacagcacaacttggccaagtgatttgtcagcacatcattggaatggcgccggaaagtttgggtgaaccaaggaaaaagggagctaaacgagcaactcaaatggaaatcgttgatgaaagtgacaccggagaagaggaggatttgaacgcttcacaagttgaccaatccgag

SEQ ID NO: 46149 - DNA, 4425 bp, Heterodera glycines
  Genomic contig location: Contig_ID=SeqID_5945; Location=1521..5945; Strand=+
  SCN-specific regions: Sequence locations=1-361,489-533,670-670,868 -960,988-1029,1053-1102,1132-1132,1182-1182,1218-1218,1269-1269,1391 -1453,1637-2021,2043-2395,2417-3160,3189-3534,3556-3598,3620 -3833,3855-4307,4329-4425
atgactaattggggtcatttccaacaaatcgacgcttcggttgcccacgttcagacgcttttcgctatgtacaagcagcagcagaacgagcagcagcagacgcagtgcatctacgacaaggcggtggcgctgggcgcgctcggcaacgccggcctggacattgcgcttgcggacctggagcggatcatcaaggacacgcgcgaggcacgcgtggtccgcatgatggccattgacgcaacgcggcgcatgcgcacgcaaatgccgcacagcgtgcgcgccatgttgctgccggtgttcctgaacacgggcgagcagccgcaggtgcgcatcaccgcttttgccaacattttgggcgcacaaccaacggccgaagtggtggaccagctggtgtacgcgattggcaaggagccgaaccgggaagtgcaggcgtactgctacagaacgatgaagaccatggccaactcgcagaagccggacgagacgcaaatgtgagcaaattcaaaatttggcaccgaaaaattggccgaatttagtgccaaacacgtcaaatcgtcactgaaacagttggcaaatgccgtggacgagcagcagttgcgtaccagcggaaagtggcagttcgagcagttgtacaacaatgcgcaacgcgagggcgtgttcatgtcttttgtgaacgcggtttcgtcccgctccgcgctgcccgcctacgcgcacgtgcagttggactcgcacttcaacgaccattatacgtacaacaagctcaacatttacatggtgcagcaggaagccgagcaatggtacgagcgggcaatgaacagcttcggcaacagcaagcggaagcagaagcagcagcagcacggcagcaagcagttgagctccatttacgagcagttgggcatcaaaagccatcggtccgactttggcacagtgccaacggcggcggacaacgacaacgaggcgtaccagcaacaccagcagcagcagcagcagaacaacatgcgtccgttcgccatgcttggcctccgctccaataacgtggacaaggcgttcattgcgctggacgagcacacgattggggagcagacgcgacggatgctcaacggggaggagatgaagccgaactgggccgccattctgtttggccacggggcacagcagcagcatctggacatggcaattgtgcagaacatgggcgagaaggaggccaaaattgcgacgtcggctggcgtgccgttgcgcattctgagcacaacgccaatgatggcaaacgttgagggacgcgtgggggcaaaggcggcgccaaaaatgggaccatctgctgctggtcatgggctgagtgcccagttcgagttcagcgccatgtcggcacggatggcacaaattcagaaaatggtttgccataaaaaataacgcccattttttaccgggacccactcgtcatgttggcattttctcaggaactgatcactccgtttgctgccagcggcgtcgaaagtattcgctcgctgcacatcaatttgccgctgcaaggcgagctgagtttggtcaactctgagcagcagcagggcatcagcatcaaagttaagttgccccagcgcgggactcagttggccagcgcccactcgctgccgttcactttcatcgccaaggcggagcccagcgctcagtttgtgcgcgagccgcgccaaatcatcgccgtccacgaccccaagctggaccagcaacagcgcgaagtgaattccgtgctgggccaaaaggcgttggcactgccgctgcagattcgcggtaaattggcgggttcgatcagagatagagagtggcatatgatcagaggaagtgataaataatgacagaaaagtgaaattgatcagaggggaccatggatgcactgatcactcaaaatatgatcatcggtccgaaaacagggcgactgatcagtaataggaaaaatgggtgggaaatcatgtgactgatcacgaattctgatcagagattaagcctgagatagacagattggcagaccaaaacctcaaaatttggaagttttcgccgtgccccacccattagccgctccctgaaacttttcctgtattaaagtcaggatcggacaattagttacagattgttggtcattagcgcaattgattccgcttaattggctagctgctgtaagtttccgttgttcaggccactaccatgtgccagccgagccgtccaacctgctgcagtttgcgcagctgctgatggccaccgagaacgcagtgcacgtacagtaccaacccaatgaggagagcccgcgcgagttgaccatccgcgcaagcggcgaacacttccgcaaagcggcacagatgcaactgccggacacgccgcagctgcacaatttctacgcacaacagttccacagcagcagcagctgcgacagtgacgactccgtcaatgcagcgaactgtgaggagaacgacgcgacggagcagcaacagggtgaaaacggcggcgagcagtacattagtaacgacaaccagcagcagcagctgaacagcttcatcagcgcgtacaagccgcgtcagcaatacgcacacgcgctgcgactgagcgcgcaaacgagcggtggggcacgggacgcgacggcgcacgccaacatccaagcgcaatgtgacgagcggatgcgctactgcacggtgcaggcggatgccaacaagaaccaacagtggacactgagcgcacaagcacaagtggtgatgccggacactgtgccgtcggtggaacagttgcagcagcccaccatgttgaagcagttcatcgcgctggccaaagcgcagtggggcgaccagcaggacaaacagcacatgaacgtgcgcattcgcggcacgcaagcgcacacggagcagacacgcgcggtgatggcgcaaatccagcagcagcacgagggcaagcgacacgggttcagcgctcaacagcaacgcaaaatgctgcagcgcagcgccttcctgaaccaattccatgtggaggctacgtacgcactaaaggcgtacgcacagaacatgatgaaccgcggaatagaactgctaaagtcggtctacttctggaacaccaaatcgcaactgttgggcggaccgaacgcaccgaaaaacggaaaggtaagcggaaacggacattttgatcatcacccaacaatgatcagaatcactgatgacttactgatcaaaaggatttgatcagaaaacggggcattaaaattgccgaaacccgctgctgatcagttgagcatcaaaaaatggggggaatagccatgatcagacattggtcaatcagtagttatcaaaacagaccgatagcgaagggtctctctaattgatcagcggaactacctcccctccaaaatttgatcactgattagagaatgcgatggcattgatctcgccccccttttgtgccacagatcgccgccacaatttccattgatccgctgcagccaagcaatgccaacgtgaccatccgtacgcctgcgcagcagttgcacatgcagcaaatccaaatgccggccgcggtggggcgccccttcccactgatccgtcaacagagcgcgcagcagacgcattcgctggcacagctgttctacaagcagttcagcctcaaaagccgtgcccaatgcattgttgacggacgaaatgtggacacttttggtaagggggggggggacggcacattagacaaagtcgggaatcaatttgggaaattctcgacggactattcattatccctaatcatttgtctgatgttttaagacggctttgccttcaccgccccgctctcctccaattgcttttctgtgctggccaaacactgcagcagcccaatggaagaacagcatcagcagcagccccaatttgttgtgatgctgaagaaagtgccgggcaaacagaacgccaacaaatcggcacaaaaagcggacaaagtgaataattgaaattgaaggagcgagaagaatttaaaaatgatgacaattttcaaaaaaaggtgctgaaagtgatcactgctgagcaacagatcgaatgtcagcccaaaacagcgcagggcaaaaagggacaaatgatttgcaaagtgaacggacagccgatcagcggggacgagcagtgtcaggacgagctgcagcaccagcagtgcgtgcagttcaacgacccacgccagacggacgtgaccattcgcacggggccaatcgcagtgcgattcaacggacgcaaggcgtggctgaaggtgtcccaggcgtacaagaacgcccagtgcggactgtgcggacactacgacgacgcggacgagcaggagcaggagttgaggatggcaaatggccaaattggtgggtttggagggcttaatttggccaaattggtggatgaggtggaccagtggaccaagcagaaggcggcataa

SEQ ID NO: 46150 - DNA, 1217 bp, Heterodera glycines
  Genomic contig location: Contig_ID=SeqID_5948; Location=741..1957; Strand=+
  SCN-specific regions: Sequence locations=1-432,454-661,683-768,790 -1217
  Gene Ontology: Mol. function=structural molecule activity; Cellular component=clathrin coat; Biological process=intracellular protein transport
atgaatctgatgtcaaatcctcaagtggccgatgctattctgggcaaccgaatgtttaatcactacgacagagcctcgattggtcaattatgtgaaaaagctggtcttccgcaaagggcgttggaacatttcaccgatttgtatgacatcaagcggaccgttgtgcacacacaacatttcaattcagaggttattaacctattcgttatttttaaacgacaattttttcagtggcttgtcagttattttggccgtttgaatgtgcaagattcgttggaatgtctcaaagccatgttacaagcaaatctgcgtcagaacctccagattgtcgttcaaattgcgtccaaatactgtgaacagcttggcacgcaatcactcattgacatttttgagtcgttcaaaagctacgagggacttttctattttcttggttccattgtcaacttcagtcaagactcggaagttcatttcaaatacattcaggttccttgagtcgtccattttaatttccatgtaaattttcttaaggctgccaccagaacaggacaaatcaaggaagtcgagcgcatttgtcgcgaatcgaattgttatgatccggagcgtgtcaaaaactatttgaaggaggcgaaattggctgaccaagtgcttttttaatctcttctatttgtaaatgtcaaattttgtttagttaccactcatcatcgtttgcgaccgccatgacatggtccaagatttggtgctctatctctaccgcagcaatctcatgaagtcaattgaagtttttgtcagcaaagtgaatcccaaacgactgccaattgttgtgggtgcattgctcaacgttgactgcagcgaagaccaaatcaagcagttgattcaaatcacacgtggcaaatttgacatcgatgaactcgttgaggaagtcgagaagcggaaccggtcgggcttttggattacatcctaccggtttaccttttatttttagtctgaaacttctgaactcgtggttggagagtcgtgtccatgaagggaatcaggaccaggcaacccataacgcactggcgaagatctacattgattccaacaacaatccggaacgctttttgcgtgaaaatcaattctacgactcgcgcgttattggcaaatattgcgagaagcgcgacccgcattacgctcttttggcatacgagcgcggtcggtgcgattctgaactcattgcg

SEQ ID NO: 46151 - DNA, 3130 bp, Heterodera glycines
  Genomic contig location: Contig_ID=SeqID_5953; Location=483..3612; Strand=-
  SCN-specific regions: Sequence locations=1-2,24-74,121-274,311 -321,350-438,460-531,576-608,630-650,676-918,958-1244,1282-1520,1543 -1583,1605-1618,1641-1716,1739-1821,1844-1976,2017-2372,2394 -2416,2438-2448,2473-2677,2699-3130
  Gene Ontology: Mol. function=protein serine/threonine kinase activity; Cellular component=centrosome; Biological process=protein amino acid phosphorylation
ctgaaaaatttcaaaaaattaaaggatttggggcgcggagcattcggcatttgtgcactttataaggtaaagcgaatatttttaaaaattattttcaatttatattaaaattaaaatattggcgatttttgtatttttaattcccttcgaaaaaaggatgaaacaagtcggctaaacaagaaagtggtgatcaaacgagtgtcacttgaatgccaaagcgaaaatgacaagcgggcaatttcatgtaggacgcttttattcaattgaaataagctaaaataaattatcaatttttgaaataaaattataacctaccgtaacaaattataaataaataattattatttatgagttattaagatgaagccagtttgttgaagaaattgtcccatccgaatgtcatccgtttctacgattcatttgttgaattggaacagttgtgcattttaatggaatatttggatggtggcacaatggaaaggtgataaaggcggttgtacggtccgcaattgtcgtaacaccgtgataaacaataattaaataataaaaattatttatgtatattaaaataaaatgcttattgaggatgatccaggagagaaaaggcattaaaatgggccaagatttggtgctttattattttacccaggtaattaattaattaattgatttttgtgatagcctatttataccataaatgacctactttaattaaagccaacactaattggacttttattttaagatcgttttggcattggaccatatgcacgcgctgaaaattcttcaccgcgatatcaaaacagcgaacatatttttgaacagaaaaatgacaattgtcaaggcatgtttaacttttagattgccaaaaagggtaatttgtcccctaatgattcaggttggcgattttggcatcagtaaggtaaaataaaataaaagaaaaaaaaataataataagtaattgagaacttcactggcttatgtttttgttaggaattgaattcgaaatgtgctcaagcgtcgacatttgtgggcacaatgaattatgtgtcgccggaaatatgcgaaggtcaatttagaaaacaaaaagcattaattacacgcacaattatgtaattggtgaatttgcaaaaattctgatcacctaattaatggtattatcatttcatggaataggccgcgcttatgggccaaaatcggatgtgtgggccgttggttgtgtgctttacgagttagtggaggtaaatgacaagcattataaaaataaatgaattaattcatcctttaagttgcacaaagcctttgacggcgactccatccaacttcttttgctcaggattgcaagagtataatatgtttttatttttaaattacagtttaatttgctaattgccagggtcaacacggcccaatttcgtccacagttacgtcgggaatgcgcgaactcattgaaaatgttatggaaattgatgaaaaccgacggccaaacacaactggtacataataatacatataatctaattcaataaatatttttgcaattaagagattcttctcaaaccgatggtattgcaaaaatggatggaaattcatacaaatttgggtaggaatatttgacttttaaaaattaaatttaaaaacaaactttttagggcgaattgagccggacatcgaattgtacacaaaagaaactcactgaagacggaaatcacagtgaattaaaaaaaataataataatgaactctgattggtttaaaaagtgtttttacaattcctgtgttaattttcttaattcagggcgaaagagagttggagacaagaaaatgcttctcaattcattttaacatattacacttcagcttaatgttagtataattaatttgcaatttttgaggatttttcgcgaaatttttattaaacgcaccttaaaacccaaaatttcgaaatttttcgtacatattttgaggatttttgagaatttataaaaatttcttgtaaaaaattaaaaaaaaatttctggaaatgtacccttaaaaatcggtatttttcaaaaaaagagatattcaaaaatgaatttttaaagtgcaaaagatgaatctaaacctagtttgagttattattttacatatttgtcgatttttcttacataacaaagaagccctaataattagaggtgcgccctgaaccacggtcacggttaccgtgaatttcatgagttttttcactcacggtcacggtcacgattcacggtaccaattcacggttattccgtgaaaaatttacactggataaaattgaatatttatgaaataaatattgttttcatagaggaattttgtcttttttgggcaaagtttgctaagaaacagagcaaaattttcaaaaatttccccggcgcgcctatcggcaccgccggccccctcccctccaaactacctatattgtgcgaaaaacaaataaaaagcaaagtttcaaggatgaccctttaaataaaaactcattaaattaaaaaaaactcgcacgaaataaagctattttgggcaaaatcagttaacaaatcccaacaaattttcaaaaattttccactaaaatccctatttttttaaaattgggtaatatgtcttataaaatcatttaaaaaggtcggaatcgatttggacgcaaaatgatgagaaaattcgttgttttttgtctttgtaaattgattaatgttgcaaaattcgctcattttaccggacatatttgtgcacaaattgaactcaaattttatattttctcctggcggcgcctatcggcaccgccaggcttccaaaagcgtatttttcataaaaaattggttcagattcgcaaaattttgccatttttgacaaaatctgtgcacaaattgaattaaaatttttgcggcggcctctatcggcgcctatggaccagggctgcacgcaagtggatttacaattacggaaatccgcaatccgcaattacgggttccaaaaaccccgcaatttccgtaatccgcaatccgcaatttcgtgcagccctgctatggacccccgtttcccaaaaaattttttttggaaaattataccacaaaaaaagacagtgaaaaacaaaaaattcgccgacagggaaa

SEQ ID NO: 46152 - DNA, 4627 bp, Heterodera glycines
  Genomic contig location: Contig_ID=SeqID_5956; Location=1655..6281; Strand=+
  SCN-specific regions: Sequence locations=1-143,165-300,323-429,451 -456,479-606,628-744,767-1082,1104-1111,1135-1385,1408-1445,1476 -1483,1505-1580,1604-1871,1893-1981,2005-2050,2073-2103,2126 -2457,2488-2613,2636-2727,...
  SCN-specific regions: Sequence locations=...2756-2870,2892-3232,3254 -3468,3506-3506,3528-3588,3719-3830,3852-4026,4097-4105,4128 -4146,4181-4181,4233-4275,4299-4299,4424-4484,4506-4627
  Gene Ontology: Mol. function=RAN protein binding; Cellular component =cytoplasm; Biological process=embryogenesis and morphogenesis
tagcctataactttgtcaatactagatcaaataaaaccattttatgctcattttgaagggaaaattctagagaatattgttagttttatttgatttggccttaaatagcgcacttggctaaaaaagaattaaagtattgaaatgtttgccatgggaaaaaattttttcctgtgggtaactttttttgaaattttgtataggcccatattttgtcccccactaaataaataataataaacctatttgcactgagagcccaaaattgggccgctgtgtttataaatagggaacggatttctaagtttttgcttattttttctgcggctttaactcgacgagaaatgcacgaaaaacacattttttgttcgaaaattttgtgttttaacgcacttattcgaacttagaaatgcttattttggcgtttcgtgcttaaaaatgcttattttagaggttcgcccttaaaataagtttttgtacttattttagcgttttatgcttattttcgttcttatttcgcgatttttgggaaatttattaacaaaaatgcaataaaaatgataaatacacccctaagaatcggccaaaaaaatttcggaaatatacacccctgagaattgacctaaaaattttcaaaaaatacactcctaagaatcgacccaaaaaatttcggaaaaatacgcccctgagaatcgacccttaaatcctgaaaatttctaaatgtacttcatttctaactgcaatcagtaaataaaattgtttgacttaattttaactaatttgcatagagaaaacagcaattttaacaaatttcacctctacatttggaattttttcatgcttattttcgcacttatttcgcgcttttttcgcccttatttaagcacttattttggactttttcgcgcttaaaaatccgttccctatttataaatcacaccgatcactgcctttttgtattacctatttaggtatttgatcagccatagccatggctctctttcataaactgtatgtacaagttttatattattcgaagattttaaatgagatagtaatcttttttttaggcaaaagctctgcaatttgaaatagaataaaaattgagttttacaaaattataaataataataaaaagtatttcttttcctctccttttggcgtactattttcatgtctctaacacattaaaaatcatgaaattcgcaaatgctaacaattttctctaaaacggtataaaatcactttcttcttttagaatcaatagagaaaataatggttttagcatttggttgaaatcagcagtttaggacttgagttataacgtaatgaaaatttgaaactcccacaacttttttctgatatgtcaaattgctggtactagttaagtttgggtcccccttttgggtcaaatttttcaaaagcgtagacagacagtcagacagtgcgctatttccttctttatttttctcacttcttcccttttcccacacacagtgctgctgcacagcgagctacttatcttagatatcaaatttgttcggtttggttgggaatgaagcgagttgtctgattaaaataataaacaatacaaaaaagacatttaccagtgtaaattttgaattaacgcgcaaaaatttacgccaaatacgctatttggcgttatgagtaattttgtctaacactgggcttgacccatagtgcatttattgtcttttcgtgtttaatactccaaacaagaaattcacaaattcttcgctagacaaatttttagtgtgactttatattagagtagagcgggaccgggaccaaaacacggacaactgagtacaactgagtaccgaggtcccggtcttgaccgggaccgggaccagtcccgggttttttcccggttttcccagccaaaaattcccggtttttcaacccgaaaaggtcccggtcccggttaagcccaaaattcccggtctcgctctactctactttatattaaaaaataacttttttactggttgtgttaactacatataaagttgtagttgatgtaatttttttcttgtctttttagagaaaatttgatatggactctttccttcaaacaaataatgatctcattatttcaattcacaaggccttagttgaatctactcaggaaatcaccaggaaaatagtaagatgctgatgtatatgggatacacaaatttggctaaatatcatctagaatttatggcacttttccagttgatggcccctaaatttgaagtcgtgaaaacttattcaagaggttttcgtgatcactaaattttgccaaacctccaaggaacaaaccaaaagtgcaaattttcgaatttatagttttacaacaaatgttcacgaccttttatgacaaaaaaatttttagcaaaccaaaaggggtccctccccctttggttttttcagggaccatcaactggaaaaagccgaatttgttaataaaaataaaaatctaggagaatttgcgggatgatgttcgtgacgtgaagttgtcgctggctaagaacgatcgtatcatgcaggaagaggctacaaattggcgtcgtcatacggaggctattgttaaggagttgggggaccgacatcagagtgacatttctggactccacaaattgctattggaactgtgcattcgctcttcacaattaccacaagctcaactcgctgttgtagaaacgaaacagtcgaaagaggacgaagttattttttttgtttaaaaattttaaaaccctaattttaaggatcacacgaagaaggatgttgaagttgtgcagattgctaagaaggatgttgaagttgcgcagattgctaagaccgttgagcctgctgagtttaaaccgactgttgagcctgatgcagaagttctgaagactcttaagaccgttgagcctgttgggtttaagccgactactgagcctgtcggatcacaatttttgcatcattattttgtaattttttctacagactcctgctgttaccaccgctgtttctgttgctccgttgagtggcactttaaccttcaccgcttcgtccatccctattagcggcagtctttttggtggtgcttgtcgacccggaacaaacacgttatcgaacttggcggccaaggtcactgctaagaccactgaacctgttggatttaaaccgacttttgagcctctggtaatccaattttttttcctttaaaaaaacttactttagcttcctgctgttactactactgctgtttcggttgctctatttaatggtgcttcaaccttcaccactccgtctgtccccattggcagcagtctttttggtggtgcttctcgtccgggaacaaacacttttgcgaacttggcagcgaaagtcaaattttgttttttttttactagttttgcttattttttgttatgtaggcagctgagtcgggtggtggttttttgggcggtggaggcgtcactgcaaaaccgatccaatttggtcaatctgcatttggaaccaatgcaaaggatttcaaggtttgctaattgaaaacaacaactgaatctgtacgatattgtgataatacgacttttttatagcttttccaacaaccgccttctcagccttcattcagttcaaatattcataccgttgataaaactaccgatgaatcgtacagaggtgatgaggggtcggacaaagaagacgctgcagaggaattcgttccagacgtggtaatgttaattttggctttcgtcacttgctgattgtgctcaccaatgcttgctgttttggagtcccctaaaaattatgtgaattattaatagccataggggtcacccttttggtttgtaaaattaaattggtcttattgttaaattagtgatcaacaaccccaaaaaactaacgaacattttttataccttattatgataaaaaaaaaacaatagaatccccatttggttcagtgataccccagcaagcattgggtattaccatcagaaagagtcactgattgtctaatccacttttccagcattatgagcctgttgttcctcttccgcccgaagttgaagtttctactggggaagaggaggaagaggtctgtcgcatttttattaagcattttattaaaactgtgaaaaaaaattctaaaggtcattttctctgctcgttgcaaattgtaccgttttgataaggatgctcgggaaaacaaggagcgtggtttgggtgatatcaaagtaatttatccaaatttaactcctttttaattccttttttcagttgctttacaatcctcggagcagtcggtatcgttgtgtgatgcgtcgtgagcaagttttcaaactgtgcgcgaacttcccaatttatccggacctgaaaattcatccgcgtgagcatatgccaaccgtttacacctgggcttgcagggtgagaaatataaatgttcagtctatttctgtttaaaagccacttagtgattttatgcatgctttttgtatttccatctttaggacttcagcgatgaaccgtcccaaggagatgacgtgacgttcagtgcgcgcttcaaggataaggtttgacattgggtgaaaaaggctttaaatggtttttgggttttaggcaatcgccaggg

SEQ ID NO: 46153 - DNA, 442 bp, Heterodera glycines
  Genomic contig location: Contig_ID=SeqID_29311; Location=15..456; Strand=-
  SCN-specific regions: Sequence locations=1-115,147-171,206-239,261 -278,322-442
  Gene Ontology: Mol. function=structural constituent of cuticle; Cellular component=extracellular; Biological process=cuticle biosynthesis (sensu Nematoda)
atggattcctcctctgactttgacaaacacgctgcccagcgcgaggcggagtcgctccgcactttggccttcttcggcgtgtgcctgtccaccgtggccacggttatcgctgtgatttccgtgccgttcgcctaccagcacttccagcagcttggcacccaaatgcagaacgaagtggacttctgcaaaatgcgctccggcaacatgtggcgcgaagtaaagccgaaaaagcggaggggaaaagccaggaaattttcaaaaaatttcaacaaattttcaggtcacccgcacccaggcctactccaaggtgtcgcacgacagacgtcacaagcgccaggcaggcagttgctgtgtctgcggagtgtcgcccccgggcccgcccggaccccctggtccatctggacaacccggtggagacggacaacccaggaggctcacgaca

SEQ ID NO: 46154 - DNA, 3392 bp, Heterodera glycines
  Genomic contig location: Contig_ID=SeqID_721; Location=1..3392; Strand=-
  SCN-specific regions: Sequence locations=1-557,579-586,612-621,652 -653,689-732,771-915,937-1090,1199-1242,1264-1459,1481-2765,2787-3392
  Gene Ontology: Mol. function=Rab GTPase activator activity; Cellular component=soluble fraction; Biological process=positive regulation of cell proliferation
gccgccaatttggtgaaagctgaccatgacgacgatgtcgacgaggtggtcgagagtctcgacaaatttgacagttttggcaaaagcggtgccaaagaggaggacgcgttggaaattattcaaagcattttcccgctcggcggacgacctttcacggcactccatcctcagctggtgccgcaatactttgaggagccgttggaattgtaaaaatttcaaaatttggcattttttaaatgccaaaaaccgaaataaattttggaatttaaatgccaaaggttcgacgagtttggttttcggctcgcgcaagaaacggagaacgatcatcagcagcagacggtggacccaacgctggagaagccgccgcttgaaagctcgtcgcacaggtggcacaaaaaaagtgccaatcaatgatttcaaaccggacaaaatgccaaaagaattggcactgtcctgcgcaatttgatttttgaattggaatcaagaatttttccaaattttcggcaccacagaacccaatttaccttcataaaaatgccgaggccagaattttttctcggctttgttgccaaaagttccgaaatccaaaaaaaaaattaaaaaaaaaaattcaacgaaaaataattttgcttttttaaagaaaggaagggttgatacaacaaataaatttattttttggtgaaatttgttaaatctttcaaaaattccaaagtttttgaaaaaacgcaccacaaaaaaaaaattataataaaaagaaatattgttaattactagggttataagttgtatgattttgcatattttttctacgcatatgctatgaagaaaggggcttaaaaatagcatttctacgttaaaattttttgatttggttaatgtttttagtgcatataaaagcatattttgggggttttcgggaataaatccatatttcgccatttttgggtttttagagcatatttcggctcattttttggaaattttcgtaaaaaaatggaaaaagcgaaaaatacaccccctaaggatggactttttgagaatttttataaaaaaatacctttaaaaatcgaaaaattttgaactttttgtgaaaatttttgaaaaaaatttcttaatataaaaaatgtaattttgttttagcacaaaataaaaattttataaattctaaatttcatatataaagttttaaaattaaaatgttttgtaattgtctgaaaacgctccttagtcattgttttggtgttttaaagtctctgaatttttacacaatttttggcatttttttgagggttaaaaaccatttttggcagtttttaaggcatattttagtgcatatttaggcatttttcgggtttttagggcatatttgagggatttttagtgcatacaacttataaccctattaattactttaaaaacatacttctggttcgggatttctaaaaaagaaaaatacaccgctaaaaatcaaatttaaaattttgctaatgatggcacatttttttggcaattaatcatgcatggcaaaataaaattaatcagaatgcgttggttggcactgatcgaaagtgcgcattcccaagtggaggacgaactgtgctgggccaaggtggacatgcaacggttgcggcacacgcccaaattcatgccgatggtcaacgacggtggcattccgcactcgttgaggccgttcctatggccacggctgtgcagtgccgcggaaaagcgcaaaaaatgtgcgtgcgcattgcgcatttgtttcactgtttttttttcattttctgggcgtcgttttttggcattttgcgggcactgttttttggcattttttggacactgttttttggcgttcttgtgggcactgttttttggcattttttggacactgttttttggcgttcttgtgggcactgttttttggcatttttcggcactgtttttggcattttttggacaccgtttttgtcattttggcatttttgttggcaccgtttttggcattttcatgggcaccgtaagtgccatagcgattttggcacttcaaactttgtggaattttccgcgaatttttcgcgcaattatctcagagattagtcaaatcttgggtcgttattcatatattaattaagcattttgcttttttcagccccatgtgattacgcgaaaattgtccggaagtgcaccaaggacagtgtgccggcgtgcatcaatgtccaaattgaaaagtgagttttacactcaacgagttcgagagtctcgaccacagtctaaaattttgaagtgccaaaaactccgtcaagctaacaaatttatgaaattgcagaaaaatgtttttggcacttagcgggctcgagaatcttggaatgcccgggcgggatcgggatcctgccgggattttccttgggtccagatcctggctttttttttgaaaagggacgggatcgggatcccgacaaaatcgagatttgggtcccagggtcgggattaaaatcacgagaaaaccggatcggttcgggatcccggcaaaatcgggatttcaattccgggaccaggactatcccgacaaagtcagaatttcaatcccggaaatcccatcccggcctggttccaatccgagtgccgattccgacttttttttaaatataatttccgggactagggacctgctgcgcactttgcccgcccatttctgcttcggccggccccattccgttggcattgcgccactgcgccgtgtgctccgtgccctggcatttctgttccccgagattggctattgccaaggcatggcatttgttgtcgcctcgctgctgttggtgtgctgtgaggagaacacattttgggtgggccaatttttcggggttattaagtaattttgtcgaaactttgatcgatttttttctgatcacttttggcgccggagccaaaaaagccgaaaattcaaaatattctctacaccagggatgggacattccggggggccacaaaagtcgaaaagcggatttccgacatccaaatatgtataaaatcggaattcccaactatgtccaaaaccggtaatcggaattccggccaccaaaaatgtcgaaaaccataaacagtaaattccgatccaaatttattatgggaatgccgtccgttttgcagatgatgtgctctctgatcgagggcattttgaccccttccttgtatgcgccatcactgcttggagttcgggctgatgaacgcgttatgcgccatctgatccaggcaattctgcgcacgagaacagactttcctgggtctgggattaagccggatgactttaagctgtctgaatgcgtcgagaattttaactggagacaccctgtggatctctattaatccccctcctccataattacagtatataa

SEQ ID NO: 46155 - DNA, 629 bp, Heterodera glycines
  Genomic contig location: Contig_ID=SeqID_723; Location=225..853; Strand=-
  SCN-specific regions: Sequence locations=1-504,526-629
atgagtgccaatggcaaatttcggatgggattgaatgtgcgcaaaagcgttgagacggcggtagggccgaaaaagacggccaatatttttggagacgaatcggacgacgacgaacaacaaaatgcggcggagaaattcgagcggaaatacgccgcatcggccgggacaaaagcgtagggaaaaacaaaatggaatgggggacaatgggaaaaacaattgtttaagccgagaacagcgaattgttgagaaggaattggcaaaaaacccggacattttcgactacgacacgcattatgaggaaatacagcagcagagagaccaaaaagtggcggcgcaaaaggaggcggacaaagagaaaaaggtggacaaaatgggcggattgaacttgttgagttggaagaaattcatggcacaatttcagcccaaatacgcccatttgttggccaaagcgcacaaacagcgcgagctgagcaaactgttggtggaggagaacacttacaaaaaggaacgcgaaaaggaggcgggccaatttgaggacgaagaagtgttcgtcacgggggcgtaccgacagcaaattgaggagagggaacggcacaaaacggagatggagcgggaggaggcactcgaaa

SEQ ID NO: 46156 - DNA, 1237 bp, Heterodera glycines
  Genomic contig location: Contig_ID=SeqID_725; Location=3723..4959; Strand=+
  SCN-specific regions: Sequence locations=1-235,257-429,455-889,911 -1237
  Gene Ontology: Mol. function=signal transducer activity; Cellular component=cytosol; Biological process=negative regulation of cell adhesion
atgactactgaaaaagaatcatcgagtggctccgacgatgtgattaatgccagcgaatttgccagtgaggaaaccttttactcgcctcctgcccaaaaatcggtgaaggaaatcatcgaagctgaccataacgacgaaagcctgaaaaagtcggaacatagaaaaaacaattaaattgcctcactaaatcttcgagatttaagatataaagagcaacttctgggcgagaatgcttcaggcccggtgttggtggagcccgacaaccccaaaaatgtgcttgtaagacgcatttcgctggtttcggacgaccaagtcaagcacagcatggacctccccggttggttttcacgcattacaatatacaatacactttattttgaaaatgagttactaataatttgttggctctattgcagttcacacgaccataaaattttaatgcatcacaactttttctagaaacatccaaattaaaattattggtatctttcggttagcccaacgagtcctctgttcgtttactaaatttcaaaaaattcattatgtttcaaaaaagctatggccaagaatgtttagaaaaccaaattttcgaaattttctggccataattttttttaaacacaatcaattttttgaaattttgcaggataatagaatgtttaatttggatgcttctagaaaaaatgttgtgcattaaagttgcaaaaaattttatggtcagatgaactggaataaagccaatatgttccccataattttcgaaaaagtttctgaattagaggcccggaatcgaacgaaaagtaaaattcactggtcccgatagcccatttgtggtaatgaatgtatttttaattttttctcaaaaagtggacttaacattactgttacctaaaagtttgttttttctaaatccatgtttatgggtcaaggttaaaatggttattaccatttcgaaaaatggcctcaaaaattcagcaaagggtgacttcgtcttctgcgtgaaagaaagctgcacctatcggatacgcttcgaattcgttgttcagcgtgaaattatatgcggactcaaatacgcacacaaagtgagtcggcttggcgtcggaggttggtgaatttcgccaacccttttataatatgtctttttttgaagtgccaaaagagttgtacatgctcggctcctacggtccccggcacgaaccgtacacttacgaaacatcaccggaggaggcgccttcgg

SEQ ID NO: 46157 - DNA, 2879 bp, Heterodera glycines
  Genomic contig location: Contig_ID=SeqID_5959; Location=3647..6525; Strand=+
  SCN-specific regions: Sequence locations=1-64,87-206,228-392,415 -551,577-960,982-1369,1391-1634,1665-1670,1692-1899,1923-2225,2247 -2879
  Gene Ontology: Mol. function=ATPase activity; Cellular component =proteasome regulatory particle (sensu Eukarya); Biological process =proteolysis and peptidolysis
atgtccagcgatattgtcgagaaaaaggagacaaaccccaatgagacggatgacaaaaccaaagaaataaaatgtgttttttgtgcttaacccaagtaaaacccatcatatttggtgtttctttctgtttcagcgcttgacgaggatgaaattgccgcacttagtaattacaacatgggaccgtacgcggatcagttgaagcaggcggagaaggacattgatgaaattcagaagcgcataaacactctttgcggagtgaaagagagcgacacggggctggcgccgcccattctttgggacattgcggccgacaaaatggccatgtcccatgagcagccgctgcaggtgaattttattttgattttggtcaataagacttgtttaaaatcttaaagatgagtgaaaatgaaaatagtttaaggaaaaactgaaaatgctaaattttaatgttagggattaggaaatggtcaaattcttggtgggtcaaaaatatcgaaaatttacaataataattcgcgacgctccaccttaggcaaatgttgcattcaatacaaattaaaatatctttttaaaaaggtggctcgctgcacaaaaatcatcaaagaagagggcaaagaaacgcgttacatgatcaatgtgaagcagttcgccaagttcgtcgtggacctgcacgaaaatgtggcgcccactgacattgaggagggaatgcgagtgggggtggaccgcaacaaataccaggcaatgtgcacattaatttatttcagaatttgcgtttcacagttacttaaacttttctgtgggttggaccatttttaagggatttgacaaaatacgccatgaattgattttaaaaattaaaaaagtgggcatttgactaattgtaagtaaaggcacaacaaaatcttcctttaaataagagagcagcatcttgatctcccctcccccgaaaattttccacaaaattttctgatgtattctaagtttttcaaaaaacgatttctcaccatccatcggcttacaaaacatttcatttttaagattcatttgcctttgccggcaaagattgacgcgtccgttacgatgatgcaagtggaggacaagccggacgttacctacgcggacattggcgggtgcgaagaacagatcaaaaagttgcgtgaagtggtcgagtttccgttgcttcaggtcggcaattcaatctctgtttttgtttttgttccattttgcctctttatttttagcctgagcgtttcacgagtttgggcattgagcctccggtgcgttttgccacaccttgggattgtctaacgttttccatttcagaagggcgttttgttttttggtccgccgggcaccggcaaaactttgtgtgcccgcgcggtcgccaatcggacggacgcgtgtttcatccgcgtcatcggttccgaattagtcaaaaaatacgttggcgaaggcgcgcgcatggtgcgcgagctgttttcgctggctaaaacgaaaaaggcgtgcattctcttcttcgacgaagtcgacgccatcggcggagcgcgatttgacgacggaaaagggggcgacaacgaagtgcaacggacgatgctcgagttggtcaaccaactggacggattcgactcacgcggggccatcaaggtgggtggggggatgtgtcttccattttggcttgaaggggaaggcaaagggggaggtcaaccgaaatttttgcgaacgggtccggtcttttaaatcgacgacttttagctttttttgcggcgccctttttgtcaaaaaaacttagggaacgggcaggggacccggcggtaccaataggcgcagccgtggaataattattgaatttttgatgaattgttaagaaaatttgttcaggatttctaatttcaggttttgatggccaccaacagaccggacacactcgacccggcgctcattcgtcccggtcgcattgaccgacgcattgaattttccttggtaaccaatgaaaataaatgccgatctgacaatgagtacacacactgctcattatgaatcttttcagcctgacctcaaggcacgaggaaacattctccaaattcacaccaaacggatgagcgtcgaccggaacattcggtcggtcattgtttttgacatacatttaaaatggagtacaacatgttcggtgtttcaggtacgaattgattgctcgactctgtccaaacacgacgggtgaacgaacgcccattaaaatgaaccctcttacaaatagcgattgcttaattaaccagaaaaagtacgttttgctttttgaggtgccgacttgcgcagcgtttgcactgaggcgggaatgttcgctttgcgtgcacgtcgaaaggtcataacggagcaagactttctcaaggctgttcagaaagtggtacgttttccttttgattgtgccaagtggattcttttatttggcttatccaaagtccttcgtttgttcgttctctttcgccctttgtattttacgttttaatttaaggtgaaaagctacgccaagttcagttcaacgccggcgtatatgacgcacaactgacaatacagttcttacaaaacggacttttttatatttgtgcacttttgtttcattacaatataaatgaggaaaccaattccgcagaatgtcttgttaacaaggactacttttacggcttttggaaattcaagcgtaaaaattgagtggcggtttcgtaaatgccgtgttaataatgcagtcccccccccatgtgtatgcggaaaaaagtggtttgtgcccagggatggcacggaattccgtcttcctaaattttattaagtagtaaagctaaagcaccacccaaaacaattgaccgataagtgtttaaaatttacca

SEQ ID NO: 46158 - DNA, 306 bp, Heterodera glycines
  Genomic contig location: Contig_ID=SeqID_29328; Location=1047..1352; Strand=+
  SCN-specific regions: Sequence locations=1-114,153-306
acaatgccgcgccaaataactgatattaaggtaaagcgatacaagcaccgatttgtttatgctttaattaacgtcatttagcaatttctgctgactgctcgacgcaaagacgcgaagtcagtcaagatcaagaagaacaaagagaacaccaaatttaaggtgctaataattcacttttctcagtccttttttccggttaaggttcgctgtacgcgctttctttacactctcgtggtggatgacaaagagaaagctgagaaattgaagcagtctttgcccccagggcttcaggtcaaagaattgaag

SEQ ID NO: 46159 - DNA, 1739 bp, Heterodera glycines
  Genomic contig location: Contig_ID=SeqID_29344; Location=1..1739; Strand=+
  SCN-specific regions: Sequence locations=1-106,253-1235,1257 -1609,1634-1739
  Gene Ontology: Cellular component=mitochondrion; Biological process =heme a biosynthesis
tagggttgcaaccccgacgtcggggttggaaaattcggggttcggggttggaagtgtcggggttcggggtcggggtttttcaatttttgccttatgccaaatagtcaaaatttttttaatattttttcggaaataatatttattaatttccataataatatttgtattgtttttatatttttttatttcttttttatcagaaattttgtatagaataaattttttttcttgaaattttaaaattttttattacttttttgttttccaaaacatcttttttcacgtcgctcttttctaaagacttaaggagaaaggtacggcgtccggcggtgccgataggcgccgccgggaaaattttgaaaatttggttagatctgttaacagattttgtccaaaatatgctaaatttttgcgattttgagccaatttttttaataaggtttatgactttttgggccctgtatgccgataggcagcgctaaattttggaattaagctctattttctaagatttttcaccaaaaaaatttatgaatttcggtaaatttttgtttttcttcgatatgtattttgtcaaaatatgccaagattgtcgatttctatgagtatttaatttaaaaaaaacaatttgtaataaagaaaatgactaaagaagaaaacgtcaaacggtatcgaactcaggacagaaagtaatgtcaatgtggtgcattaacctctacaccacattccaaatgtccaaatcgagcaaattttctttatttaataaaaatttggcaaatggttaaaaaaattcaaattttgtctaacttttttgcattttctcccacgaaaatgccattcttaggggtgtatatttaaccccgaccccgatcggggttaagggtcggggtatgaagcgtcggggttcggggttttccccgaaaatggccaaaaatgtcgggggcggggtcggggacgcaaccctatttttattttaagattggcaactcatctttcgctggcttttattctctacggcattttcctttggaacggactttctcatctttttacgccaaataatgtaattgttacgccaataactaattgtagaccagctcttccaattatagcatagcaaatctccggccattaaaaaattccgagggatggtacacggcaacaaactgatgatttttatgactatcataatcggttccattcatttatttgtagaaatatattcacgcgttctttgattttgctcattgtcaggtgccttcgttgctggtctcgacgctggactcgtttataattcatggccaaaatacgccgatcggtggattcccgagggagttttgtcccatacgccgaattggaaaaattttatagaaaaccctgccactgtgcaatttttgcatcggaacatggtgaaaatgctatgtgtctttgtaattagaccggaaagatttaggcctatttgacactgattttggccactttgacatggattaagggcatccgaactccgctggggtttcgttcccgtttagcacttcattcgcttttagtgactgcatggctgcaacttgcgcttggaatctcaacactggtatgaatgtattggaaaatattttcacctaattcttttttagttacaccatgtccccgtttcgttggcatcgatgcatcaaaatggggcgttgctcctttatagctcagttatttggctgtcaaatgagctcagaaagataccaaaa

SEQ ID NO: 46160 - DNA, 316 bp, Heterodera glycines
  Genomic contig location: Contig_ID=SeqID_29350; Location=1122..1437; Strand=+
  SCN-specific regions: Sequence locations=1-29,53-316
atgcccgaaatcagcaaaaccaacctgctctattttctgctgcttctgctttgctgggaaggtgctgtgcaaaattttacgatttttttacgaaaattctttttttttaatatttttttgcaaaattttgtcaggttgcattgcattggccaccattctgaagccgttcctgtcctttttcctctcccggcttccaattggcgaccgttggccccgtcggaatgtgccatggcttttggtgatgaagcgaggcaaacgcgaaatgaaggagggacagttggagagggcggccaaaaaggatgcggtccgtctttaa

SEQ ID NO: 46161 - DNA, 2435 bp, Heterodera glycines
  Genomic contig location: Contig_ID=SeqID_5966; Location=1..2435; Strand=-
  SCN-specific regions: Sequence locations=1-68,92-110,175-402,426 -448,472-495,518-601,629-724,771-787,811-819,841-921,943-1023,1045 -1150,1187-1558,1580-1692,1728-1748,1779-2176,2198-2238,2260-2435
  Gene Ontology: Mol. function=branched-chain amino acid aminotransferase activity; Cellular component=cytoplasm; Biological process=branched chain family amino acid biosynthesis
tgaatttgttttagtgttttattgcctttttaatattcattttcattttattatttgtatttccgctctttaataaatctttgtcattagtaaaattgtatagtgaaaacaattttaataagattttaattaaaaaaataagattaatatataataaaatttgatatttttaaagaccttcgaaaaaaataaaaatacttttttttccatttttcaaaatttttctttaattaggacgcaaatatattgattgatataaaaaaatcgcgaaatatggccataaaatatagatctacatcgcaaaaatatggacatatcgtaaatttccataaaaaaggaaaatttctcaaaatttcttaaaatctcttggaattcgaatttaaaatcaaaaattcgatttttaggggggaaataagaagaaatttacaatcggataactggcgattgcttattattattattattattattcgaatttatattatttaacagcattaaaattaaaggccaaaattaatttgtccaaatcatttaaaaaaattaacgcaacaaattacaaaacgcaatttcttgcacattttctcattcatccaaccaattcaaataattaattcacattaatcacaaaactacaaattgattaataaatattacaaaaaaggaaaaaaaccttgccactacatgtaaagtgaagtgattgcacctaccaaaatgatctctttcgaaaataatatttatttttccaaattaaaattataattaaattttttgacctaatacgtttaagattaaatatatttaataaaaaatgatcattaaaaacactacaaaaaatgtattctcttctgcaaaacaattaaattcatttgtgcttgctaaattctccacagtttcaaatattagaaatacatttttggtcggtttattattattttttaaaaacgctttaattagcacgacgaattgagcattgttcaagcgacaggccaagaattaaagccaaaaccgtttgtcaatggccaattgaaatttggccaaaatttttcggaccatatgatggaggtggactggtccgatgccaaaggatggggaaaaccgttaatttctccattacatccgctccaattgcaccccggggcaaaggtggggcaaataaattttaaaaataatttttaaattttaattaggctttacattatgccatcgaactgtttgaaggcatgaaggcttaccgcggtcaggacaaccatattcgactatttcgtcccgaaaagaatattgcacggatgagacgaacagcggcacgcctaatgctaccggtaaaattgccgttaatctgaattggtaatgttgtactgctagaaatctcgcaaatcagtgcaacatcgggaacataattttttttttttttgaaaactgggacattattaatgggaaaaaccattgtccgctgtttttgtgtatcatccaagtcgaaaaaattagttggtacaaagtaaaaatagtttaaaacttactttgaccaccgaattatcccaaaaaaaatttcatttcgtgccatttaaaaaagaacacacaatttcggtgccctctaaagggtgtagtgacaaaaggcccacggaaacgtacacacaaagacaaaataccacggacaaatgacccacaaaaaaaaattaaaagataaaatgcttcaatttataaaaaaaaaacttttaaaaaaattataagcaacgctgattttaaagaaattttagtcgtttgtctttgtgagtcctctgtccgtcggccctttgtcagtgtggtatatagtataaatttttgctttaagtgattaattaattttcttcaacataatataaaaaattgcaggattttgacggaaatgaattgctgaaaatcattgacgaattggtgcggactgatcaggattgggtgccaagttcggacgaagcatcgctgtacattcgacctacaatgatcggcactgatccgacattgatcgaaggatggtcaaccggttccaaactgttcatagtcactggaccaactggcaacattggggaagctgcccattgtccgaagccaattgcacttttggccgacccgaatttggccagaacatcgcccggcggggttggccaatacaaaatgggatggttagtttgtcgaaattgaaagttttaaaactttttgatcataataatgatttgtatatgggggcaagtatttggttcaggatcaaaaatgttcacttttcttggccagagtaattgtcagaaaattccaagtttcagtttcttacagtgatgttccagtgatgagaaaaaaataaatagagattttggtcgggaacgagaaaagtgccgtgaattggatttcggaaagtcccggaaaaaacggtgctgtaacggtttacaatggtggaactcttgaaa

SEQ ID NO: 46162 - DNA, 746 bp, Heterodera glycines
  Genomic contig location: Contig_ID=SeqID_29406; Location=336..1081; Strand=+
  SCN-specific regions: Sequence locations=1-409,443-746
atgaagcgcgaaaatgttgttggtacgttgaatggtttttcagtttttgaatatcaccctccccccccccccctaaaggtgtttttctgccggtgttcgaagcccaccgaaaagagggctctgacggagacgcgtacaatttgacgggacttggcaaaggcggggcgaacattgggaagctcaagcgcaactacaacaaagcggtggaactgctggtggagctggccacgctgcagacgtgctttatcacactggacgaggccatcaaagtgacgaatcgtcgcgtgaacgcaattgaacacggtcagtcgggggaatggacaaaaatgcaacagatacgggaaaaaagcgggatgaaatgaccgagataacccccgtcctgttggtctaacaataaagtccaagtggaatttacaaaacatgaccaaaacaaaaaacaaattcgtttttcgcggcttcatttttgtcacggttcgttttttgtgtgttatatgtataggctatatgacttctcgctgtttgaactcctaataattataatgacaaaaaatgaataatccgcgaaatgaattagggggtcattcatggaaccgaaatccatctccatttgcacattgtcattcattagatttaactgaaaaccgccattttcagtaatcatcccgaagattgaaaatacgctcacttacattgtcaccgaattggacgaaatggagcgcgaggaattctttcggtaaaaggcaaaa

SEQ ID NO: 46163 - DNA, 1057 bp, Heterodera glycines
  Genomic contig location: Contig_ID=SeqID_29416; Location=153..1209; Strand=-
  SCN-specific regions: Sequence locations=1-155,178-359,382-638,660 -1057
  Gene Ontology: Mol. function=acyl-CoA dehydrogenase activity; Cellular component=mitochondrion; Biological process=electron transport
atgcacatttcctttgtttctcgacaagcgactgcctttttgggtgttgccagtagaaatggattgccacgagtcgccgcagaagcaccgcctgctccgcttacatatcttagcgaggacgaagtcgcacttaagcattcgggttaaatacgcggaatctatttatttttggttcttttatagttaaacagttttctgagagtgtcatacgaccgcttgtgaaagaaatggatgtgaaatcggagatggacaggcgagtgatcgaaggcgtatttgcaaatggggtacggatccacgaatttaccagttttgataatttatttcagcttatgggcatcgaaatagcagagaagtttggcggttccgagtccagcttcttcaatgtggctttaaccgtagaagaattggcaaaagtggacccatcggttgcggttttggtcgatgttcaaaatgtgtgcctttccttattcagccagaattttgcttattcattgtttatttagactttagttgcaccattgattatagaaaatggaacggaagagcaaaaacacaagtatttgacacgaattgtgaaggattgggtaggacgggacttgctccctcctcgttttatttgtctatcaaaagattggtgccttttgcctttctgaagctgggagtggatccgacgcattcgcattgaaaaccgttgctcttccggacggcgatgattttttgatttcgggctcaaagatgtggatttccaatgcctctttcgccaagttttttctcgtatttttttcgattccattagtttgaacaattccatctttttatgtgatggccaacgcggaaccaacgaaagggtaccggggcatcacatgttttttggttgaccggaatctgaaaggttaacgacgaggttcatttgctgggaagacatttcaacaaattgcaggagttactgttgcaaaacatgaggacaaactcggcattagagcaagttcgacatgtcctgtccatttcgacgaggtccgagtcccgaaaagtgccattcttggcgaatatggcaaag

SEQ ID NO: 46164 - DNA, 718 bp, Heterodera glycines
  Genomic contig location: Contig_ID=SeqID_29426; Location=244..961; Strand=+
  SCN-specific regions: Sequence locations=1-72,94-134,159-165,187 -456,478-718
  Gene Ontology: Biological process=MAPKKK cascade
atggttgaacgatttttcccaaaccctgaagaagcgccattaattaaagccatccgagacacttatgcaaacatttggagaattgaagagaatgagaacaatgagccattttctgagataattgaagtaaaacgaataaataaaaatatattaaaaatgtgtttaaaagtttcatttaattgttttcattttagagagtcaaaaaacagccaaataattttgtaatgaaattaactgaatatgcattatgggacgcatggattaaaaaggatgtggagaaagtatattttggcaaagaaattctcgaagctttggcaaatttcgatgctgacaaacgcttggcatacattttgatggaaaaattacggccgatgtctgtgaaggtaaagtcgggaaaatgcatcaattgtgagcttaattttaaaagtctcagtttcaattttcaaattcttaaaataattttataaattcatttatgcaaattcagaatcacattatttgggcagaggacggagaagaaagcagcggagaagactttttagaagacgtgaccccggaattgggaatttttggcactttgctcggcaacattgtcaacggtgaagtattgtacaatgcgcaatttggccatcagctgaagaccaaattggccagcgagaatgagggtggcatcgcaagtggaaacagtgcttatgattcggcatatttggtggactga

SEQ ID NO: 46165 - DNA, 1507 bp, Heterodera glycines
  Genomic contig location: Contig_ID=SeqID_5994; Location=72..1578; Strand=+
  SCN-specific regions: Sequence locations=1-235,262-778,802-1297,1321 -1468,1490-1507
  Gene Ontology: Mol. function=ATP dependent DNA helicase activity; Cellular component=cytoplasm; Biological process=nuclear organization and biogenesis
cgcccaacatttttggccatgacgaaatcaagcgtggccttctgtgcctgctgtttggcggcacgcgcaaagcggtggacccgacggacgacgcgtcccgtgtccgactgcgcagcgacgtgaacattttgctgtgcggcgacccgggcaccgccaagtcgcagctgctccagtacgtgttccagctggtcccgcgctcgcagtacacatccggaaaggttgccattgtggttcctttttaattaatattttaaaaaaattccccaccccgaaaaaatggagtagagtaaaaccctccgccgataaattattttccgtttttttttgaattaaacatacattttttcaaggaaaggaggggtcgcaaattctaggaattttctttaaagacaataaaaattccaatatttttcccggggcgcctatcggcaacgctggacaaaaaactccaatttttattaaaaaattaaccgaaaatcataagatttgatcatttttgaacaaaatctttaaccaatcgcatgaaaaattacactttacctctctgttcccaaaattttttttggaaaaacgcaccgcaaaaaaaaagcgggtttttaaaaaaaagttatcaaaatcggcggccgacctccctccccctaaaattctgtcgtttaatgatgaaattgaatttcagggctcttccgcggtcggcctgagtgcgtcgatcacgcgcgactcggactccaagtcggtggtgttgcagacgggcgcgctggtgctggcggacaacggcgtctgctgcattgacgagtttgacaaaatgagcgacggcacgcgcagcattttgcacgaggtcacaaaaaaatgggtggggattgatcagaccacccagaaaggataagggtcaggacctccgaccattcggggtaattcccgcaacttttgtcttgccccgagcccaattaccaattcgggacccgacggagtgacaaataaaacgaaaacagccgaaaaaaacgatgggttttgtttatttttcacaaattttcaataagttttttggggtatggaacagggatgcttcgggtcaagaaaaagtcgggttaggtcgaccgaaaaactttggaccgtgaaaaaaaagtccggtgccggacttcgggtaacccgtacaaatccctgcgcgcatatggaacaaagagctgccccattaaaaattggtgatcagcaagcagcggcgatcaaacaaacaaaccctgatcactcactactactgatcaaccaattaatttttcaggtgatggagcagcagacgctgtccattgccaaggcgggcatcatttgtcagctgaacgcgcgcacttccgttttggccgcggccaacccaatcgactccaaatggaacaagcggaagaacattgtgaagaacgtgaacctgccccacacgctgttgtcccgctttgacctcatctttttggtgttggacccgcaggacgaggcgtacgaccgccgattggcacggcatttg

SEQ ID NO: 46166 - DNA, 683 bp, Heterodera glycines
  Genomic contig location: Contig_ID=SeqID_29486; Location=183..865; Strand=-
  SCN-specific regions: Sequence locations=1-87,109-226,248-454,476-683
  Gene Ontology: Mol. function=DNA topoisomerase type I activity; Cellular component=nucleus; Biological process=chromatin assembly/disassembly
atgctttcctacaatcgtaaagccactggttcagaggcatttcacttatattgcctaaattcaggtgcaaatcgtcaggtggccatcctttgtaaccatcaaagggcagtgccaaaaacgcacgaaaagtcgatggaaaatttggagaataaagtgaatatgacatgaaacggaaacgcaaatcctaagcaaaattcagataaaagagaagaagcaggagtacaaggagttgaaggatcagctgaagaagagcaaatcggtggacgagaaaatggcaaaaaaatacgaaagattgaaggaacagatcgccaaactgaacacacagcgcacggacaaggcagggggaaggaagggttggcaaaaattccgaacaaatttggaatttgatttttcggggaaataagtcacccttcaaatcaacgaatcgggaacagcaaagattggtcatttttgatttcaggatgaaaacaaacaaattgcactgggaacctcaaaactgaactacttggatccgaggttggttctatcgaatattccaatttactatgtccaaaaaaaatttcaggatttcggttgcatggtgcaaaaagaatgacgtgcccgttgagaaaatattcagcaaaacgcaacgcgacaaattccgctgggctctcgacatggcgaaggaggacttcattttttga

SEQ ID NO: 46167 - DNA, 1985 bp, Heterodera glycines
  Genomic contig location: Contig_ID=SeqID_6006; Location=117..2101; Strand=+
  SCN-specific regions: Sequence locations=1-501,523-729,754-913,935 -966,998-1024,1046-1389,1411-1474,1496-1743,1773-1985
ttgccatcgatggcttcgtttatgccgaatgctgtttccggccattacccgggctggcgcggccgatttccctcctctcataagcggcgttctgagcccgagtggtctgtgaaggagctgatcagaatgaacccattgcatctgtcagtgtctttcaatcggtcaacaaaaaacgaatgcttttccttttgcagctttttcctaggctttgtccctccctttttgggggcgattgggtcaattgtgacggcactgcttctgcacaatgatgaaataaggcaaatttaaaattcattcaaaattcgtcctataattttaatttcagtaattacaattggcagtgcggggtaaacgttgagcaattaacttttaagctaattttaaaactgcagagagctcggctcccttcgctttcgcgaataataaaccttccgatggaaagtgagtggaatttgcaaaataaatgaccaattaaagtcgacgattaaccaagggattttctggcaaatcactttccttttccacattccgctgagagcagtcgaaattgcagtgggatgtgagtttctctccagtcgaagacttatttgatggtcccttggtcatttcctttcagttttccgttatggccgtttacggagtgtccactgcaattggccgcgtctctattcgctgtgccgacacttttacctttggctcggctctttggaattgatttttctggtcgtaaatttcgtagtgattaggctatccgaggatggcacatgaccgggctgggctcaaaaaaacagctttttgggatttggtctggtttttccaaggttttcctggtccaaacatttgggttcgggggtaaacaatggaccaaacaatcactggcaagaatgtaaattgtaaggatagaataaaacacttcaaaaaatatactacatttggtacaagggtttaacgaacttttctttttcgattttaattttattatcaaattaaattaattgttttttgagttgtcctaatcttagccattttaaaatactttctctgttttccaacattaccccaaatgtggacactttgtcacattaccccaaatgtggacactttgtcacattaccccaaatgtggacactttgtcacattaccccaaatgtggacactttgtcacattaccccaaatgtggacactttgtcacattaccccaaatgtggacactttgtcacattaccccaaatgtggacgctttgtcacattaccccaaatgtggacactttgtcacattaccccaaatgtggacactttgtcccattcgttgctttttgttaattaccccccccccattttcaaaggtcgctctgtcggtggtcggggagcgtgagttcatctgttggtttggctttttgatctcctttagccgccatctttccttaagcttaccatgtgatcttcttttacgccttcggtgccttcgccattggcttctttctgaccaatgtcatctgtcactcgcagtccctttattatttgaacccttatgtattgccaattttctttgttgtccatttttttacatttaattacgcagggtcgaatttcgtaccatttcaaaattgtggtgaccattctgtaagaaagtgggcattcgtcgttagcttaactcagtatttttaaagttacgtcatctccgtgcccgttctgttcggcgcttttgtgctttattggcgaaaatgcatcaccatcagtcagtttttcatttcatttctttctcattttcgcccttcataaaacaatgcttttcaaatgcttttcagtgtacgatgttttcgcagtcgccgaatatatcgacgtgtttttgaccatcgcttatcattgctgtgccttctttgacattcgctacaaagtgattttcagtgtcagggaagtccgagaaaggaaaatgcaatgagagaaggaaaagaaaaggaccgaagaacggacgaacgaaagt

SEQ ID NO: 46168 - DNA, 791 bp, Heterodera glycines
  Genomic contig location: Contig_ID=SeqID_29512; Location=789..1579; Strand=+
  SCN-specific regions: Sequence locations=1-334,356-791
  Gene Ontology: Mol. function=structural constituent of ribosome; Cellular component=cytosolic large ribosomal subunit (sensu Eukarya); Biological process=protein biosynthesis
atgcttctttcattcataatcctgcttttcctgccaaatgcttttccactgattgtgtgtgactgtatcatttgtcgtccgcaattccttttgatggatcgaccgctttcagttgacccaaaccgatcaatttgaatttaattttcaaatttactttcatttgctttattttttgtaataaaattggccatcattataacaaatctattaccataattaaaggtaatgcataattaacctgaacatttttgttgcattgtttctcccatttgcttgtttataatcacataatttctttccaaaaccaattttagcaagacaaaaaatcagaagcgaaaatggtcaacccgaagggataccgtcgcggcactcgttacatgttcgcccgcccgttccgcaagcacggcgttgagccgctttcaacattctaccgcgtgtacaagcggggcgacattgtcaccgtcaagggcaacggcgccttccagaagggcatgccgttcaaggcgtaccacggcaagaccgggcgcgtgttcaatgtgaccaaacatgcgctgggcgtcgtcgtcaacaagcgtgttcggttagtatttttggatatgttggtcggtgttcaattcggaattgtttaatgagttgtaatggatctgtctggccgacatttagccatgtttttcgggatgagagaccatcaccattcatagaaatcaagataagaatttttgagggaaaatgttggttccagttcagtttccatgtctctcaatcattgagttcttgtccaatttgtggaa

SEQ ID NO: 46169 - DNA, 1902 bp, Heterodera glycines
  Genomic contig location: Contig_ID=SeqID_6010; Location=982..2883; Strand=-
  SCN-specific regions: Sequence locations=1-794,816-1429,1451 -1609,1632-1902
  Gene Ontology: Cellular component=endosome; Biological process =locomotion
aaattgggcaacgaagccaaaacggcggcgcagggcaattccctctttgccgaggtccatttttgttgccattttttgtgtttttaactctattttttaaacttatttgattttttcagatcgtttctttgactgatgttctcggcgttgcctttcggccctgtccaaatgcgcgatatatgcttcagaatgaatttgagccgtccgtgctgctgaatgtcatgctcagtcccgaaaccgactccgtttgatttattgttgttctttcccctaaaaatttttgccatgatattttatcttgtctttgcgcaaattgcggccgtgatcccagctttaattgcttatcattccaacattttttatactcatttgatgttttttcgctatttgagaaaaattttttgtattcctatttcaaatggcaattgtttgttgtcattttacctttactaattcaaaatttctttttctataattttttcattgtttttatgatttttctctgatgggtaatttctttggcattcggacaaaagcgaacagatctccgccagcggtaactgatcatgaccgaacgaccttggtaagtacaaacgattacaaaaaactttgacttataagccggaattttaagggtccgctttcagtgagtactttgctgattgtgacaattttaagattctggacaaagttttgtcgacgcgctcccgaaatgattatagtttaagaacacagaatttttgcaatatttaggagaaaattgagtccaacatttgttaattgcatggcattgttttatataaatgcagttgcatcaattttcagtcgttgaaaatgcagcgcgacaaattgcgccaagcgtgtcaacggtacgagcgcaacatcgccaaggacgcggagagagcgcgggcactgctcagagacggacgcaaagagtgagcaaatggggaacggatgctaatgaggaaaagcacacagtgacaaactcaccaccccctttgaagccgagcattgttactgttgaaaaggaagcgcttccaggagacgatgatcaatcggatcggcggattcatggagcaggtggagcggacgatcaccgacatggaaatggcacagatcaacagggaagtgttcgacaaccttcggcttggcaccgaggcattgaaggcactgaacgaggcaggcactttcggaataattgacccgctcacattgccaactattcctagaaaatttgaaaatttcttttagacaatttctttggacgaagttgaacgtttaatggaggagagcaaagaggcgcaagagtttcaggaggtcctttctaagatagagtcaatattttgtgttgttattgccctctgtctcgctgatttccaggaattgtccaccattttgggccaacaaatgtcggaggaggacaacgacatggtggaggaagagttcgagcgaatgctctccgaacaaatgccggcagtgccaacggagcaaccgacggacacaaaagagggacggaaaacagcggacgaagagaggacaaagggtacggtgaatggggtggggtaacttattgtgggatttgttggtcacttatcataaaatggaatgtacccattgggggaggggcaacaaattacgtattgtccgcttttttacattttagaaaattttcggttgaattttgcatttgaacattgattaaattaaaaatttaatgtctctcggttccttaaatgaaagaagaaatttattattagaaaaatgtgaagaatttctatttattgctcaattgttttcgcttaattacctttttggaatggcattatcagtggttttcacttcacttattttttagaggagaaggagccaaaacgacggagggaggcggtggcgcaggaggcg

SEQ ID NO: 46170 - DNA, 1665 bp, Heterodera glycines
  Genomic contig location: Contig_ID=SeqID_6014; Location=642..2306; Strand=+
  SCN-specific regions: Sequence locations=1-191,214-606,628-1065,1087 -1104,1138-1288,1310-1350,1373-1406,1428-1528,1551-1665
  Gene Ontology: Mol. function=RNA binding; Cellular component=small nucleolar ribonucleoprotein complex; Biological process=rRNA processing
atgggcctccccaagaagttgttggtcagtgtcaacacaatctattataaacagaatatattgcacttattgcagcttcccatcagaaaaagcacaaattacttccatttagagcttggccatttcacgcattcttgcgagaatgacatcgtttgcttaaccacctgcggaaaaatcccctacttcaatgcgcctgtttattttcaaaataaagaacaaattggaaaaatagacgaaattttcggtggacccaaagacaatgtaagttttatttattgctttatttttaacttgaataattttgcctcggatttttggtaatactgccggcggaggacggaccccttgagcaaaaaaattcgacctttatttaaaaccgcttcaaatgcacaaaggaacaacgagttcgccagtgttttcagcataatattggctctattgcactttatgagtccaattgctttttatgaggtttcgacggatggtttaaatacctcttgaaaagccttaagaaacaattttaagttactcttattccgttgtaaatgtaaatgtttcagggcttctcagtcaagctcaatgaagggctaaaatcttcatccttcaagaaagaacaaaagctttttatcgaccctgctaaattgcttccattggagcgttttctcggcggaaatcagtccggcggtgggagaggcaggggacagcagcgggggagaggaggcgcgggacgagggggccgtggaggcgggggaggacgcggccgaggctttaacgcttcaggcgcaggcagcggagggagaggtaccatattaacatacaaatagaattggccaattccaatggaatggtgtcgctttttgtaaccgcttttaataaatttgccaataattgaaaattttttggtttcggtaagggggtgggctacgtaagttacacatgttgatattattgtaattggtggagattaaattctttctcaatcattgctaattttttgaactttttatgatacatgacctattagatgcaggcctatttccaaccacacacattgataggctataatataaaatttcaaaatttataggtggaggaggatttagaggcggaggacgtggaggaggaggcttcagaggcgcttcagggggccaagggggtaatttccgtggccaacggggcggtggtggtgggttcaagagaccattcgaaggcacacccgcggccggaggactttccaagcggaagaagtttaacgaatgatccatcattttcttgattcatttcctttgttgccgtgttctctttttggatgttctcttgaattaatctttcccttttcttgagaatttactgacggaaagcatccaaacaaaattcattgttgcttgtttcaatttccaattataaaggttttgcttttaattccatttcttaacattgccaagtcggtgattgaacatgccatccatttccttctttaatttactggcacatcttttccaccgtcgttcctcctttcccgacttcgtgcttctccaaagactgaaagtgaatcatcacgcggtcgggcggaatcccaaggcgactttggacgaattcgctgatgttcttacagtgaattacattttcatctgcgctgacacagccaattgatttgatcttata

SEQ ID NO: 46171 - DNA, 1105 bp, Heterodera glycines
  Genomic contig location: Contig_ID=SeqID_29580; Location=144..1248; Strand=+
  SCN-specific regions: Sequence locations=1-410,446-642,713-820,843 -1039,1062-1105
  Gene Ontology: Mol. function=RNA helicase activity; Cellular component=cytoplasm; Biological process=cell cycle
atcattttgtgtgttaaggcggggagacgttcgatatttattgtgtgtgttagaagaggaagagaagaagcaggaagagtggaagatgagcgcgaatacggaatgctatcgttgccacgaattcggttggatggagagggagttggtggtgttggtgtgatttcgggtccgtccgggttctgttggtggtgttgagagagaaaactgttggtcctgtcggatggtgttagcacattgatgagaggagaaatgggaggaagaggtggtgtagagagaggtggtggtggtgtttggcttgctcttctctgttgttcctgggacttggccgtctgccggtcgtctggggaggcggggcggtgctgaaccaacgcccttcttaagggcacatttcgcgtgactgtcccaatgccggtcgtagtggtggtggtggtggtggcggtggcggctcgcgcggcggtggaggcggtgagcatttgttacagcaaccgactgatttgttttgtttttcagaaaccaagtgttataactgtgagttttgcttctgacaccgtttaattgggaatggaacataaattgtgatggtttttgtatcaatttttcaggtggacgttctggacattttgcccgtgaatgccgtgatgccggagaccgcgaccgtgggcgcggtggtggtggcgggggcggcggacgaggtggcgatgaccgcggcagcaaatgttacaactgcggtggttacgggcactttgcacgcgaatgtcgcgatgagagaagcgccagcggcggtggacgtggcggcagagacgacagggatgaccgaggcaacaaatgctacaattgtattggcacccgatttatataaccaaaaaatgaggaatttcactcgaacaaaaaggccctcagccaaaatcccactgataaatgacagtgagtgaaaagccacactaattgttgttctataaaacggtagagctgtttgaacattcttgttaaggtgggaaaagcggtcatttttcgcgcgagtgtccggagggaagcgaccgccgcggtggtggcggcggtgggcgcgaccgtgacgaccgtcgctgctacaactgcaatgagccag

SEQ ID NO: 46172 - DNA, 482 bp, Heterodera glycines
  Genomic contig location: Contig_ID=SeqID_29584; Location=297..778; Strand=+
  SCN-specific regions: Sequence locations=1-482
  Gene Ontology: Mol. function=ubiquitin conjugating enzyme activity; Cellular component=proteasome complex (sensu Eukarya); Biological process=sporulation (sensu Saccharomyces)
aacagaactatttgcgtttatcatcatcatcatcccttcattgtgcaataacaacaacacttcaaaagcgacctcatcgccgtttctcatcgttcattcgtccgtccgtccttcacatcaattcgctcgccgttttcgcaatggcacgtcgacgcatccaaaaggtggcaaatgacaactctctgatcaaccaatgctttaaatgttttgatccatttgcaggaaatggcggagctgcatcaggaactggtcacgacgggttacaccgcggcaccgatggatgacggcagagacttgtaccattggaaggcctccatcaaaggaccgcccgagtcgccgtacgaaggaggcaccttccatttggacatcgttttccgtcgcgactacccattcactccgccaaatgtgaaattcgacacgatcatttaccatccgaacgttggagaaaggggcgacatttgtttggacattctgaagcagat

SEQ ID NO: 46173 - DNA, 557 bp, Heterodera glycines
  Genomic contig location: Contig_ID=SeqID_29599; Location=66..622; Strand=-
  SCN-specific regions: Sequence locations=1-557
  Gene Ontology: Mol. function=troponin C binding; Biological process =growth
caagccagcaaattcaatgaccaagagggcaagctgatcctggactgggtcaaaaagctaagtggtgaaaacttcagcacggatggggtgacgaattaattggatatggcaaaatccaaatttgaaacgaatcttttcagagccgtgagaatttctataaattgttgaaggatggcactttgttgtgcaagttagtgacatttagagggattttactaatgcgaaagcctgcctatctgatcagattggccaacggcattcagcccggatcggtcaagaaaattcaacaaccgaccggcaatttcgcctgtatggaagtgagtggagaaaggagggagaagcatcagaagacgaataactcccctttagaacatcaacgcttttgtgtcatttgccaaggcccaaggagtgccaacggaggaaacttttcaggtgccattcattggatatttaaatttggcattcactggttaattgcaccttttcagagtgtcgacttgttcgaggctcgcgacctgtactccgtttgtgtcactgtgctttcattgggacgaatc

SEQ ID NO: 46174 - DNA, 647 bp, Heterodera glycines
  Genomic contig location: Contig_ID=SeqID_29604; Location=67..713; Strand=-
  SCN-specific regions: Sequence locations=1-530,552-647
  Gene Ontology: Mol. function=protein serine/threonine phosphatase activity; Cellular component=cytoplasm; Biological process=protein amino acid dephosphorylation
atgaacgaggaatactgcttctctgcttcgactgctgttgcacagagctgggcccaaacaaacttccgaccagtggacgagcaaccgaacagccttgtggacacgctcatcgccaaactttcgcgcacgactttcgagcagttcacttccgaagtaagtgatgcgttcattttatccgttctttcatttcaactctcttcaggtcagtgctcaggacattcacaagctttgcgatatcaccgtcagtgttctccagcaacagtcaatgctcatccgtctgcagcctcctgtcgtcctttgcggcgacatccatggccaatttcgcgacttgctgagaatcttcacgacgatgggctttccgccggacaagaagcacctcttcctcggggattacgtcgaccgcggcacgcaaagcctggaaacaatggtcctgctcttctgctacaaagtgagtttgctgaggcgggttgagcgagaatcgttttaattgtccactttttaaggtgaaatatccggacagtgtcatccttctgcgcgggaaccacgagtgcagcaacatgaaccgagcgtgagtttggaattggacgaggcctgggggaactaattttctgcttcctttagctatggcttcttcgaagaggttgaac

SEQ ID NO: 46175 - DNA, 488 bp, Heterodera glycines
  Genomic contig location: Contig_ID=SeqID_29644; Location=427..914; Strand=-
  SCN-specific regions: Sequence locations=1-137,210-335,375-488
  Gene Ontology: Mol. function=chaperone activity; Cellular component =mitochondrion; Biological process=protein folding
gatttttggattagcaaacaattttgcttttgtggttatgctaagtgctgcaaaagatataatcaaaggaccgacgaaagaatccgcaaatttaaataacgcaacaacaaatttgtcttccgaaaatttatgtcgggtaattaaaaattaattatttgattttaattttacctatttttatttgtattttcataaattttaaatattttcagcatgttctaccaaagccaagctgtaatagcatatcaacaggtgccattttattggccattatcatccctgcattggtcattaaactaatgtgcccatttgtttttgatcgagtgccatttgggttattaattaattaaagttattattttatttatttattagcttccgtcattttcttgtgtgcataatgcaagcactcagctttatcattgtggcattttccaactctttcacacagtcattaattggcgtcatttttacatcattaggcggtg

SEQ ID NO: 46176 - DNA, 1333 bp, Heterodera glycines
  Genomic contig location: Contig_ID=SeqID_6049; Location=397..1729; Strand=+
  SCN-specific regions: Sequence locations=1-504,527-736,760-1333
atgacttgcccacaaaaaatcagcgacagcagtcccctagcaattaacagtggcctaaacattttctcagttccacctaccaatgtgtctgttgttcgttcattctttcgtcaagtgcttccgctagcaacaatcacgcaagaatcgccttacctatttcggctttacagtgacaatttgtggaccgatttatcgcgggtctatctttatctcgagctgtccattgaaaaaccgggagcaaacgataaatgggttgcgatagatgatgcggatactagtgtctctgccattcaagggattggtcaaacatttgtccagcaactaaaagttacggttggcaatacggaagtatacgatagcggaaacctatacacattcaaggcttatatcaccaatgagttaagctttccaataaatgccaagaaaaattttcttggttcaacagggtattatcacaccgtaaaccaagatgactcaacagacgatgggttcaaagagcgttgtaaaattttcaagggtggaaaaaatgcgcaattcctctcccgtctcgactttgatctgggaaaccaagagctttatctcttaaataatttggacttgctcttcacaatttacaaggccaaagatgtctttcttttgcaaacattaaaagcaaatgattctaccaaatatcgtttgacagttcacgatgtcaagatttatgcaaaaatggttgaggtccaaccctcactaaacatgagcctttacaaaacccttgaaaaacaacccgccacatacgcagtacgcaagaccgaaatcaagtcgtcattcatcagtgttggtcgatacgaatttgagtacaatgtattcagtgcaaccattcctcgacgtgtgacaatagcgttggttggaaattcagcatttcatggtgactacaaactgagtcccttcatgtttgagccgtttgatttgcgtgagatttcggtacatgctggtggcgtagtttacccagctgttccttataaactaaatttttcaaatgatcactttgtcagcgcttttgttgacatgtatgaggcactcggaatggctaactcggaacgttcatttgacatttcaatggcccagttcaaaaaagggtggaccttttttgtcattccattgacttccacgcttgacgacagctgtggatttgagctgttgagaaacggtacgacaaacgtacgagcaacattcaattcaccaattccgcatggtggtgtagagatgattgtcttgggtgaattcgatcaaatgattatggttgattataaccggcacattgtgaccgactcaaagcttgggtaaattataa

SEQ ID NO: 46177 - DNA, 2742 bp, Heterodera glycines
  Genomic contig location: Contig_ID=SeqID_6062; Location=598..3339; Strand=+
  SCN-specific regions: Sequence locations=1-328,350-630,652-990,1031 -1036,1067-1470,1493-1743,1765-2415,2456-2742
  Gene Ontology: Biological process=gametogenesis
atggccgcacatttcccacacattcgttctcgcattatcagtgaacaaatatcactcattgaagaaatcattgataaactctttgattatcttaacaattcctacaatggacaccttggacccgttaagaatggcaaagagaaccaggaaatcgaagtgatgggtttgtttttctttcgcttgctaaattactccagataactaactcattgtcagttgagcttatgagaacgacttccatactcatcggccttttgagggcatttggcagatattgcaacgacatatcgtttccgctcatttcgcttatttaccctttgccgtacaatttaccaagaaaaccaactgacgagagcatccatcggaagtccaacgcgtgtcatgttgggtaagcaaaagggaatttaaattagaccgaataaaagactcaaaatttttagctcacaaattacccaattatgtagaatcacctcaattaaggatttaaaaaagatatcatactagcaataagacatttttgagttaaaaagcgtttcttttcgttttatttatttatttttttgtcgtgtcggattaaggaatgcgtttttcccgacaataagacactttcagattgaatactgattcttcaaattggttttggaacgaccaaatgaaaactgaaaacgacacaaattgttacaaaaagttgttcacccgacatggaagtagttttttgttgcaaagagaaccgtcatctgttccaaaatttcgcgtttgttttggtgaaattcaaaaaataacgaattgcgtaagttttattaatagagtgctcatttttcagcacaaaaaagcaccaaaattgcaaaattagcacaaaaattaaaaaagcgagaattcagcatgaaaaagttggacttaaagccctcattataacttagaaatgcgtttttcatgcgaagctccaagttagcaaaaaatttcagcaaatgctgcaaaatgggcacgctgtatattatatatttaattttattgattttaaaattatattcacaggtcaaaaagttactttctttggatttattgtccaaacttgattcaatcgcgggtcaagtttttctatcgtcagaattacgcaaatttccttacaaaaccgtttcggagacgctcattttggtatcagttacacttttgagagatattctaagcccactgtcaattggaagcggtgggaatgaagttctggagtgttttgctggcgaggtgattggtttccgaaagatttaaatagtttttgatttactttttgggacaattccaaaccctataaatccacttgggtgcatcgataataaatactctaaaattattcagctgaacgagttcgttctgtctttgttcaaacatggtcaggattccatcgctcagaaaagtcaaattgacgagcgcaacgcttcttccgtcgacagagaccgttctcttccacttaaacaacagattaatgataaagaaattgccgtgaatcgagtcaaaatgctggtcattgccaattctatctgtttggaattgatcgtttggagtgcggtggatgaaagtggtaagcaatggaccaattggagaatgggttcttttgtccatttcagacggggatatgatttgtgggacgatatcagagaaaatgtggctgccgcaccgccacgtgttggctcatatgcccgttaatgtgatggcactggaggcattgggcagtatggcggagaaattcccaactctctcaagcactctcatcattcgtcttctgagcaaatttctgactgatccttgcccaattttgttgaaaattgcctctgaattagtaagatagatgggttttggcttattctaatgaagtgccatttcaagaaaccgaaggatcaacaacaccaacaattaaatgcacgagaagaattactttccactcgacgaaaaattgggctggcaagtctgcgatctgctgcaattaattctttgtcgaggttggtccgttttgaagaccaattttacagcgccgtactttagggcgctgaagtcggcgttgctgatcgatcagagcagccttcaggcgtgtctcgccagtctctcgtcacgtctttacactgtcgcttcggagaatgataggtggggtaagaaataagccacttttagattacttggcgtctttagcaaggctcttttggtgtctgaaaatctcatccaaactcttggcaaattgggcgtttcctttgtcaacgatgcttcttcttccgaacttgtccttcaagtatttgtcctcatcgtcctgtcgatggacagccaaaaaattctttgttcagatatttttgcaacgtttttcgaacccaccttctcagcaggacaatttgatcatttcttccctggccgacatgtggatagcgggagctgtttgtcttttctcttctttttctaacaaatttattttttattgtgtagaattccattcacgacaagacaatgaaactgttcaccagagtcaccattgagtcgagcagtcgcgtttattcttccgatgcgctgcccgacagtcgttatttgtaactctcactggaattaatcgttcacccaaaatgcatttaaggcacgtttcattggcagttgacaatgcactcgcgaaaatagcaaattcattggattctgaagaacagcagactcttttcttattccgtcttttggaacttttcattcaattgggactcgaaggacaacgtg

SEQ ID NO: 46178 - DNA, 2018 bp, Heterodera glycines
  Genomic contig location: Contig_ID=SeqID_6064; Location=1..2018; Strand=-
  SCN-specific regions: Sequence locations=1-403,425-460,482-504,527 -557,579-810,833-1019,1041-1145,1167-1390,1414-1528,1551-1630,1653 -1681,1709-1864,1886-2018
  Gene Ontology: Mol. function=peptidase activity; Cellular component =mitochondrial inner membrane; Biological process=electron transport
tgctccattcgctctttggtacgaactcaaacaaatggttgagtaatacaaaatctttccccttttcagactcaacttcccaattcttatgaagtgttgcgagaccgcggtgacactgctgagctgagtcagctgaaaaacggctttcgtgtcgcctcttatgcaaacggacgtccgacagtgacggtgcgtttggatttgcatttccgcattagcttacaatttacaatattctaaaaactcaggtcggtgtttggctgaatgctggctcgaggattgaaaccaatgagaacaacggaatcgcttcactttttgaagggttgctgcacaaggttcgaattttctcattttttggtaacattggttttgataccagattttatagtttggtggttaactaataaattttagggatcagggaaacgaaattcggtgcaacttcaaacggagctcgccaaacttggggctcggcttcgctctttcactacccgggagcattcggccttttttgtggaatgtcttaaatcggacaccgataaaggttcggtcatttctcttttattttaggctttttcatcactttatagtggtcgaattgcttgccgatgcgttgctgaaccaaaactttgacgcgtcgaaaattgaggagcaacgcgccgtggcattggatcgactgcataaggccgagaagggcgacattcgcggctcagtgctcgacaatttgcacgccaccgccttccaaggaacaccgctcagactgtcaccacttggcacaacaaaagcattgaagtaagtgccaaattggaaacaaaaaagtggggcaagcaaacttaaaaaccaacaattagacggagtctggttcaattgatgtgactgctttagctcattgaccaaagaatccgtgtccgaatttgctgacgacattttgaaggccagcggaatggtgctgacggctgttggtggtgtggaccatgagaaaatgagcgatttggtcagttggggcatgttacaacattgcgttttttatattatcattattactttggcggacttctttggaattttttttccattctttcatttattttcaggccgaaaaacactttggccaccttggcaattcgtacaatcgcaaagtgcctccacatgtggcgtcagtgaacaacattggtcacgaacaaatccgtccaaagggttatcggttcactgccggcgagttcctctaccgggacgacaattacccgctaatgcatggcgcaattgcggtggagggcattggcagaaaccaccttgactacatcgccatgctggtgggagaactgggggggggggggcactgaaggcatattttgggcacatcggtcaacatggcgtttacaatttttaacgaatttgtttaaattttatttatttgaatagtacaattttcgatgcttttttcaggggggggggtgggtcggcgggaggcaaacgtagtgcacccattcccaacttgtttgtccccatccataattgttgtacgtttgcatgtttttcataggttgcaaatgcctatgttggcacatgggatcgttcctttgccgcatcgctgaacgctccgaagtccacggtgcagaagatgtgcgccaacgacgatttgatcggatatgaaaatttcaatatcagctacgatatcacagggtacattttctgttttatttagtaaacttttaatatatttttttcagcctcttcggcttttacatagtgatgaaagggcatagtgacgaagttactggcgaagccacccgtgccgttctgcacgcgtggaagcatttggcgatgggcatcaccgacgaggaagtggacgcggcgaaaaacgcactcaaggcccgcctgttcctgggactggagaacaactcgcaaattgccactcacatagcatcggaggtcgggggcatttgacgaaatgggaggaggggggagggagggggaagtacgatgatttgtgagaaataattagttttttttgcagacct

SEQ ID NO: 46179 - DNA, 298 bp, Heterodera glycines
  Genomic contig location: Contig_ID=SeqID_29771; Location=352..649; Strand=+
  SCN-specific regions: Sequence locations=1-30,52-223,250-298
  Gene Ontology: Mol. function=GTPase activity; Cellular component =Golgi apparatus; Biological process=signal transduction
atgtcgtcacaagaggatgaatatgactatctttttaaaggtacttttttcagagatttaaccgttctcggacataaataattctgaaatttctgtaataaaattttggtttttcgattttgtcatttcccttatttttgccctggctattccccatcatttttcagtggttttgatcggcgacccgggcgttggcaagtccaatttattgtcccgtttcacgcgcaatgagttcaacttggagagcaaatccgccgctggtgtggatttgtttttcgaattctcaccttccattaag

SEQ ID NO: 46180 - DNA, 353 bp, Heterodera glycines
  Genomic contig location: Contig_ID=SeqID_29772; Location=710..1062; Strand=-
  SCN-specific regions: Sequence locations=1-311,333-353
  Gene Ontology: Mol. function=RNA binding; Cellular component=nucleus; Biological process=mRNA processing
cttttttcgctgtccctaaaaattttaaattggtcgctgcgcctctttttgagctatacgacaattccgcaggctatgggccgctgatcgccagccttcctcaaattctgagccggtatttcactccctttctgatttttgagtttcttccccgtcctttagcttcaatttcctctacaactatgcttaagtggctctgccgttctccccgcttcgctttatgatgacgaattcttcatttgtccgatcattttctgttgcaccaattggttgcttgttaaatctcatctcatctattttcggtcctttctcatcgtttcgaattcgattcattgtttgttccattatttggt

SEQ ID NO: 46181 - DNA, 598 bp, Heterodera glycines
  Genomic contig location: Contig_ID=SeqID_29870; Location=675..1272; Strand=-
  SCN-specific regions: Sequence locations=1-236,258-282,304-598
atgggttgctacaaaagactgtcgaatcattgggtcattttccgctgccggcaaagacaatgggcaaatatttttcccgcgatgtttgcaaaagtttttcctgaaaaccttaatctgacaaaaagttcttttataggcatggtgactcattgctcattttggacaaaaccggaagaatacaaaaatttacacgggaagggcatttcgtagaaatatcagccaaaattgatgattatattgggaacggattcacaattcgagaggacgaggctgtgatcgcgtgcagtggtattgtgaaggatgaggtgacagtgggagaaacgaaggacgaattcatgtgttgtacaatgcgaaatgttcaggaaggaaagaccatgtgcgacgattgggtggaaaacattcgcttggatgggtcgagatggacggaggaagcgtaaagagcggcttaaagaaaagaacacataaaccgaaagagaaaccaagaaatatctctcaaaaaatgtcaaaatttgggcattttcggttgtgaatcattacttaaatacctaatcgcttcttttgatttaaattccttaccctttttaattaatttaataaa

SEQ ID NO: 46182 - DNA, 920 bp, Heterodera glycines
  Genomic contig location: Contig_ID=SeqID_6101; Location=1206..2125; Strand=+
  SCN-specific regions: Sequence locations=1-205,239-774,798-882,905-920
atggcacaatatgtgccgtggtattacaaacgctcaccgcccattttttgtggcgtttgtgtgcccgtttatttgggcgtttggtccgttcgtaagttcatcgttgtgcttggctttctgctctttctgatcggcgttctgctactgctcggtcttctgctcatttgcgtggccatcgaatgttccgctgcgtttgtcccccttcttttcttcgtttatttgtttttcttttcagtgccggtgctttacttccgttcgccttagtgcttatcattgctgggctactacttttgcactgcggatgggctgctcatcttttggacgttggcgagggaatgccgtacgggtgagtgccgaagtcatacgaaattttggatgagtgccgaatttctgcggcattcccccgtggatatctttccattatttaagtgaatattcgacgacaaaaacggtgagcacttcgaccagaacgaaaaggacggcgccgaagggggaggaggagccggtgttcgaagagatcgaaggcaaacagccgccgcccgagatcaagcagggattttggcaattcgatgagcgcgaggcgtggcaaacggtggccaatccgtacccgataaagtggactaatcttcacggaccttcgctttgactgttttgtgtgttcagttacacgctgaagccggtgattgaacgccaaccgtacgtgccataaccatgggaaagcaatgaaaatgccattctctgtgccaattttggacaatcccatcgaatgccactgaattttcattaaatttttctttctctgttgccattctcttatgtgtcaaaatagagattaaaagtcaaaaattgctcaaaaaagtgtggtaaattttcttcttctggaatatattttaattatattaaagtgtaaaatgtgacaa

SEQ ID NO: 46183 - DNA, 474 bp, Heterodera glycines
  Genomic contig location: Contig_ID=SeqID_747; Location=2529..3002; Strand=+
  SCN-specific regions: Sequence locations=1-214,236-474
  Gene Ontology: Mol. function=structural constituent of ribosome; Cellular component=cytosolic ribosome (sensu Eukarya); Biological process=protein biosynthesis
atgccggaacgtttgacttatcgtagaaggctttgctacaacacaaagtccaataaaacgaaagtggtgaagacgcccgggggacggaatgtgttccactaccgcaataagcttggttcaatcccaaaatgtggcgacaccggtgtgccgttgaagggggtgagcaacgcaatgtcattaatgaaatgattggttaacgggaaaggcgaggtttaatttctgtttttggttgtttaaactgggctggacatacttttgcatgagagataaatctcccgtgggatatgccgacttatctcttcccttcagattaaagccgcgcgtccgcgtcaattggccaaaatgacaaagcgaaagaagacggtcacgcgcgcttacggcggttgtctcagcgctgcggctgtccgtcaacggatcatccgcgcctttttggttcgtacttatcactggactcaaagaattgttttgtgttga

SEQ ID NO: 46184 - DNA, 903 bp, Heterodera glycines
  Genomic contig location: Contig_ID=SeqID_29951; Location=1..903; Strand=-
  SCN-specific regions: Sequence locations=1-66,90-117,142-341,363-903
  Gene Ontology: Cellular component=eukaryotic 48S initiation complex; Biological process=reproduction
attgatatatgagcatccttcaatgtttagggctatgtgctccgaatttcgggtggtaacgacaagcaaggctttcctatgaagcagggagtgatcaccaactcgcgtgtgcgccttctcctctccaaaggccattcctgctatcgccaacgcaagaagggagagcgcaagcgaaagtcggttcgcggatgcattgtcgactcgaatatgtccgtgctggcattggtcgttgtgaagaaaggtttatgatttggttttttgtactcggccaattgttttttcggtcttaaaccaattaacgctttaggtgaacaggaaatcgaaggactgaccgacagagttgtgccccgtcgtcttggtccaaagcgtgccacaaagattcgccgtctgttcaacctgaacaaggaagacgacgtgcgaaagtacgtaatccgtcgcacactgccggctaaggaaggtttgtgtttacattaagttcactgcttttttgcgaagttttatgcacgtatgttaaattgacagttacaagttttggtttgtaaaaatcctttcaaaatgatgtcaggtcgtgagcatttcgagtctatgatcatgaatagtaacatcgattttgctataatgagcttaaatccaaaatcgaaccgtcgaaaatttaaaaaaaaatggtgtttaaatttcgcttctttcgagttctaattagaaattagccaacccctgatattacactttagcgatttattgccaattgtaaataaaaaggccctcgtcatttttaaatgtgtccaatactcaattatgttgtccttgctcttgtcctcttaaaaaaaccgagtctgaagacggactatgttttcggaataaaagattttcttcgtattcctatttcttcgcccacgaagacat

SEQ ID NO: 46185 - DNA, 297 bp, Heterodera glycines
  Genomic contig location: Contig_ID=SeqID_6119; Location=132..428; Strand=-
  SCN-specific regions: Sequence locations=1-106,128-138,160-178,200 -261,283-297
  Gene Ontology: Mol. function=hydrogen-transporting ATP synthase activity, rotational mechanism; Cellular component=proton -transporting ATP synthase, catalytic core (sensu Eukarya); Biological process=morphogenesis
atgctctcaaaaaaacttttccagtctatcttgaacaaatctccaaaggttggttgtctgttaatatttattcagctattttcctttcttcagactgctttctcaacttcggctcgtttgtctgcgtcaagtgctgaagtttccaggattttggaggagaaaattcttggacaggcgtcacaaatcaatttggaggaaactggaagagttctttcaattggagatggaatcgcacgtgtttatgggcttaagaacattcaggcagaagaaatggttgagtttgactctggaatgaag

SEQ ID NO: 46186 - DNA, 396 bp, Heterodera glycines
  Genomic contig location: Contig_ID=SeqID_29965; Location=1224..1619; Strand=+
  SCN-specific regions: Sequence locations=1-2,26-318,354-396
  Gene Ontology: Mol. function=tRNA binding; Cellular component =mitochondrion; Biological process=reproduction
atggaacaagaacaacaacaaaatgttcatcacagtgggcgcgaagtgcgtcagatgttcatcgactttttcgtcaaggaaaaggcccacaaatattaccattcctcttccgtggtatgcaacggtcgtttccgctctccttttgaccattttcagattccccacgaggatccgactctgttgttcaccaatgccgggatgaatcaatttaagcccattttccaagagactgtcgacccgaacagtgacatggccaagctgaagcgtgcggtcaacacacagaaatgcataagggcgggtgggaagcacaacgacttggacgacgtggggaaggacgtgtaccaccacacctttttcgaaatgctcggcaattggtccttcggcgataatttcaag

SEQ ID NO: 46187 - DNA, 1861 bp, Heterodera glycines
  Genomic contig location: Contig_ID=SeqID_6136; Location=1745..3605; Strand=+
  SCN-specific regions: Sequence locations=1-75,97-206,229-332,354 -1171,1193-1315,1337-1392,1555-1611,1641-1861
  Gene Ontology: Mol. function=casein kinase activity; Cellular component=nucleus; Biological process=chromosome segregation
atgacggattcattggtggagctcagcccgggagcgctcgtctccggccgttggactgtcatcaagaagcttggagctggcgcgttcggtgccgtctacttgtgccaagaccaagatgggattacaaagggagcactgaaaaccgagccaatcaacgcgccattcccacttctcgcgctggaggtagagtttgagtttgaggggggaacacagaaaatttggtgtaatttttgtttccctttatttcaggccatcgtgttgcgcagctttgacacacttcgagcgagcagtggaaagcatttttgccgttgcatggaccttggacgcgaccaacagctggatgctgcttctggacgtacgctggagttcaacttcattgtgtgagctttgacagggccggatgtgtggagtacataaatctttgtccccccattttcagcatgtccctggttggccgtccattcgacaagcttttgcaagaatccggcgactgcttcagccccggcactgccatcggcgccgcactccaactgctcaaagcactccaggccctgcacgaagttggctatcttcaccgtgacatcaaaccagcaaattttgccatcggactgccggagacgaacgagcagcggcttctctacctcctcgacttcggcatgtcgcgcaaatacctcaaagacgacgtgaggagtttcactgctgctttttgtttttgaatttttcaaaatctgtatcccccgcattttcagggcactatacgacgccagcgggcctcagcaaactttcgtggaacaccaatctacgcgccgatctccgcgcacatcaaacgcgactacagccgtggggatgacatcgaatcatggttctatgtgctcatcaaattctacaaaggcgccgtcccctggaagttcatcaaggacatcaacgaggtgagtttttgcagcgccaccaggatttaatgatgattaattaattttaatggtcccccatttttcagattggccagtacaaatgtcgccgcctgaaggacgagccggccaaagtgcgaaaagaggccctcgaggagctgaccggaggatgtccgcccgagttcaacaaaatcttagcgcacattgtgagttttctccgtctcattttttcctcttaatgctttgcatttttcaggatggtttggagccggaagaccgccccgactacgaaatgatcgagaagacactgcgcggctgcctcaagaagttggacgtccgggagcatccatacgactgggaggtcggacgacagaacgtgccactccaacaacggcaggcgagcagcgaccaggagaagaagaagaagggcggttcgtcgcacaagaagagcggttcgtcggataagaagagcgcttcatcgcacaagaagaagaagagcaactcagcggaggacaagaagaagagccaagcgccgcagaagaagaggaagagcaactcggaggaagaaaagaagaagaagagccaagcgccgcagaagaagaggaagagcaactcggaagagaggaagaagccgtccaagaagaagtgagcgcagcgggaacggcacggcaccattctgatcaccaattgctcaccattgtgcttatatatatatatatattttttttttttgtgagcggcggagcccatttgatccccaattgctcatcattgtacatattttgtgagtggccccatttgatccccaattgctcatcattgtacatattttgtgagtggccccatttgatcaccaattgctcatcattgtacatacatattccagtgatcaaaattgcctgtatgtacacataattatttgctcaccaatgttgtaatcatttccatgtgca

SEQ ID NO: 46188 - DNA, 782 bp, Heterodera glycines
  misc_feature (764)..(764): n is a, c, g, or t
  Genomic contig location: Contig_ID=SeqID_30029; Location=186..967; Strand=+
  SCN-specific regions: Sequence locations=1-119,154-161,193-782
  Gene Ontology: Mol. function=metallopeptidase activity; Cellular component=extracellular space; Biological process=development
tattctgtcagccaacagtgcaaatttgtgtttggtgctgctgccgaaattggtccttacatgccaacttgtcgccgtttgtggtgctccgtgtccttcggataccaaatgggatgccgaacacaagtaaattatataaataattgattcattttaattggcatatatttggtaaaccaaaattttttcgtgtccttttaagcatatgccatgggccgacggcacgccctgcggcgataacatgtggtgccatcggggacaatgtgttggcatgtcgccaatgcagcggcaacccgttgatggcggatggggcgaatggaagccgtggcgtgagtgttcgcgcacatgcggcggaggtgcttaattagggcatagagtcaatcaataaatgatcagcgattcttatcaggagtccaaaaatcgtttcgagaatgcgactcgcctccgcccgagaatagcggcaaatactgtattgggcagagggaacggtatcgaccatgcaacatccaggtcagtattaatgagtaggtttttgatcatacatcaattgattgattagattcacatatgcacagttagtgatccattatttgaattttaaaaaatgcagtgatcaattgcttaattgcaaaatttttaattataatggccaccttttcattctgatcagtgattactcgcatttgcgtgatcataatttcagtgatcatcatattttgatccttatcactttgttttaagaacggtccctgggaaacgcccgngttttcgtgagcttcaat

SEQ ID NO: 46189 - DNA, 3456 bp, Heterodera glycines
  Genomic contig location: Contig_ID=SeqID_6139; Location=395..3850; Strand=+
  SCN-specific regions: Sequence locations=1-191,213-705,727-793,815 -916,941-973,997-1004,1027-2296,2319-3050,3075-3456
  Gene Ontology: Mol. function=transcriptional repressor activity; Cellular component=polytene chromosome; Biological process=growth
atgtccgactctgaactgatggatacgctggaaggtggtctaaatcctgatgatgaattaaacgacacagttggtgatcccgactccatggaagaagatgaggagcaggaagagcgagagcaggatggggcggatgaagatccgatgctggagagcacttcaggacaaggtcgaaaatttagttaaatgcgaaaatagttttaacactttttaaattaaagcggacgatttgtctaagaagtcaagaaagttcgctggagggaaaaagaaaggtcgcaaagggaagcgaagcgcccgatcgggcgggtcgcgcgagcaacttcccgacgcgtacacgcattccagcacggaattgtgcacaatgttgagtatgacaaatgcggaatttgaatactctgaagacgacttcaaaaacatcacttccggaaagacggtcaatagtcgatttcaccagacacttcaggagttgaaccccaaggcaagctgggcacgtttgcaatgtgtgatgactgccaagtacaatgagtaccaggtgtacagcaacaaacttgaaagagatttcaattaattgttgcagaaaatgttggccgatcaaggaagacaaatgccgaaaaaggtgccatcgcgttcatccgccgttggcaacgccggcggcgcaactcccaaagaatcaatggcaagctcttcaccatcctttgtcaagcatcttccatctgggagttctgcaacaatagctgagaaagtggcgcctttgaaaattcggttgtccgcccgcaaaaaacgtcgtaacgatgactcggaagaagacagtgagaaaattaccgagaaaattttcaagattttacttttagtgaattctgatcaagagttcgagtctttgttgaaggagcacgaaagacaattggacgaacaagacaaagagaaggaggaaaagaagcaggcgagagtggcggccaagaaagccagagatacgacgaaacagcagcagaaagtgaagagacgcaaggaggaaggcggcgaggaagcggagggcgaattacaggtaattggcatggattagtagaggtgggactgcaaacatcgtacaaatgcaatttgatattaattttgcgtattcgtaaattactttttccaaataaggaaaatcaaaaatcccatacaatatgtcatttttcttcagcaagagcatcaagattactgcgaagtgtgccaacaaggcggtgaaattattctctgcgacacttgccctcgtgcttaccatttggtgtgctttgatcccgatttggaagagccgccggagggcttttggtcgtgtccccattgtgaacagaacggagtgccaaagaccgccgacggaggcgacgcaaacgctgcgccggggaacatggagaagtgcagagtgtgcaatgtgaggaaaatgaaaggccattgtatccatagattaaaatcttccctctcttaggagcatgatttcttgttgatatgttcacgttgtccaagttcataccacgcattttgtctatcaccaccactaacggaattgccaaatgaacacgaggattggacctgtcctcgttgtcaagtattgcctggggatggggaaattataatattgagtaggcatgggtcagaacttgaatggaaggggaggctagtcggaaagcacacaaaatttgagatcaaattttagaccaaagagccgaaaaatcggccggaaaaaattctgtcgtggcggtggatcgagtacaaatacccggaacaagtctctgaagaggacgcactcaaagaaggcgaacagcctgcaaacattgaggacgaagcgcgacgagttcgactgtttttgcaccctcaaaaagaaatgaagccacgcagagaacgcgaattttttatcaagtggaaatatatgagctattggcactgtgaatgggtgccagagcttgtgctcgagttgtactttacgcaaacactccgaatgtattggcgcaaaatggtgcaagaatattcgaacctaaaaaattaatttgttgtttttaggacccagaagttcccccggaagtcgatgatgggtccaacgaggacatgaagacgggcaaaattgacgacagagaaaaagtgatacgccatggacttattggaattgagacacaaccatttaaatttaggaggatgacccgcacaatttagaacagaaattctacagatacggcataaaacccgaatggatgcaggtgaaaggaatcatttgaatgtgaacaaattgaaaggaattttaaggtccaccgagttatcagccacgtttattatgagaagaatttatttgactatttggtgaaatggcgcgagttggtttatgaccaggccacttgggaacgcgatgactttgacattcccggcttggaggaagccattttcaaatattggatgcacaggtgccaattgcagtttatgcaacaaaaaacgatgtttagggagagaatgagcggcgaagcgatgccaaaatacattttgaagaaactgaacaaaaaacgggccgagcagggatttgtcacattcgaagaagatgagaaaaaaaggaaaaagcgtgagggcaaagcaaccattgacgtaatgatttggaagccgggaaacagccatcgcattaccaattcagataaaaaagaagtacgatgttcaacccgactttgtcagtgagacgggcggaacattgcacccctaccaattggagggcatcaattggctacggcactgttgggccaacggaatcgacgcgattttggcggacgaaatgggactgggcaaaacaattcaggtgccgaagggtagcggaaagacagcaattaaaatgccatatttagtcacttgagttcatttattcattggtcaaagaggggcattcgaaaggcccttttctaattgcggcgcctctttcgacgctgatcaattgggagagagaggctgagttttgggcacccgacctttacgttgtcacttatattggggacaaggaaagtcgatcggtcgtacggtgagtattcccttttcttaaaatgattgttttcatgtttcactttcagtgagcacgaattttctttcatcgaaggcgccactcgcggagggccaaaggcaagtcggttgcgcaccgaccagggcatcaaattccacgtgatgcttacttcgtatgaggtgccaatgtttgcttacggtgtttttctgttttgcaacaacagttaatcctttcagttggttagcattgacaaggccattctttccagcattgactgggctgtcctggtggtcgacgaagcgcatcgtctcaaaaacaatcagtcgctgttcttccgcacgttgcgcgagttcaacatcggctaccgtctgttattgacggggactccactccaaaacaacttggaggagctgttccatttgctcaattttttgagccccgaccgcttttag

SEQ ID NO: 46190 - DNA, 900 bp, Heterodera glycines
  Genomic contig location: Contig_ID=SeqID_30064; Location=36..935; Strand=+
  SCN-specific regions: Sequence locations=1-11,34-362,384-460,488 -718,740-758,780-900
  Gene Ontology: Mol. function=transcription co-activator activity; Cellular component=chromatin remodeling complex; Biological process =chromatin modeling
atgcgtttcatggaggtgccgcagcggttgcagacactgctccaacagcccgacccattgatcattcaccatgtcatccgctgggacggaagcggctcatcagtgggggccgcagcggcagcggacggttcgccgactgagaacaaaaacacggcatgttacgatgtgaggaggacggggctttagggttggtggtatgtcaaaatttggcacttttgtgcctttgcaggtcgatgttgagttggacgacccaatcaaacagcagcagtcggcctttttgcagtccaatgccaatgtgcaagaattgatggcactcgaccataaggttggattgagagacattaccaaaatgggggacaacgaccccaaaaaatttaaatgggaaatggcacggtttatttttgtttcccgacagtcgaaatcggcattgatgcatattcaaaataaccaaaaagtcccccaaaattgaaattttgttttcaattaagatttacaacactgttgaagagattaacgaactgaaagtgcgacgcgacttttttgccagttttgtggagaatccgcaagcatttgtggagaaatggctcatttcgcagagcagagaccttaaggtgagaatttcatggatttggatttaattattccccgcacccaaaactgaaaaattggatttcattaaaaatcgcctctgatttcccccctcccggccaatcttaaaaaatataaacacacaaaaaagtcctttttgcaatttattcctaaatttcccattttgcattgttaacaaattgcgccattttacagaatttgtccgaaatttccgccgattatgagatggagcgtcgtgccgacaattattatcagcccgttgttcaggagggcgtcttccgttacatgtaa

SEQ ID NO: 46191 - DNA, 830 bp, Heterodera glycines
  Genomic contig location: Contig_ID=SeqID_6151; Location=384..1213; Strand=-
  SCN-specific regions: Sequence locations=1-249,273-342,364-539,561-830
  Gene Ontology: Cellular component=mitochondrial inner membrane; Biological process=cell organization and biogenesis
gttgccaaagcattggagcacattgagcaaatgaacacagtcccggagcggctgattcgggtccgattcaatgcggtccgatcatttttttatttaaaaatgattttcccttttttcctattttactccaggacgtcaactcatccatgcagtggaaattcaagccggtgcagaacgaaatttatgtgaaccccggcgagacggctttggcatttttcacgggtaaaaaaatcagagacgaaaaacagcaaaaaaaaaaaaaaaaaattattgcccccttaatatttgtggcaatttgtttttataataattggcataacttttgaattcgcacatttttttggctgtttggctttgaaaaagcccaccccaccacagattggtgccatttctaaagcctaatgagtcatctattttttgtttgattacgtgcatttttttgcggaaatttattttttaaaactttttaccgaattttagaccaaggttgtgttttggtaaaaaagcccgtaaaacgcatggaaaatttaaaacaaaagatttactgaagtactttttatctccaaactagactatgtaaattggaggtgtattatttccaaatctgcccttcagatttgtcatgtgatttcgaaaattaatgattttgtcaaatcttttttgttgaagatccgggtgttgattttgggtcgggcccaattagcgttaattacccactcctaattataattgttgcgttttttgcagcggagaatccgtcggacaggccaattgttggcatcagcacgtacaatctgacgccgttccaggccgcctattacttcaacaaa

SEQ ID NO: 46192 - DNA, 504 bp, Heterodera glycines
  Genomic contig location: Contig_ID=SeqID_30091; Location=1..504; Strand=+
  SCN-specific regions: Sequence locations=1-127,150-221,243-504
  Gene Ontology: Biological process=gametogenesis
cgggttggaggggcacgaaaaatgaagtgaaatgtgtggcgttctccgccagcggcgaacacttggccacctgctcccgggacaagtccgtctgggtgtggcaagtcagtttttcgttcaataagggaaaatcagatggggaaattaaacattgttgcttttttggatatagagaccggacgagtcggaatccattcgggcttttttcaaaatcctgatcccatattctctgaaaattttctggtttgttggttttgaaaccgtccaaaaatttttgatttgctaaatgcatgtcccatttttggttatttccgaaattcgcacagatggacgacgctggcgacttccaagtgatctccatcctgcaacatcacactgccgatgtgaaattcgtgctttggcatccccgcgaggaactgcttgtctcgggcggctacgacggctccgtccgcttttacgcttccgacggcgaagattggtgcactggccattcggtgaatggtg

SEQ ID NO: 46193 - DNA, 1235 bp, Heterodera glycines
  misc_feature (107)..(107): n is a, c, g, or t
  Genomic contig location: Contig_ID=SeqID_30098; Location=1..1235; Strand=-
  SCN-specific regions: Sequence locations=1-1,60-642,667-782,806-1235
  Gene Ontology: Mol. function=serine protease inhibitor activity; Cellular component=integral to plasma membrane; Biological process =signal transduction
caggaagaggaggaggacgaggacgacgaggagtacggcgatgacgacgaagaggaagaaccgggttagcaaattatctgggcggaatcagggattttagaggaatntaaaaaagggaacgagaaatgacaatgggaaaatagaattggaaaaaacaaaaattgatcatctactctttttagatgacaaaaccgcaaagaaggagacgacggcggacgcaaaggccgagcaggacccgtactttaaggacgacccgcaaggcaatgagcacgaacgtttccgtgatgcggaggaacgtctagagaaacgccatcggaagaaagtgaccaaagtgatcacggaatggagtgaactgtttgaacggtacagcacaatgaaggagaaggaccccaagggggcggagcagtacaaacggaatatgtgagagggaaaatgggagggaagggacggcactttttggagtgacgcattcccatcgaaggaccgcaaaattccgaaagactgtggcggcactcgaagcggagaacaaagagcagcgcaagcaaattgaggaattgcacgacgaaagagtgcagacggcgctgaacgagaagaagcgacaggtgagcagaaagagaaagcgaaacgatgggaagagaacggaatggaaaatggcaaggaaaaccacgaaaaacgggcatttggttggcagggtataaacacgaaaatcaagaattctcaacaaaaaaccttttctttcaaaaaaccatgtacggactggactgtccatggtctttgaagacaaaaatatatatatagttttgctgtaatgttgtcggggaatcatcagagccgtatcttccaaatgggtgggggaaggggacgggctgtgacttttaatgcattatttattaccaaaattgttgactaattgcaacaattaccaaggcaacccacgagtaccgtgccgcgttggctgtccaagtgggtcaaacgaatcgacagaacgtgttacggacgctgaaaaattacatacgggcggaggagaaggaccggcaacacatgctcaaccggtacagacatttgttgcgctcggatccggaggtttgtttagcgaccaaaagtccatctttctgaaccccccccccccccttaggcggccctctcttttgagcccattttgctccatcgtttgcgttacatcgacttgcgcatcaatggcactttggccatgctgcgcgacttttcgtcacttg

SEQ ID NO: 46194 - DNA, 1317 bp, Heterodera glycines
  Genomic contig location: Contig_ID=SeqID_758; Location=1291..2607; Strand=+
  SCN-specific regions: Sequence locations=1-81,104-246,268-1317
atggcattccacaaaattgacaatgacagtgtgaactccatcaccaatgccttggactttttccgcatcccaccaactaacgtcagtgtctcatcctccaaagtgtttgagctgctcccaagtaaccccctgaccgacaccccctatcacttcaagcttcactccagtcaaaattatattgatctctccaaatgctatttgttatccgagtttcgaattcgtaaggaaaatgcaaatggtcaactggttgaccttgcagctgatgaggttgctccgattcaactgattggacacacattcattcgaaacatcaaaatgagcatcaatggccgtgaagtgttcaacgcaaattctctgatggcctacaaatcgtatttttcacacgaactctcctattcaacagcggccaaggactcgcatttgaatgctgcaggttactatcgtgacactggtggtgtgcttgaggtgggagacggatgcactgcacgacgcaacctgtttgtaggcagcagaacagcacaattcattgccaaaattgacgccgatttgtttaaccagcctctctacttgatcaacttttgtgagctggacattgaaattttgcccaacgacaacgactttgtcctaatcacaccacccggtgttgctgcagccactcgctaccatttcgaagttgtcggtttgaaaatgtatgtgaagaaggtgtccctgatggacggattggcgttggacattgcgcgaaagcttgagttgaagccggcacgatatgcagtgaggaaaacgctgatgaagtcgctgttcatcagtcatgggcgttttgaatttacgtctaatttgttcatggatcaaattccccggcgtatcacaatgggattggtggccaatgctgactatgttggcaccgtttcacgcagccccttcaactttcaaccatttaatgtgcgtgaaatttccataattgccaatgggcgctcctatcctcaagcagcctacgacttggactacccaaacggaaagtatgtgcgccccttcaacgacatgaacgaagcggtgggattcgccaactcatcggaaagcaacgggattactctcgcacaattcggcactacgcattgcatttacatgttcaacttgacgagcagtggagacgaccaagcggcgctttttgatctgataaggaacgggaccacagcagtgagcatcaaatttaatcaggcggtgcccgctggaggaataatgttggtggtgatgggcgagtgcgactcgctggtgatgttggataaaaatcgatcgatcagcactgacatcactatttaa

SEQ ID NO: 46195 - DNA, 1476 bp, Heterodera glycines
  misc_feature (1460)..(1460): n is a, c, g, or t
  Genomic contig location: Contig_ID=SeqID_30179; Location=1..1476; Strand=-
  SCN-specific regions: Sequence locations=1-90,112-343,365-444,472 -812,897-1476
  Gene Ontology: Mol. function=transmembrane receptor activity; Cellular component=cytoplasm; Biological process=Rho protein signal transduction
tttttatcaatattttaattatcgagttccatctcgaccacaaatttaatctttaattagaatctttatccgaatcgtgaaaatcttattcaaacaatttttagtattttgaagccactgaatacacaatagagcttgaaaccattgaagatttattgggtaatttaaataaatccaaacctaagacccaaaaaaagatttattgtttaatcagcgcaaaactaacaccatatttcatttttggaaacattttcatataaatttatccaaattacatcaaaagtttgagttaacaacggattgaaaataattcaatttgattcaaaaatgaatttaaattttaaaattgctaccgttgccatcatcttgacttttacatacaggaatgtgctttctgaggataaatgtcaaagcatttttggcttacaaatggttaaaggtaaatttcagaaaaaagttaaatgaatagcaaaatatcacgatgttttttggttataattcaaatctcttaagatagggctgtgaaatttgaggattttctacatttttttttgggttttttgttgatatgattgattaggatttcggatttaaggagattcctggatttttgtaaaattaaaacattagttttatggtgggggcggataagaaagtaaaaaggagaatgtcttttaccaaaatctgtaaacaaaaacggctaaaattgtttttttgttaatttacacaaaaccgcaaaatctgattattatcaataaaatttcgaaaatttcccggcggcgctttggcatcgcggacccctcctcattctcaaataattttttcaatacaatatttatatttaattttgttgttagaaattaaaattttttcaagaatttattcttatttttttagaatgttcatatgacgaaaattcaccaccacaagcgagtgattgtccaaatatcaatcccaatagtaaccccagcgcagactcagaggaaatgcgatcttgcattcgggcattatgttgccatcagtgccatgaagccggcgcaacgatgtatccgtatttaagacaaccatccaatccgttttcgtcaaaatacactaattacatttgctgctgcaaagaaagcatgacaacaagcacatcttcaacatcgacttcatcaacttccacaacaactttaagtacctcaactgcaacaacaccaacgtcaacaacctctagtagttcaacatcgtctactccgagcagttcaactagttcaacatcatcaacttcgtcgactctaagcagttcaacaagttcagcatcatcaacctcgtcaactccgagctgttcgagcacttcaacggattcgactccatcttcctcaaccacgtcgactccgagcagttcaagcatttctacaagttcgacagcgtcaacttcaacctcatcaactccgagtagttcaaccacttcaacgagntcgaccccatctacct

SEQ ID NO: 46196 - DNA, 1313 bp, Heterodera glycines
  Genomic contig location: Contig_ID=SeqID_30212; Location=577..1889; Strand=-
  SCN-specific regions: Sequence locations=1-264,287-856,904-926,948 -1069,1099-1313
  Gene Ontology: Mol. function=purine nucleotide binding; Biological process=energy pathways
atggccacactatcaaacacagacagtgaagaaatcccacagaagcggccacgggaaaatgacaaaaaggatttaacgacgtcagcagaaaaaaataacagcgcgaatggtggaagttcagaggtaacaaagaatttttgcctgtttacattgaaagtgtgcttttgatttgtttacttagcattcctaaaataaattcagagtgccaaaaccacggctgtttcgcacagggctccctttgacgcgacccatcgcataaatcgccttggtggaaaataccatgttttattagcggtgacgggctccgtggcctcaataaaagtgaatgaactgatcgccgaattgtacaagcaatcacccgagaaccgtttagcaattaaagtcgacactttcttttattccgtctaattttccacagttcaggtggttgcaacccaaagtgctctgaacttctttgacgcggctgacacacaagaaattgtttacgatgacagagatgaatggaatatgtggaagaagcgcggagacccagtgctccatattggtaaagtcaattttatgatcgaatctcaacaaatacaactttataaagaactccgaaaatgggctgattcgatgctggtcgcacctttggatgcgaattctctcgctaagatagcaaacggaatttgtgacaatttggtgacgagtgtcgtacgagcgtgggatcagcgaaaaccgctttattttgctcctgcgatgaacacagcgatgtgagacttgagaaactttgtacgggttagggattcggaaatagttaatccgattcgtgatcctacctcgaaaacctttatgaaacacgctttcacgacttattaatataaaaaattacaaacaaaagggcctctcccctttggtttttaataatttcagagagttcaatttttaaataagtgccaatgtttattaacaaattacaggtgggagaacccattgacatatcaacacttgaaaacgctgaaggaactgctcctgtacagggtatttttgaattttataagaggttactaaaaacagttttttccttaacttaaaaaaaatatttttagtttattttttctttgagatttaaatttgtctaataattttgtggtttcattgaacttttattttttttaattaaggagatcccaccaattgagaaggaaatgatgtgtggggacaagggatacggcgcaatggcctccgttcaaatgatagcatcgataatttcctctgacatcaaaaacaaatacgctgtctattcatactcctccgaaaatgcgtcttcttaa

SEQ ID NO: 46197 - DNA, 2044 bp, Heterodera glycines
  misc_feature (36)..(36): n is a, c, g, or t
  misc_feature (152)..(152): n is a, c, g, or t
  misc_feature (194)..(194): n is a, c, g, or t
  Genomic contig location: Contig_ID=SeqID_762; Location=2988..5031; Strand=-
  SCN-specific regions: Sequence locations=1-261,290-336,358-700,744 -779,824-1043,1065-2044
atgcgcgagatgaaagcaaatggacaaaatgggaangaggaggcgtttgactggcgtatttataaccaatggaacagaattagccatgttgttaattgcaatgcgcaattgggagatgggtcagcgaatgcttattcaaacattcaagtttntatgcttttcttttttaggcttctcaaagcaactcccggccncaagtgatcagcagaagtgaatgaattgatgagaagtgatcaatcagattttgaattattggcgtgctcataaaaatgttattttttattggaatgatcactttggatttttgtgggccattagtataatttgtggttctccaaaatataaaaatcttaaaaatcatatcatttttcaatgttttcccgaccgacggtgactatcggcactgttggcccatatcccaaaaagtgtccgaaaaggatcgtcgatttttttttaatctaatttttgtcgtcaaagtcttagttttgcgggttggaatcactttggcgtaatttaagcataacttcataatcctagaaacaaagctggagaaattttccggtttaaccgggggcatttagtaaaaagagagttttttcttcattctgtacattgtttatatttcgaaaaaatttattttatgtgtaaaatattttttggcgttttgaaatattttattttctcacttatgtacatttgcaagagaatggttaaatgatttcaaaataaaaacatcttttttcgagataccaatttggattttcagcagggttcaaatgcattttttctctaaaaaagggatttttgatccaatttatttaatcgattaattaaacccagatttcgaatgtgtaatgtggacattttcgtcattattaacattactttttcatttttaagatttttctaaatactaatgccgaagaataaagggaaaggaggcaaaaatcgtcgccgagggaagaatgaaaatgatataatgaaacgggaactcgtcgaaaaggacggcgacgaccaaggcatgaacttttccaagacaattttattccatttttgttttactcagaattaaccattaaaggcccgagatttcccatgcttccataatctttaaattattgtacaatcctcaaaaaaaagctggagttatttatgttttaggatttgcaaaaattttatacaattagctttagtgaggttccaaattcgaacaaatgtcacaaattgaaaaaaacaattgttttttcagcatatgcccaggtggtgaaaatgttgggcaacggtcggttgacagcattttgttttgacggcaaaaatcgcctgtgccacatacggggcaagttgcgcaaaaaagtgtggatcaacaccggcgacatcattctgatcggcttgcgagggtaccaagatgacaaggcacgtggggcagtagaaatcggactcttgaaaaaaagcgggactagaaaatggtagggtcggcaatcccggaccgggatttccattttcctggactcaaggttcagttgctttctctgaaaaaaaacctggaccgaaatcccggcaaaacggctggggtcggtcccgtccgatgtatagtttttattgtattacatttgctataaaaaggcatcatggattttttgaaattgcgaatcactcgccccttttcattgccccgaaaaaatttttttgggtaaaggaaacaactaaagaaaagtctggcaaattccaatcgttgtttgttgtcccggtgttacaagtttttctaaaaatggacacaaaaatcgcatttttcgtgaataacttcccctgtgtttttcagctcgccaggctttcgtagataacgccttcgtttcttaaatttactgatttagactgaaaatttttccaggcggatgtgattttaaaatacacgccggacgaggcacgcattctgaagaattcgggtcagttgccggagagcacaaaactgaacgaggtcggcgaggagcaaaatgagggcgaagtggaattcagtgagttcaacagcaaacaacagtttacatga

SEQ ID NO: 46198 - DNA, 545 bp, Heterodera glycines
  Genomic contig location: Contig_ID=SeqID_30243; Location=1..545; Strand=+
  SCN-specific regions: Sequence locations=1-545
  Gene Ontology: Cellular component=mitochondrion
tgtttatccacacacacagtgtgctgggcgtatgcaccagcaaacatgacgaggaattgtgcaaagcgggcggtgatgcgtgcgaatttgtgatcgacggttattacatttcggtggcaatttgcgtggtcgtcggtctgctgtggtatcggtcagttctgttatattatttctcgatacgatacgaccaatagaaaaacagtatcagaatgttccgaactggtctaacaacattgagaaattgttttgctaaggatgaagaagaaattttctaacaaattttattggaactttacaaaaaaaaatttccgacgcgcggttcctcccccccccccctccgaaaattgtgcggacttgtgtctgaaattaggtacgattcagtcttttctccacaattcaatgtggcgttgttttgttttatcgtattgttaggcccactaaatttgattgatagtttttacgatttttattttagaattttctaccggcgcatcaaatacttccagaagattccccgtcaagattggcgcgtgatcaaaacaaaa

SEQ ID NO: 46199 - DNA, 461 bp, Heterodera glycines
  Genomic contig location: Contig_ID=SeqID_30249; Location=108..568; Strand=-
  SCN-specific regions: Sequence locations=1-195,245-383,406-427,460-461
  Gene Ontology: Mol. function=DNA binding; Cellular component =nucleosome; Biological process=nucleosome assembly
atgtctggacgcggaaagggtggcaaagcaaagtcaggaggcaaggccaagtcgcgttcttcacgtgccggactgcaattccctgttggtcgtcttcatcgccttttgcgcaaaggtcccatccaacaaatttcttgtccttagttcaattaggtcactacgccgagcgtgttggagctggtgcccctgtgtatttggcagcggtgttggaatatctcgctgctgaagttttggaattggctggcaatgcttcgcgtgacaacaaaaagacgcggattaatcctcgtcatctccaactcgctgttcgcaatgacgaagagcttaacaaagttttctgccactattttatatttctaccatttcacctttagcttctttctggtgtgaccatcgcccagggtggcgtgctgcccaacattcaagcagttcttctgcccaagaaaacccatggagaaagtcag

SEQ ID NO: 46200 - DNA, 674 bp, Heterodera glycines
  Genomic contig location: Contig_ID=SeqID_30265; Location=451..1124; Strand=+
  SCN-specific regions: Sequence locations=1-674
tttccagcctcgtgttcggccctctgatcaagctcttcggtaggatgccccttttgatgttcggtgccgtgataaatctgttgatgatcatcactttgatggttcgccttccttacttcttttgtcccatcattttgatcaatagatttgggttgttaatcccggcgatcggactttgtttaacgctgtcgccggtgtttgggggatggcagacggagtttggaatacgcaattgaatggtaagcaaagggaggggcggcggggggagggggaggagatggcctatgtccaacaacagtattcccggaatccgctcccacccccaccttttgcgtccactccccccccccccttccggggttggctctgactttatgttcaaggcttttgggtcgcactgcttggtcccggccgtgaccaattggaggtggcatttgccaattatcgtttttggatgtcttttggcctcgcgctcggcttttttctcatccgcgccacttccatcgacactttccttctcatctctttcgccttccttctgatgggcattctcggctattttttggtcgaattattcgaaatcattgcggtaaaatcgaaaattcgaattgggcttaaaagaaacatttcttcagatgaaattggaattagaaagaagaacaacggaagtgata

SEQ ID NO: 46201 - DNA, 917 bp, Heterodera glycines
  misc_feature (66)..(66): n is a, c, g, or t
  misc_feature (100)..(100): n is a, c, g, or t
  Genomic contig location: Contig_ID=SeqID_30273; Location=516..1432; Strand=-
  SCN-specific regions: Sequence locations=1-103,125-173,195-214,238 -241,264-493,515-788,869-917
atgaagcttggaaaaatggtcaaaaataaatgggttagaatttcaactgggaaatgttttgttctntatttagggaaaaataatatgaaaaaagattatntaattaactcaaaaaagatttcagaatcggataatgttcgtgacctaggcattttaattgactcgaaactgaatttttcagaaaatattaacaaaattgtacgaaacgcttatcttagagttttccagattttaaaagtcttaaaaaccagggaaataaagactctaacaacagcttataaaacttttgtccgacctcaattagaatacgctaccgaagtgtggaacccaaatttaaaaaaagacattgacaaaattgaacgggttcaaaaatttttcacaagaaaagcatttagaaaatgtggttttttgtacagaaaatataaggaaagactaaaaatcactgatttacacaaattggaagaaagaagaaaaatcaatgatttaacaacagcttttaaaattataaaagggttcaccagcctcgatgctgaaaaaagtttctttttctcggaaaggcccaggaggcctttacttttgcgagtaaagcgccacacggccaaaactcaaaataattttttcaatagaatagtaaaaagctggaataaccttccagtggtagcggtgcaaattaataaggcaaaggaattcaggggtttactaaaagcaatgagttctgagtaggattttccatgttgccatatttacactatatttttatcacctgtgaatttttaacatttgattgatttatttttattcattttttttattacgatattcattttgtattttttatttgaccaactttatttgttgttttctttttggcaccatataagagcactcatgtgcctttggtttgctcgataaataaa

SEQ ID NO: 46202 - DNA, 193 bp, Heterodera glycines
  Genomic contig location: Contig_ID=SeqID_30286; Location=1086..1278; Strand=+
  SCN-specific regions: Sequence locations=1-193
gccgtttcgccctctttcaactttttgcgtcgtccgttgcctttgttggtctttcgtcgttccctttttaaaccgccattggactcaccgttctgtggcatttaccggacaaatggcgaaatttgccggacggatgacattttggtgtgccaacacaagatgaactatcaccctggagcaaatgtacccagga

SEQ ID NO: 46203 - DNA, 681 bp, Heterodera glycines
  Genomic contig location: Contig_ID=SeqID_30323; Location=383..1063; Strand=-
  SCN-specific regions: Sequence locations=1-230,252-585,609-681
agagttgatcggcctgtacatccgttcttctcacaacatcatccaacaacacaaatggcaatcctatcgtgacaaaatcatttatcgtggacctatggatatagcagtcgctctgagcaaattacctccgactgagcacatcaaacaatcatttctactcgacttcaatttcacttctgtgggttattaattaaattgttgtttgtccattcactcaaatgttctgcttaggaattgattgcttttcaggacaatttgatcgtcttatcgctgcaaggaatttttcgcgatgggaaagaagtgtcggatgggtctaccaactttttgaacatgaaatttttcacccgacagtttgccattgtcccaaaaacggaggggtaatttatgttggtcaacaaaaaaaaacctttttttttgccatttaggatcgcgataatttcggatattctccaaattacaccgattagcaatgctcggatggaacggtacaacaatttgctcaagaatgcgactgtggcgcaggtcataaaacatttcttattttgttaatgagaggattttcaggtgcagcaatcggctctcgtccctggcggtgtcttggcttcggctgtccaacaacaaattgatgggatggccccaccgcctccgagtccacagacacaacctgtgttgatgatataa

SEQ ID NO: 46204 - DNA, 763 bp, Heterodera glycines
  Genomic contig location: Contig_ID=SeqID_30324; Location=126..888; Strand=-
  SCN-specific regions: Sequence locations=1-36,59-411,433-763
gtgttaaatgcgtccggtacaccaatcaatggagcgttcactttttggtcagccccttccactgctgctccggcagcgacagcatctgtctccaatttatcggccacaacaacagttatctcatctgaaccggatctcactccactcacaccgtccacttcggacgtgacagttaatggtatggtaaattaaaagattaattcctgtttttggcatggctattaaggttttatcaagtccctttgtcgggtatttttttgttgaaaaatacgccgtggattactctatgagtcctgagaacggctttttaatccggtcgagtatagttgccaaattttggtcctttcaaatcctgctgctctatttatgatgaattgcgcaggaatgccaggaccgggcaccgcccacacaaatttcaaaaattaaaatacttttcaccggcttttgtggcacggcattgttttctttttgtatggttgtttatccccatacattttcaaggccacagcagcaatgtgaaggtgcttaagccggtgccgttggtgatccgaacccaaagtgcggacgaaattgcgggtgccgttgcgcacccgaccaaaccgtcggagatccggaaactgatccggtcaaagatggtccgatgtcgcatttgcaggaaccgttttctggacaagcacatttatgagcgacatttgcgcgacaggcatcccaaggaacacgcggcttatctgagccaacaggaggacgaagttcgacagcaaag

SEQ ID NO: 46205 - DNA, 828 bp, Heterodera glycines
  misc_feature (519)..(519): n is a, c, g, or t
  misc_feature (554)..(554): n is a, c, g, or t
  Genomic contig location: Contig_ID=SeqID_6226; Location=168..995; Strand=+
  SCN-specific regions: Sequence locations=1-262,284-718,740-828
  Gene Ontology: Biological process=embryogenesis and morphogenesis
atggccatgggaccgaatggggcattggtctattgcatggaatatttggccgacaatttggactggctccactcgcacctcaacgagggcgaagacgactactttctgttcgattgtccgggtccgtttttagagtttaatccctttataattggctgtaaaataagggccaaatggcggttgtttttaggtcaaattgagctgtacagccatctgccggtgatgtgtcaaattgtgcaggcgctgcgcgagtggaacttcaacgtgtgcagcacctttgtcatggacaccaccttctgcttggactcgaccaaattcatgtcagccactctcaccgcactgtcaacgaccgtttcgctgcaaacgccggcagtgaacgtgctcagcaaaatggacttactgaggccggaggaccgacggacagtcgaagaaattgtggacggagagctccaaaatgcaatggaaaaggtgtaaaatgaatgcaatgcaaagacacacaaataaattatatataattanagcaagggaaaagccaatgggaggaaaagcatcgncaattaacggacgcactctcgacagtaatcaacgactacagtatggtcagattcattccgttggagcttcaggatgagcaatcaattgaaggtggacgaatgaacgaagaataatggggaaaaccccttcgtccgttaattttagaaattctcttggccgttgacagtgcaattcaatatggagaagatgcggaagttaaggtcaaatatccggaggaaagggatcaagattttgaatgacaaatcgatggcagttgttgttgtgtttggacaa

SEQ ID NO: 46206 - DNA, 734 bp, Heterodera glycines
  Genomic contig location: Contig_ID=SeqID_30394; Location=208..941; Strand=-
  SCN-specific regions: Sequence locations=1-178,200-322,344-734
atggcaacgcggaagttgagttttcctgagaaaattgccaatattcttggagttatttatcgctatcatgaaccgcgacttccacgttacaaagtttgaatgatttgaattatttatgttactaatccgactccgttttacttaaggacattctgaagaaagtgtgtgtccgagaattggctcctccaactccaaaggattggcctcaggtttatacattcttcaatatttatattttttcatatataaagatcaaagcggattatgccaaattggacacagtgatgagaacgcaggcctacagacagtttaagttgaaggtaacttttttcaggaaattcacttgcatttgtcaattgcccgtaaattaaggaatttctcgtttattcggctgttttcgtggaagtgctctgttggtttttcgtcggagagatcattggacggggcagtctcaccggatacatcgtccgcagttctttcgttgacccggtaaaattttcgattaggcatttgtaaaaaacgaaacaaagaaattggtacaaaaccttacaaaaaaaaatagggaggttgatcccccccattcgtccgcaaaggcaaatatttgctaccaattgttgaattgaactttgacggtgtttttctttcagaaggccgcaaagaaaatggcgcactttaaatgggacgatcatcatgaactcaaagtggagaacgacgaagagcaaagcgggcactga

SEQ ID NO: 46207 - DNA, 1109 bp, Heterodera glycines
  Genomic contig location: Contig_ID=SeqID_30421; Location=177..1285; Strand=+
  SCN-specific regions: Sequence locations=1-1109
  Gene Ontology: Mol. function=sodium channel activity; Cellular component=membrane; Biological process=ultradian rhythm
tttgactcgggttttcgttactttgtccatgagaagttttccatgccgtatctgtccacggaaggcataagcgtttctccgggcatcaaagtgttctccgccatcagtccaactcatgtaaatcaaattcttaatattttcccattctttctttttacaaatttacctcagctaattattcccaatttttcagtacattttattaccccatgaaatgtggggcaattgttcggatcagtggcccgaggatttgcaggaaatcgtgaatgatggggcggctgatgaaaggcaaagcgaataactaattatactgtataattagggagcccattaaggtactcgtcgttgaaatgcaaaacgttgtgccgtgccaaatacttcaacgaattgtgcggctgcagcccgttcagttacaacatcgacgaatgtaacaacaagcatttaattgttgaattatttctccattttttcagttttctccgtttgcactccctacgaaatttacaaatgtttgggctccaccgttctgaatgacaccaaactgtcgcagaatggtacaaatgccaaaacaacgtcttaactttagcacatttcaaattcaaaaaaaagagtgccaaaatatttcagagcaaatccttccgaattgcccgcaatgtaaaatcgaatgccaaagatgggtttaccacacgtacaattcgtacaccgaagcatttgtccgcaaaccaaaggacaaatggaggcgaaaagctgaacaatggcaatgaatgtttaaaatgaaaaacaattgacagtttgaaggtcgaccatcgcttcgctgaacattttctaccgcgacatggcttataccgagtataagcaagtgcaaagcctttcgatgactgaaattctcagtatttattcagcatttgattatttagattaattaattaacatggcttttagccttttttcaaatttgcctctccaatttcaggtgacattggtggcaatatgggtctgtttttgggcatgtcattgatctctctgatcgaattcgtcacttacatttgcaaaatcagttggcttttcgtctccaaaaggcgaagggatcatatggcaagaaatgaaat

SEQ ID NO: 46208 - DNA, 2235 bp, Heterodera glycines
  Genomic contig location: Contig_ID=SeqID_6238; Location=1768..4002; Strand=-
  SCN-specific regions: Sequence locations=1-589,613-762,785-1340,1362 -1643,1665-1743,1765-1945,1967-2138,2160-2177,2205-2235
  Gene Ontology: Mol. function=protein binding; Cellular component =intracellular; Biological process=positive regulation of body size
atgactgcctcgagtcaagggcgaccgcttccggacggcaactttggcaaccatgcaggccctccccatccgcgcagacgaaaggcactgcccacttcggacgacgtgacggaacagccaacaactcatccgaccatgtcaccagcaccatttgttccaactcgacaaccagcgcagcctctgtcagtgaattgcatgcactccccattttgttgttgtgtttaagtctgatgaatcgcgtccctttctcctctttcagcactgatgatggcaccggcaacttcttcatgagcgcatatgccatgtcagcgcagaggatcgccagcgattcggagtggaagaaaacggtgggtttcgggggactgacttggccagaaaaaaaaaacttggcttaaattcattctttcattttttcagcccctcggacaaactggcctcttcaatatgggaaatacgtgcttcatgaacgccactcttcagccactgttccatacgcccggattttctcaactgttccaagaaaagagcgcgcagcgattcgtcaatgggtgcgtcaggaggggggagccgagcgccgtcttcgaattttcataaaattcattttttgtttcccttttcaggaacaactcgtttggcacgaatgggatgatctccggctcattctctgcgctcatcgacctgatctggtctggcaagttcaacgcacttcggcccaccaccttcctggtgagtgactgtgcctttgatcaatccattctaatcaaatttttgcctttttcccccaggaattcttcgctcgccgtgtcaacaccgaaatggccgaccgacagcagcacgacgcccaagaatttcaactctatctgctggacgcgcttcacgaggacaccaaccgggtgagttttgcgattttatgttccatttttcaccctcccccctccccattttcaggtcaacaagcgacaatcgtttgaacagaactacgacgacaccgatttgggcgccagcgcttcggatttcaatgagaggtcgaaactgttctcttcgtcgccggtcaacgatctgttcaacgtgagtttggagccatcattcattttgtttgtccgccgccaatttctaatcattttcccttttgttcagctgacaaacatctccatggtccaatgcagcacgtgcaatacgacgagtgttcgcttcgaggtcgtcaaccaactaaggtgagtttttcacagacccaaaagaaattccataatttgaatttccctttgaatttttcagcctcgaattgccgaccaacaccgacgacctgacgctcaaggactgcctggaggcgcacttttcatcagcagtgagcagcacctcagcctgaatttgtgtctgatcccatttcccctccctttttcagagtctcgaggataaatgggattgtccgaagtgcaaaagcaaacagccggcgacacggagcacaaaaatttgggagatcccgaaggtgctgatcgtccatttgaagagattttcgctgaatgatggacactacgtcaaaaataacgtaagtttccgtcggggttttttttgagcgtaattttcactgattttttaaacaattttcaggtcgaagtaacgtttgatgtggccgagttggacctggcgccctttctccacgagaagtctccgcatcacaacacagcactcagtctctacggcataacggtgagtgatcaaatttggttaaaattgtcactaatcacactaattatgtttcaccattcccccttcaggatcacagcggtcggctgaacagtggccattacacatcgtccgtgatcaatttgatcagcactgatcgggagtggctgagtttcgacgacgaagcatgcattccgtgcggcagcgctccttcgcccgttgtgagaatttcgttcccgaccattcaaatgaaaaaaataataatttcttttcccctttttagagcaagcacgcattccttctgtactacaagcggatgaactcgaaagccacgtgatacaagcggatgaactcgaaagccgagcgcgacaacaatgccaatgcgagtccttcggtgctgagcgacgaagagaataacggatgatattattgtgtgtctacaagcggatgaactcgaaatccaattgatattattgtgtgtgtatgctctgtataatatgtattgtatttgtattgcattgtatgttcatattagtcgtcttgtaaaataaa

SEQ ID NO: 46209 - DNA, 935 bp, Heterodera glycines
  Genomic contig location: Contig_ID=SeqID_30433; Location=81..1015; Strand=+
  SCN-specific regions: Sequence locations=1-120,144-935
  Gene Ontology: Mol. function=somatostatin receptor activity; Cellular component=integral to plasma membrane; Biological process=G-protein signaling, coupled to cyclic nucleotide second messenger
acccactcctccgtcctgcacatgcgacttgcactgactgtcacccatttgctgctcgtttcgcttggtcagtcagtcggcttttccctttgatccccccaatgtccaggaagtgttaatctccttgtcatctttgtcatcttaattcggccttacatgcggtccatcaccaatgtttacatggtatgaaaagaaaggcaacgaatgccaaatccctcacagatttcactttgtttggccgacttcatttacctgaccaatctgacgctggtcgccgtcactcagctcaacgacaagtcgtggcctttctcttcctttctctgcactttgtacgccaacattaacttcttttagttttccctcgtttaggtatcacgggactgaaacgacaggtaccaaccgactcggctaatgatggcacagaaattgctttaacttaacatatgccatcatttttagtactttacgccacttttgcagcttttccttaggcaaatacgccagcgtaatgttcgtcgttctgttggccgtcgaccgttactgcgccatgtgcaagtccaattggtgcgctcgctaccgcacgtaccgcggcgcggtgctcgtgtcgcttgccgcgtggctgttcgccgcgctggccgcttctccgttgtatttctttgccgaagtcgcgcttttgacgcttcgttcccccgtttcgcctgcgaatcgccgcgaattgcacaaattgtgcatcgcaaaatggcccaattctgatgtcgctcgatggtatgcccacttttctttcgttttacgagaatgggacggagtggcccctcgggagtactctcgacaagcctttgtttttcgttccctttaaggtacattaccatttcctctgtgctgatcttcgcccttccgttggctgtcatcttcttctgctactatcacattctgag

SEQ ID NO: 46210 - DNA, 749 bp, Heterodera glycines
  Genomic contig location: Contig_ID=SeqID_6240; Location=161..909; Strand=+
  SCN-specific regions: Sequence locations=1-129,151-232,255-463,486-749
atgagtcatgacaatgggaacaacgcttttcccgccgcctcgtccatttacccctcccttccgtcggccctttgcgatgaaaagccttcccccgccgccgttttgtcccattgcgatgatatggaaggcatcagtctcttggtaaaagctgcggattttgcagctcgtagacaccgtttccaaaagagaaaggacgagcggacgccttacataaatcacccaatcggagtcgcttttctgctgataaggtaaaacttttaccaggccaattcgaacaaagcgaagtctgccgcttttgcagcgttgccaaagtgtacgaccccgccacattggctgctgcttatctgcacgatttggtggaagacaccaaaacgacgtttgaggagttggaacaacttttcgggagagaagtggcggaaattgtcagagaatgcaccgacgacaaaaacttaccgaaagatgtgcagaggaaaaaacaagtggagaaagcggccggttcatcttacaaagtaaaaagaaagtccgaaaggagaaagaaacattgtgctgattaaggcgaagttggtgaaattggcggacaaattatacaatctgagagacttacaacggacgctgcccatcggatggagcaaatcgagggccagggaatacaccaaatgggcaaaggaagtggtgacccaactcaaaggcaccaacgaagcgttggaaatggcattggacgatgtgatcaaccaattactcgacaagaa

SEQ ID NO: 46211 - DNA, 630 bp, Heterodera glycines
  Genomic contig location: Contig_ID=SeqID_30449; Location=277..906; Strand=+
  SCN-specific regions: Sequence locations=1-20,48-114,136-630
  Gene Ontology: Biological process=embryogenesis and morphogenesis
atgggcatggctccgccttcgctactgcaacagcagcagcaacagacgccttttacacaacaaaagccgacacccatcgctcctttggcagtgcctccggcagcgaccgctccgcaacagcagcaggtggtggacaggccgactgaatgccttcctcccgccagaattggtctttacgtatcatttaggctgttagtccgcctccgcttagccaacaagcacagcaaagcaacagcgacaatttggacgaggagcagcaggcgcaaatgcttgtgagtgttcaaatgaaagatgtccttttatatagtagtgacaaattacccctcaaacaaaaaacgatcaaaaaactcagtaatttcggttatgtgtaaacggattttattaaaaaaagcaacaaaggccaaaggaattcacacaaataggggcacaacatttggcggttgcctcttttaaatttcgcgctgttttcacatataaccgaaaagtaccaaaaactcaatcgaatctcaaaaattcaagatccgcgtgctgcaactcaccgatgagcaaattcgtatgttaccacccactgaacgtgcccaagttatcgaattgcgtaaccaacttagaagtgcggatgcaaatgcgtga

SEQ ID NO: 46212 - DNA, 1362 bp, Heterodera glycines
  Genomic contig location: Contig_ID=SeqID_6242; Location=1..1362; Strand=-
  SCN-specific regions: Sequence locations=1-93,122-149,172-720,742 -1102,1124-1252,1275-1362
  Gene Ontology: Mol. function=protein kinase activity; Cellular component=DNA-directed RNA polymerase II, holoenzyme; Biological process=regulation of cell cycle
attgatacgaactttcgagaagagctttccagaattcgagaaaaagtagaagacatttacacatatgaaggaaacaaagtaattcttacttcctaattttaaatttaaaagaaatttcaggttggtcgcggaacttatggtcagaaaagaaaattttcaagctaatatatttttaaggccatgtgtacaaagcaattttacggaactctccatctggcatggatggcaaggcatatgcactgaaactaattgaaggtgatacgaattttcatttctaaatctaaatcaggcattgatttctggtcgtattcttacaattagaatgacgaatttaatttcttaatttgtttcctaaattccctgactatttaggtcagggcttttcgatgtctgcttgtcgagaagtggctcttctaagggaattgaagttgcgctccattccaacgattggtttcactttaacttttgttaagccatcccaacctcatcaaattgctgcgcgtctttctcaccactgaaaaaagagtttggctactctttgattacgctgaacatgatctttggcacattatcaaatatcatcgatctgcaaaacagaggcgacaacccgtgatggttattctgatatttcccattttcagcacccccagggacttatcaaatcctaccgggggcggtgccaccctcaggcggcgacctttttgacgttgtttttcaggtgcctaaagggatggtcaaaagtttgctctatcaaattctcgacggcattcattatttgcacaacaattggataatgcaccgcgaccttaaagtcctttgaattgaccaattagcaattacctttataggtttagcccgctaatattcttgtgatgggtgaggggacgggcattgaacgcggaagggttaaaattgcggacatggggtgagtggctttgtcctttgattgattttttcgctcggttttaggtttgccagagtttttcacaatccgttaaaggtaatgactgttgggctattccattattcattataataaaaccaagaaaagttacgaggaaatttgcaaataaattaatcatttgcgcatcgaatcctgaattaatatttttatgtcatttatcttttaatttctcctcttatttggccgttcagcctctgtccgagctcgaccccgtcgtcgtcaccttttggtatcgcgcgcccgagctattgctttgttctaaacactatacaacagtttaactgggtaattttttgctggtttaatttcattttccccaggcaattgatatttgggctattggttgtatttttgctgagttgctaacatccgagccaatttttgtgtgcactgaggtg

SEQ ID NO: 46213 - DNA, 898 bp, Heterodera glycines
  Genomic contig location: Contig_ID=SeqID_30453; Location=12..909; Strand=-
  SCN-specific regions: Sequence locations=1-207,241-470,499-846,890-898
  Gene Ontology: Mol. function=microtubule binding; Cellular component =spindle pole; Biological process=meiotic spindle assembly
atggatccttatgacctaatagagcctgtagacatctcatcaaagttgaacatcaatttcgaaagtcaaaagtggcaggaaagaaaagaggcattggacgcactgcaacaattgttgttgcaatcgccgcgacttgctgattcgccaaattatcgggaggtcatcgaacatctgacgaaggtcaaccatcaaaaaatgaatggattctaataatctaattatatttatttaaatatttaaggctatggcaaatgatgcaaatatcattgtcgccgcaagtgccaccaaatgcgtgatgtttttcgccaagggattgcgttccaaattcactccttacgtgtcgttggttgtcccggtgatcttcaccaagttcaaggagaagaaacagttgctcagagatgcgctcgtcgagtgcatcgatggcatcgcaacatataccgtaaaaatggataatccaatcgaaatgaatgtttaaaaaataatttgttttttatagagtttcgaccacctatgcaaggccgtgctcgaggctctgtcctccaaacagaatccgagtcagaaatcacagacggatttgttcatttaccgcgttttccgtacccttccggccaacgaaattcccaagggtttgctcaaggatttggtggcaattctgagcaaagtcacatttttcaaactttttagcctaattttcggccttttagcatggctttgatgccgattccgaagtgagggactcatcctttgctgcattgggtgccattatgaaatgcactggagaaaaggccttaggctgtttcatttcacctgaattggccaaagacacgaacaaaatgcccaaggtcgtttaaatgtttctttttcaaataattttgttatttgcagattgctgaaaacc

SEQ ID NO: 46214 - DNA, 981 bp, Heterodera glycines; identical to SEQ ID NO: 30473
  misc_feature (21)..(21): n is a, c, g, or t
  Genomic contig location: Contig_ID=SeqID_30473; Location=1..981; Strand=+
  SCN-specific regions: Sequence locations=1-111,133-264,287-459,487 -674,698-981
  Gene Ontology: Mol. function=GTP binding; Biological process =cytokinesis

SEQ ID NO: 46215 - DNA, 1350 bp, Heterodera glycines
  Genomic contig location: Contig_ID=SeqID_30477; Location=60..1409; Strand=+
  SCN-specific regions: Sequence locations=1-420,443-857,879-911,939 -1037,1059-1192,1214-1350
  Gene Ontology: Mol. function=signal transducer activity; Cellular component=actin cytoskeleton; Biological process=regulation of muscle contraction
atgcgtgcgtttcttgcttttgaaatgcgtcggaaaaacgtggacgagcagaaggcgcgcgaaaaagaattcgcagtgcttttggaagactgcaacaagtgacagtttttttgggggatccatttctgaactatttcatatgggcgagaatcacttaatagttatagtatttctaacagttggtaaccgatcagcctttttcagatggcttcagacgggtctttaccttgacaaaccgcacccgcggactggggcaacagcgcttcatgttgcagcttcaaaaggctataacaaacttattggttggttggcattgtcatagggactaaatggaatttaatgatatattctagagtagagcgggaccgggaccaaaacacggacaactgagtaccgaagtcccggttttgaccgggaccgggatcagtcccggttttcccagccaaaaattcccgggttttcaacccgaaaaggtccaggtcccggtttgcccaaaattcccccggttccgcttctctaatatattccattattatttttaggcatgctaatcagggcgggggcggacgtgaacgcgcaggacttcgaggggtggacgccgctgcatgcggcggctcattggggcgagcgggacgcatgccgaattctgatggagaatggtgccaacctggacgctttgacacatacagtgcgaaagtggcaaatattaaatggatggggaggggtgggaatagaagacagcactttccatgacccactacaatttattttcagggccatacagttttttcgctagcggacaaatctatttcggattatttggtaaacttgcaggaggttggttgcccctcggattgatgcagttttgcacaattttcgcagaatttcaaccaacttcgctccgaagcgctccaacaccaacaacagcagcaacagaatggtgccactcataatcagccttcaaatggaagtgcggtgctgcaggatatggcaaatttgacacttggaaaggacaaggaatcgtcagtggacagcgaaagagcaagcaaagtaagccgttggtggcggcacacacgtacaaggggtgtcttcgcatatttctacatgaaattgagttttttgtgtattgtcagtgtaacatccttccgatgagatcgactctttgttttccttgttacaatggctcattttccacttccgtttctttccttttcgcgtcaattttcatctttccctttagcgatcgtccagcgtctacagcagcagtgagcaggacccttcgtgtgatggacaagggggtaaatgccttgccaaccaggaaaagaaagggtttattaacgaaaaacgaat

SEQ ID NO: 46216 - DNA, 681 bp, Heterodera glycines
  misc_feature (7)..(7): n is a, c, g, or t
  Genomic contig location: Contig_ID=SeqID_6256; Location=194..874; Strand=-
  SCN-specific regions: Sequence locations=1-184,211-681
  Gene Ontology: Mol. function=ATP dependent DNA helicase activity; Cellular component=chromatin; Biological process=DNA recombination
atgtctngaattggtaatttcgaaataagaaatgtgtctaaagtcgaacgtatcggtgcacattcccatatcactggtctcggcttaaaggcaaatttcgaaccaatttttatttccgatggaatggtcggacaatgtgcggcacggaaggcagccggattgattgttcgcatgattaaagtcgaatttataatttaaattctattttcatcagcgattgcttaaggatggacaaattgcgggcagagctttgctaattgttggcgagccggggacgggcaaaacggcggtggccatgggaatttcgaagtcaattggcggcgatacgcccttcatttccatttcggccagtgaagtgttttccatggatctgagtaaacccgaagcattgactcagtcattccgaaaggcaattggagttcgaatcaaagaggagactgaggtgacaatggcatggacgctcagacacaacctcttttttgcctttgcaggtcctttgcggtgaggtcgtacaactcgaaattgaccgtccccagtcgggtgccgggccacgagttgggaaattgactctgaaaacaacggacatggaagcaatttacgacattggaaacaaaatgactgaatccgtcatcaaagagcgaatcacggccggcgacgtcatccaaattgacaaggcaaccg

SEQ ID NO: 46217 - DNA, 2521 bp, Heterodera glycines; identical to SEQ ID NO: 6256
  misc_feature (43)..(43): n is a, c, g, or t
  misc_feature (868)..(868): n is a, c, g, or t
  misc_feature (2340)..(2340): n is a, c, g, or t
  misc_feature (2385)..(2385): n is a, c, g, or t
  misc_feature (2444)..(2444): n is a, c, g, or t
  Genomic contig location: Contig_ID=SeqID_6256; Location=1..2521; Strand=+
  SCN-specific regions: Sequence locations=1-134,157-664,691-1369,1391 -2072,2095-2497,2519-2521
  Gene Ontology: Mol. function=protein serine/threonine kinase activity; Cellular component=nucleus; Biological process =spermatogenesis

SEQ ID NO: 46218 - DNA, 1511 bp, Heterodera glycines
  Genomic contig location: Contig_ID=SeqID_771; Location=516..2026; Strand=-
  SCN-specific regions: Sequence locations=1-15,37-127,149-328,350 -850,872-1191,1214-1511
  Gene Ontology: Mol. function=methyltransferase activity; Cellular component=small nuclear ribonucleoprotein complex; Biological process=ribosomal large subunit assembly and maintenance
atggtgccgggcgagtcggtgtacggcgagaagcgcatctcctcccagcagaccgaaaatgcgccgattgctgcaataacgccgaagacggaagagacaacgaatggcagcaacggtgtctcagcacccaccgccgcggctgccggcccggcaccgccagtcgagtaccgggtgtggaacccgttccgctccaaactggccgccgccgtcatggccggcattgaggacacgcacatttacccgggtcagtttccgtcaagcactcgcaattggttgataacccttttgttttcgatgaaaaacattgggtgcatgattcttgggatttcgtgtttgcattagtttggccgttttcaaatctcggaccctgactccaacaaaagtcgaaaatcaagagtttgccggaatttggtgcctaaaagcttttcatctgcgtaaatgctttggagcattagtttcgaacttccattctaattctttcgtttgtgattatgtttctaagttggctagaaaaggatgccaaatttataaatccacggggttcatgaaaaaccgtccggtacggattgaatcgggaccgatttttctactcaaatttattttcacatgcgcaatatttgcatgctttaggtgcccgtgtgctttatcttggcgccgcttccggcacttccgtttcccatgtgtccgacatcgttggacccgtatgccaaataattttttttgtcttggatttgtaaatagataccttctttctttaggaaggcatggtctatgcagttgagttttcacatcgcagtggacgtgacctgctcggcatggccaagaagcggcccaacgtggtgccaattgtggacgacgcacggcacccgcacaaatactccatgatggtcagtcaacttacaattagctatttgcatcatacctaatttcctcacaaatagggtcattcgcttaaactttcggctcttgcgagttttctaaattgaattttaatccaaatttgaaaaccatcttttttggtttacgtgtcaatttcgtcttcccaaaattgaatacaagtttttttcctaaaatcactgcgcgcacagattggcattgtggacacaattttctcggacgtggcacagccggaccaggcacggattgtggcacacaatgcgcacaaatttctgaagaacaacggccatgtggtcatctccatcaaggcgaactgtgtggacagcacggcggagccggaggcggtgtttgccggcgaagtgaacaaattgcgcgaggagcagttcaaacccattgagcaggtggattggatgttgcattggaatggattgcgttcttgtaaaattgtccaaccattaggacgcacaaaaaagcaaatcgtcacatcttggcaatggaaatccccctccacttttttaggtaacactcgagccgtacgaacgtgaccacgcggtggtggtggccgagtaccgagccgccaaaaagaaggtcaagaaggaaaaaatggaggagga

SEQ ID NO: 46219 - DNA, 2082 bp, Heterodera glycines
  Genomic contig location: Contig_ID=SeqID_772; Location=1..2082; Strand=-
  SCN-specific regions: Sequence locations=1-106,149-336,358-544,566 -623,662-1038,1060-1060,1089-1411,1433-2082
  Gene Ontology: Mol. function=protein binding; Cellular component =ubiquitin ligase complex; Biological process=apoptosis
ctccgtgccaactcttctgccagttacataatccaattcaaaacttacaccacaattgcgcagtttgaattggtgaacgaacggactaaagaaaagctgacattgaaggcagaagatgatgatgatgtatatacacatattaattttgtgttggagcgatgccaaattgtggcggcaggacaaaaagacggacaatttgaacaatgtcgacattacaataatgtgcgtcatgtttttgctaaaacattagtgtctgttctgtgattttagtgtgacacaataatgtgcgtcatgtttttgatgactatatgataaaggtgggtgaatcggtgacgtctcatttatgaaaccaaatttgattatgtttctctctgctttctaggttgaagagaggcttggcgaagagcgggaccggtgccaaatttatttggacaacacgacaatggactcgctgatggaggcatgtgacacggcgttgatcaagcagcacctcgagctcttccacgacaaatttgaggtagcgaaatttttttgccaattttacatgattgtacatttatttctcagtcattgctcactcgccaacagaatgaccatcttggacggatggtgagacttgcagaaaccactttttctcaattttttgcataaaattctttttcagtacacactttgttcgcgtgtgccaaacgggttggccaagctcaaagagatcctggaggagtacatcgaacgggagggcaaggcgtccattcagcaaattgcgcgtgaggcgttcaacgatccgaagcaatacatcagctgtatcctcaaaatgtaagtttatgcgggttttaggaaataatgaaccgttttaaaggcacgaactctacaatcgcttggtggtggattccttcaaaactgaccatggctttgtgcaagcaatggactgcgccttccgcaagttcatcaacaacaacgaaattacggcgatggctcggaatgcgtccaaatcaccgcagctgttggtcctctactgtgatcagcttttgcgcaaaagtgcacgcaacatggaggacgagaagatggatgagaacctggagcaagtggtgggtttgtttggactttaaagtttgaaatgttccatcaatttcttttttttaaaatactaatatcccattgtcagatgaccgtcttcaaatacatcgacgacaaggacatgttccaagcgtttttccacaagtttttgtgcaagcgcctcgtctacgacacgtcagccagcgaggagcaggagcgatgcatgatcgcaaagctgaagcacatgtgcgggttcgagtacacctccaagttggagcgattgctgactgatgtcgcgctgagcagggaccactccgagcaattcaagcaggtcgctaacgaaattttaattttattgaggcagttttatcccattttagcagccgaggacatccaacgttgacttctccgtcattgtcgtcatgtcgaacgtgtggccactgcagcagccggtcaaattcgaaatcccgcgtcctctcctcgactgcattgactgtacgtttggggaaggcgggtggtggagagaactcccaaagggaagaacccattactttttagcctacactcagtactacaccaaccgtttcaatggccgtaagctgacctgggcgttgcaaatgtgccgcggtgaattggtctcgacgagcaacactttcccgtcgaaatactcatttttggtaagcaatttcgacattaaaaataaggatttcgtgataaaatcaaattcaattcaccgaaaaatcatataagttattcaaaaattgtttttttttgcagtgcaacacgcaacaaattgccgtcctcatgcagtacaacgaacgcaacacgtacacacttggcgaactgcacgtcgctcttggcaccgactttcccggcgatcagctgtgcgctgttgttcaatccttggtcaagacgaatctcctgaagctcaccagcgccgatgggaaagctttgaccgagacgaaactcaatgacaacgagcagaaattcaacggaacccaggattccacaggtgaattcgaaaat

SEQ ID NO: 46220 - DNA, 1256 bp, Heterodera glycines
  Genomic contig location: Contig_ID=SeqID_773; Location=31..1286; Strand=-
  SCN-specific regions: Sequence locations=1-242,264-1256
  Gene Ontology: Mol. function=protein binding; Cellular component=SCF ubiquitin ligase complex; Biological process=apoptosis
atgaataatcatccggtcagattcgagacaatttggaaggatcttttgcccggccttgagtccatcttcaagacgcaggagagaatggcaccgcagcgctatatggagtattacacgttagttttaacaggtttaactgttatgaaagacttaagagggtcgcgataaaaaatgattgcagataccgaaacatggaaccaccataaaccgggtagtgaaatttgggcagcagcattcaccgcttttaaaaatttggggttgaccattcttttcgaagagaaaagcattcctaacttcttccatgtgccaacattaggattttttgtttttagtctcgtcttcaattactgcaccaaccagcagaacgacttcacgcacgaaacaacgaacaatcgggcgcgtcggggcaaccgcacgacggcgggaacggctggtgcagagtttgtcggcgaggagctctacactcgactgcgccacttcgtcgaagagtacacaaggaagttgcttcaggttttgttgttttgcacaaattggggaggtgggaaataaaattgtacaggataccgaattcaaatttgtttttgttcaggaatgccagcgtctgtccggtgaccagctgctggactactacaccgagcagtggaccaaattccagttctcctccactgtggtgaatggcattttttcctacttgaaccgacattggatcagacggaacatcgacgaggcggtgcgtcccggaattttggaagtgtacaatgtgagtggtttgacggtcatacatgaattggggatgggtttcatttttaaattctcgaatttcagttggctgtctccatctggaagtcggtgatctttgacgaactgcaccacaacatcacgtccgctgcgctggcgctggtggagaaggaccgcaacggggaacgcatcaccacgcgactgatcagcggcgtggtcgcctcatacagttaagcttttgcttacaaatttggaccccgaggcggggctggggagtcagggaatgggtctttcgttcggcgaccagattctgccgccactctttcgttcgaacacccgctaatttgcattccttgtttccagtcgaacttggcatcaacgagcacgacccagcggcggacgtcggaggaccagcaacagctgcggtcgcccaacaacagcagcagaattcggtggtgcatcgtccgagtgtcaaataccaagtggaccgcaactactttgagcagcgctttcttgag

SEQ ID NO: 46221 - DNA, 1341 bp, Heterodera glycines
  Genomic contig location: Contig_ID=SeqID_776; Location=30..1370; Strand=-
  SCN-specific regions: Sequence locations=1-132,154-193,248-313,342 -342,368-492,515-550,572-678,702-795,818-1098,1120-1258,1280 -1310,1332-1341
  Gene Ontology: Mol. function=structural constituent of cuticle; Cellular component=extracellular; Biological process=cuticle biosynthesis (sensu Nematoda)
accaccagcattaattatttttgggcatttcaaattcattagttccagtgaaataaaccctcgcccctcaaaaaataattatttacatttggacacaccaaattcataaataatttagtgcaaaatgcaagagactcacattgttctcgggattgcctcggtgtgctcgctgttggctatcatcgccacagttgtcactctgccatctctgtactcggagatgagccaaatgaacagcaaagtgcgcaacggagttgaggtactcagccggccgcactcaaacaatgaatgcaccaaaatttgccaattttccaggccttccgcgtcaacaccgactcggcatggactgacttgatggacgtgcaagtggtggtgacgccgccgtcgaagccccgtgcgaaccccttcaactccatcttccgtgccaagcgtcaactgcccggacactgccagtgcgctggcctccaacaaccaagctgtccccctggtccgcccggcccggctggaccgcctggacagcccggacagcctggaagcgcaggacagcccggacaggctggacagcctggccaacccggttggcattttttggctgacctcccccctgctaataatcatgcctcccattgcagctgctccttgccctccccagaacatcccctgcccacgctgccctgctggcccgcccggccgccccggaggacagggaccgcccggacagcaaggagcccctggacagcctggtacgcccgctcaaggtggaggacctggaacgcctggcgcgcccggaccccaaggacagcctgggcagcccggacgccccggagcctctggccaacccggacagcctggagcgaacggagttgtctcgtaagtacactttaaccattggttgtaaaattaaacccgattcaatttcgttcaggcgccctattcctggcccgaagggaccgcccggagcgcctggccagaatggaaaccccggaggccaaggtcagccaggacagcccggaggccaaggaccgcccggcccacctggcgcgcctggtcagcccggccagcctggaaacggtggacagcctggacagcccggagcaccgggacagcccggcaaggacagcggctactgtccgtgcccgccccgctcttccgtgctggcggtcaaaaagaagatggcggcagccaagaaagcataagcagcgacaagcgcagggagaagagaacaaccgaaagacaaaggaccgacgatgcgaaagcgaagctgaagatgatcattattgggtggaaattgttgttgtcggaatttgtgttcaccagcagcgcattttccacacgaataaa

SEQ ID NO: 46222 - DNA, 1268 bp, Heterodera glycines
  misc_feature (1266)..(1266): n is a, c, g, or t
  Genomic contig location: Contig_ID=SeqID_6263; Location=1748..3015; Strand=+
  SCN-specific regions: Sequence locations=1-346,368-647,669-998,1020 -1268
  Gene Ontology: Mol. function=ubiquitin-specific protease activity; Cellular component=intracellular; Biological process=positive regulation of body size
aatgacgtcacggaaaaagaagctgaatttgacggaacaaagagagtcgggcaaggctttgaacggtaattaatgccctgctaataacgagtcatctttaattttaaatcataacaaaagttctttttggccgaaataatttttaaactacagaatttaacacaattatactgagaatacaattcttatattctttacaacaactttttttttgtaattcattttgcaaaggtcgaacgagacggaagagccgacgatgccaccgccatttgtcccatgccgacaagcagcagcccatatgtctgattggcaccattttttgtgtttaacaatgcgtcatttgttcaactcttttaggactgacaatggcaccggcaattacttcctcagtgcgtacgaaaagactgcgcagagaattggcaacgattcgaagtggaagaaaagggtacatttttgggggcatcttgttgagaaaatttcttaggcttcaatttcatattttagccacttggtcagaccggtctcatcaacttgggcaacacgtgctttatcaatgccattcttcagccgcttttccatacgcctggcttttctcaactgtttcggcaaaagagtgctcagcgattcgttaatgggtaagtcgagacaattaattaaaaattataatagaatcatttgggtttttcagaaactatggaacgaagggagtcattgccggatcattctccgctctgattgatcagattttgtctggcaatttcaatgcaattcgaccccaagttttcttggtgatttctctgttttgctattttattgtattaccaattttcttgaaggaattctttgctaatgtgaatgccgaattggccaacggacagcagcacgacgcccatgaattcctaatttatttgctgaacgcgcttcatgaagacaccaacagagtggggctttttagagaaaaagcgattttgtgccatttttttacccaactttcagttagaaaagcaacagccatttgatcaaaattacgataacaccgatttgagggccaacgctttcgatttctttgagaagtcaaaactgttcttttcttcgccggtcaacgatctgttcaatgtgaaccgatcactcactgatcactccgtaatgaccgtaattttacctctttcagctcactaccatttctgagaccaaatgcatcacttgcaatgcgtcgagtgttcgttttgagtccgtcaatcaattaaggtgggttttattcgcaanaa

SEQ ID NO: 46223 - DNA, 725 bp, Heterodera glycines
  Genomic contig location: Contig_ID=SeqID_30530; Location=374..1098; Strand=-
  SCN-specific regions: Sequence locations=1-223,254-303,325-725
  Gene Ontology: Biological process=regulation of protein activity, epigenetic
atgaagacgttcatcaccgccctcatggacaagcagcatctgaagcgacgcatccaagtgttggccaagtcgggcaatgtcatggtggacagtgacgcgctttgggtggtcaaatatttggcctccaagaaggaactttcgtacgctttttttatattttttcaaaggtttttttacaagatttaaaaaaaaatagatgctttttcctctattgtcatttgggaaaataaattaaacaaattatcaaaatttttcaatttttggtaatgtttctaaaaaaattattgaggcttctaatttcgtaaaataacaatttaaacatttctatgctttaggcagtcattcgacctgtacctgaagaagatcctcgagggcttcaaccccgacctgtacccggtcgccattcgagcaaaagcgatgaaatgcttggcccaaattgtggaagcagactaccaagtacagcaataatacataatccatgaccaaactcaactaattaccgtataattagataattgctccatttctccttcaattcccaggtgctaatgatcgcggaggtcaacaaaattgtgcaagatcggctgatcgatgcgaacgcgtccgtgcgagaagcaacgttcgatctgatcggcaagtgtttggtcacccggcccgacttgttggacacgtactactccattttggtcaatcggacaaaggtcggtggcatttgcatcccatga

SEQ ID NO: 46224 - DNA, 447 bp, Heterodera glycines
  Genomic contig location: Contig_ID=SeqID_30543; Location=248..694; Strand=-
  SCN-specific regions: Sequence locations=1-3,25-53,91-447
atgaaaattaaattaatttttaatgacaatgagtggtaaaatgtaaaatatcctaaaattttaattcaaaattaaaaaataataataattccgctcagctttgtgggtgtccgagtcacagcggaagtgttgttggcaatcaatcgatgtgttcaaatcatttccaatcggttggccaattttctgttccaaacatggcgcacttatgtgtggctgttgctcgcctcggtgtacggcttgtacatgctgattttcacgaagccaattctgttcaccggcttgtatgtcagttggttcaacaacccccacgtgggatatgtcgacgaagcggacgaaatgacagtaagctgttttttttgggttgaagctgggatggccagccaatgtttaattggttgtgattacattttgtacagtaaacctctaaaatactgtaagacacagtaa

SEQ ID NO: 46225 - DNA, 450 bp, Heterodera glycines
  Genomic contig location: Contig_ID=SeqID_30587; Location=560..1009; Strand=-
  SCN-specific regions: Sequence locations=1-450
atgggattggtcgctaatactgactatgctggaacaattttgcgcagtccattcaactttcaaccatttaatgtgcgcgaaatttctattagtgtaaatgggcgaccgtacccccaagcgccctatgatttggattacagaaatggaaaatatgttcgcccattcaatgacatgaatgaagcggtcgggttcgccaactcaacagagagcaacgggattacttttgctcaatacggaaaaactcattgcatttatgtgttcaatttgaccaacagcggggatgatcaagcggcactgtttgatttgataaagaatgggaccacagcggttagcatcaaattcaatcaaccagtacccgtcggaggaataatgctagtggtgatgggagaatgcgattcccttgtaatgttggacaaaaaccgatcaataagcacagataccactatttaa

SEQ ID NO: 46226 - DNA, 1203 bp, Heterodera glycines
  Genomic contig location: Contig_ID=SeqID_30591; Location=311..1513; Strand=+
  SCN-specific regions: Sequence locations=1-158,180-789,811-1167,1193 -1203
  Gene Ontology: Mol. function=soluble NSF attachment protein activity; Biological process=reproduction
atgtacaaaggggaggagcagcgcagttcggcggccaaatgtctgctcaaagtggcgcactacgcggccgagttggaccagtaccagaaggcgcagctcacttttgaggaggtggccatctacgaggcggacaatccgatgctgaaatacgctgccaaaacccactttttccaggtgcagttttttaataatatttttctcggcagtccaccatcaagaaaaattttgttgtttgtaaacgggtctggaaaaggaccggattttgacatttttgggccaaacttggtaatccaatccagggttgtcgaaagcgaatgcagattaatttttgttcaatttaacgaaattaacatgttacatcaattaaacaatttttatgccaaaaagttgtactagtgctaccagcagtgaaatttggaatttatattatgtttttataaacaatttttttagaccaattgattctgtcgtttgggtcctattcgggagaaatagggacggaattaattgttgttgtccaattcaggcccttctctgctccttgtgcatcgatttgctggacagtcagcgggcactgaaacgatacgaaggttggttggtcatttgatgaatgaatggtggggttcacatcaaaatcttgccaccggaatctcgccgcagaaattaaaaaaaaattttgaacatagaaacaaagtttgaaaatttttaagcattcctgcgccgagattttgtcccgcccccgtcaagtggtggttggacagggaaactcccgagggatgacggcgcgacaacatttataatttcattttcgctcataccacaaaatataaactttgaatttgtatgattttttcagaattgagcaattatttcgctgacgcgcgcgagtgccaactggggaagcagataattgaagcgatggaggtgagtgaattttatattggcacaatattcggaattttcattgtttgaagaacggggacccggacggattcaccgaggctgttcaacagttcgacaaaatcagccgtttggaccaatggcacgtcgcaatgttggtgaaggtaaggtgcaatgatcactatcgattgatcagtcagtgatcaattgattggttttttaattttccaggtaaagcgacgctgtggcgacggcggagacgtgaagaatgaggcgggggaggaggaggacgatttgcgataa

SEQ ID NO: 46227 - DNA, 897 bp, Heterodera glycines
  Genomic contig location: Contig_ID=SeqID_30605; Location=804..1700; Strand=+
  SCN-specific regions: Sequence locations=1-87,111-330,354-360,384 -455,488-840,864-897
  Gene Ontology: Mol. function=structural constituent of ribosome; Cellular component=cytosolic ribosome (sensu Eukarya); Biological process=protein biosynthesis
atgggacgtcgtcccgctcgttgctatcgctacattaagaacaagccttatcccaagtctcgcttttgtcgcggtgtccctgacccgaagattcgcatttttgacttgggtaggaaacgcgcaactgttgacgagtttccatgctgtgtgcacatgatatcgaatgaaagggaacatttgtcgtctgaggttaatgttaacatttgctgtaattttaagaaacgaatgattttctattttgcctcaaaaaggtgctacaaactaatctatcaaatcctatatacaatttgattttgacaatttgatgtttaggctctcgaagctgctcgaatttgtgcgaacaaatacatggtgaagaattgcgggaaggacggcttccacatgcgcgtccgaatccacccgtaaacatctatcggttgcattccaatatcattttgctttccaggttccatgtgattcgcatcaacaaaatgttgtcctgcgctggtgctgaccgtcttcagacgggaatgcgcggcgcctttgggaaaccccaagggttggtggcgcgtgtcggcatcggtgatatgctgatgtcggttcgtgtccgtgaccaggtaaatctcttcccttggctttcagctttattttctttttagcatcaagcccacgctcttgaagcattccgtcgagcaaagttcaaattccccggccgtcaatacatcgtcatttcgcgcaaatggggcttcaccccttttgaccgcgaagtttacgagaagcaccgcaaggaagggcgagtcattccggacggagtcaactgccgattcctcaagcaacacggaccattgacggaatggctcaaaaatccaatctgatcaattgtacgacggatatattcccttttatatgctttgttga

SEQ ID NO: 46228 - DNA, 854 bp, Heterodera glycines
  Genomic contig location: Contig_ID=SeqID_30730; Location=246..1099; Strand=+
  SCN-specific regions: Sequence locations=1-103,127-255,277-362,420 -495,518-562,584-854
gaattgttggagcaacgggaaaagttggaacgggccgaacagaatttggacaccattcaccacaccactcagcacacacagcgcagtgagagtttttttaggccaaattttaaatttattttgtatattcaccatcattgacaatttatttgcccaggcctgaacagcttgaaatcgtggtttggtgggctggtcagaaacaaactttcacgagcgccaaaagggttgggcacggcaaatgccaatgccaacaatcagcagcaacaacaggaacagaccgtgcagcagcaacatcagcaggtgatcaaaaatggatagaaaagagtcacatatttcggggtgtgggaggcctaacaaatccgattaaaatatatacattttttaaaaatttcaagaaaattaaaaaaaaaaatttttttggcgacgtttcgtcccgaggcgtttcggtggtgaccttttgccctgctccctttgtccaggcatagaatttcttagaattttttgaatcaaacaaaggtttaaaaaaggacccgctgcggctaattgcgttataaaatgtttggagactgccggaaaatttaaatttgtcaaggaaattggaaagttttgcatttcggggctggggagagtgtattctgtgacaattaagtaattagcgttatttgacttctgaattaagcgtccgctgcatgcccatttggtgcagtcgtctgctgacgaatttgccggggccatcggtggcggaggcggcggtgttcagcccccgcaacagcactcgctgaactcctcgtcacgcgcgtacattcagggcactcgttgggaggcgatggacgacgaaattgacaacaatttgg

SEQ ID NO: 46229 - DNA, 776 bp, Heterodera glycines
  misc_feature (40)..(40): n is a, c, g, or t
  Genomic contig location: Contig_ID=SeqID_6324; Location=139..914; Strand=-
  SCN-specific regions: Sequence locations=1-247,280-354,384-586,609-776
  Gene Ontology: Mol. function=stearoyl-CoA desaturase activity; Cellular component=mitochondrion; Biological process=lipid metabolism
tgaaaaccttcacaatcaatcgcccattgttccgatgttntaggcattttcctatggttcgccgggggcgttggcattacggcgggggcccaccgcctttggtcgcacaaggcgagcgaaagcgaacatttccattgactgctcccttctcatttctcagtcttacaaggctcgtttcccgcttcgtgttctgttggtcgttctgaactgtgtcgccttccaaaacgatgtgatcgaatggtcgcgcgaccaccgatgccaccacaaatggacggacaccgacgctgacccgtgggaccaattaactaattgattggttgactaattgatcagtcaatgccattcagtcacaatatcaaccggggcttcttcttctcccacatgggctggctgttggtcaaaaaggtgggtcgagcagcgaatgaatggcaaacatttgctaattgcagcacccgcaagtcaaagccaaagggtccacgttggatttgtccgatttgacttccgaccctttgttggcattccaacgaaagtcggccaaatgaatcggcaaaataattgtcaattttcagattttacctccctttggtccttctcttctgttttctgttgcccacggtattcccccctcacttttcttttttccatgcttttcgttaagctaatccccgttttgttgtggaatgaatcgtcaagcgtcgccttttacaccgccgcagtgtttcgctacactttcacacttcacgcgacttggctgatcaacagtgtggcacacatgt

SEQ ID NO: 46230 - DNA, 1520 bp, Heterodera glycines
  Genomic contig location: Contig_ID=SeqID_30767; Location=97..1616; Strand=-
  SCN-specific regions: Sequence locations=1-529,551-617,641-680,703 -793,815-908,930-1520
  Gene Ontology: Mol. function=pre-mRNA splicing factor activity; Cellular component=nucleus; Biological process=mRNA splicing
atgccattttttcttcagtgagtctcaacagtttgccacccatttgaaagagtcggaggccgtctcaacgtttgccatggaaaaaaccattcgccagcagcgcgagtatttgcccgtcttcgctgtgcgtcagaaactgttgcaaattgtgcgcgagaattcggtggtcgttgtggtcggcgagacgggcagtggaaagacgacgcaattgacgcaatatttggtggaggacggcttgggacggccgggtgccatcgtcggctgcactcagccgagacgagtggcggcgatgagtgtggccaagcgcgtgtcggaagagatgggcatcgaacttggccaggttggcacgggggacgggtgggccaagggtatggcattggcaagaccaccaaccaattacgggttgtttggttgaatccaaatcgtagtgccaaaattggacagaaaagcgaagccatagaaagtgtgtgtttcgtcgctgacgacattttgttggaatgctgattatattgttgtttcagacggataaaaaatctaacaaaaacacactccttggtcattctctagaaaatgtggcagatgattgttgcctttatatgttcggttttcaggagtgcggttatgccattcggtttgaggactgcacatccgagaaaacgataattaaagtaacttcgatttcccatttttgcatttcactttaatttttttcagtatatgacggatggtattctgctgagagaatgtttgaggtgccatcccaaacgcattctttttttagattttataattcattttcagtgaccccgacttggactcctacgccgccatcattatggacgaggcgcacgagcgttcactgaacaccgacgttctgtttggactgctgagagatgtggtggcaagacggtaaaagaaatgaaattaaaattgcatagataaacaggctcataaccagaaaaaaattcggtggggggaggcaaccgaagagcttccagcgccgtagaaaaaaaacctagatgctgccgaggaaacgaaaatttggtcatcttttaagaaattcagttaatttaaaattcccatttttcggatagtttttcatttcgggcgtttggcaattccccacacaccccctggttacggatctgcggcggaattaagtagggacatctaattttcaacattatttgagtgctttccactttcgctgttcatttttttcggttaatcattccctgtcgttttcctttccaaattttctcttacgtttcctttttagttccgacttgaaactgattgtcacttctgcgacaatggatgcggataaattcgccaatttcttcggcggacatacgccaattttccaaattcctggccgaacatttcccgtcgagatttaccacgcccgtgttcccgtggaagaccacgtcgacgcggcggtcaaacaggcggtcaaaattcacttgggcggcatggagggcgacattttgattttcatgccgggccaagaggacatcgaa

SEQ ID NO: 46231 - DNA, 1398 bp, Heterodera glycines; identical to SEQ ID NO: 30776
  Genomic contig location: Contig_ID=SeqID_30776; Location=1..1398; Strand=+
  SCN-specific regions: Sequence locations=1-116,143-429,454-516,539 -1398
  Gene Ontology: Mol. function=structural molecule activity; Cellular component=synaptic junction; Biological process=cell adhesion

SEQ ID NO: 46232 - DNA, 1334 bp, Heterodera glycines
  Genomic contig location: Contig_ID=SeqID_8; Location=8236..9569; Strand=+
  SCN-specific regions: Sequence locations=1-88,110-410,432-579,601 -1225,1249-1334
atgacttgccctcaaaagattagtgaaaacagtcctttggcaataaacagtggtttaaacattttctcaatacctccaacaaatgtggcggtcgttcgttcattctttcgtcaagttcttcccttggcgacaatcactcaggaatcaccatatctctttaggttatacagtgataatttgtggactgatttgtcacgaatctatctctatcttgaattgtccattgaaaaaccgggagctattgacaaatggatagctatagaggacactgatgtcagcgtgtcagcaattcaaggaattgggcaaacgtttgttcagcaattaaaagtgaccgttggaaacactgaagtttacgatagcggaaatttatatccatacaaagcctacattaccaatgaattgagctttccagtaaatgcaaaaaagaactttctcggctcaacgggatattatcacacggaacgtcacgatgatccaacggatgatggatttaaagaacgttgtaaagtttttaaaggtggtaataatgcacagttcctctctcgccttgactttgacttgggaaaccaagaactctacctgttaaataatttggatttgttgttcacaatttacaaagcgaaagacgcatttcttttgcaaacacttaaagctaatgacgacacaaagtaccgtttgaccgtgcacgatgttaaaatttacgctaaaatgattgaggttcagccctcactcaacatgaatctttacaagacactagaaaagcagcctgctacttatgctgttcgtaaaaccgaaatcaaatcttcatacattagcagtgggcgctacgaatttgaatacaacgtgttcagctcgacaatacctcgtcgtgtaacaatagcgttggtcagtaactcggcttttaatggtgattacaaattgacgcccttcaagttcgatccatttgatttgcgagaaatttcagtacatgctgggggcatggtctatcccgttgtaccacataaattaaatttttcaaagaattactatgtaagagcattcgtggagatgtatgaagcgttgggcatggctaattcagaacgttcatttgacgtttcaatgaatcaattcaaaaatggatgggccttttttgtcatctctttgaattcaaccttagacgatagctgtggatttgagctgttgagaagcggtacaaccagtattagggccacatttgattcaccaattccaaagggaggagtggaaatgattgttctcggagaatttgaccaaatgattatgattgattataatcgacacattgtctccgactcgaagcttgggtaaatttataa

SEQ ID NO: 46233 - DNA, 5319 bp, Heterodera glycines
  Genomic contig location: Contig_ID=SeqID_69; Location=14915..20233; Strand=+
  SCN-specific regions: Sequence locations=1-100,122-153,175-218,243 -248,270-761,784-1627,1649-1766,1813-2578,2600-3451,3473-3477,3499 -3810,3832-3978,4000-4052,4074-4739,4761-4786,4808-5093,5117-5319
atgcaacatacaagacgttatttactagttcctgaggaaatttacgagagcctaatatcgtccccacaggatggatcaccaattggattggttcgctcaagaattaagcaaataaaaaatgataatgaaataaatgaggagcagagggcctttaaatatgaacaggaatttaaacggttcaataagctgaaaaatgacgaggaggaacgcccagttgatgttaaaatacaaaatttgcaggaagtggcagaaacttttccaaaaccttttaatctaataagaaaatctgctataccacgacgacataacctaaaacttggtaaaagaagaaaggattatgttgacgacgacgaagaagtctttgacgatgtcaagataccgaataaagatgatattttgaatttcatttacaaaaactctcaagccctgggaatctctgaacaagggcaaatacttaaggcagacggacgcccgtttataacaagtaacgttgaagatattgttgatcatttgacaaaaaaggatagaagtgccaataagaaagatcctacggcactcaaagaatttgtagcgagagcaaaacaaaacgcagtgttgagtaggcgtctcttttctgatggtcaaactggtaagggaatttataaaaagacaatgttaaaattcaaaccatcgttatggagatgaaaaaacaatgtttgttagagtttttatacaaagacctaaattcacccgtttcattcacaagcgttgaacccttgcttagagaagctaaaaaatatgaaacaaaaattagtcgttcagacattctaaaatttttattaacccagcgcacttatacacttcatagacaagctaagcgccgttttcggcgtttgccaactctcgccccaggtttacatattgaatggcaagcagatttggcaatttttgaccgtctttcaaagtataatcgtggactcaagtacttgttagtttgcattgactccttaagtagacaaatatttgttgagccaattaagtcaaagacaagtaaaaatatgattaaggcatttgaccagatattcaaaagaactaaatatattccatggaaaattttgactgatcaaggaaaagaattcacagcacgacctatacaggaatattatcgttcaaaagacgtagaacatttttgtatgctcacttctcctcaatttcatgctggcatggctgaacgtgccaacagaagtataaaagaacgattgtatcgttacttcactgagcgaaatacttacaaatggattgacgtaattcaagatatcgtaaagggtataaatcattccatgaactcaaccattggaatgagacctgtagacgtaacctttgcaaatgctgaagaattgagaaaaaaactatacaatgaagcagctaaaaaccctagaggaaatcccaaatttcatgttggagatcgggtccgaattgaaaaacacaaacacgtgttccaaaaaggttatttgccccggttcaccaatgaaatatttactattgcggaagtacattctgagagatcacctattgtttacaaaataagcgacgataataatgaaattattaagggatggttttatgcaaatgatttatgtagaatttttgaaaatgataataaattgtatgacattgaaagaattttgtcaaaaaagaaaagaaaaggtgttgaacatgcgttggtaaaatggaaggggtatagtccccaatttaatagctgggttccattaagttcaattactgtgaaaaatatataaaaactcttaaaaaactttttttttttaataaaatgccttctaattcgttttatattgtactcccatcaaatacaaatgttgaagggaacagaaccaattcttttcggacacgtataccacgaaaactacaattcaacacggaatgggaagtaggcctcgctgtaattgtttatccccattcttggccttcaatcggtactgcacaacaacaatttgttgaaattgagtggcagacaggaaaagcgttacgcattgaagttccaccatcaaatgtcacaaacccctacgaactaagcaagaatttgtacaaattattgggcgagggaagtgatcacttggcaaaacaactgagaactacgcaaaatgctttcctacttgtgataaataaggctaggcggtgggcaagagaagaatatattaaaagaaaggtgaaggagaatagaagtattcatgatgaagaaaaacttctacacgcgctgcttattgacagtgaatcatttatcgagttgaaagacgtggatcggggtcttattgctgaagagaaacatgctgaaacaagtaaagtaccgctgagaatttcgaccgatgataaagattcttatcagaagaaattgaacgaatacttttcaggtttaagtgaacgagatttgaaccttattgatgattttatcaaagcaaaagtgaaatcagagattaaaaaaatgacagaagacgaacgtatgatccttgaggcctcaaaggaagtgggaatgggagcatggcttcaagcttatcgtagaatatggcttgcctgtcaattcacctatgacaataatagaaatcgttttgatttaaattttgatacgcgttacgtaaagaaagtaaaaatcacagcgcaacttgcctatattctggggtttgacaacacagaatttttggaaccagaaaacgaggcaagattcatgccggacatgaacggaggagtttcttcatttaacgtatacgcacctaatctcattgaaccaatgatgattggagacgtaaccgctcctgttttacgaattgtaacaattcgaggaaaacccgatgaggtaattgaggaacaatttttagcgatacaataccataaaattttgctaaaagaaatttcggagatttttattgaaattcgtactaatagcggaagtctcatgccgttccaatatggaacatgtacattaactttgcattttcgaaaaaagtcctatttttaaatgaataccttagaaattaataaaattctatcaacaaattcattgaccaaaaatcatttccttggctgttttgcagctgatcaaatacccagtggggcaataataaaatttccacactgcatggtattcaatattgatccaataacctcaaaggggtcccactgggtgtgtgtttactgcacttcaccgttacacattgaatattatgattctttgggaatttggccaccaccaagtttttacatagcaaattatttaactcgctatgaacaaatacgttatagcacaatcccacttcaatctttaaattcaaatacgtgtggccgacatgttatattctttttgttcaacaggtgtttgggttcagcttttgaaaaaattgtaaatcttttacattttacaaaaacaactcctgatacaattgtgaattcttttatgaggaaattaataataatataaatagttgaaaaactttcaaattttaaaaatgcatgttgattttgatccccttcaagtggattggtccacattttctcaagaattgcacgttcaatatggtggttataacatctttcgcggagttccttatcaaagaggggcaggtgttggttcagtgtttagaagtctcatgcgatttcttttacctattggaaaacaaattggttcatcaattgcacggcagggactagaaagcggaaatcgagtgttaacaaatgtattgggaggtaaagatctaaaggagtcactcgtaaatgagggtaaaacggggcttaaaactctcctggaaaaggcagcaaataatattgaaaaacaaaaaggacaggggtttgattttaaacgttataaaaatgaaccaacacaaaaagttgggaaaaccaggcgaaaaaatataaataaactccaatctccagttgggccaccattggttgccaaaaccaaaaataaacgtatgcgtgttgactttttaggaacatattaaataaatgagttgcccgcaaaagattagtgaaagcagtcctcttgccataaacagtggtctgaatattttctcagttcctccaaccaacgtctctgtaattcgttcattttttcgtgagatacttcctcttgcgtcaataactcaagaatctccctatctttttcgtttatacagtgataatttatggactgatttatcacgaatttatctgtatcttgaaatctcaattgaaaagcacgacgctaatggtaaatggacatcaatagaagataccgacacaaatatagcacccattcaaggaattggacaaacctttgttcaacaactaaaagttacggtgggaaacactgaagtttacgatagtggaaatttgtttccctttaaatcttatataacaaatgaattgagctatccaacaagcgttaaagaacattttctcgggtccatgggatattatcatacggaagcacatgatgattcaacagataagggatttaaagaacgttgtaatgttttaaagggaggaaaacatgcgcaattcctctcacgtctcgattttgatttaggaaatcaagagctctatctgctaaataatttagatttacttttcacaatttacaaggccaaagactcgtttttacttcaaaccttaaaagcaaacgacaataacaaatatcgtttagcagttcatgatgtaaaaatttatgccaaaatgattgaggttcagccttctcttaatatgagtctttacaaaactcttgaaaaacagccggctacatattcagtacgtaaaactgaaataaaatcttcattcatcagtgttggccgttacgagtttgaatacaacgtcttcagctcaacaattcctcgacgcgtgacaatagctttagttggcaattcagctttcaatggagattacaaattaagcccatttaaattcgaaccatttgacttacgcgaaatttcagtacacactggagggatggtataccctgccgtcccttataaattagattttcccaagaattacttcgttagagcatttgtcgacatgtatgaagcattaagtatggcaaattcagagcgaacttttgatattaagatgagtcaattccaaaatgggtgggcattttttgttatcccgttgaattcgaccctggatgatagttgcgggtttgaactattgagaagtggaaccacaagcatacgtgccacgtttaattccccaatcccaaaaggaggcgttgaaatgattgtcatgggagaatttgatcaaatgatcatgattgattacaaccgtcacattgtttccgattcaaaactcgggtaa

SEQ ID NO: 46234 - DNA, 805 bp, Heterodera glycines
  Genomic contig location: Contig_ID=SeqID_30839; Location=1..805; Strand=-
  SCN-specific regions: Sequence locations=1-805
  Gene Ontology: Mol. function=transcription regulator activity; Cellular component=nucleus; Biological process=cytoplasm organization and biogenesis
agtcgacccggctctatcgaatggtatataatacataccctttttccgagttacagctcggaatgttcgcttgtgagttttttatgaaaagaatctgaccaattcgtttaacttctaataatgcacccattttaggagggcgtaactttgccggatttttacccattgacaaaatccgaagagcgcgaattgaagcgaattcggcgcaaaatccgaaataaaatgtcggcacagacgagcagaagaaaaaaacaggcgaaatctgaagaagggaatcagttgaattgttttgatgtttttaggattacattgaggccctgcaggaacgcattttcatgagcgacagcgaaaacagagaattgaaaaagcaaatcgaagtgatggcggcggaaaacagacagcttgcggcacaactgcgcaacatgcaggtgctggacaaggacttgcaattagccacacttacccatggtttagtgggcgggggcgattcagtgtaaattacctaactcattaacactaattagcaaaacattcgtttgtcctttcttttcaaaggcttccattggacaatcgtcaaagcgcaatgcccagacaggcacttgcctggctgtccttttgctttccgtctgtttaattgtgacgccaaatagtcgacaccttggcatgagaggacaagcgaatggaccctttcagcagcaacaggcgctgatcgcagaacaacagcagcaaaaaaaggtgggccaatttgtccgggattgggggcttaaattttgaccacccggcctatcagcaagggattgttttt

SEQ ID NO: 46235 - DNA, 1085 bp, Heterodera glycines
  misc_feature (1016)..(1016): n is a, c, g, or t
  misc_feature (1019)..(1019): n is a, c, g, or t
  misc_feature (1050)..(1050): n is a, c, g, or t
  Genomic contig location: Contig_ID=SeqID_30864; Location=1..1085; Strand=-
  SCN-specific regions: Sequence locations=1-10,33-117,149-185,208 -210,232-233,255-443,467-467,496-604,627-914,936-1085
atgggcgacagaaaggcggtgattaaaaacgcggatatgaccgaagagatgcagcaggaggtcggaccaagcaaattgagaataatgaaaaatggaggattttccaaaagagtatcgcattttgtaacaaaaataaaacaaaggcccccaaaaataatcattttcagtttaaccaaaagctcaatttttcattggatttgaatttatccgttactaaatttaaattttattcatttccatttcccttttaggccattgagtgcgctacgcaggctttggagaagtgcgtttacttattttagcaattcgtttgctcttcggaaatgcttaaacttttccccaacgattcccttggaaaacaaaaattggagtgttttaagtgtttccgccttttttcttttctttcttttcgatgcgcaatttgtcctccctttgtcaggtataacattgagaaggacatcgctgcgtacatcaaaaaggagtttgacaagaagttcaacccgacatggcattgcatcgtcggacggaacttcggctcttacgtcacgtgagtttttttagaggggggggggattttgaatttaatggctttacggcgtgaaaacccaaaggctttactcgccaaacgatttttacgcgtttaatcagtgaccatccttattttcttaggccacaaacatctgaaagattaaagtttagggaatcttaaatacaagaaaaacacaatgagaatatccaaagtcagcttttcgagtatattcggcgataattttttgtttattatctttgacacaaattggttacaaaaactttgtagactttaaactttagaaaagtaccaagaatgtaggtctttatcaagaaaaagattagtgtgtggtcaacggttggacatgtaaactgcaatagaggcaaaccaaaattaaatgacacttttggactttacacgaattttggacaaatggtcggaaagtgtgaatcttttttaagtaggggagaggaaaagccgaatattnccnacaaaaacgagaaaagagctattcaaaattntatactttagacacgaaacaaacacttcatttact

SEQ ID NO: 46236 - DNA, 2480 bp, Heterodera glycines
  Genomic contig location: Contig_ID=SeqID_6368; Location=1641..4120; Strand=+
  SCN-specific regions: Sequence locations=1-320,342-541,564-643,670 -702,727-734,759-856,878-1071,1093-1383,1405-1560,1582-1587,1609 -1660,1748-1857,1879-1892,1915-2203,2225-2324,2346-2480
  Gene Ontology: Mol. function=protein binding; Cellular component =cytoplasm
atggcacaaaagcagcaacaacaggcgcaaattggccaccaatttgatgagggcgcactgctcgaaaaggtgcaacgaatgatcagagaggaattgcgacgatttgatgccgaccgtactggcattgttgactatgcactcgaaagttcaggttcgacatattactggcaaagagggcatattgtgtaagagaaatctgttttttgttaaaaaaggggaaaaaatttaaattccaaattttgaaaattcaccgcgtcaaacttattggcgtttcacaaccaaaaaccacaatcagtagcaattttcttcaaaaaaaaaaattgtttttaataatagaaaaattgatagataaatcgaattagaggaaaacaataacatacctattcaggtggatcagttctctccacgcgttgcactgtccaatacaatgaacggtcgcgtgtccaaaaattgtttggcttcccactgtggtacaccggttattcgccaagaactgttatacaggtgcgctatttgcacaaatctcaaataaaaacttttcaatttattaaattgaaaaatttctcacaatatgccgagtttgagatgctatagcttctttcattgctgaccaaactcaatttagtggtcccttttttagatacgtccaaaaatcggtttaaaattaaatcccaaaattccattattttatattgaatcatcgagaaaatatataaataaatacccgacataggaaaaatatataaataaattaaataccaattaccgcttaagcgaaagggctatggcgcatcaactggcgaatgctgggcattctacggaggccatggctatttgaccattgggctgtcgcaagtaaaaaattttttttttttttgattcgtcccataaatttttgtaactttattagcgcatcaatgtgaccgcagtgtcttatgaacatttgccggttgaaatgtcgccggacaagcaaattcggagcgcaccgcgcaatttcctcgtttgggttagttgtttttttagtgtcgggattagatgatgttatttttaatttcccatctgactttcacccattataaataataaaaatgctaaaaaattacgaaatcgtaaataatttttaggtgttatttcccaatttcattaaaaaatacaaaattgaaaccataaaaaaattctttaaaggataaaaaaacaaaaaatttagggcaattatgaccctagtaattagagttaaaatttagagttaccaggacttggatgagctggacacccgacttttgcttggcaattttacttatgacgctgagaggggcgaaccattgcaaatgttcccagttcaggtaatttaatcaatgacttcgaatacaataattacaattaaaaaatgaatgcacaaattaagttacgcatcagatttttgacacagatttcaataaattttactttaatgtcagcaatgggacccacatggtacacaaattgttgagctggaaacgctggcaaattggggctcgcaagtcacatgtttgtaccggttcagagtgcacggagacaaaatgagggtgagtctggctgttaatttctttcccaagtcattaaaaatcatttttacgaaataacttctatggtaaaagctttataaaaatctaaataaccctaaaaatattttataatataaataaccctaaaaattatatgttttttccaacaaaaaatttttttttttaatttatgattatttatacaaacctaaaggaaattccggaagtggcatcggcagatgatttggcggcatttgactccgctaaacgatggcccgactcatcaaaacacaaagaaattggtggcggatgaacggactgacggacggacacaacgtcttcccgtggaagaagaactcaacataacaaaactcattatcagttttattaaaggatttttctttattttatttttccccaatttgtttatttaccatttaattactctatcccatttattattgttaaccaatttgacttctgttaagtcgcaattcactggttttctttgttatcattcatacatattaacctaaacacttatttaatcactgtagcaattaaaactttgttttgtttggagaacaaattttcctttccagcaatttggattactaaacaccacactgagtatagtctgtttttcccaagataattcgttttggttttttccctcatttcttggtgcaaagtttcgttgttttgatgacgctttctgcccctgctttttttgttttagctgctgcgcagcttaagtagtgattatatttatttatttgttctattttgagtttgcttttgcatgaccataactcaacaaaagggaaaaatggtggaggttcaaatccgcctcacgccaacatttttggatcaaaaaatttaaaaaatgacgcttattgaactttttgctagtagatgacatgaatttcggtttta

SEQ ID NO: 46237 - DNA, 766 bp, Heterodera glycines
  Genomic contig location: Contig_ID=SeqID_30928; Location=285..1050; Strand=+
  SCN-specific regions: Sequence locations=1-176,198-254,276-477,499-766
  Gene Ontology: Mol. function=AMP deaminase activity; Biological process=purine nucleotide metabolism
atggcccagctgttcgacaaacttggcgtcggcccgcacgacctgtccgtggataggctcgaagtcagagcggatgacacgtaaacggcaaaattttgttgtctattttacaatttcaattttcagattccaccgcttcgacttggcacggtgggccattggacacgatgtgagtgaataaatttcaaaaaatttgataagtgctaatttgtgattgatcgaaatgagatttctgatcaattggtcattcatttaatttgtttttcccaggtttggtccccaaatgcccgttggataatccaagtgccgcgtctcttcgacatttaccgtgccaatgtgagcaaataccgtagcacttttctgatcacattcacatttttccattttcagaaaattttgaaaacttttgacgactttctcgacaacctcttcactccgctgtttgaggtgttttctccaaaaagtaaataaaaaaaactggcattttcaggtcaccaatgaccccaacactcaccctgaacttcaccgattcctcaaagtgatcgaaatgcaaaaataccataaaacactcaaatttcagcatgtttccgggattgattcagtcgacgacgagtccaagccggaaaatgtggcatttacgaaggattcaccggagccggcggattacgacaacgaccaggtaaaaaggatcaaaatgatcaattcgcgttcaaaataaatcatatttcagaatccgtcctactcctattacttgtactacatgtaa

SEQ ID NO: 46238 - DNA, 1059 bp, Heterodera glycines
  Genomic contig location: Contig_ID=SeqID_30976; Location=108..1166; Strand=-
  SCN-specific regions: Sequence locations=1-187,209-243,265-1059
attgatacgattgtgcacttcgcagccgattgcaccagcaagcgatgctatgaacaaccaatggaagcgttggagaacaattcggtcgcgttcgtccaaatgttggaatgcgtgagagaatatggcaaagtgaaaaaattcgtgcacattagcacggacgaggtaataattagcagcatttgaaggccattaggaaacacttaatttgcatcggaattctccttttgaggtgtacggcgattcaaatttggggccaactgaaaaggcgaagtcggaagagtgcccaattttaccggggaatccgtacgcggccacaaaagtgcatcgttttgccattttaatcatttcgacataattcctttgcaaatcctcaggcaatctgcgagttctacgcccatctgttccaacaaaagttcgcacttccaattgtgacccttcgcatcaacaacatttacgggcccaaccaatgggacgttaaagtgacagacaaatctaaaaattataacaaacattttcaaatgttagctaatgcctcgcttcatcgaaatggcacggcagcagaagcgattccccgtccaaggcagcggggaccaattgcgctcgtggctgtacgtggacgacgcgtcggagggaatcatacgggcggccgaagttggccgagtggggcaaatttacaacttgggcacttatttggagaaaaatggtcggttggaatggtttgaatgtggccaaattccttgccgatcaaaacgctcccacaaagtgtgaattcagtgaaggaagtggcggaatgtgtccaaagcgaagtccgtactcaaatgggccttccgctcgttgctccccaattcgatcacattgccgaccgaccctacaacgaccagcgatatctgatcagtttttcaaaggccacgaaggaactcggatggaccccgaaaacaccttttgaagaaggtcagtttcaaaagaaaatttgtatgaattgttgtaccttttccaggtttgaaaagagtggtcagctcccacttggagcataaaacggagccaagccaaagactttcg

SEQ ID NO: 46239 - DNA, 3103 bp, Heterodera glycines
  Genomic contig location: Contig_ID=SeqID_6387; Location=1..3103; Strand=-
  SCN-specific regions: Sequence locations=1-189,211-330,376-380,403 -1052,1074-1245,1269-1299,1334-1514,1538-1781,1891-2248,2272 -2278,2309-2455,2477-2497,2519-2679,2703-3103
  Gene Ontology: Mol. function=ATP binding; Cellular component=basal lamina; Biological process=cell surface receptor linked signal transduction
gactgtgccccgggctactcgcgcaccggcggtgggccctacttgggcatgtgcgaaaagtgcgagtgccacaaccatgcaagccaatgcgatgccgagtacggcgcatgcattgactgccaacacaacactgaggtaaaacacacggagaaactctgataggaattgacgattagccttagaattagcaagtttattctttgattcaaatgaatttgctaatttttggcacgggcagaaggctgccaatgagattaataaatcccaaatttggagatgaatttgtttatttttgctaattaatccactctctctctctctctttctaagttaattaattattttttcataaatatttaaaaataaaaatttaatgtcaattttccggcactttttgaagggttctttttaatttaatccccgacaaactttctaatcaccaacttacctgtctaagggtgatcgttgtgagcgttgtaagcccggctttgttggcgacgcacgtcgtggcactccctacgactgtcgtccggcaccggagatcgcggttgtacgcccgcgctgcgattgccacaaccattcgccgcgcggctgcgactcatacggacgttgtattgtgagtttttgtaaatttaattactaatctcattaaataagcaaaatcgtcagactcttcataaatttgttttgctcttcagctgtgcgaacataacactgaagggttccattgcgaattgtgcaaaaagggcttttacggcgacgcaacaaagggaacgccgtgggactgcacgcagtgcccgtgcccgtaagttcctttgaagagtgccgccacactttcggctgcaaaaagtgccattcattcatttcgttttatgtgaaggggtaccgccgaatgctttttggatgcgcgtggacaggtccaatgccgcaactgtccgccgggctttgctggccgtctttgtgatgagtgcgttttgcatacacttggcaaatttaagcgtccaattaagcaaattagcatcagcgtaattacattgccctttcgtaatttgtttgccctttttcttcccccgattctctaaatgccatttcaatttctttccatttccgccacttttttccacagatgtgcccccggttatacgcctggtcagaccgccgatgggcgcaagtgcgagcccatcggcaagcacaagccgtctgaagtggagttcgtgccgggacccgacggtgagagaggtgcttttggtgttggtgttggtgatggccggcgtgacattggcgttgtgcggcctccgaatggcgcgcagcaccggcgcgggggcggcggcataaaagtcgaacgcaccgggccgaaacgctaccgcgtgcgaggccaccgctttttcacaaactgaccaccgccgatgcgcagaacattcgccgctttacataataacgcattcactcacttccgtttatttcgcttcgcttgcatttttaggcattgtttttttgtgccgttttgctttttcatttttattttattttttaatttgttttcgcttcgttcgttttttgtgcctttcgcgtgtttttggccatttctcagctgttttttgagtgcctcctaagcaaaacacttcagaggaagaagagttccaaacccacttccgtcagcttcgaaggtctccccaattgtgctgctgaagggggaggaacactttaccactctctgaagggtttcaaatcaaaccgatttttgtctctgttacggtgtttttgtccggcatttctcatcatctctcgcctatctctctatttcctcttttctctccttctctgcacccactctctctctctctttcaccctctctattcgcccttctctctcgccctccttttgtctctgatttcatttagaattttattctccaatttaaattgctaaaatcgctgccccttcagaatttcaaaaatttctcttgctttaatgacatttgaataaattttggcacttttttctctctttttttgcacttttttggcaaaattccaacttttctttgttttttctttgcttcgctcgctttccgatgcttcgccggtgatgggccaaatgctgcaaattttcttctccgttgctcggggcctttttaattgctcgcctttgcaatcggtaagggttactgtactttcggtcgggtttctgtacctcccgaatttattttcctacggtcggtctctcttctttaaatcaattaaagtgtcctcctttctttccctttctttacgtcacatttttaattatcaattaattttaattaatgctaattaccctaatttagtcttttatcatttagtgccttttcgtgtggaaattcttcagccaaaacagctgaccattcaggaaggttctcgtgccaaatggacatgcaaaattgtttctgcagataaagtaaagaataaatttggattaaaattttatagaatttgtccaattttcccggttcagcccgacttggtggaaatccaatggagcaaaatcggagaacccgaattgcccgaacgggcacaacagtttggacatcagttggtgatcgaccaagtgcaacagcaggacacgggacactaccgatgcaccggccgattgaaaggggacatttctacggacgatgccacgctgacaatcggtaggatacagcagcagcacgggcgggagaatgtgttcaaatggggtgccattctcgtacattaagcctcgccacaagctgcgcccgcctttgtccattaccccgccactttgcccccggcattgcccgcggcacctgcccacatgccaaagccatccgtaacaccgcctcatcaactggtggacgaaggtaacgctaacgcatggcaatgacacatactaacttcatttcattgttaaaaggccaacaagcagtgttcacttgtctgaccccgggctacgccgactgcgaagtccaatggcattttcaacgcctcgggggaccgctgccgcacggatggcaacaacgcggcaatcagatcattgttcagagtgcacagcaaatccacgccggagactacatttgcagtgtaacgcacccagtttggcaca

SEQ ID NO: 46240 - DNA, 1235 bp, Heterodera glycines
  Genomic contig location: Contig_ID=SeqID_31007; Location=66..1300; Strand=-
  SCN-specific regions: Sequence locations=1-903,925-1235
  Gene Ontology: Mol. function=DNA binding; Cellular component =nucleoplasm; Biological process=RNA processing
atgagcaaatttactcaggtgccagaggacatggacgacgacctctttgagttggccgccggtttgccaccgaggagcaaaaacaacgaacaggagccgaagccagttgaagatgaaccattgcccgacgccgagcatgttgagctggacttttgtgagtatattatttattcagctttgttttgagctttttatggatctggaattagcaaataccattttctagtcccaggcattctggccttctaagatttcgtccaaaaaggtttccttcctctcaaatactccgtccgaagcgaccccttttcattaaaaaattttctttccttatttgaacgtaacatttcctaaatttccaaaagtatgagtgggtttttagacaactccgacttcaacatgaaggcatgtcccagcaacaaatggcttgtcgatcccgacaatagtgatggttttgcgttgatgtggggaggggtacgcgccaattggggtgttttggtgccggacgaggaaaatcagcgcgccgaaatgccaccaatagcgttccaagtgaaggcaagtggaatttcctgtactttttcagcgcatctaaataattcttatttttacagatcactgaatttctctccctcaaacatttgccgtttgacgaagctgatccgcaccaaatccgtgttggttggtctcgagctgactcttccaatttggtaacattttatattattttaaacatttccaaatttgagaggtattgtttatttaaataaagacattaatatttttagcttggcgaacaacaaaattccttcgccttttcttcgatgggcaataaagcgaccaataacattttcaccgattttgtcgacccgttctttgtcgatgaagtgatcacttcagttttggttagttttgggcaacacattcttgtactttctattaaattgttttcttaaaggatgttgggcgtgccgaaattcgctattacaaaaatggtcaaccacttggcgcggcattcaccgacattcgggtttgataaacgatttgtatatctaatatcaaaaaaattccagtaccgaaccggcgatatttatttcccccatgttgctaccaaaaattgcaaagttatggttaactttggcaccgaaattcctgaatcgattgaagcggccaaagacgagtccggtctttgcttgtggaggtttatatgggaattatctcgcaaaacgcgcatattttga

SEQ ID NO: 46241 - DNA, 754 bp, Heterodera glycines
  Genomic contig location: Contig_ID=SeqID_31036; Location=349..1102; Strand=+
  SCN-specific regions: Sequence locations=1-434,456-754
  Gene Ontology: Mol. function=structural constituent of ribosome; Cellular component=mitochondrial small ribosomal subunit; Biological process=protein biosynthesis
atgttgaaaaaaagagaggatttatcaaaccgatccacacacttgaggaacagatagaatacatgaacagcgaaggtttgagaggccaaacttttgcgcttttaagcttgtttgcttttcagtttttgccgaaacttacaaaggacgtccaatttgttttatgtggaaacgtaatatgaaaggccagtggaaattgcaaccgccgcctcgacttttttgcattgaccgcaatggtaaactccgaaatgactaagaattggcatttcctgtgtctgattgcatttcccatttaaaggtcgtttcaacgttggaaatgcgtgtacggtgtgtcgtgatgagtatttgttcttcgattatagagtacgttcctcacaatgaccttcaatttccactgttttttagaatcccaaattgcttgagcatttcctttaccccggcactgatcagcccctgcccataattcaaaccggactttgtcaagaacagtacgtcaatttgcaagcccaacttctcaaggccaaagagcacggtcccttttagtttaatcgttggtcttttaaccctcaaattgttaaggtacgtttattttcaacgtgcccttccgtcacttcaattatggtcaatggtatccaaaagatgcgaatgcattaataagcagtgatttgggaggaggatcaaccgagcagagacttgacaaacgtcgaagacatttatccgaatccctcaatcgcatttgaaacacacaaccgggaca

SEQ ID NO: 46242 - DNA, 1887 bp, Heterodera glycines
  Genomic contig location: Contig_ID=SeqID_6406; Location=77..1963; Strand=+
  SCN-specific regions: Sequence locations=1-30,59-249,271-554,576 -596,619-647,669-1887
  Gene Ontology: Cellular component=nucleus; Biological process =reproduction
atgaacccggtttattccattggcactcccgttgaccagcagcaacagcagcagggcaaaaacaatgaagcggcggacaacagtgaaaatgtgccggccaatcaaatgccacccgaccttgacgaggtgtgtttaggctacatgactcaatgctcgagcacacaaaattcgtaccaaattttcatttcgcaattttttctcggcatttgtgtcttgagtccttgaaaaccgattagtttagtgtgtctgtttaaagttaatttccattttatcttgttttgaaatatttttcaattttccacaggctgataccgcgcatcgcgtccaaacggacacttttgtcaattatgcgcccctccgactgcgttccggctttccccaccctgacgaagttgtggaaacgctctcgctcagcagtgtttcgtcgccggaaattcgctataccatggccatccccgacgaagtggtcgacggaggtacagacacaaatgggaaacatgagttttcgaaggtccacaatctcttccatttaggcattccttttccggggattgaggagaggattttaaccccttttctggtccgacaaaccaaaccccgcccccttttttcagatttcttaattaggattcgctttttaccaaattgaaaagttgcctgatttgggtgtcacttggtctattgtataattggtcaattcaaatttaactctcgttcttaggtcggatatccaatcttcagttggaagccgcactgtacgcctgccaagctcaccagcgttttttgccttccggggaaaggattggctatctgattggtcagttttgccactttttggtattttttttaaactcattcataaatttttttaaaaattcctgacccattggctccgcaagaatagatttttttccaaaaatggccgttttgaatttttttggccataaatttcgaatatttcccatttccgcttcttgccccctggtattttcatcaccctttccatccttcggcaaatgccataacctttttatcaactttgtgtttaggtgacggtgccggcgtgggcaaagggcgcacaattgcggcgattattttcgagaatttcttgcgcggccgtcgcaaagcgatttggctgagtgtgtcgtccgatctgaagtatgacgcggagcgagacctgcgcgacattggggcggacaaaattgcggtgtgtgcgctgaacaaattgcgctacggacgcattgggtcctccgagagtggcggtggcatcggtcggggcgtcatttttgccacttactcctcactaattggcgagagtcggcgcggtagcacggcaaaaggtggcaaaagtgccgacgcgatggaaatgatgaaatcgccaacgacacaaaggcagcaacgacagccgcttgtaacacgcggcttcgccagttggtccaatggtgcggccgcgagtttgacggcgtcattgtgttcgacgagtgtcaccgggccaagaatttatgcccaaccgctggctcaaagccgaccaagacgggcaaggtggtgctggagttgcagcaagcgttgcctggcgcgcgaattgtgtacgcctccgcgacgggagccaccggtaaagcgctgggtgaaaacgggagacggtcaggggaggaatattgttagctatacttttttcgatattgtcgctgagatacggcattttatgaactattttgcaactaaattttccatttttcagagcctcgcaacatggcctacatgtcccggcttggcctctggggccttgggctgaccttcaaaacattcggcgagttcatccatgcggtggagaaccgtggggttggtgccatggaaatggttgcgatggacatgaaggtatatgtgtaa

SEQ ID NO: 46243 - DNA, 1421 bp, Heterodera glycines
  Genomic contig location: Contig_ID=SeqID_6412; Location=2406..3826; Strand=-
  SCN-specific regions: Sequence locations=1-5,27-131,155-677,700 -998,1022-1309,1337-1359,1385-1421
  Gene Ontology: Mol. function=pre-mRNA splicing factor activity; Cellular component=nucleoplasm; Biological process=mRNA splicing
ttttacgaggaagtgttcaccgaactccaacgcacttatggtcggcaattctaattttttttttgatgagattacaatttttgattttctaaattttcaggtcctgttgaggaattgaacgtaagttggagatggttttttcccttaattttacaaaacatttcaattttaggtttgtgaaaacattggcgagcacatggtacaaattgacatgctcaacaaatcatttgccattgtttttcacagattggcaatgtgtacgtgaagtttgtttatgaggaggacgcagaaaaagccgtgcaaggcctggagaatcgatggttagcatttttgggggaatgaattggaatttggtcacaaaatagagcaaatgccattcatttcctcgactgattacacattttcggagtttttcgtttactacttttggggttaaaaaaaattggtattaaatgagcgcctcataccctgttttacttggagatggttttttgtgtccacgtggaggtactcgctgtgaagaatttaccaacccattttcgattttcaaagaagtttctgcctttttgagacagcgacagtccttgagtttggcttggaggttgcatcccacgcaacgacctttttttacgccgttttttacggcgtgattttcctttactatgccatttgatactagtttccttgggcccatttttctccgttttcaaccctaaggggccagcactgatagagggggggggggtgtgtatattagaggaattactatcattttttgtcacaacaacaaatggcccttctctccgcaggttcaacggccagcccatctacgccgagctgtcccccgtgtccgactttcgcgaggcgcgttgtcgccagcacgaaatttccacctgttcaaagggcggcttttgcaatttcatgcacctcaaagatgtgtcggatgaagtgtaagtctggcgatttacaaaaaaccctagggaagcaaagatttttcgaattaaatttttttttaatttttcagctacgaacgttgttacgccaatcgtggtgcacgttaccgcagcacacgtcgccacgaccgcttttacgctgatgatggctacgatcgtcgagaagggggcaacaggtgggtggacgacggacgaaaaaggaccgccgagggagatcggcgggtggtggttatgttgggcaaaaacttagagccagactcttgatgggggggggggtgctcttcggcctcgctttttcgctgcgcttacgtaaaaaatttttttagggggtaaggtccggcggcggtatcgccctgctaaatttttgtgaatatttttgtttttcttcgtagggatcgcggcgatcgaggaggaggcggcggtggtggtgggcgcgaccgtcgcagacgcgacgaccgaggcgatgac

SEQ ID NO: 46244 - DNA, 2224 bp, Heterodera glycines
  Genomic contig location: Contig_ID=SeqID_6425; Location=2369..4592; Strand=+
  SCN-specific regions: Sequence locations=1-126,148-299,321-405,473 -597,619-668,690-1787,1810-2186,2221-2224
  Gene Ontology: Cellular component=plasma membrane; Biological process= female meiosis chromosome segregation
atggctcttctttgggttcagcaacacatcacttccttcggaggcgacccgcgggctgtgaccatcggtcattccgtttgaaaatgccatgctcacttggcattttgtttttagttggccacgatgctggcgctgtcagtgctggcattcacatgctcagccctttctcaaaaagtacagcagcacataatgaattccgctttcacctcttttagacctcttccgcggtgtcgtggccatgtcgggtgccgaagtttcgtaccattcgatcattggaaaaccggcattgggtgccataaaaattcccaatggagttgaaaatctttttacacagcctttaacaacacaatgaaacttggccgttttctgggctgtgttcatccggtggcttcggaagtgttagtggggggagggggcaaagggaggaaaatgggggagggtaaaggcgcaagtgaagggggggggggagaggctgtgcccccatattagaattggttgggtctttcagctggagttgcatcctcacccgttccaccgatgacattgtccaggccgtttcctccaccgccgtcccttccattccggtcctttcatccttttatttccattatttgctttaagctttcagatcgaattcaaccgttacttgtttttgccatcggtgacaattatatatttttcttataaaacccattaacacacttcaattgggtttatgggtttcggttggcccttcgtttcgccgtcaggtccctttgatttttctccgcttttgaggtggatggccatgaactcacagcccacccgctttggctgcttaacaatgtgcgcaacggaattgtcaatgtcttttcggtgcccttcctcgtcggaatgaatgcacaggacgggaccgaggccattttggaagaccgcactttgggtgggacggcactctcccaatttggcactttgttcatttgcacaggcgaattcaccgactttctgcaaatcacccgccaatacatgcgttccttcatcatcgaatacgcgttcaagcacaactatacgatgaacagagaagtgccagcgaaagaccagagcagaataacgatctgatcagcgtcccttcaggcggttatcgatgccatcgaatccttctacacttattggcccgatgcttccgatgtttggcaaatccgacggtggttcatcgacttgatcactgatgcctattatactcagccgatcactcagtcggctcatctccactccgataccggctcccgtacctttctctatgtgaacaattacaatttctccatgcagcgtgaaaacactgtggcacataacggcgaagtgcccaattttccggcatgggccggtgaatccggccttttatgataggcatgacttccattatcaggcagctgtcacgactgcgatttgttccttctctttggctttcccttcatgccgcctgagttgctgccaaaggcaattcgatcggtcaattggacggacactgatcgaaatgccagtcaactgttctcctcatttgttcgccagttcaccaaatattcgtttgtcctgccgttcttccatttaattccaaaattcagtgaccccaatttgccaaatgatggcacttggttggcccatcagccacgagcccattggtacattaactttaattactctcgcgggcaaagtctgacagtgccgggcactctctcccgggactttcgctttgaacaggtcgctttttgggagaattatatccccgcagtgagtttctcaagtttttattttaattggaaaatacccattaagttggtcaattatatgaccaccactttctccccggaggagggaagtgttcgaaatgagatggtgttgttcaaagtgagtggttggacttttcaaatggcttgttgtggttatggcctaagaaactgaggaaggcattgattggatgtctaaagtgaattagagccgcgaaatatgcgtacacctccgtgctattcaatcctttcagggattgttcggtgtgtctctgttggttctcatcgctcttttggtgctgaccctttcattgggttacaatgtgtgcactcggcctttgagagagcgttgtggaagatattcggaatgggaggaagtccaagccgaagagagaggagcaaatgtggaaatggcaaggaaaagcacgagggaaagaggaggaggagaaggagctggacgg

SEQ ID NO: 46245 - DNA, 1754 bp, Heterodera glycines
  Genomic contig location: Contig_ID=SeqID_31161; Location=46..1799; Strand=+
  SCN-specific regions: Sequence locations=1-144,166-262,285-290,312 -669,694-949,985-992,1023-1251,1273-1522,1554-1596,1643-1665,1714-1754
agtgttgaaaagcagggaaataaaaactctaacagcagcctataaaacttttgtacgacctcaattagaatatgctactgaagtttggaaccctaatcttaaaaaagacatagataaaattgaacgtgttcaaaaaatttttacaagaaaagcacttagaaaatgtggttttgtgtacaaaaaatatggggaaagactaaaaatcacgggtttacacaaattggaagaaagaagaaaaatcaatgatttaacaacagcttttaaaataatcaaagggttcaccagcctcgatgctggaaaaagtttctttttctcagaaaggctcaggaggcctttacttttacgggtaaagcgccacacggccaaaactcaaaataattttttcaatagaatagtaaaaaactggaataatcttccagtggtagcggtgcaaattaataaggcaaaggaattcaggggtttactaaaagcaatgagttctgagtaggattttccatgttgccatatttacactatatttttatcacctgtgaatttttaacatttgattgatttatttttattcattttttattacggtattcattttgtattttttatttgaccaactttatttgttgttttctttttggcaccatataagagcactcatgtgcctttggtttgctcgataaattaaattaaattaaacaattgccttatttggccttatgtcttcgtcatgtctaaatttgtgtaactataaagttaaattcatttttccattttctcgatcccttcattaattttaaattatgtatgttttcgtttccccacacggaaaaataaaaaaaacattctcacacctataaatttgtaaaaaaaaaccttaggaaattttttatcagaaaattcaagaaaaaaaatttttagaaaattttttcagcgattttttcaaagttttatgatgaattaataatttttcttaaaaaattttctaaaattcgctgaagaaattttttaaaatttttccttgaaaattttatcaaaaatttctcaagattttttttcttgaaaattttctagatttgagaattttttaatttttttccgggcagaaacgatgcgggggaactgattggagaaacggtggggggaggaacgtagagcaccgtggcgctcacttggccagtgcatatgaaaaatttgtgaggtgagacacctcataagacgcgaaattctacgaatttcaaaaagcatcattttccctaagaaattttaaaaatatcaaaacttttaaattcgaaataaatcttagacgtttttcgagaatttggatgaacattcgctgaaaattttggatcggccccttcgtcaggtcaccgagtttataaagcaaagagagtcagatgaaggaagaccaatgcgccagatttggataaatacttacaaaaataggcgttcagcggcagacattattgtcattactagagatcggtattttgaaaaaagcctggacctggacctggattccatgttggacctggatttcctgggcaaaaatccaggtccaggaaaaatccaggctcctcgagacctggatccaggcctggacctggattttttgaaatttgttttaaaaagcaaacaaatgcttgaaaaaatcaattatttgctagaagcatctaaaaatatctaattaataataataatgtgtttttaaatttatttaatctgtttttgaaaacttgaaaaaacatcggtcacttgaaaaa

SEQ ID NO: 46246 - DNA, 510 bp, Heterodera glycines
  Genomic contig location: Contig_ID=SeqID_31179; Location=51..560; Strand=+
  SCN-specific regions: Sequence locations=1-510
  Gene Ontology: Cellular component=extracellular space
atgaatccttcgcttggcaacgcttttgtgccgtcgggccccgtcgcgcttctgccgcttggccgtgacctgtgctcgttggtttggaccgtgtcaactgccgacgcggcacggcttctccaactgtcgcccgaacactttgtggaagagctgaatgggacacttgtaagcagtgccttttatgggtctccaaataatggggtccattttgaattcgttttatttgcacttttaaactttcgaattatctttttccatttttagcaatttgacaactcttcggctaattccctcgtcaacaattcgttggattgtcttggcaaggcactgaactttttgccgtccaaagaatcgcctgccaaatgcacaattccccgcgttttgtcgctgccttacgatgaccgtgccgtgtttcctctgtcccttggctacgcttacgactacattcggccgcgggttgcgcttattgggtacgaaaaattaaatcaatgtggcggcacagatccttag

SEQ ID NO: 46247 - DNA, 1815 bp, Heterodera glycines
  Genomic contig location: Contig_ID=SeqID_798; Location=11..1825; Strand=+
  SCN-specific regions: Sequence locations=32-161,184-440,595-644,681 -775,810-830,852-1202,1314-1342,1394-1439,1478-1533,1555-1728,1765 -1815
  Gene Ontology: Mol. function=ephrin receptor binding; Cellular component=axon; Biological process=Eph receptor signaling pathway
atgaggataatgatgatgatgatgtatgtttgtggcacgtctcgccgtcctcaaaagtccattcacattcattttggggtgccaattctgcagatggtagccaccaccgccgccggcagtccgaaagggtttcgtcatcatcgcggtatcatcgcggcacagaaagggaatttatttcttcggctgggttggctaatccatggcttaatctcccagccgggccgcttttcggcaccgcaaagagaagcccttgggtcggcaaattgtatagcgaaatgtcgctcgccaaattattgagtggggtatcatcagtgagctgaagcaggagagaattggaacggaaattgggggggggggagcaaaatgagaatatatgtcttaattttgtgcttttaagagggtcaagaaatggtgaagaaagtgaaatgtcttcccaaaagatattttatttatttttatttctgaataattaatattttaatttacattaaaatcgagaaatattttttaaattaaattttattgaacaaatatttactttttgatatgacttcttaatttttaaaacaattatttaatttaatttatttttttgagttgagtaatatttattgttagtcttttgtttttgctgcttccttctcttttaaattttaagaattatataaatataaataaatctctataaagtggttaaattttaaattggtaatttttttttttacttttcaggtttcccgagaatcttatgaccaatgcatgcttcaaggtcagcttaatatttaatttaaaaattttgaaaaataaatccacttttttctatttcctccaaatttatttatccatttcaatcaaattattttcattaattaattagcgtaatgagtataaatttcctaattactatatttccaggcataggcacaaaacagctcggcgtttgctcgtcccctgaacgacaatcgtccattacgctggtgttccgcgatgtgtccccgctgccgtccgcgttcacttttaggccgggccaatcctacttcgttataagtgggataaatttaaaaattgattactgtattccctaaaatacagccccccccctaaattatagccccccccccccctgaaataaaagccctcttctgaggggggggggggcttgaaaaacaaaagcctccctgggctctatttaggaaaaacggtaatttaaattaaaaaattcttaatttttgaaaaataaaatttttctttaaaaacaaaataatatataataattataacattagaaataattatacatattaagttaaaatgattcaacctcaaaatatccagaaaaagctatataattgattttaaaaaattgcaataatttcaaaaaaattttaattttcttcgaatattctcaaataataaaagaggatcaatttgatgactacaaataattaaaaaataataattagatttatttatttttgactcaacatttttgttcagcaacctcaaacggcacattgatgggattgaacaacactgaaggtggactgtgtgccaccagaaatatgcggctcaaatttgacgttttgtccctggccgatgaagcggatgccaacaatggtacggtaccctaaggctatacctatcgccctggaatttaaaaattttcatgaaatttttgaaaatttcagatacaatgcttcaaattccgcagccacatcatgcacatgctcaccatcatcatcaccatcaccaacatcatcaccaacaacgctatcatcataaagcattggtgcacaagcagcaggagacgcacag

SEQ ID NO: 46248 - DNA, 1752 bp, Heterodera glycines
  Genomic contig location: Contig_ID=SeqID_6444; Location=251..2002; Strand=+
  SCN-specific regions: Sequence locations=1-189,274-553,575-752,782 -783,805-846,868-964,986-1185,1207-1285,1307-1420,1466-1514,1537-1752
  Gene Ontology: Mol. function=ATP binding; Cellular component =mitochondrion; Biological process=seryl-tRNA aminoacylation
atttaccatcactcttctttgtcacagattgaactgtttgcggtgtgcacggaacgccaaagtgatgccgaattggaccgtattgttcgcctccaacagtccctttatgcgtcacttcagctccgttttcggtgggtgtggcacagaataaaaggccaagaaaaagggtgcactccataatctcgcctctaaaatttttttttttaattttcaaactgaaattttattgaaaaaattttcaaaaaattttttgttaaattttcttataaaaaactaacaacttttttcttgaaaatttcgaaatttgaaattttttttaaattttggcacttagattttgtcccatccaaaaaaaaatagtgacattttgccaatgtttttttgtctctcctctcaagggtaatggacatgcccagtgaagagttgggagcaccggcagcacgcaaatttgacttggaagcatggatgccgggccgaaaaagttggggcgagctgtgcagcgcgtccaactgcaccgatttccaggcacgacgactgcatttgaagtacaggtgaggagaagggggaggaggacaagcaactgatgagggaggcaacaacaaaccacgattactactgtatttatacaatacaattctatacagtatacagttttagccctgacaatgaggcggcacttcattcgtcccccccccaacccaaccccttatcgtttcctctccgaaatttaaatcttagaaatttttcgaaacaataatttttttgtttttttttaatttaagtgaaaatttaaagaaaatttcaggggggatgcctctccgctgacaccaaaatgttaaaaaaacgaaaaattttccaaattaattgaaaaggagttgctgtttaaaaagaactagttattgtcacatattcccccgcacccctcccccccccccttatttttaatgtctgtccttgatgactgtctgtctgtccatcatctctgtccgtcaccccacccccggcacttttcaggccgtctgccgacgctgccgtcaacggtaatgaaagcactcctctccgttttgtgcacacctgcaacggcaccgggctggcctcaacccgggcaatgatcgcactgctggagacccatcagacgggggtcagtcggccccccccacccacccaaccacctgtttaaacagacacagtcattagtgctgctaattaacccaattatgtgaaaatttcatatatatatttaatgtcgaccgaccgcattaaaagcgccgcctgtctagctgtgcaaatattataacataatgcatttagataattattttattcaattcacgatatctcatttaatggttttaaattaaacgggtgtacgactccccccccctcgcacaaaactttaaaaaaattcaaacttttcaacaaaaaaaaaacataatctatttttaagaaaaaaaaattttaaaatcgctagaaaaatttttcggttttttttaattccctggggggggtgatggtggtggtacggtggatgggactgatccgaagcggattttctggcctggctgagcaagtaaaatgtatttccataattaagtttaatccaattcacgatatataatcccatttaatggcactaaattaaaattatcatcatttaagcgtcaaaagggtgtcaaattgccggacgtaatcaatgaacggatgcacactgaacgaagtgttggcatttattgtatacatcagaaaaatgcc

SEQ ID NO: 46249 - DNA, 1084 bp, Heterodera glycines; identical to SEQ ID NO: 31242
  misc_feature (23)..(23): n is a, c, g, or t
  Genomic contig location: Contig_ID=SeqID_31242; Location=1..1084; Strand=+
  SCN-specific regions: Sequence locations=1-83,105-153,175-313,335 -586,608-758,780-885,907-915,938-1084
  Gene Ontology: Mol. function=signal transducer activity; Cellular component=nucleus; Biological process=mRNA splicing

SEQ ID NO: 46250 - DNA, 878 bp, Heterodera glycines
  Genomic contig location: Contig_ID=SeqID_6450; Location=1435..2312; Strand=-
  SCN-specific regions: Sequence locations=1-878
caaaatcgtatttgtgaaaacgccccgatgctgaagggaagtgctgcgcattggactaccatctcgacgagctcactgattgtcttcggcacgactttcccagcacaacgggaccagcggcaatgatagcggagcccatccagggcatcggtggcacagtccaattccccgagggatacctaaagcgggcattcgacgagatccatgccagaggcaaataggcccgaattatttttggaaaagcgaaaacatttcaggaggacttaggatatgtgacgaagttcagacaggctttggccgccttggcactcatttttggggatttcaaagtcaaaatgccgtgcctgacattgtggcgatggcaaagggaatggccaacggatttcccatgggcgccgtaatcacaacaaaagaaatcggtgccagactgatggagggtggccgatacttcaatactttcggaggaaatccgctggcgtgcaccgtggccaaagcagtactcgaggtgaagcaatttcgaaacggaaacccattctaattgattgcaggtaatcgacgaggaaggactccagcaaaattgcttcaaaattggtaattttctgctgagtgaattgtgccgaatcgattcccgccttttgggagacattcggggaaagggtttaatgatcggaattgaactggtcgaagaggatggacaaagggtgttgggcacggaaagagttgagagaatattcgaatgcattcgacgggagggcgttttggtcggaaaggggggaaatgaagggaatgtgctgaggataaagccaccaatgtgcgtgggggaggaagacgcgtggcgatgtgccgaagcggtggcaaaagcgttgaaagaggaagag

SEQ ID NO: 46251 - DNA, 2076 bp, Heterodera glycines
  Genomic contig location: Contig_ID=SeqID_6451; Location=950..3025; Strand=-
  SCN-specific regions: Sequence locations=1-340,362-524,546-1317,1341 -1682,1706-2076
  Gene Ontology: Mol. function=ATP binding; Cellular component=nucleus; Biological process=cell cycle
atggctcaggaaatccaaatccatcaagcgctcgcccacccgcacgtcgtcaagatggaagggttcttcgaggatgatgacaatgtttacattctgttggagttgtgttcgcggcgctctctcatggaacttcacaagcgcagaaaggcagtcaccgagccggaagcgcgctatttcactttccaagttagccgagtttcgaattagcttttgccaactttagccactgattgttcagatcgtcgaagcctgcaaatatttgcatgggaagaaaatcatccaccgtgacttgaagcttggcaacctttttctgaattcggaaatgcagctgaagatcggcgactttggcctggccacggtggtggactacgacggggagcgcaagaagacgctttgcggcacgcccaattacatcgcacccgaaatgctggacaagaaagggcactcgtacgaagtggacatttgggcgatcggctgcattctctacacacttttggtggggaagccgccatttgagacggaaactttgaaggtgcttttttgtggttcataacttgtcactcaagtgtttcatttcgtttaggacacgtacaatcgcatcaaggccaaccagtacaccattccgcccaaaataggcaaagacgcggcttccctcatcactcgtctgctggcgccggacccagcgaggcgaccgcgggtcaccgaaattctcaacttccaattcttcacggacggctttttgcccaaagtgttgccgagttcatgtctgaccatggctcccaagttcaacatgcaggcggtgtcaggcggactcattcggcgacccgaagtgagtggaactggcattcccttttgctagaactaacattttctcactattagttggaccatgtccccagtcctcgtgccgccaaaggccccgctttcactggacatgcgccgctagcctccgtccccgagacgaaagtgcctccgcaggcggtggcggtaaagcaggacgtggcatcggtgctcatcactgagatggccgcgggtctgccgcatttgcgaatgtttaattgcagcgattgcttccgtttaggcgagaacaacgatgtgccggccgatttctacttgtccgatttgtacgcgcagctgtgctctctgctgaatacaaatcccgagcggttcagcgaagcggacaaaggtgatggatcagtgattgtgataaatacctgactgattctgattttctcagacgagatcgaagatccgagggcgcaacccttcttttgggtgtctcggtgggtcgactactcggacaagtacggactgggctaccagctgtgtgataacagtgtcggggtgctgttcaacgacaacaccaaagtcattttggacgcggctgggaagtgagtttggctccgttgaattagaaatgccaattccgttggccttcagtcagttgcaatacaccgagcggaacaacaccgaacacttttacggggccaacaaatacccgcaggcgctggagaagaagatcactctgctcaagttcttccggtcgtacatgaacgagcatctgatgaaggcgggcgccaacattaagatgcgggacggcgacgagttggcgcggctgccctgcctgaacacgtggttccggacaaagtcggcgattgtcttgcatctgagcaacggcactctgcagatcaacttcttccaggtgcgcattgaataaacacatgaatggtctaatattggtgatttctgcacatttattatgggatttgtcttttcaggatcactccaaattgattgtgtgtccgctgatgagtgccgccacatacatagaccagcagaagaatgtctttacctgcaaattccaatatttggagaaatacggatgtcctaaagatttgtgtcagagactcaaatacactaaggtaattcgcttgatgaaaactattgaataatcacaatttaggtccatattttttgcaaattcaggtgatggttgaacgtctgattgcgcggcatgaaaatccgaatgcgatgactgcaaaaagtggcaggcgtgccgaagttgtgccgcagtag

SEQ ID NO: 46252 - DNA, 1108 bp, Heterodera glycines
  Genomic contig location: Contig_ID=SeqID_6452; Location=1040..2147; Strand=-
  SCN-specific regions: Sequence locations=1-261,299-391,413-437,459 -523,546-1108
atgtgctctggcgtcccccagggctctgttctaggacctattttgtttcttatttatattaatgatttacctaagaaaattccgaaaggaatttttatcaaactttatgcagatgatgtcaaattgtattcaatacatagaactaaaactgacagagtgataatgcacgaagctctgaggcaattgtccaattggtctaatgaatggtgtatcgacatctctattaacaaaacctttgttttgtacttgggcaaaaataaccctagagaacaatataaaataaataacaacacaatttgcgaagtggacaccattcgagacctgggtattcttattgacaataaacttaaacttactgaacatataaataccgtaactagaaatgcttacggtagaatgcgatttttatttcggattattaagtcaaaaagaatttcaatatggaaaatcatttttatgtcgtatatccgtcctcttcttgaatatgctcctgaggcatggaaccctcagttaaaaattcacattaataaaattgaaaaatgccaaaagtactttactcgtatagctttaagaaaatgtaatttgccatatatcccatatggacaaaggcttgaactttttaaattaccaactcttgaaaaacgaagaaaaatttttgatattcttacaacatataaaataattcatggtctcacccacctagatccaaattccatgtttaaacgcactaatttaaatactaggaataaatcattttttgattaaattccaagtttcaatctaagaaatcatccatgtccttcgtaaatcgatcagttaaaagttggaattctcttgataaaacaatattagcaacaaattcgattaatacatttaagaaaattttaaatattataccaatgcacaaaaatttaaaagttgggagggattatccataattgacattgatctcatttatggtaatttgttttgacagtgattatttttatgatttattttcatttattgcttgttttctttattcacttgctctgtttcgctataattttgacagttacagagtaagtggtccccgcccttctgtgacttatttttcttgcttaataaa

SEQ ID NO: 46253 - DNA, 2464 bp, Heterodera glycines
  Genomic contig location: Contig_ID=SeqID_6454; Location=380..2843; Strand=+
  SCN-specific regions: Sequence locations=1-471,505-975,997-1476,1505 -2223,2245-2464
aaagatgcacgtggtgggcaatgccaagccaatgaaatggcaaaagggcgctgctcttcggcggacgaaggcaagcaaaatgcgcagagggaggaggggggcgcgtacaatgtgtggaccaaaaaggcgttggaacgagcggctgcgagcgcctccattgttcgtcgtttcgttgctttttgttctaaatgaaattcatttccccgggattatatttagccaaaaagtccggtggccaaacgcgaagagaatgacaagccggtgaaacgcttttaccccctcaacccgtgggagaagcagcaaccgaacaacaacaacaggcaaaacaagggcaaggagaacggcacacgccagccccaggtcatttggcgaaaactacctgacatttgacgatttgcaacttggtgactcgacttttagagactatacacttagggattccgacatttgaggctttcggcaattgtagggattttaatttaaaaaaatatttaacaaaaatttccaaaaaattatttcttaacaaaccaatttgacaatctcgttttcactcgaatgctcttggtgaggataagcttttaataaaaatttgtcgaattttcggctgaatacttagtattttcattaaaatcccccattgtcgtgtcccaaatgtcgggtcaacaaaagtcgctttataccaaatgccgagtcccctatgtcggaatccatgtccctaaaagactggtccaaaagttacaaatacccaaattttgcgcgatgcttggcactggagtggtcgaaatagaaaagaacatttggaaagaaaagtcccaattttcgtgtcttcaggctatgcctgtcggctgggtgctcggcgttcgttccaaaaccacgtccataaatgaagatgccggaccaagccatccgtcgacctccgacgctctctcaacaacggtcaagccaccggcatcgtcgtcgtcgattgccagcgttcttcctcctcatccctctttctcattgattcaagaaaacgggttcgaacagcgggttcgtttttcaggagttattaataaatcgtcggattctatggttgccgaatgatccaatccatgttcaggtgtacactgattggaggagtcagtgcaaaaaacagcgtgaggcacttggctacgacattcccgaggtcaagcattttttaaaaattatctcaaacattcaaataaaacaggccagtagcccgaaaaaaattctggttaggggggggggtggaatccaaaggccttgccattcgggccaaaaatattttacccagtgttatttttcaaaattttcagcgccgggagaaaaacaggaatctgtactggttttgggctaacaaatgacaaattttgcccttttacgggtctattttttcaaaaataatggcaaagtggggtccgacggtgccgatgggcgcgccaggaaattctttgcaaagtttattgaaatgataagaaaataatacaatttttttaaaaattttccaattcagatgcatacgctctatcggttttggtctctggttttgcgggacaatttccacaggtcaatggacaacgagtttccgtaatttgcactggaagacgctgaccatgggtaaacgaattcaaaaaggcgtcttctaaatgctttacctcccattcattcatccatccctttagccttcggtatggcattgaatcgcttttccgtttctacagctatgggcttgagaagaagttgcgcccgaagctgtacaacgatttccaagaagccactttgcaggacgttaagcgcggacacacttttggtctcgagaaattcctcgcctttttgaaatgtctctggcgtttgatttttttatgtatttttaaacgaaaatacgcttttttcagattgtaagtacagcactcaattggaggtgatgccacaaattgccaaggaattggccaggtaccgcagcaccgatttattcgccaccgaagtgagtgaagtggaaggttttactcggaccaggccgttttctacgagcataaattgttggctataactttttttttctttaccaacaaaatccgtcagtcttgttatcattcggcagccctaagtgtgtcctctattagcctgcaaaatttcagattaaaaaaagttatggtccgaagagttaaaaaaactggttgttcgaacgaacattttttgccataacttttttgaaccttaacgaaatttctcaaaatttgcaggtgaatagaggaattttagggctatcgaatgataccaagattgttggatttggttggcaaagaaaaaaatgttatagccaacaacttgcttgtacgaacacgcccctaacccattttaatgtgtgaaaattgaaaatatctatttaagccagcgaaagccgcaaaactcgaattgcagaacgagtcgaagaatcggagtggcggccgtaatgtgatggtcg

SEQ ID NO: 46254 - DNA, 418 bp, Heterodera glycines
  Genomic contig location: Contig_ID=SeqID_31309; Location=85..502; Strand=+
  SCN-specific regions: Sequence locations=1-9,31-32,54-160,182-239,261- 418
aaaaactattataagaatgtataagacttacgtcagacctcaattagagtatgctgttgaaatttggaaccctaacttaaaaaaaagatatagaacgaatagaaaaagtccagaaatttttcacgagaaaagcctttaaaaagtgcggacttttacatagatcatattcagaaagacttgaaatctgtcagcttatagaattagccaaacgaagaaatattgctgacttaactatcgcttttaaaattatgaagggttttacgagtcttgatgctagtaaactttttactttttctgatcgatcctctcgtaggccattacttttgagaatgcggcgcacaaccgcaaaaagcaagaataatttttttaacctataggtaagaattggaataatttaccaattgttccaattcagaca

SEQ ID NO: 46255 - DNA, 1295 bp, Heterodera glycines
  Genomic contig location: Contig_ID=SeqID_31321; Location=1..1295; Strand=-
  SCN-specific regions: Sequence locations=1-206,229-327,354-1295
  Gene Ontology: Mol. function=ATP binding; Cellular component =mitochondrion; Biological process=protein biosynthesis
atttttactttagtaatattcccatctgtctttttcaaaattacttttgttcgcaatctttcgttaaacgaatagtgtacacacaccgatcgggaagacaggtggtaaaagtaatggcattattagttattagggcaaattatggaaaaaaccaacagtgttgaatccgggatacgacttggccgaaatcaaaatattcactccagaatttattttcattttatcctttgcaggtaaaagcaaaaaaggaggcggttatgaagaaaaagatggaattgggcgacgatttcaagtccaaatacgagttgaagactccgaaaggttgccatttttaattttaatataatataattcaccgatttgtatagaaaaatatccggcccaaaattttcttgcgccataaatcataaattatgtctaaaaagttatctgtctatcgaaatttttcctttttctgtcatctcgaatggattgtattagcatgttggattttaataaaaaaatgaaatgtcaaattttttttttactaggtactcgcgattttggacccgaacaaatggctactcgtgaaaaagtcctggcaattgtcactgaaacttttaaacgacacggagcggtgacaatggagacgccggtgttcgaactgcgcgaagttttgatgggcaaatacggcgaggagggcacgaagttggtctacgaccttgccgaccagggaggcgagctttgctctttgcggtacgacctcacggtaagttaattttttggcaattttatctttccacaattctaaaaatgaagaaatgctttgcttcatacaaataaacgcattcgaatatatggacaattagcgggagttcgttcattgttttaaataaagttgtgacaatttttttaattcgtccaatttaaggttccttttgctcgttatttggctgcaaataaagtagaaaagatcaaaagatatcaaattgccaaagtgtacagaagagatcaaccagtgatgacaaaaggtcgttaccgggaattctaccaatgtgtgagtgttgaatttatcacaaaggattggaaatgtcacccaaatttaaaattaggactttgacattgctggaaatggcgaagtgatggtgcaagaggccgaatgtttgaaaataatggacgaagtgttgaccaagttggacatcggtgcattcgaaatccgagtaaaagcgaaggcgccattcactgctctttacgcccttcccctcagataaccaccggttgttgttggacggagtgttcgctgctttgcgagtccc

SEQ ID NO: 46256 - DNA, 844 bp, Heterodera glycines
  Genomic contig location: Contig_ID=SeqID_31347; Location=108..951; Strand=+
  SCN-specific regions: Sequence locations=1-196,218-588,610-844
  Gene Ontology: Mol. function=ATP binding; Cellular component =cytoplasm; Biological process=protein biosynthesis
atgacatgtgacacagtcaacagagtgatggccgacccggaaatacgcgaacttatccagcagcagtggcaaaaggttagtgaccacagccaagggcagagatagataaagcgatccctttgggacaggattcccaatatgagttcgtcgctcccaaacggccttttcttcggatgacttatgcggaggcaattgaatggcttcaaaagaatgaagtgatgaacgaagaggggaaacccttccaattcggcgaggatattcccgaaggccctgagcgatttatgaccgacacaattggacaggtctttgaatccctcgtttttctttcacaatcgcccgttcccttcagccaattcttctcaatcgctttccgcatggaattaaggctttttatatgtcacgttgtgcagatcaaccggaattgaccgaatctgtggatttgctaatgccgggcgttggcgagatagtcggaggatcgatgaggatttggaaggaggacgaactgcttggggccttccaaaaagccgacatcgatcccaagccatactactggtacgtggaccagcggaaatacggaggttgcccccacggaggttttggacttggtctggagcggttcgtatgctggttggccaatcagcatcatatccgtgatgtgtgtctcttccctcggtacatcgggcggtgtgcgccgtagcttttttccgtctttgaaaaggaccaaaaacgaacccatacgaatatgggtattgttcatttttggcgttaaaacaaatgtatcttctaaattgtgcattttttttgttgttattgcataaagggataaaacacatgaatgttcaca

SEQ ID NO: 46257 - DNA, 3000 bp, Heterodera glycines
  misc_feature (6)..(6): n is a, c, g, or t
  Genomic contig location: Contig_ID=SeqID_6478; Location=1..3000; Strand=+
  SCN-specific regions: Sequence locations=1-428,450-456,478-593,616 -721,743-875,897-940,963-1097,1139-1181,1208-1330,1354-1436,1467 -1549,1571-1662,1684-2534,2556-3000
tatttntgtggtctaataattgaaaatatgtgaaacccccccagcattcatttcaatttcttgaaaatttaaatttgctttatgtgaaaattccaaatatgtaaaataatggcattttctataaaaaaaagttatttaatatacataaaggtatgcttttaagtataaagacattaaaatttcatttcataatcaaattaaaaagtaaaattttcggcaaattatcccttagaataaacttttcatttttagtcccaccacttgttcaaaatcgcgaaatatggagataaaattgcgaaaatctcaaaatggacataaaatggcaaaaatatggacataaatttttcaaaattaggggtacaatttcttaaatttcttcattttcgctgaatgtaattaaaattttcaaaaatgggaaatatggtatcaaagccattttagaataaaaaatacacgataaagccaagatttactcatttttagcgaaaaatcaaccggaatttttttgcttatttttgacatttcaaaaagcttttgattctgtccctcacaatttactattatataaattagaaaaaattggtattaggggcaaacttttaaaatggataaaagaattcttaagtaacagaatttttcgcgttaaaataggggattcattatcctctataaaaaaagttggctctggcgtcccacagggctccgtcctgggtcccttacttttcttaatttatataaatgatcttcctgatgttataccatcaggagttaatattaaattatatgctgatgatgttaaaatatatatatgctataaaacaagatctgaaattgaaattatgcataaaacattgcataatttatttgaatgggcaaataaatggcaaataaaagtttcagttcaaaaaacttttatattatatttgggtttcaaaaacccaaaagaaacatataaatttgatgggaatacaataaatgctgtggatacaattagagacttaggggtaaatatcgataataaattactgttttctgatcacattttacaaataacaaagaatgcatattcacatatacgatccttgtttagaataataaaatcaaaatcttcaaaaatttggattattttatacaaaatttttaagccatctggtcgctttaactccccctcttatagacttaacacaaaatataacaaaaaatatattccatttacgtgagggcaaccaaactgtggaatcaattagataaagaacttgcaaaaataaattcattaaaacaatttaaaacaaaaatcaaaaattctttagagtaattaaaagcaggactgaaaaaaattttttttaataaatagttacataagcgattcgataattttgataaatttgagccgctttgacttatctttattttaattgtgtgacttgtgatctctcttttaatattttattcattttttattttatccgaattacttttggacaattaatttatacatatgttgtccacaaagtaagcggattttcccttttgtggaccttttctttattgaataaataaataagtaagtgaaaaaactcagtgaaaaataatatagtagaaaaaacttatatgaaaaatatgtcaatgaaaaatacatcagtgacaatacgtcaatagaaaatgctttaatggaaaattcgtcaatagcaactttaatgctaatattaacataacaaatttttcccaggcggcacttatcggcaccgctggactccaaaattaaataaaatgccgacgctaatttaaaaaatcatttattctggtttttatataaaaacgaaaggacgcattgatttttaaatggccattgccatgcaactaatggatacggtaataatgccaaatcaaatcttaaggtatcaaaaaaattcccaaatattttcggctttgacttgaaaaatgacatactttttaatacagcttttagaccggtttaacattagtttccaaataatgctgaatcctgtcaactgagattttaccaaaatcgttaagattgaccgatattagacaaagttacgacaaaaaacactttgattataaacacatgcatcatactgtatatcagggatgggccaaatcgaatgataccgaaccgtcgcacccagtaaaaatggtgaggaaatcactccaaatggtactcttttaaaacgtagaaccaaaagattttcttgtgtaattggttttcttatatctcttacccaaaaattttacaaattctctgtcttcctcttttaactacaatgtccaaaatgctcgttgaatatcagtccataaagcaatttttggtattcgtgaacgcattaaaagccctgggagctgtggcatttcgattgggccacgaaaaagcatgtcatttaggcatttaccactcctttttttgctgagccatcataaacaatccatggctttatttcccggtgcgaagacacaatgatgagggagaaaatgttcgccaaaccattttattgaagattcttcgacaatttgctcttttaaattttctttaaatgactcttccaacgctttaagctgacttggggttactctcattttttctaacatactcattaaacgccggtatgctatggcaaaatttgttggtaattcttctttagggcttttccatgaccaacttaccatgtatctcccattttttcgttgaaccgtttctttaaacattttcaaggcaatctcatcatccttctcttccgggttatcccatactcccatagtttctaaattccaaaattgttttggttccttattctttacactgattgtggctgttatattttcaaataatgattccaatttacccgaattatttttcatttgaccgcaaataatagggccgactgatgtgtctaccttaaacaaatttcctttaatgtgttcgacccctttaaagaacttttccaaaattctgccataccaatcagtatgtcaggtctttca

SEQ ID NO: 46258 - DNA, 2971 bp, Heterodera glycines
  Genomic contig location: Contig_ID=SeqID_6489; Location=1..2971; Strand=+
  SCN-specific regions: Sequence locations=1-575,599-669,704-1010,1032 -1522,1544-2170,2192-2221,2276-2517,2539-2651,2673-2843,2865 -2910,2933-2971
  Gene Ontology: Mol. function=protein binding; Cellular component=COPI vesicle coat; Biological process=intracellular protein transport
tttccggaaatttagcacttgtgacacgtcaatatgtggcagacatgaccagagcacggttggaaggacttttgaacgcttttcccaagcttatcacttcggataaaggtaaaaatgaagtcaatttttgtcgaatttagtttttagctcagcgccaacatactttcgttgagacaaattctgtacgatatgtctatcagccgatggacaacatttacatggtaattctattgttttttgttcatttaacagttaattttcaggttttgatcaccacgaaagcatctaatattttggaggacctggagacgcttcgtctgttttcccgagtggtgggttagggttattattactaacatttgaatcagagcgcgggaaagatttgttctcccttgaagggttcgaggcataactttgaatatacacagtatgcgataaaagggccccctcaccaatttccgactgcggcttggctttttcaaactaattctcattcattcatttaagtgcacgccataagcaaaatttcttatcatttacataaacaaaacaatagctttttacactaaactgaccaaacaaaaaagcaaaacaaacatttcattttacaaatcattattcaacaatgtgctatctctaaaacatgaaagacacagtagtgtgcatctcaaaccaatacattttttaaaaaacttgacaaatttcagttctgtgtctcatggatgagaggcacaatagtgtacatctcaaacaatatattttaaaaacttggacaaaatttcacacttctgtgggtttacaaaacttttagtgtacatcgcaaaacaattcactaacaaagaattcttttgacaaaagttcacactctgtgggtttctaaaacttggtaggcacattagtgtggatctcaaaacaattctaataattacatataacaggtaatatgattgactaacataagccacacaccacactaatgaattttctaaccaataataacaaataattcatttaataaattcaacatttttctgacaaatcaacaattttaaagcgcaattacaaaatgaaaattatatccgtatttgataatgtgtgaggatcacaaatataattaaataacaataacgaacaaaatatcaaaaatcaaacataaaatacgtaatcgaaaaggtatgagtcacaaatcaaatctaagcaacggacaacaaacgaaatactacccatttttttgcgacttcttaattggctccaaagtttccgaactacgacgtttaattggtgtcgtcaaaatcgcctcaagattaacgcgcccagcaccaattttaacggatgaaatctcgcaatggagctgaaggcattcatctatgataataaaaaaaacttgaaaactcaaattaaaaccaaaggtaatgccgacacaattacaattaccttcaactttcacaaaaaaaatttgaagttcgatctgtgtgttcttaacgcatgaaccaagacgttctaccaattcttcgccattgacgtacaaatcagccctcattcctttcttgtccgcaacgactgcagcgaaatgtttcccgactggcgaaaacgatgaagcgagagcacaattcattgctttaaaaaattaaaagtcaaaaacatttatttatctctcacacaaaagtcacagaacaaaccactaatgttttatcaaaaacatgacccacattattgtgtcacacgaaagtcacacaacaaacactaatgttttatcaaaaacatgacccacattattgtgtcacacgaaagtcacacaacaaacactaatgttttatcaaaagcatgacacacattagtgtctcacacgaaagtcacacaacaaacactaatgttttatcaaaaacatgacgcacattattgtgtcacacgaaagtcacacaacaaacactaatgttttatcaaaagcatgacacacattagtgtctcacacgaaagtcacagaacaaaccactaatgttttatcaagagcatgacacacattagtgacttacacgaaagtcacagaacaaaccactaatgctttatcaaaagcatgacacacattagtgacttacacgaaagtcacagaacaaaccactaatgctttatcaaaagcatgacacacattagtgtctcacacgaaagtcacagaacaaacactaatgtttatcaaaagcacgaagagtatattattgctttataaacacttttacaaaccaagtaatatattataaattaataaaaaaaattaaaactcacaataaatgcaacccgaagtcaatttctcaaatgaatccgcagtcgcaatggcacattgaatcacctccattcttgtgaaagtcatcaccacaaattcataatccagtggcgtaacgtaaattgtctttccatcgaaacgctcttgaaagcgttgagctttcagcatgtaaaatttgacgacctgtatttagtaaggtaagcactgtaaaaagaaacagcaaacttacaattccaagggaacaaatttttgaaaatttggacgacacgctcttaaattctgtgagaacaacattctccccagaagcacacgccaacaaagccgtcaacttcttctcagacggtaaaatgcttacaatctgcccacaaaaagaccttaacaattttacttaaaacaaattactaattcaagcacttacgcaagctgagtgccacatggtgtggctttgagctcttccagagtcgtaagcatggcaacaggctggcaccagatttgaaaaagcctaaccggtagaaaaaatgagccgtagcggcagaaaaacaacgataaattgtttagtcaccagatttttgaccaaactggtagaaaaaatgagccgtatcggcagaaaaacaattctctaattgtttaacaattctaaaataaaacaaaaattaaagtaatatatgaaataatgtgtatacaacaaaaata

SEQ ID NO: 46259 - DNA, 1311 bp, Heterodera glycines
  Genomic contig location: Contig_ID=SeqID_809; Location=379..1689; Strand=+
  SCN-specific regions: Sequence locations=1-282,304-569,591-1311
atggcatttcacaaaattgacactgactccgtgaactcaatcaccaatgctttggactttttccgcattcccccgaccaatgtgagcgtctcttcgtccaaagtgtttgagcttctgcccagcaaccctctgaccgacacaccataccacttcaaactccactcaagccaaaactacattgatctttccaaatgctatttgctcaccgagtttcgaatccataaggaaaatgctaatggacaacttgttaacctaaccattgatgatataaacattgcaccaatccaaatgattggccaaactttcatccgcaacataaaaatgagcatcaatgggcgcgaaatattcaatgccaatgcactgatggcctacaaaacatatttttcacatgagctttcctattcaacaacggcaaaggactcccatctgaatgccgcggggtactaccgagacacgggcgactcactggaaatgggagacggatgcacagcgcgacgtgatttgtttgcgaatagtaatgtagcccaattcattgccaaaattgacaccgacctgttcaatcagccgctgtatctgatcaacttttgtgagctggacattgaaatattacccaacgacaacgaatttgtgttaattgcgccgaccgggggtcggtaccgtttcgaggttgtgggactgaaattatatgtgaaaaaggtgtctctgatggacgggttggcattggacattgcacgaaaattggaggtgaagcctgcccgttatgcagtgaggaagacaatgatgaagtctgtgttcatcagtccgggtcggtatgagttcacagccaatctgttcatggaccaaattccccgtcgtgttacaatggggctggtggcgaatactgactatgtcggctcaattaggcgcagcccattcaactttcaaccatttaatgtgcgcgagatttccattgttgccaatggtcgatcttacccacaagcaccctatgacttggactacccgaacggaaagtatgttcgtccattcaatgatatgaacgaagcggtgggattcgcaaattcatctgagagcaatggcataacttttgcccaatacggtaaaacccattgcatttacgtgttcaatttgaccaacagcggggatgatcaagcggcactgtttgatttgataaagaatgggaccacagcggtgagcatcaaatttaaccatccagtgcccgagggaggaataatgttggtggtgatgggcgaatgtgactctcttgtgatgttggacaaaaaccgatcgataagcaccgatatcactatttaa

SEQ ID NO: 46260 - DNA, 799 bp, Heterodera glycines
  Genomic contig location: Contig_ID=SeqID_31447; Location=577..1375; Strand=-
  SCN-specific regions: Sequence locations=1-410,432-799
  Gene Ontology: Biological process=embryogenesis and morphogenesis
acgacttggacattgcgcctgatttcttcgatttcttcttggccactcggcctctcctcgagtccgaccgctcccttttctgtgtttctgcttggaatgacaacggaaagaaaggactcgtcgacctctcttttggggcgtcgcttctcttccgttccgacttcttttctgggctcggatggatgatgaccaagtcattcacattcttttttgttgaccaattccaccagaatttagggatttttggaatgaattgaggccgaaatggccacgcgctttttgggacgactttcttcgtgagcctgaacagcgcaagaatcgttcgtgcattcgtcctgaaatatcgcggacggcgatgactgaatttggacgcattggagcgagcaagtcatctcgacttaaaagaccacgataacatggaaaaacccttcaggggtctgtttttcaaccgacatttgcgacgagtattcctcaatcgaatgcctgtgaattttacgcggattgatctcagcggttttattcgaagtgaatatgacgccagtttcttggagagagtttattcggcgcaaaaagtccaaatggaaaacattttggaatggagtaaaaacagcggagattgtcgaattgagtacgaatcgatggaggaatttgtgtcgattgctttgagagtgggcgtaatggcggactcaaaagccggggtgccacgaacggcgtaccggggagtggtcacgtgttttctgaatggcacgcggttgttcattgcgccaccgaaaaacggctggaacggatacgaccgaaa

SEQ ID NO: 46261 - DNA, 1626 bp, Heterodera glycines
  Genomic contig location: Contig_ID=SeqID_6502; Location=841..2466; Strand=+
  SCN-specific regions: Sequence locations=1-213,251-256,279-781,806 -1023,1104-1111,1133-1626
atgatttcaaatgctgagagtcttttggtcatgtttatctcccccaaggatcgcactgtcgttgtccgggagcaggacggaacgctacgaacggcgttgccggaagaacacgatcggatgaatcggctgttttttgtgcaacccaatcggcctgtcaacgaaccgccgctgtttgcaatgaccgacgaatggttacaggtgcccaagaaaccctttttttatataaaaaaacaaaaaaattttttttattgctctggcaaattggcatccaattactgaccattcacaatttttaggccctaacttttttttcttactttgtcaatgcctaatttttggtatcaaacgaaagcttaaagtctcgggaatttataaataatttgcaaatattgacattagaaaaaaaaatgacaatcagagaacacgacaatcaactcttttttttcgagtatagccaagaataatttttgccgttgcttttagcccggaatttaggtctatcaaaaactatagactttaagtttattttgataccaagactttttaggcattaacaaagtaagaaagttaaggcctaagaaattgaggatggtcagtggttggacggtaagctgctgtatagccaaatatttcagatttcgcaatttttttgaattttaaaattttttcacatcctttaactagagtgccacgggaccgggaattttgggcaaacccgggaccttttcgggttgaaaacccgggaatttttggcaaacccgggaccgggaccttttcgggttgaaaaccttttccccttttttccagaagacgctggaccgtgatgagcatgagtttgtgctggactgggcctgtcatttttacgagccggacgctcccaaatttgttgaggtccatcattttttgtcagaaatcggtggcatttttcggggggactggacaaaatctcgccgccggaatctcgccgggacaaaatctcgccgcagaaatttcaaacaaatttttcaaggaaaaaattcctagaaaatttttaataaggaaaaattttcaaaaaaaacttaacaaatattttttttttttgaaattttcttataaaaaattttctaagaattttttccttgaaaaatttctgtttgaaaaaattttttttgaaatttctgcggcgagatttcggcggcgagattttgggatgtaccctttttcggaatttttttcgtaattcgaaaaatttatttcactcccttcttttcttttcaaaattaaacgactttgtttagctttgtaagtacatttttgaccacacattggaaaatgacaagttggacgtgctgtactccaccagacatttcggcacattggccttctatttggtgatcaacggcaaaatggacaaactattggaattctatgagcagaagaacaggtggtcaccagcgttttcatatcatcaaaaagaaaagttaccatttcccacaaatccttttgatcacatttatggccaaaaaggtggaaaatctggttttttggaaaaaatttatgtctcaaatcatgagcaattttcagaataagcataaaaattctatgataaaactcgtacgctttccatataacccgctaatggattaa

SEQ ID NO: 46262 - DNA, 1400 bp, Heterodera glycines
  misc_feature (1376)..(1377): n is a, c, g, or t
  Genomic contig location: Contig_ID=SeqID_6509; Location=742..2141; Strand=+
  SCN-specific regions: Sequence locations=1-156,178-206,320-368,487 -751,935-1158,1180-1301,1324-1400
  Gene Ontology: Mol. function=structural constituent of cytoskeleton; Cellular component=neurofilament; Biological process=embryogenesis and morphogenesis
atgcagcccgacctgcagcctccctattgcgatggtcggtcgccaacgctggtcaatcggctgccgcctttccattcgaccactccgatgatcacgacaatggcacagacaagcgcaaaatcagtggaaaagacaaatgaagaggaaatggcacaatcaaagaaaggaaaagcaaaagcgacgacagccgaattttcaggagatgaaaaagaaacggacgaaggcgaagaggaaaaagacaaaggaggaaaagtagaaaagaaagagaaacagcaaaaaggaagtgacaaggaaaaggagggacaaagacaacagaagatactgccccaattggagcaaattgaagaacagacggaatggcaaccggtgagagaggaggaggcaaagaaagagacagacgacgaaagagcacagcaagacggagaaaatgaaagaggaaaagaaaaggagcgtcaggaggaagagggagccaaagaaaaagagggaagggaacacgaacaacaaaagtcggcacaacgcaaaaagacaacgaacgtcccgggcaatgccattgagccggcaattatcagcagtcggaagccggccattgtgaccatccaaagcaaagagatagaggaaatgccgccggatgcatttgacgatggcagcatcaggacggcaccgacccctcgggcgcaacaaatggaagagttggagagagaaatatccggaagcattgtgccggaactgattgtgccacaagtgatcgtaggagggaaacggaaagaggaaaaaggggaggacgaagaggaaaagggagacggaaggcaaaaaggaaatggaaaacggaaagaggaaggaggaaaagggaaagaagaaaaaggggacaaagaagagcaaaaaggaaaaggaggggaaaaagaaaacggaaaagggaaagaggaagaggaagaaggaaatggcagcaaaacatcggcatttttgcaagagaaaaccgacgaacacaacgccaatggcaatgataaggtattatcgtgttagaagaatgaatctgaacagaaattggttaagggaacaacaaattccaaggcgaaaaacgaaattcgaattgagccaattgggacaaaaggacggacaaatgccaaggcaaagcctacggcaattcccgcggaggaggcagaagagggccgagaagacgagcagaggcaacagcaagccgaagaaaagccggaacagcacgagccggcgtcgtcgagtgccgtgccgccatctccgccacaaaggcaacggccgacgacccccgaggcgaagagaacggcacggccatcgacagaaatggcaacaacggaggaacagagggaaacaccaaaagggaaaattgacaaagaaaaggcaanncactcaggaacacaccagcagaa

SEQ ID NO: 46263 - DNA, 2008 bp, Heterodera glycines
  Genomic contig location: Contig_ID=SeqID_812; Location=324..2331; Strand=-
  SCN-specific regions: Sequence locations=1-263,290-621,678-680,702 -710,732-924,956-1004,1026-1552,1575-1747,1776-2008
atgactttgcttattataaagtcttatggagttgctcagagagtcttgactgtggatggggtccaggaatttcctggattggtgaagattgtttggtatttcaatttttataaattatatcgattgtgcaaaattaaggacgcggagtccttggaaaaattttacattgcaaaaaatgaagaggcccacgctgaattggatgccgttgaccaaatactcaatgagccgtttttattaggaagtgcacttgcagcagctgcagttgatggtggtggtggtggtggtgatgacgacgttgatgatgctcttataatagcgggagaggatgtaatcaaattttttttgaatttttactattttttcaaggcaaccgggccgccaaaaaagagtacaaaacgaggtggaaaaaagtatcgggctttgagggagaaagcccaagcactgcgtaacactgccactgaagcagcatcaacattgtcatcttcctcatccgttaatacctcgatgttcaaaaaaatgtcgatagagtatgcacgaagagttgcccagctgcgtgaacaccgaaaaaagaaattaccgggtatcagtgaggagttggtcaatgtgagaatgggttgtgggttttaaataaaataataaaagaattttaaaattaaaataatatttagtataaaattcaaaagtataaatctcctttaaagaattataaaatatgattatttagcagaaatctaaatcacaaaatttatactaaatcaaacgaatttgcagttgtttaccctaaaacattatgagtactccactgcacgccttcaacgcccggtgtccgaggggttggcatcagtggaacaaattcaaaattttacggagggcataacatttcaaggggtacacaatggctcagttactgctgtgcattttcaggcatttttaaaacaaatataattgtgtttttaattttcgtcgcttattttcagaaaaattacattttaagcggtggtgtcgacaaaacaattgcttttattagatttgatgctgatacccaacggagaacttttttggggcattcgtctaaaatttctaaagtccacctacaccaaaacttagagacatttgtctctggctcatttgattcaaaggctggttcatcttgttaaaatatttctgctaattttcaattacgtccccccccccccaaaaaaaatttttttttgtttcattcaggtcaaaatctggagcactgaacaacccaatgcacttcatacaattgctattcatggaaaagccgtcacagacgtatccctgcatccgactggcgattacgtgctctgttcctcagaagactcacactggtcgtttattgatctccacgctggacgtccactggtcaaagtcaacaatcgttcttcacctttgctaaccacattactcgaatttaaaaaaattttctcaggtcaaatctaatgatgatttgctgggcatttgctgtggtcaaattcaccccgacggactcatctttggaactggaggaaaaaatgccatcgtcaaaatttggaacatcaaagagcagaccagcttggtccagttcgagggtcacaaggaggcggtgggggccatttctttttccgaaaacggatattatttggctaccgggtcaacggacggcgaagtgaaaatttgggatttgcggaatcaaaaaactgtaacctgttttgcgccttacgatgttaaaaaatcggtgaatgacttttaaaatcaaaatttttattttttatcttcaaagattaactgcctcacgttcgaccagtccggcaaatatttggcaatcggaggagagagtgtcaaagtttatggagtcgaagaatggaagcaaattttggaaatgaaagcccatacccaggaaattacgggggttgcattttcggaagatgcaagaatggtcatttcgtcaagtcttgacggaaatatttccacctttttttaattctcattttgcaattataataaa

SEQ ID NO: 46264 - DNA, 591 bp, Heterodera glycines
  misc_feature (512)..(512): n is a, c, g, or t
  misc_feature (567)..(568): n is a, c, g, or t
  Genomic contig location: Contig_ID=SeqID_31594; Location=615..1205; Strand=+
  SCN-specific regions: Sequence locations=1-591
aaaatgcagagacttgctaaactggccaatactggcggacttttaattcctttgtctggtgccgttcagacaatttcgacgaggggcgttcttcgtattccgcactgggagaatcacatccgtttcgacccccgatttggacgcaagcgaccgtgtcaagatgtattggaccgattcgcaaggctgaacaatggtcttcttctttttttatgcttcattttcttttaaatttacaatactttccataaaggtttgtgggtgcgatcgcgacaaggcagaaacaaacaagtttatcagaaggacgagatttttcgaaaagtcaatatgcagtgggacacgtgcaccaaaagagaatgtgcaatgcttgacaaggtccccttgtcatgacaatatttatcttttcagcgcactcacattgtttctcttaattcaatttgtgtttagcttatgactccgttttggcttcgtcccaagcattacgtcggtgatccaatggagccttatcacacgcngtatgggatcactttcgcacgtgtcgatgatcaaaaacgtcttgtgcgagaaggnnccaactcctgctttgacgattga

SEQ ID NO: 46265 - DNA, 1524 bp, Heterodera glycines
  Genomic contig location: Contig_ID=SeqID_6537; Location=714..2237; Strand=-
  SCN-specific regions: Sequence locations=1-501,523-524,590-590,835 -894,1156-1183,1214-1235,1442-1496
  Gene Ontology: Mol. function=transcription regulator activity; Cellular component=nucleus; Biological process=actin filament organization
ccaccccaaatggaattgatggcacaccaccacaacgaatcgccacccgttggacgattggctccgaaattatccctttcatcgacgcccggcacaattagcggaaatggtccgggggacaatcaaacgacggcatttactggtgaattggcatttcaataaaactaattaagagaaagtttgcagcgtaacgtaatattttcaacccattcattcagaagcactctctccggaccattcacaacaaatggctgtgatgcaacaattggcagcccaacttggcctttccaacggcggaaacgcgacggaaggcgaaaggaatgcgttggagcaactgcttggcagtggcggactccatttggccgaactgatggcacacgctcaaaaccagcaacagaacactgacatgaacaggtggggaaccactgactacgcgttgtttttgctctgatcattcttggcatttctttctgcctgatcacggcctttgaccatttccttcgtcaggtgcccttccccgtcgtccgtccgttctccgcccgccactctctccggctctgacctccaccaccaatcccagcagaatgtgtcctcctccgtcccctcctcgtcgtttgcttgtgcacagtgtgccaaacactttcccagccaatccgccctcttccaacaccaattgatcgctcacatcggcggcaccgatgcgccccagcagcagcaacagtcgaccgccagcaacgacactcagtcgactgttaacgcattggcaatgttagcagctgcgggaattaacgggggaagtgggacgacgcaacagcaacagcagcaattatttggtgagaaaggaggggacaattgaaagttccaagagcatcagatgagtgggctttaaattcaggacagttgctcggctccaaccctttctcacaaggcacaacgccttcgctgatgttcaacaattcgtccgcttttggcggaattaatccgacagagtttgacggtgccgcaatgttggcgaaactgagcgcagagttcgccgcggttgcccaggcacaacacggtcaaagcggcgctatttcagccacaacggtacaatcgacgggagggccgtcgacgcagcaaaacggagcaatgggcaggggacatacgccggcgccggtaaatttctttaaagttcggaaagcaatgaatttataattgaaattcattccccctttttaatgtttgccacaatttcagtccaacaaaccgccgcctcagaaacgacaatattcctccaccagcaaaaacttttgcgacttgtgcaacaaagaggtgtgcaacaagtacttcctgaggacgcacatgctgaaaatgcacaacataatcatagacgagaacaaacagctgatagcgaacattgacacggtggacaaagaacggaagggcgaggtgaagttcaggttggagatgagcagagggaatgggtggcgaattgtcattggtttggtcccaccgttaggtgtgacatttgccataccagcatga

SEQ ID NO: 46266 - DNA, 1233 bp, Heterodera glycines
  Genomic contig location: Contig_ID=SeqID_31634; Location=1..1233; Strand=-
  SCN-specific regions: Sequence locations=1-81,104-297,319-493,560 -912,934-975,1010-1233
  Gene Ontology: Mol. function=ATPase activity; Cellular component =spliceosome complex; Biological process=mRNA splicing
ggccgagtcgtctcgtgacgaaatgctgtcaatgtacggggttattctgttggacgaagtacacgagcggacgatgatcaccgacgtggtcatgggactggtcaaagtcagtggtcccatttcctttatcccagatgaacatttttataacccccgcttcatcagagaataatgcgacatcgtcccgaattgcgagtggttgtgatgagtgcgtcgctgcaaaccggcacatttgtgcaatatttctcagagttcgattatcttacaatgaaaatcagcggacgaacatttcccgttgaaataaaagtatttaaatatttactaattggaatttaatcattacattaaaattggcgttaattattcagcactccgattgggatttgacctttgagccgaacgaatacatttcaaaagctgtggaaaaagccattgcaattcatcgaagggaagcgcacggcgatattctgctgtttctttgtgggcaagatgtaaatgaaagtttttaaaaatggaagaaaactattaaaaataataaaatttaaaaagtataaaattacaactaaatcaaggagatcgaaagggcctgcgaaatgcttgaagaagaggcaaaaaaatgccgtgaaagtggccaattggtcggttgcatttgtgccgttaaatgccttttcaatatttcattaggacgttttgccgctttacggctcaatgcaactcgaacaacagcgcaaattgttggaagcggagcaaaaccaattgactaatggtgaacgcttaatggaaatggaaatattgattaataattaatttgccggtgctttagcaattacgggttatcgccgttgcattgtggcaacaaatgttgcggaaacatcaatggtgggttggtcatgttatgccgcagtctttcattctttttcttgggcttcttcatctttgtaaataattatccccttgaataatcctctgattaactctctctaatgctttttccctcccttccctttctttaatcctctgctttatctctccaatgcttaccctcatagaccatcgatggcgttgtgtacgttatcgacccgggcttctgcaagcgcaacatttacaaccccaactcgaagatcgagtcgctgctcgtccaacacatttcacgcgcctccgccgtccaaagggccggaagggcgggtcgaacgcggcccggcaaatgctttcgcctgtacacggagcattgct

SEQ ID NO: 46267 - DNA, 1488 bp, Heterodera glycines
  Genomic contig location: Contig_ID=SeqID_31654; Location=222..1709; Strand=-
  SCN-specific regions: Sequence locations=1-31,53-352,374-659,681 -840,862-1391,1414-1415,1437-1488
  Gene Ontology: Mol. function=calcium-transporting ATPase activity; Cellular component=integral to membrane; Biological process=hearing
atgaatgttcaatcgccgctttacgccgttccttgcaaaattgatccctctcccagcagaaggacagctactctcgacagaatgagtcccgattccgggcatcgagactctgccggagtgtcgggtgccggtgccttcgatgtgacgatagaagaactgcggacattgatggaatttcgtggaggcgaagcattggagaaaataagcaccgactacggaaacactttgggcctttgcgaaagactcgcgacagacccaaacaacggaatagcgaatacgcaggacgaactgaagaggttgcctttgctggccatagtccgacaaactcttctttctttgacttttccgattattcggccctttgttggcttttaagccccaaagtgccgatgaacatcctcgtttgattgcccatcttttaaattttaaggcctctgtgtgaattgacctttgaaattggaatttcaggcggagggatgccttcggtgccaatgaaatccctcccctcccgccaaagtctttctttacgctcgtctgggaggctctccaggtctgtccgatggcatttcttaatgagtctttttgtcggtcaatttaggacgtcactctgatcattttacttagtgccgcagtcgtttcacttgccctttcattttataaccccggatcggaactcggaggttcgcttttccatcatttccaatcgccgtctttcctcaggtggaaaagacgaaactgagcaggaagcgggttggatcgaaggtgcggccattttgatttcggttgttgttgtcgtactcgtcacggctttgaatgattacacaaaagagagacaattcagaggttggccatccccgggaaaggcggacaaaaaatgaatttaatttgaatttgaatttaaggattgcaagcgaagatcgaaacggaacacaaattcgcagtgatccgcggaggaaagcagctgcaagtggtggtcaacgagttggtggtcggagacattgcgcaagtgaaatacggtaatgatttgccggaaaaagcggacgatggcactttgacaagccgaccattggcacttttactcattgacactttcccttgcttcttcaggtgatttgctgcccaccgatggagtgctaatccaaagcaacgatttgaaaatcgacgagtcgtcgctgaccggcgaatcggaccaaatcaaaaagtcggccgagcatgacccaatgcttctttcgggaactcatggtcagtggtgcccattttgttgttcgcactttccttttagtgatggaaggcagcggtcggatggtaattactgcggtgggagtcaattcgcagacgggaattatcatgacacttctcggcgcggcaaagtcggcgatggaagacgagcggaaggagaagctgagggaggagaagcggcggacgaggcgcaggagcaaagcatcaggtcagtgggagcattggccaattgaggagaatggtattcgg

SEQ ID NO: 46268 - DNA, 961 bp, Heterodera glycines
  Genomic contig location: Contig_ID=SeqID_31703; Location=210..1170; Strand=-
  SCN-specific regions: Sequence locations=1-961
  Gene Ontology: Mol. function=endopeptidase activity; Cellular component=nucleus; Biological process=proteolysis and peptidolysis
atgccgacaaacaaatcgtcaaaattatttggaaccgctcgatgtcccttgaagaggtattcgtaagtggtttcgatgcaaaaatcaggcggaaagacttgctgaccctctccaatttggagtggttgaacgacgaaggtgctgtttatttatttaaaattgctttatattgattgttaattgttcgtaatttagtcatcaatttctttttgaacttggtggtcgaacggaacaacagcgatcccaacctcccaaaggtccatttgagccttccaaattttttaccatttatttataggtgttcacgtttaacactttcttctaccaaaatctacaaaaaaatggttttaccggtgtcaaacgatggactcgaaagatcgacattttcgcgcacgaaatgctcatcatacccatccatttgcccaatcattggtgcatggcggtaagaaagcaattgaaagttagagaatggtaaaacttcaatggtaatttagataattgacttcagacagaaaaggctggactattacgactctttgatggggaccaatgaaaaatgtctgcataatttgaggtttattgccaattttacttcttgaaaacaacaatttctagggattatctggaacaagaatcccttgacaagcgaaagaggccattcgattctgaaggatggatgatggaatgtcggaaggtcagttgtaataatataaaaatggttgaattatgggattcactccggcggaatttaaataatatccctcaaatttttttgcaggatattcccagccagtccaacttttccgactgcggcatgttcagctgtttgttcgcagaatacgcctcgcgcagagcaccgatcacttttacgcagaaacacatttcatattttcgcgagagaatgtgcttcgaaatttaccaaaagagtttactttgattgttcattttcacgggaaataaa

SEQ ID NO: 46269 - DNA, 422 bp, Heterodera glycines
  Genomic contig location: Contig_ID=SeqID_31720; Location=152..573; Strand=-
  SCN-specific regions: Sequence locations=1-399,421-422
  Gene Ontology: Mol. function=intracellular transporter activity; Cellular component=integral to membrane; Biological process=vacuolar transport
atggacaatggactctttgaggaggcgtgggaacgagcggtcagaaacagcgaaatgctacgcgaaaattcagtgctggaggttggcaaacggctggtcaaccatttgatggagcaaaaggcctacgatttggctgtcaattttttgccacaggttttttgacaatcactcataaatattttaacacccaatcgtaatatatattttttaggtttgttcaacacataaggtggagtgggagttttacgtcaacgaattcgaacggcaccaccaaattctgaaactcgtgccgatcattccgacaaaggacccccaattggagcccgagtgttacgagtctgtgctgctcgccgcgctttatatgcggcccaaactgttcgatgcgattgtgtcccattggaacgcggacatttaccgagcgc

SEQ ID NO: 46270 - DNA, 1448 bp, Heterodera glycines
  misc_feature (81)..(81): n is a, c, g, or t
  Genomic contig location: Contig_ID=SeqID_31760; Location=1..1448; Strand=+
  SCN-specific regions: Sequence locations=1-122,144-219,241-269,291 -334,358-742,764-1015,1045-1448
  Gene Ontology: Mol. function=RNA binding; Cellular component =nucleolus; Biological process=rRNA processing
agtcatgaagtggttgcgtgggttaagcgaattttgcgtgtcaaaaagactggacacagcggcacgttggacccaaagtanatatagtacaattttgtttatgaatggaaaaaatgtttattatccatagtaaacccctatttgcaatttattttttttctatgataggtttccggtgttctcgttgtgtgcgtcgaccgcaccactcgtctggcaaagtctcaacaaaatgctggcaaagaatacgtcgccattttcaaactgcacaacccagttgaatctgtgaagaccatacgccaggcattggataaggtgtctgaattacataaaaagtctaatgttttcaaatatttttgactttagctgactggtgcgctgttccaacgcccgccgctcatttccgccgtaaagcgtcagctgcgcattcgtacggtgtacgaatgcaaactcatcgagtacagtccatcccagcaaatgggcgtttattggatgagctgcgaggcgggcacttatgtgcgtactcacattgtccatctcggtctgatgctgggagtcggggcgcaaatgcaagaattgcgacgtgtacggtcgggagtgactggggaaaatgaccacatcgtcacattgcacgacattatggacgcacagtatttgtacgaccagcacaaagacgaaagttatttgcggagaataattcgtccgttggaggcacttttggttcagcacaaacgcatcgtggtgaaggacagttcggtgagtttgattgcaatcgaaagaattcaacgattgtttaaggtaaatgctatttgctatggtgccaaaatattgatacccggcatacttcgttatgagaatggaattgagataaacgaagagattgtgattgtgaccaccaaaggggaagctgtttgcatcggtgggctaattactcaaatggttgtgctactgaccaaatgaatgtttagcgattgccctgatgaccacttcgacgatagcgatcactgatcacggagtggtggcaaagattaaacgtgtcattatggaacgcgacacttatgcggtgagttaaaccggttgagacgggagtatttctaatttgtgattgcccatgatttcggtttggtggtggtactgagaaaattccccctttttgcttcgtgtgcgaaaaaaattttgcgctctataataaacaaaatttttgggaatgaaggagagggaccgtttgtgcgttaggcgttggaagagggtgcaaacagaaaaagctaaattttcaacaaaaattaaacatttaacttttaagcgcaaatggggactcggcccggtggcgtcaaagaaaaaggcgatgatcaaagatggtttgctggacaaacatgggaagccgaacgagagcactccaaagggatacgtgcccggaatgatggactattccctatcaaaagtgaaggcat

SEQ ID NO: 46271 - DNA, 245 bp, Heterodera glycines
  Genomic contig location: Contig_ID=SeqID_31793; Location=1009..1253; Strand=-
  SCN-specific regions: Sequence locations=1-112,146-170,194-245
  Gene Ontology: Mol. function=protein binding; Cellular component=SCF ubiquitin ligase complex; Biological process=reproduction
aatcttatggggatttgtcccctttattcacattgaatttggcacaatttaattgtgttgctctcattaaggcagccaactatttggacgtgcgcgggttgctcgacgttgcgtgcaagacggtggccaacatgatcaaaggcaagtcgccggatgagattcgtcgcacattcaacatcaaaaacgatttcacgcccgaagaagaggagcagattcgtcgcgagaatgcctggtgtgaggactga

SEQ ID NO: 46272 - DNA, 2010 bp, Heterodera glycines
  Genomic contig location: Contig_ID=SeqID_6598; Location=2478..4487; Strand=+
  SCN-specific regions: Sequence locations=1-216,238-325,388-487,525 -531,555-677,699-780,807-812,842-855,888-1720,1753-2010
attaggaacgcattgctatttgctctcctcactgtccctattttgataataggaaacggcccggcgggcattgcgctgtccgcgctgctctccggctggcgccccttctacaacaaacgcgtgccgcacccggacccgcatctgcacgcgcaactcacgcgcatggcgagcagcagcagcgacgacaattgtgacctgtcactgcttgaccaggtgggtggtgtgttgctgttgtggaggagtggggtgccccagcaagtgggagcagtcagcaggacaaaacatctccgggacataacgtctcaccgggataaaacgtcgccacaaaaaaaaaaaaatttttttttttaaactttagaaaaaattcaagaaaattataaatttttagttgcctagcctatcccggcgacgtttgcgcttctgatcacttttcgaaaaattatgagggattaaatttttactaaaaatatgccttacaataatggtgtaattaaaaattcaaaaaaaaaaaaatttaaaattaagaatttcgagaaaattttaaaaccaaaaagcgttgaaatattttcatgttaattttattagctatagaaagggttaattaagttcaataaaactttaatttaaccttaaggaatacggcttcaaaaatgtgacgaaatatttttttgtttacgtaatttaatttttaaaaatttgatcatccacaactaatttgtaattgtgatcagaagttcaccaaattttgcagagatacataatggaaacagtacaaatgtttacaaattttcctataaatttttcacccgaggaaaatttgtttttaatattttttttaattgacccatgggaatgttttcaggaaatgggataaattattttaaaatagaggttgattcccttccttttagtatccccctaatttttttttttgttgccaaattcaaatttttggcattttgccacagcaggaccttgacgcgttggcggaccaacattttgagcgcgcgcaaaacgccggcggcgccggagggcacacgccgttctccgtgctctacgattgcctcgcgcggccccatttaagcgcctcattcgcctcctccgcttcccataccgctgctggccatcatgcggcggcaaacggcgacgacgacgtcgatgccgagcagttcgtcgtcgatggcaccagcgctggtggcgacgattgcggggtaaaaatgtgcctgctgccatccgaaaccggaatttcacgggacgcaagatttagcgttgtgcctccctgggatatatgtaatccacttatcatcccctccccatccactctcaattactcgagacttggttcgagacccgccccctcccccctcccaaaaaaagagctcggtcttggcgagattttattccgtccccccgatttttacggtatcgaggtattgaaaacagtttgcggttttaattgtataaactaattgatgtgtgccattctcccccccccccgcttccagcaacggcatcggtcgccctcccccgccgcttcttccccggtcccctcctcctcctgcctttgctggagacgacgcgagcgcgatgccatttcacacattgtgctcggcgatcagcagattggcggcagttggaccgaatatgacgaccatgtgagagaacaagagtggggcgcagattgaatttgagaccagtcagggctgaaatggcgggactcaatttcccccatttattttttctaaatattttccccaccgtccgatatgttccgtttctgttcatcatcaacatatcaatcatatcatccccgatcagatgctcactgtgagtgcggtcgagtggatggatttgcccggcttttccctggccgcggattttgtcggcgacgctcagctcgcgcagcagcgcccgcgggccggcctctacaaggcgtacttgaatgcctacgtggacgcaatgggactgcggcacaacttcaagctgttcacacgggtcacccacattgag

SEQ ID NO: 46273 - DNA, 735 bp, Heterodera glycines
  Genomic contig location: Contig_ID=SeqID_31866; Location=140..874; Strand=+
  SCN-specific regions: Sequence locations=1-195,217-735
atgccggtggttgatgcggaagggacgccgttggcacgcgacccggccagcggacgttacttggacccagcggatggcacaccaattgcggttgatgatcagggacgaccgttggaccgtagcggcaacgtactgtccaaaaacatttatgacgagtacgtgtgggtggatgtcggtcttgtgagtccggacgggcttccggcacggacggcgggcggccgaatcggtgccgaagcgaccactgccacacttcacgacgatcacgccgtggacggggctgaactcgtgccgtctgatgaaggcggtccggtggcggcacttccggatgaccgcgtgccgacgcgtgtagagaagggcgagtgccgcgtgcaggaggcggtcattgacctggtggtggcagtcaacgacgaactgctccaagcgcatggggaccgcttgcgccaggcgttggacgaccttttggaccagcatttggacctggcggcggatgccacccgcgtggcactgctccaatacggcaaaagtgtggcggttccggtcagtctgggcggttaccacgagcgtgaccaactgctcgaccaactcggccaactgcgctccactgcctccaacttgttgggactgcccgacttgtcggccgcctacgaagcgagcttacaacagttcgaaagtttcggccggggcggaaatgtaccaaaagtgttgctggtggtttccagcggggaggatatgtga

SEQ ID NO: 46274 - DNA, 711 bp, Heterodera glycines
  Genomic contig location: Contig_ID=SeqID_31881; Location=392..1102; Strand=+
  SCN-specific regions: Sequence locations=1-132,169-240,264-443,465 -477,499-528,551-648,689-711
gtgtacgattatttctccgaatttattcctaaatcatttgacgataaagaatgggttcggtacgtttttgactaacacattaagtcagtcttcttttcagaacaatggaatgttcaagtgttgtcgaacgcgttaattattgggcttttttggcactttctcagcatcgaaaagacttggacgaaatgaaacataatcaaagtgtagaacatacggatagttttttcaaagaacaggttatttgttgttcgttttttattttaaatgtccttactcctatttttctcaatatttattgaaaggatcatttttcaatgggttttattgaataaattcgcatttattcagttgcgactttataatgctggaggcatgggatacagtgaagacgcgtactgtttgtatttaaattcctatcaaggcagaaattacgcatcgagaaaatgcaagtggtctttgtcattgtcgatccttaattcaaaattttgaaaatgaaaagccttttcagatcgcacaattgaagaatcaaagaaattggcccagcaattaacacttggagaatcaccgcggattctcttcgattgtcaatttttacctcaaatgacacaacgaatttacggcaaagtagcaaaatcggcagttcatgcatattttgtatggttttggaattttacaatgatttttatttctttgatttcgcaccaaatttaa

SEQ ID NO: 46275 - DNA, 1104 bp, Heterodera glycines
  Genomic contig location: Contig_ID=SeqID_31889; Location=1..1104; Strand=-
  SCN-specific regions: Sequence locations=1-408,432-596,618-688,711 -1104
  Gene Ontology: Mol. function=protein carrier activity; Cellular component=cytoplasm; Biological process=protein-nucleus import
tctttaaattcagcatcctcgtgttcgttacgccgtttgcaatgccattggccaggttttgtttcccacacatacacattggcaaaattcaacttttccctgtgaagatgtgcaccgacttccagcccaccatccaaaagaaatgccatgagcgtattgtgcccgttctcctcgaggccatggccgacatgtccgtcccgcgagtggctgcgcacgcggcggccgcaatggcatgagacgcattcgacggtggttttatacggccaaattttcattggtttaggtgaacttttgcgaagattgtcccaagtcaatcatcagtatttatttgccatcggttattgtgtattttgttcattgttttaacctatttgttaagataatggaacgattggagtcagtgctttcacaaactttccagcaaatgatgaccaatggcaaaaaactcgtcttggaacaggtcagttattgtctttttccctttgttggatcaatattattcaaacaatttcagataatcaccacgatcgcttcggtagctgatgccgcccaggatcacttcgccaaattttacggcaatttgatgccccctctcaaatacagttcattttaaagatgctcattgctaaccgaccctttctccatcattttcctttctccgttaagtttttgaaaacgccaaagatgacaatttgaagttgttgcgtggcaaaaccatcgaatgcatttcgctcattggaatggcagtcggcgcggaactgttcgagacggacgccgacagcgtaatgcaagtgttgctcagctcgggagtcaaattcgagaacaatgacgacccccaaatctcctacttcatcagcgcgtgggcgcgcatttgcaaaatcctcggcaagggtttcgccaagtatttggacatgattatgccggccgtgctgtccgccgccgacttcaagccgtctgttgcgcttgtggatggcaaggacacggatgacaacgaggactgggattacatgccaatcgacgagaaccgctcgctgggcgttcacacggccggactcgaggacaaagtaacggcgtgcgaaatgttgtgctgttcgcgggcttctc

SEQ ID NO: 46276 - DNA, 586 bp, Heterodera glycines
  Genomic contig location: Contig_ID=SeqID_6612; Location=421..1006; Strand=+
  SCN-specific regions: Sequence locations=1-14,38-216,238-488,523 -535,559-586
  Gene Ontology: Mol. function=ARF small monomeric GTPase activity; Cellular component=cytosol; Biological process=G-protein coupled receptor protein signaling pathway
gactgatttttgtcgtggacagcaacgaccgcgagcgtgtgggcgaggcgcgtgaggaactgatgcgaatgctggcggaagacgaactgcgcgacgcggtgctgttggtatttgcgaacaaacaggtgaaaaggggggggggacattataggcacatggcatttagcgggaaggacacttccgtgttggttgcgattgagaatcatttaattattattttgcaaattttaggatttaccaaatgctatgaacgccgcagaagtgacggacagactcggactgcacactgtaagcgttggctgaatgggattttgttaggtttgagttaacgctatggcaaaacaaaacttgttgttacgtatgagtttctcttccttttgttccgtttagaaccttcgggcaaatgggtgctttctgacttccacaattaatcactgaaaaaggaacattgtttcgccattgcaatgttttggtgtttcagcttcggaaccgcaactggtacatccaggccacctgtgccacgtcgggcgacggactctacgaaggattggactggctgagcaatcagctcaagaacagaggatga

SEQ ID NO: 46277 - DNA, 3749 bp, Heterodera glycines
  Genomic contig location: Contig_ID=SeqID_6622; Location=339..4087; Strand=-
  SCN-specific regions: Sequence locations=1-187,209-471,500-680,702 -1254,1276-1284,1314-2099,2121-2218,2240-2913,2935-3185,3208 -3459,3550-3749
  Gene Ontology: Mol. function=zinc ion transporter activity; Cellular component=vacuole (sensu Fungi); Biological process=zinc ion transport
atgggcgccggccatcgcgctgagcaacaggcggctgctaatcgactgcaggtcattttatttattttaagtaatagactgcaggtcattctatagaaccccttaaaccaaattcgaacaaaaagtcgaatttatgaaaattctcactattgccataaaatttatttaaaaaagctaaaagtagtcatgaatcattaaaacatcaaaaatgaccattttgctcagattctaacataaaagccacttttcaaaagacccctctttttaaatagtgccggatttttgcggtaaattcgaattcattttcctctaattcatcctgtcccccccccactttcagcccaaactgtccatgagcagtgtctcttccgttggctgttgtcgtcggcgaatgtgttacctttcgcgcggctgtcgccttttggtgatgatctttctgacgtttgccttctttttcattgaagtaagcacaaaaaaattaattgtttaattaaaaattgcactttaattaacgccaaattgctttgtttcagctcgttttcggttatatttcccactcaatggcacttattgcggattctttccatatgctcagcgatgtgattgctttgtgcattgcgtttggatgtcttaaggtctgtttttgtatcattaactgaatgtaaatgttttaaagtgctttttattgaaaatgaaaaaatctttaaaagtttggctagaagaatctcttttttcttattttaaaactcctcccatatgacatctgtattaaaagatattaacctttttgaaacaaatgagaaaaaaagaatattcttgattgggtcaaaatggccaaaactgtttttaagtcgctttaatttgggtttctcgcaaagtgatggatttagctgcgatttttttgcattcaaagaaaatttctgatcacttttttccacagattgccgagcgaaggaaaagctcaaaaaatacttttggttgggttcgcgcggaagtgctcggcgcgttggtcaacggcgttttccttttggctctttgtttcactattttcatcgaggcaaatccttcaaaaaaaattaagattttctttatttttcattttcagtccatccagcggctgctgaacccggagccgatcaaaaatccgcttcatgtgttggtagtcggactgatcggattctttatcaatctgattgggatgatcatgtttcgtggccatgttggtgagtgactgtcactgaatcggtcttgcaccaccaattagggaaccaacttgcaaaaaacttgttttaattaaaattatttgtccctccttagggcacacccacgccgctcacggcgttgaggacgtccgctcggaagtgctcgaagtggcggccgaagcagcggcggctgcagccgccgcgaaggcggacgagccgctgttcggcgctgggaatgcggacggacggcgccggaaccaccgctgctgtcgggacgggacaaagcgggcgcagcagcgaggcggacacaacgaagtggacgaggaggaacagaacagggccatttccatgtccgacttggaggcagtggaggagtcgctgatgtcccgcgttccgcggcacaaacattgtaagatcggatggatggtgattgtatcgggcagagtttgcctcctccccccgctaatgtgggggaatccaaacaactcaattcttaattttcaaataaaaatccaacctgttcgtaatcatacgggggtcgggacatcgcaaaattttcggcgaaaatagaaaaacacgtaaagatgggaaaaggttatgaaaatgggaaaaaaagctaaatttttgttttccatttagccaagtcgcagagtgctggccacctgaacatgcatgccgtctttttgcacgtgctcagtgacgcggtcggctcagtgattgtcatcgcaaccgcattggtggcatggaaagtggaaggggtcgagtggctcaagctgtacatggacccgatgctcaggtgttaattttgaggaacgaaaaactcatattcaacatttaaagttagatgaattattataattatataggtatgcattttttttaaaaaattagaaagggattattttcttacatttttatgcgtgctgttttttgatcagtctcctattttatgaattgtttatcactatttttcttgattttcagcatcgttttggtttgtctgatggtttgtacaactttgccacttggtaagaaaatattactagtatgtaaattaagaaaaaaataacgatgtaatacaatactaattgtaatgggccttggcataggctttgttcggggatttcatcgcttgaatttttctgggctttatccagaaatatagggctttttttctccataaaatacaaatcacaaattaatcttttggtgcgtcattttctgctgttcagtgcatgagactgcgttgattctgctgcagactacgcccagcttcgtgaacatcgactcgttgcagtccaaactgttgcacatcgacggcattgtggcggtccacgagttccacgtgtggcgcctcgtcggcgagcgcatcatcgccacggtgcacatccgtttccgcacgctgcgccactatgtgctggcggcggagcaaatccgttcattgtttcacgacaatcacatccactcgaccaccattcagccagaatttgccgaagtgggacccgtggaggggggggggggggagccgactgggaatatccattaaggaattatgcgtaattattaatgggtcacacacattccaacatccccttacattgatgggattgctcatcgctttagagttccatttcccacccgttccgatgaactctattcgaataaatagagcaatcaaaggcccttttgactgttttttttcattgtataatttcactttggtttctctttttagatggacacctcaggcagtgtgtctgaattggagtgcgccttcgcctgtcttccgaacaattgcgcaatgctggagaacggcgacgtgacctgttgcggaaaggacaagcgaactccgccaaaggtgtggtgaaccggaacccgtcagttgggcgccagcacgttttcagctataactttttttctttgtcaatcaaatccaacattattggtatcattcaaatccctaaatgtcttctattagtctgcaaaattttgataaattttgttgaggttcaaaaaggttatggccagaagaatttaaaaaaccagattttccaagctttttggctctaacattttttaaacaatacgaaattttttggaattttgcagctaatagagcatctgaagggctctcgaatcataccaagattgatagatttggttgacaaagaaaaaagttatagtgcaaaaacatgctggcgcccaaacgcgccggcgcacaactgacgtagaccggtggtgaacagctttttgttgacaaatgcaatagaatgaattttctctctccctccctccctctctccccctctccgcctcccccctcctctctttctctctctctctctctttttgtttttgggttcatcattttaaacgtatgtttttcagaaaattgtcacttcgaccagcatcgccattgaggaggaggagcagcaacggccaaccgatgcgaccacgggcgacggcggaacggcttttttcaccgccgggagcggcagttcgagcagcagcagcactaattcctcaccggaacagagcggaagctga

SEQ ID NO: 46278 - DNA, 776 bp, Heterodera glycines
  Genomic contig location: Contig_ID=SeqID_831; Location=3325..4100; Strand=+
  SCN-specific regions: Sequence locations=1-776
atgttgactgtatttatattgattttcaaaaagcatttgactcagtgccccatgaattacttttatacaaattggaaaaaataggtataaggggcaaacttttgatgtggataaaggactttttgagtaataggacttttcgtgttaaaattggggatgatttatcctccagtaaaaaagttggctctggcgtcccccagggctctgtccttggacctttattatttttgatttatattaacgatcttcctgatgctttgccatcaggagtaagaattaaattatatgctgatgatgttaaattgtatatttgttataaagcaagaaccgaaacagaaattatgcataaagcattgcataatttatcagaatgggcaaataaatggcaaatcagaatctaaattaaaaaaacttttgtacttcatttggggaataaaaaccccaaagaaatatataaaattgatggaaatataataaatgttgtggatacaattagggatttaggcataaatattgataataaattgcaattttccaatcatgtcacacaaataataaagaatgcatatttacgtatgcgttctttatttcgggttattaaatcaaagtcttctaggatttggattattttgtacaaaacttatgttagaccgttattggaatatgctcctgaggtttggaatccatctcttctaaaaaacattaaaaaaattgaaaaaatgtcaaaaatatttcaccaaaagaagtctttttcaatgcagccttccacccattcc

SEQ ID NO: 46279 - DNA, 190 bp, Heterodera glycines
  Genomic contig location: Contig_ID=SeqID_6657; Location=1..190; Strand=+
  SCN-specific regions: Sequence locations=1-190
aatagaacgaacgcaacgacaaaaaagggaaatctctccgtccgcccctcggcacgcgctgtttaattgctgggcgactccgcaattgtcacctccacgtccacgcccggctcaatggaaatgcccgtgattttcttcagcacgtcgctggagctgttcagattgatgatgcgtttgtggatgcgcatct

SEQ ID NO: 46280 - DNA, 679 bp, Heterodera glycines
  Genomic contig location: Contig_ID=SeqID_6658; Location=1750..2428; Strand=+
  SCN-specific regions: Sequence locations=1-106,176-399,444-615,644-679
atgcaaattttcgtcaaaaccttgaccggaaagaccattactttggaagtcgaggtatcaatttaacaattaagaaaacattagtactatttgacatcttaaggcgagtgacacaattgaaaatgtcaaagccaaaatccaggacaaggaaggaattcctccggaccagcaacgtttggtaaaccaagcaaatctgagaaagcggataatggaaaaaatggccctttcagattttcgctgggaaacaattggaggatggacgtaaaattctttaatcgaatgttgcgggtgtaaaaatcggacctttttccccttttcaggcactttggccgattacaacattcaggtacgccgcccaatttgaggaccacaatttttactggttcgtctcctctgttccagaaagagtcgacgctccatttggtgctccgtctgcgcggagggatcattgagccgtcgttgcgcatgttggcacaaaagtacaactgcgacaagcagatctgtcggtacgaattggcacccatttcaagcaacttttcacactttgttttgcgatacttttgcattttacatgtttttaagcaaatgttacgctcgtctgccgccccgtgccaccaattgccgcaagaagaagtgcggacactccaacgacttgcgcatcaagaagaagctgaagtag

SEQ ID NO: 46281 - DNA, 581 bp, Heterodera glycines
  Genomic contig location: Contig_ID=SeqID_6658; Location=197..777; Strand=-
  SCN-specific regions: Sequence locations=1-414,436-438,496-510,533-581
  Gene Ontology: Mol. function=structural constituent of ribosome; Cellular component=eukaryotic 48S initiation complex; Biological process=protein biosynthesis
taggcttttccttataaggatgacaaaccgcaagaggcagcgcccgttgaggaccgaattcgcattaccctaacatcacagaacgtgaaatcgctcgaaaaaggtttaaacttttaaagtaatcccgtgaagtccattgctccaaggatatggcgttttcacctacttttggctgatatttcattttggcattaatttttacaattaaacgtccgttaacaaattggaaatacatcaattcatctcccattttgttccaattttcctccgactattcacaatatttctttgtcagtctgtgagcagcttattcgcggcgcaaaggacgagaatttggtggtcaaaggcccagtgagaatgcccacaaaaattctgcgcattaccacacgcaaaacgccgtgcggagaggggtcgaagacttgggaccgtttccaggtaaacaaaccaacggaaatcttagaatttacaataaagaatattatggcttaataatttggcaccaagaaaagcaaataaataaatatattaaaaaccagcagtggtcccagaatacggagagggaaattgggcaaaagggccac

SEQ ID NO: 46282 - DNA, 616 bp, Heterodera glycines
  Genomic contig location: Contig_ID=SeqID_6674; Location=1178..1793; Strand=+
  SCN-specific regions: Sequence locations=1-80,102-200,222-316,355 -493,515-616
  Gene Ontology: Cellular component=cytosolic ribosome (sensu Eukarya); Biological process=protein biosynthesis
atggtgacaaaatcgggcaaatactgcctgggctacaaacaagcgcttaaaacacttcgttcgggcaaagcaaaattggtgatcatctccagcaacacgccgacactcaggtgcgattttgttttgaaattgttcgattttttggagaaaacttaaaatggtggaaattttttggatttttgaggggcagatcaggccgatttaaataaattttctcggcggtgtctactgatactttgaactactaatttctctgaaatttccaattttgactcaaaagttcacatagcttgacaacttttggcataaaaatgagataaatttcataaaattttttattaaatcaaaatttttggtaaggaaaaagtctttgtatttacaataaagttgccatttatttattcgattgtcacaattattgttttatttgttcatggcctttagacgcagtgaagttgaatactacgccatgctgtcaaagacgggcgtgcacgagtaccatggcaacaacatcgagctgggcaccgcttgcggcaaactgttccgagtgtccatgctgtccatcactgacccgggcgactcggacatcattcgaacaatgccaaccgaggcctga

SEQ ID NO: 46283 - DNA, 1278 bp, Heterodera glycines
  Genomic contig location: Contig_ID=SeqID_833; Location=804..2081; Strand=-
  SCN-specific regions: Sequence locations=1-31,55-192,228-326,348 -404,428-551,580-778,807-1278
  Gene Ontology: Mol. function=protein phosphatase type 1 intrinsic catalyst activity; Cellular component=bud neck; Biological process =cellular morphogenesis during vegetative growth
atggcaagagaggagtactgcttcgatgcaacggcggcggcagcggcggagcagtctcggccttcggcaacgacttcaacacttgtgcaaggagatggcctgtcaagcagcttcgtggacgcgatcatcaggaaggtcaggcagtcgcctgtccaacgcttcacggatgaggtgggatttttttgacatgacatttcaacaattaaaaaatttcattttttccacagatcaccgacgaggagctcaaacaactctgcaaggcggccacggacatcttcagaatgcagccgacgctcgtcaggattcagccgccggtcgtcgtcgtgggcgacatccatggacaattcacggacctgcagaggatcttccacacgcacggcaaccctccagagcagcagtacgtcttcctgggcgactacgtcgaccgaggcccccagtcactggaaacaattgttcttctcttctgctacaaggtgtggtttagtgaatctttaacagaccaaattaaatccccaaaaccattgcaggtcaaatacccagcgaacttcatgctgctgcgcgggaaccacgagtgcgccaacatcaacagagtgtaaggatcgcatttttttgtgttgtttcagacttaaattccccccccccctttaaggtatggcttcttcgatgaggtcaaccgccgctaccagcgtccgggtccccgccgcctctacgacctcttcaatcagacgttcgcctggatgccctacgtcggcctgatcggcgacaaaatcctgtgtgagtcacattttttgttgttgttgtccattcatactaattcattatttttcaggtatgcacggcggcctctccgaccagatcaacagcctggagcagctcagccacctgaatcgtccgcaaatcgacccgccgcttcggacgctggagatcgatcttttgtgggcggaccctgcgcgcggagttcgtggcgtcatcccgaacaccagaggagcgggcatcgcattcggcgaggacgtggtggagcgggtgtgcgacatgctctgcctcgactacatcattcgggcgcatcaagtgagtttttttcttttttttcatttgcttctggactaaattcccacttcccctttccaggtcgtgatggacggagtggaatatttcgccggccgccggctcatcacccttttctcggcgccgcgctacactggccgcaacaacacgggagcaacgctgacaatcgcgccgaacctgagccacagcatcacccgcttcccgccggcctga

SEQ ID NO: 46284 - DNA, 1153 bp, Heterodera glycines
  Genomic contig location: Contig_ID=SeqID_6680; Location=170..1322; Strand=+
  SCN-specific regions: Sequence locations=44-306,333-426,449-536,558 -1153
  Gene Ontology: Mol. function=structural constituent of muscle; Cellular component=striated muscle thick filament; Biological process=striated muscle contraction
atgttcgtgctggagcaggaggagtacaagcgggagggcatcgcgtggactttcatcgacttcggactcaacttgcaggcgtgcattgagctgatcgagaagccccttggggtcatctccatgcttgacgaggagtgcatcgtgcccaaggcctcagacatgactttcgtgcaaaagctgatcgaccagcacttgggcaaacaccccaacttccaaaagccgaagccgcccaaaggcaaacaggcggaagcgcactttgccattgtgcactacgcgggaacggtgcgatacaacgcgaacagtttcctggagaagaacaaagacccgctgaacgattcggcggtaaacaaaaaggggcaattcgttaattaattaatgagctgctaattgatcattgacaggtgtccgtgctgaaagcagcccaagacaatgaactgttgctgaacattttcgaggattacgtgacgcaggaagaggcggccgagttggccaagacaggccaatccagcggcaagaagaagggcaagtcatcctcgttcatgaccgtgtccatgatgtaccgcgagtcgctgaacaacctgatgaacatgctttaccagacgcacccgcacttcatccgatgcattatccccaacgagaaaaagcaaagcgggctgttggactcggcgctggtgctgaaccagttaacctgcaacggcgtgttggaaggcattcgaatttgccgcaaagggtaccccaacagaatgcagtaccccgacttcaaggtggccagtcaatttaaaactattgccattaataccaaacaatctcagcaccgttacgccattttggccgcggaggaatccaaagttccagacgagaagcaggccagcaaacagatcacggacaagctggcgacggatggcgagctgaaggacgaggagttcaagctgggcaacaccaagattttcttcaaggcgggtattctggctcgtctcgaggatttgcgtgacgccaaactgtccgtcatcatgaccgggttccaatcgcgcatccgctggttcttggcccaaaccgacgtcaaacggcgcatccaacaacgcgccggactgctcattctgcagcgcaacatccgcggatggtgcacactgcgcaattgggactggttcaaact

SEQ ID NO: 46285 - DNA, 1208 bp, Heterodera glycines
  Genomic contig location: Contig_ID=SeqID_32139; Location=116..1323; Strand=+
  SCN-specific regions: Sequence locations=1-282,304-1149,1171-1208
atgtctcgtgtctacctgtttctggagttgtccatccaaaaggaggacgctggcggacgatgggtaccaattgaagcggcagaccaacttgtcggacctatccaatgcattggacaaacgtttgttcaacaactcaaggtcacacatacaacatccgaacactcttcacttgcagaaaattaccaatatttaggttgaagtgcaaaacacagttgtatgacagcggcacattgtacccctacaaagcgtatctgaccaacgagctgtccttcccaaacagtgcaaagggtcatttcatggccagcgcgggctaccatccctcgctgaagcatgacagcgcgacggatgccggcttcttggcacgctgtgctcgctttgagggaggacgaaaggctcgcttcctttcccgcctggactttgacctgggcaaccaggagctgtacctattaaacaacatggacgtcctgttcaccatctaccgtgcaaagaacacattcctgttgcaaaacctggcgccagcgccggcggtaggagcagcggccaggcagcagtatgccttgtatctgcacgacataaagctgtacatgaaggtggtggaggtgcaaccctcgctgaacctgtccatctacaaaacgctggagaagcagccggccacctacgcggtacggaagacggaggtgaagtccgtgttcctgaccgccggccgtaccgagatggaccacaacatattttccgccgccatcccccgtcggttgaccattgcgctggtggcaaacggggcgttcaacggacagctggcgcagtcaccgttcaacttcaagccatactccatccgtgagatcagcgtgcacgccggcggtcaaatatacccggcggtgccgcaccgcatggacttttccggcgccgcctacattcgaccctttgtcgacatgtacgaggcgctgggcatggccaactctgaacgctccatggacatcacactggaccagttccgcgacggatggacaatttttgtggtgcccatgacctcgacgctggatgacagttgcggctttgaactgctccgctccggcaccaccagcattcggctcacattcaacgaagaaattccggccggcggcgttgagatggttgtgctcggggaatttgatcagttgataatgatagactacaaccgtcacattgtatctgactcgaaaattgcataa

SEQ ID NO: 46286 - DNA, 2117 bp, Heterodera glycines
  Genomic contig location: Contig_ID=SeqID_6686; Location=1960..4076; Strand=-
  SCN-specific regions: Sequence locations=1-1341,1363-1423,1445 -1494,1516-2117
atggagggaattggggtcatttgggccgccgttgttggaagtgaagtcgacagcgattgtgcaatggaattgctgactgaaacagcattaggtaaatgccgaactaaattaagcaaattgcaccccaatttcagtcggctcacaaatgtcggcacgggggcaccgcacacgcggacaagttcaatgctggcggaagggtctttgctcttttggcccggcctcaactgaaggggaaagacgacaaattattcaaacaaattgccaagttaagcctcaaaaaataaattatcttcgtttttcaccgactatgtgcctccctcgtcgctgaccaaatattttgtgttcgaattgagcaattggaagaaattggtggttgcgcttccgatcagttcgtcctttgtgcgattgtaattgaaattgtggcacgaaattcgcaagatccattccaaagagctggggaaaaatttggacggaagcacaaagtcgcgccagcggggatttgcgttttggtgcgccacttcactgcgatagagcaaaatctgatgatagaatgaaaatattgcagaattagaaaaactaatttttactggcattcgctcgtcagtttcgctttttggcaccaattccaacacaaaataaggggcggtgagcagtccgggcgtttccaaattgtggccgacaaattggaaaactgattgtgagacaaaaactttcattttaaaagttggatgtttatttaaaaatgtcaatgtctcacgcgttccgccggcgcttccgctcgcctcctcctgctgcacggcttcggccagcaccaacgactgttggtgtagggctttttgtagtaagtgaagtgccagcggcacagcgaccggcttagaaccggcacaaagcaatgccagcagcaaaacatgcgcgtcggcgagcagtgtccgcagaagaccagactgaacatcgacggagtacctgcatttttgatttaataaataagaaattgaaaaaagaattgtaaattgcaaatcaagtggactcacaaaacaatgcgcaactgttggcatttgtccaaccgcagaagcaacgaaacccgtgcctcgaatttcgggttaatgccattccgtgtttctgtttggccaatctttgaacagcgaaacaattttaggtaggctaatcaaaaaaggaaattaaattcaaaaaaagacacctcaacaaaatttgcgtcattatccgatcgcgctgtaattaccaatcggcagccatcagaacattcaagtggcaaatttcttgtaaagttttgttttcaaatataaagtgtaaattaaataggtatttatttactcacagacaggaaaaactgaggattacagattcttcggtcattcgtaagaaaatgagaaattaatgtaaattgggtaaattaggattttgcaaaactttgaatcgaattagagcttaaacaaagcgaagggagtgaaaatgcataaaaattgaagttgtaggtttttaaataattttattaatgaagaaaatacaattgcaattgcaaattaaattattaattgttctacgtcaaataaataaattaaaagttatgtttttctttactcacaaatgctcacaagaaagttacatgttttcttaaagccttcactttcagtaattcttattgttaacataatgacgcaatttctccccgacaatttgttggctctgtttgcgcctcgtccgccgattcaattcaaaccgccgccagatgatctattcatccaccgaaaacacatgcaaatggggggcatggccgagtgtgtccatggttttgaggtttacaaaacacctttaatgaattggattttttatttgttaggatccgaaggacactcctccaaaacccaaaattgagacccgagaggagaagagagcgcgaaaagtcagttttaaacgcattttgcaacaaaaactttggatgaaactttaaaattcagcgcaaggaaaaggaggagctaatggcctacaaaattgagcaaggcattgccacttggacacctgcggacaatccgaaggcgaccgttgacccgtacaaaacactttttattggccgaattgtaaagaaaaatacatggtaa

SEQ ID NO: 46287 - DNA, 1669 bp, Heterodera glycines
  Genomic contig location: Contig_ID=SeqID_32165; Location=1..1669; Strand=-
  SCN-specific regions: Sequence locations=1-237,263-527,570-850,873 -1073,1098-1152,1175-1178,1211-1328,1352-1545,1577-1669
  Gene Ontology: Mol. function=pre-mRNA splicing factor activity; Cellular component=nucleus; Biological process=mRNA splice site selection
aagttctcgttatggaccgcctatacagacgcgttatcgaatgttggtgactaatttgtcaacacgctgttcatggcaggttgcctttttacactttccaaacgtaaaaaaaacatgttaaaattcctcaaaaattacccaattgccttttttgtatgcatccaattcattatttaaaaaccagcttaagctgcgctggtggttgcgcaaatcaataaattattttcgaagtctaacaaaaatccaggctcttgtcggtgctctttgggtggtttcttcgatggctcttcaccactttcgcctttctctatgtttttcccattcttcgctttcggaggggaagtctcttcgagaaggaatcgaagatgaactaatgaatttatgggcaccttctccgtgtgatgagagcgttgtccccctctttctgttgggttccgaatggaagagatgagacacaaatggccccttttttgtgctcatcaatgagaagaactgatgggaagagggcataactgcagaaaaacagtggtggaagaggaggaggaagaagaagagggaggaagagtagggctgacaaatgagcaggatggtgtgttcactttccattgaaaaactaacttaaagcgtacattacaaccccaatgggtttgatgttgtagtccgcttcttcctaagattgttgttttaatgctattcattgctttccaacattcaggacctcaaggatctgatgcgaaatgccggcgaagtcacttatgcggacgcacacaaaaaagtgagaaatgaagcagttgtctgcttcgccacccatgaggatttgcgacgtgcagtcgaacgttatcagggtaagaaataaaaatgtaaaaattgataataattgtttttctttgaggcaaggatataaacgggcgcagaatcaaactcgtagatgactccgaaggctatgccgggcgcaaaaggtacgtacgttttgaccaatgccattccctcgcaaatttcttagtcgctctcgttcgccccgttcgcgttcccgctctccgcgttctcgtactcgttcaccgccttctcgttcacgctctcctcgttcgcgcagcgcttcgcctggtaataactgacccatggcattttagtgttagaaattctgatgatactgggtgattaatttcttaggattattataacatatgaataaaaataaataaaggtgcaatggtaaaaaattgtggtccctatttaacttttttttaattttgtgataaaaatcaaattcctggggtttttgagggtgctgacatttttattcatttgacattgaagcattgttttgctttaaaataaataaattttaaatgaattcgagacttttaccaaagcaaaaatgcatcttcgaaaaaaattcaactttttattcgaattcgtacccggggtccggaattgggcaagtccaagttcagattcgtaataagcaccacgcaattcatgaataattttttattttaggtcatttatggttttaattgttatatcccttctagctgaaaatggtcggtctcgttcccgatctcgttctcgctccccaactccaagtcgttcccgttctcgttcgccaaatgatgaaaagtgaaccaacgaagaagagtcgatgatggagcacctctttgttggatgg

SEQ ID NO: 46288 - DNA, 1096 bp, Heterodera glycines
  Genomic contig location: Contig_ID=SeqID_6691; Location=574..1669; Strand=-
  SCN-specific regions: Sequence locations=1-200,222-1096
  Gene Ontology: Mol. function=ubiquitin-protein ligase activity; Cellular component=ubiquitin ligase complex; Biological process =protein modification
tttgttggtcgtgtgatcgccaaggccatttatgacaacaaacaacttgattgctactttactcgtgccttttacaagcacatcttgaacaagcatggtaacaccggacgttgtgtttaagaacctgagaacctaattccgacctaaattttttccagttcggtaccaggacattgagagtgaggaccccgacctcttcaaatcgctggaatttttgctgaacaatgccgttgaggacctcggagccgagctgacttttactgttgaggtggaggagtttggtgtgcgatcgactcggcagttgttggaaaatgggaacaagacaacggtgaccgatgccaataaacacgaatacgtccatttgatgtgccaaatgaaaatgacaggtaatttggaggggaaagagaatttcttacacaaaaaaaacatttttaggctcaatacggcaacagttgaacgcgtttctcgagggtttctacgaggtcatccccaaaaagctcatctcgattttcaacgagcaagagttggaattgcttatctccggcctgcccgatatcgacatcgacgacctttgtgcaaacactgaatacaaaacatacacacggacgagtccgcaaattcaatggtagtgcaacaaataacatattgaacaaattaaatatctattgccatacatttaaaggttctggcgcgctcttaaagctttcgatgccgaggacaaggccaaatttcttcaatttgtcacagggacttcgaaggttccgctgcagggtttcgcgcatctcgatggaatgaacggtgtacagaaattcacgtaagcattagcacacaaattcattcctctctaacaaacacgcacttaagtatacaaaaggacacgcgttccaacagtcggctcccatccgcccacacgtgcttcaaccagctggacttgcccgaataccctgattacgaaactcttcacaaaatgctgcttttggccagtcgcgaatgttcagaggggtttgcttttgcgtagaagcgatgctagattgaattatttatcaaattagaacatcattcattgttcattattattcggctcaattgtaataaa

SEQ ID NO: 46289 - DNA, 781 bp, Heterodera glycines
  Genomic contig location: Contig_ID=SeqID_32210; Location=125..905; Strand=-
  SCN-specific regions: Sequence locations=1-125,147-200,222-298,325-781
  Gene Ontology: Mol. function=protein tyrosine phosphatase activity; Cellular component=cytoplasm; Biological process=motor axon guidance
atggactgcaaccgctaccgggacgtcatctgcgccgagcagggccgcgtgcgactcgacaacggacgatacatccacgccaactggatcacggcccttggcgaacagcgcttcatctgcacacaaggcccgctcgagacgacctgcgctgacttctggacaatgatcgtgcaggagaacatcgaaggcattgtgatgctctgcgacaccgtcgaacaaaacaagaccaagtgccaccagtactggccgacaccggacaaaaaggtgggggttttttttttgctcaattttataatcatttccctcccccctcttttcccctttcagcaattgcacttcgccaacaagacgatcaccgtgcacttcatcgaagagactgcgctggagccggacctctacaggacaaagctgtcggtgctctcgcgcaacggctccatgtacgtccaccacttccactggcgccggtggcccgaccgcggtgtaccccagagcgacttggcgcctcttcgtttgcttttccaagtgcaacagcttcggcgctcggtggtccactgttcagcgggtgagtttgtgtcatgttggaaagtaaaaattcaataaatttcccatttttaggaatcggacggactggaacactggtggcgctgcacattgcctacgatactctgcagcgtggacatcgactcaacatcctctcgttggcgcgcaacctccgtcagcatcgggcccaaagtgtgcagacgccggaccaatacctctacatatacttcgtgattttgcg

SEQ ID NO: 46290 - DNA, 898 bp, Heterodera glycines
  Genomic contig location: Contig_ID=SeqID_32219; Location=496..1393; Strand=-
  SCN-specific regions: Sequence locations=1-132,155-375,414-898
  Gene Ontology: Mol. function=sodium:hydrogen antiporter activity; Cellular component=integral to membrane; Biological process=sodium ion transport
tattccatgcgtacaaaaaagtggcggaaactgtgcccgactcggccctgcttattgtgcttggctttgcacttggccaactgctgcgcctgttccgtgttgaacgtcacatttatatgtttgaggcgaacactttcttcctttaccttctcccaccaatcatttttgaagcgggtaaattcgtaattacaattcggattaagtcatttttttttaatttcctaaaaattcgtctattttttaattttcttgttctagggaatctccgatttgagattgtcgccaaagcttgaccataagaattttcgataaaattcatatttatgcaaaagaaaaactattcaaatcagttggatggaaaaaaatctaggaaaatgtttgtttgtttgttttttatttttatttttttgtttagatttggatccgaaattttcaaaattagtcgaaatgttcagaaaatcgttcttttctgaataataaatccgattttttctcagaaatttcggtccgtttttttaaactcttttcttttttaattataaagttcttttattgtatttacaggattttacatgccgacaaatttattgtgggaaaattatgactcaattttattgttcgcatttgttggcaccatttggaatacggttgcaattggtactataaaaattgttttcttatagaaatttcttctttttttttaggtttcactctgtattggctgggcacttttggcattttttcaatgccattttcaatatgccaagcattgacttttgccgccagtatcagttcggtggacccggtggcggtgattggcgtttttgagcaaattaatgtgaacaaatttttgttcatcaacgtgttcggtgaagcattgtttaacgatgcggcggca

SEQ ID NO: 46291 - DNA, 3767 bp, Heterodera glycines
  Genomic contig location: Contig_ID=SeqID_6703; Location=488..4254; Strand=-
  SCN-specific regions: Sequence locations=1-28,51-297,319-614,657 -1400,1422-2073,2102-2116,2139-2220,2247-2969,2991-3308,3340 -3383,3419-3557,3580-3650,3677-3743,3765-3767
  Gene Ontology: Mol. function=transcription regulator activity; Cellular component=intracellular; Biological process=body morphogenesis (sensu Nematoda)
atggacaaaggacggagcaaaagcccaaatgataacaaagaggaggaggaaactcaaagcgccaaagaggataagactgatcataaagttgggttaatttcgcttcattttatttaaatgctttttgaataattgcagacaaatgagcaaatgttgctggtgaggaccggactgaaactgaagcgtggcactctcttcaagaagaagcgaaatgttgacccgaaaacaatagatctgaccataaagaaggaacaagagggcccgcggaagacgaaggccgaattggcatttctcaaacggcaggaggagacggcgttcgaccgtttgtcaaagagggcccaaatcagtcaccgggagaaagtggagaagttcaacaagcaaatggaggaactgacggaattcaacgacatcccaaaggttggttggccgaaaaacccattaatttttaatgaggcatatcaatctttaggtgtcttggaccaaatgagaaggaaggaaaaatactactgtatcatatattacatttgcgatcacaatcagaaaaactaaagcaaatgcattcatttttagtaaacgaagttccattcgttttgtatctttccgtttgttttgcattatatttttattttattctcgtttggtaatcaaaaaagaaatgccagctattccccgcgcggatcgcctgaaaaccatttattcctcagcgaaggcactgaattttgcttttcgactgtcggccacaaatccaatcgcaccagcattcaatggggtgtccgcctaccaaccgcaactgcaacggattacaataaagtgggggacgaacacccatcccaagggatgtttgacttgcaatttccgtttcttttgccacagattttgcaagcaaagcgaaacaagtgttggcatgcgcaattacatcgaacattcgttgactaaatttgcgacggagaacccatactgtgccatttacgttgtgccgggaaggaacgcgacgccagtgctaagggcggaatattcaaatgggcgactagtccacgtgaacgcaaaggctttcaggtgaataattatgaacagagaccaaaaatgagtaaattttttggaaattcaagttattcaaacattttttggatttgtatagaatgaccgttttattttgaaatctttgtgccttatctttgctctacctagaaaatcggaattaatggcaatttattccaaaagccacttatttcagttaccccatatttgcggacaaattcactccagacatttgcgcctatgtccaaacgggtttttagttttttcaatcctagaggtcataagcagaattagagataagaaaaactatgttttttctagttttttagcagcattaattttttgtaattgttttattttcaaaaatttactgacaatcaaactatcgaatacagtcactttctatcacttctttaatgctgtttatgacctcttggattgaaaaaatgaaaaaattcaaatttatccgaggcgaaaatgtctggacacgcatatatctgtgttctctcttcataaagaagttactatttttattatatgaaaatctttattttgtaattacttttttaaagcatggagcgagtttgtttgcatatgaacaaccttaggacgcgcagtggaattccaatttataaatgtaagaacaacacattttgtaactaacaataagctccccaaattcagttgaaaactcccatttttctcacaataaatctgtgcaagggatgtggacaccgtcaaaatggagagacactcgtcagaatttgcacatacttcccaagccggaattttcgccgttgttgacaaatgctacatctgccactaaatttctgtgggagaactctgttccgccgacagcggaggaagtgaaagacgaaacaaaatgattttgtttatttatttcgatcttttggtttatgaggacagatcacacatttatcccttttcgcgcttctgataataaaaagcgatgtaaaacttacattgtgctgcaaaaattcaaaacagaatgccaagattgcgaaaatattggcatatgcatacatacatatgtttgtatctctaacaatgtatacacagcaaattaactgaagaaaaatcaaattttaggttcaatttcttattctagcaatacaaaatgggtgcagatggaggaactattccaaagcgatgcgaactcgtcaagaagaaacgaaagaaagaaaaaatcgagaaatcgtatgaggctgctacaaaatggcgcacttgccagctgtcacagcaacctctgaaaaagccgattgtatgttgcaagcttggaaggtgaagcgcctctcatttcttattcactgtattttcagctgaaattgcaatttttagactttacaacaaagaggcggtgcttgaggcaaagctggacaaaaccttggcaaaaaacaaagcgactgaacacattcacgcgttttccgatgttaaggagttgatgttgaccgacaacaaagcgtggaaggacaatggaccggagaaaggagacatttacatcggtgaagcattcactataatccccaatcttttaaataggtttaatcataagaaagattccaatctcgggtatttgtatgttggccagtgttgggtccttgaaatttcagaaaaaaatgaaaataaaaatgcaaaattttgagtaatttaattagtacgatccctagcctgttttctagaattaagatcgtttaatttgctcatcaaatgcttgttctactttgtttttcccatttacatttgtactttaagacatgaatgagacgccatgggtttgcccaatcactgccttgccaatgaacggagtaaacaatttttttgtcaattggaagtgtggttgcgtgttctccgagaaagcgcacaacgaactaaagacggactcatgttacggatgcggaggaccaatgcaggagcaacagttcatcaagctgtacccggacgaagaactctttctgctgtacgaacaacgaattgttgatgaaattgcgcagagaaaactaaaggcgggggaaaagaagcgcaaaacgaccggcgattcaaagggcgcggagcatcagcaaaagaagagcaaagtcgaagaagagactaagttcagcagcattcaggacaatccgaacgtgccgaaggcggtcaagtcgatgttcacaaccagtgaagaggccaaaaagcagccaacagcccattgggtgacacacaatcccctttattattaatggcgatgtgagctgtttttttcatacatgtatttgtaaaataaaaaaatgaattataatttaaaaaccttagttagtgatttgttctcttctcatgtgaaatactccgacattatttatttaatgcattatttttattttataatgagcaaattgaaaaataaaagggagagattcataagaatttccatatttatgaggctgagaagtcctcttgattctatgaatataaaagacattgcattacagaaaatcatttgcatttgttggtttgcgtctgactattcattagaacaaatggatggattgactgagccaatgctttcgacacggccaagcccttcgattggagccgagggaaaagagcgttttgcgcgtgaaaatcacagtgaaattgaacggcgaagacggaacaaaatgacacattacatcaacgaacttgcggacatggtactgaaagtcgctgttgccatcgctattaaacatttcatgtga

SEQ ID NO: 46292 - DNA, 1114 bp, Heterodera glycines
  Genomic contig location: Contig_ID=SeqID_32242; Location=79..1192; Strand=-
  SCN-specific regions: Sequence locations=1-60,82-446,470-499,522 -859,881-973,995-1114
  Gene Ontology: Mol. function=signal recognition particle binding; Cellular component=integral to membrane; Biological process =cotranslational membrane targeting
atgaacaagcccgacttggtgttgtttgttggcgaagcttgggtcggaaacgaggcggttgaccagctggtcaagttcaaccaggcgttggccgacaattccgccgtcggggagcaggcacggctgatcgacggcattgtgctgaccaaattcgacaccattgacgacaaagtgggcaagaatattcaattgaggaatcaaatgtaaaaaccaaaggttggcgccgccatttcgatgacttacatcacgggacagcccatcgtttttgttggcaccggtcaaacttaccacgacttgcgcactctgaacgcgaacgctgtcgtgaacattctgttgaagtgaccgatttgttttgaagcgctttcttttcggactgtcatgaacaaacccattttaccgttgaaaattgtggtgacgtgttaaattccatttattattagtttattattaaacattttacaattagcaggaaatgattcctaaaattggtgttaaattgatgttattcactgttctgatttggttgcttcttatttttccggcatttgtaattcgcttgaaggcatttttctcattgtaccataaataccatctcatggtgtgtgattattgcttcgatttgttataaaagacaaaaaccgattatattaatgcgtcaattttcgaaatttttgtagtaattttaacacattgacttggttttgaggaggcatgccactgttttcccggggcaatatttgggccgtggcgttggcgctcggtacgttcatgttgattagtatgatgctttatctgtcggtggaatcgaacgcgcggcggaggacggcactttacggggacgacgaggggggcaaatttgaggtggaaaagggactcagtaaactcatttactaatgtcgaaacaaaggaacgccaaaatgccattcggagacgcatcgaaacgcttaaaagcgaagtggtggaaaaccgaaaattattggagaaattgggcaaaaagttggagggcattgggaacaatgcgatgaacgacggtggcgaagaacgacggaacggaggagaaaacgcggacagaaaccaaaacggagcgcaaaaggaagaggcggaggaaattgag

SEQ ID NO: 46293 - DNA, 385 bp, Heterodera glycines
  Genomic contig location: Contig_ID=SeqID_32262; Location=1197..1581; Strand=-
  SCN-specific regions: Sequence locations=1-385
ttgcaagccaatgaatacacaaatcaatggtcattccatccccgcaggacattgacaagaaagtgcgtcaggaggtggacgaggcggtcaaagtcgcactttcagacgaaggcatggcgcttcattgtttccaccttattttgttgttttttcagttttacctccggaagcgctcttctccgatttgtatgccaacactccgccgcttgcggtgcgcgggacgactgccgacgcaaccgtcacacagccatttgtgagcacggcggaagtgttgagaaaaatggggagggagccgaagaattattgagagaacgaacggacagatagccaaagacgcattgataattaggagaagcacggaataattaattgttagtcaattatt

SEQ ID NO: 46294 - DNA, 703 bp, Heterodera glycines; identical to SEQ ID NO: 32283
  Genomic contig location: Contig_ID=SeqID_32283; Location=1..703; Strand=+
  SCN-specific regions: Sequence locations=1-115,137-355,377-479,514 -613,635-703

SEQ ID NO: 46295 - DNA, 1830 bp, Heterodera glycines
  Genomic contig location: Contig_ID=SeqID_6720; Location=974..2803; Strand=+
  SCN-specific regions: Sequence locations=1-270,355-534,557-600,623 -658,689-1230,1260-1285,1464-1468,1490-1830
  Gene Ontology: Mol. function=cytoskeletal protein binding; Cellular component=cell-cell adherens junction; Biological process =intercellular junction assembly and/or maintenance
tgcttctaatcctgctgagatgttcgaactgcgcgcggaattgaacgcacacgaaaaattggcggaagaaaaaatcacagaatgccaacatttgcgcgccaatttggaactggcacggaaggaggtcagagaagcggaggagcacgagacagtgctgcgcgcagacatcgacaaattggagagagagttggcggaccagagacgcacgacaatgccaatgcaaacgcaccaattaacggtggacaaattggagagcacagaacggaaggtagagagagagagagaaagagaaagagaagggagagagagagcgggaggaaaagaagagagagaaagataagggggagagagagaagaaagttggcataatggcattggtgccattttgttttttttaattttctgagttttatttttggaaattcagtgaatttttgattttttataatttcttggcgtcagcccaacccttagcttgttagcgctataatttttccataaaattaaactaaatttgagttaaaagtgccaattgaaaattaaaggaaatttcagcaaaaagtgccagtttttaatttcggaattttttgccacaatttttaaattgtttttcttgaaatttataggctaaaaaaggaaaaaattataaaatggagtcattaaaattaatttttaaaaattatttttagagccaacaattggagcaacgtttcaccgctcagttggacacgttacagcgcgaaaagtttgaagcggaagcgcaactccaaactcaggtccaattatttgtgaatgcttcacgtcatgtgacacattttcggttcagaaaagacagcagcgtgactgtcgcgcggagatggacgcgctgcgcgagcgcgccggatgcgacgctgaccaatgggagcggcagcggaaggcactcgaatcagaacgaaatgcgctgcgtgcacggctcgaccttgaggaggcaaatgcacgtgagctccatgctgcaaaatgtgaagcggaaagcgctgcacgcaacgcggccgagtacgagcgtcaagtgcacgaaagagaggagcgcatgcgcaaattggagacagaattggcacaacaacggcagcaggtggccatgagttttttgtaaaagattttcaacaaagatattaatatccatttttgcaagtgctatccttgaaaatcatcatcttgattcttaaaaaccgtggcaattaaacatttttgggcaaaatttaaaaaataaaaatgaatttttactcatttatcatttaaacattttaatttaattaattaattagttaattatcaattaatataattaaattatttaattaatcattaattaattatcaattaataaaattaaattcattaattagtcataattaattacctcaattaatataattaaattaattatcaattaatattattaattaaattaatcattaatttattaaattgatcagcaataaacaataaaacacttcaagactgatgccgaaaagaaaaagtcgcagctctaccgagaggaactgatcacagagcaaaatcggcttagcgatttgcttggtcgcctccgttctggttaacactgtaatctgctttttgtactcacagtaatttgttttacagtatgccttatggcgctgcgttccggcgctgacgaagcggcagacacttcctgttgtttggagccgacctgcatgcaggacgacctgcagctgattgcaatcattgatgatctgctgatgaaggcgttgacggacgcacgccgggaggcggacgcactgcgcgtgcagcaacagaaacaaatccgcgagcttg

SEQ ID NO: 46296 - DNA, 1257 bp, Heterodera glycines
  Genomic contig location: Contig_ID=SeqID_847; Location=1810..3066; Strand=-
  SCN-specific regions: Sequence locations=1-178,201-225,250-412,435 -1257
tttttgttgacccaccagcaacggaaaatgggcaacgaacacagcggcggtcgctttggtggcaacggcacaaacaaagaaaagggggacgacgatggcggtcaaacatctccgagcacttccactggaattcccgcctcattttcttttctcgctaagaaacgtatgttaattaggtattaaatttaaaatgtttttctcatatttatttgcatttttgcaaagtatttatatatttttttattttttcgctaataataaatgatgtctaggaaattcggcaaaaagtgcggtgatgggcagcattgtcgtggtcatcgagggggccagctgttcgtcgtccgctgtccctggcaaagacgtggaccttcggaggataaaggcacggattttccgtcgtgtggttatctttaacgcctttttaggaaattcctcgttttttgcctttactccgcggagttttgcccggtcacagagacatccccgaagtgcagcagaaaatcgacagcaaaagcattcttagttttatgcatcgccttcagcaacattttaaaagctgtgctcaaacggtggcgactgagcagggccgaatgttcgcccgaattgtcgaagtcagcgggggggggggatgatgtggaaatgacaagtcaagaaatcctgttttcccgaaatatccattttctggtgtaatgaatgtactaatttctttaaacatcaatttaatatacaaaagtttacatctccccgttctgacttccatcataagtctcatgattatgacaaataatcccccccccccttgttttcttttatgggtcgttattctgtacaattaattgccttttattacttttgtcagattgaccaattaatttcgtcgctgttcaaaaagacttcgacggccacaaaaagattggacgcactgaacaacgaattgagaagggtcggcactttttccagccaattggaggaaattcaggcacaatttatccgcaaattgacaatttctccaattcctcccccatttaggcttctcttctcgatttgtcctcctccgccaattcgctaaaccaacttttgtccttcgacgaccgtttgccgcctcttcaattcgcatttactccaattttaacgcgaaaaaagttgtcagaaaatgccgggacaatgttgcctcaaaacagtgacaatattaattcgggtgacagaacggcgattgaaagggatttgaggaaagtgagcgaattgcgagtggtggac

SEQ ID NO: 46297 - DNA, 1038 bp, Heterodera glycines
  Genomic contig location: Contig_ID=SeqID_847; Location=444..1481; Strand=-
  SCN-specific regions: Sequence locations=1-124,146-903,925-964,988 -1038
  Gene Ontology: Mol. function=structural constituent of cytoskeleton; Cellular component=actin cytoskeleton
tttcttacgccgatggatgggccgccgcccccgccgatggccaaaccggggcgtattcggatgttccgctcgcttaagcaattcgtgccgacgaaggcaataaatttgttgcgatgttcggaatggaattgtttggctttatttaggctggtgagttaaaattgtacggggaggacattgtctatgtgaaggaagcgccggaggggacgaaaagttgcgaagcgaaaagttccacggggcacaccgaaggaattctgccaaagcaattcggtgaaaatcacgagaaatgagtcaatggcaattcgtacaataataaatttacgaaataaagcctgatcctatcgtaggcccaagaagcttgagactaagcccatatttgagttgcctttgttcgaattgtcatggcacccgagaaagtgggacgaatcggcaaaaacatttgtcagttgaacaacacatggaactcatcgaatttccattacacgaggcggcgagggccggagatttgagctttttgagggagtgtttggacaacaaagtgcgcttttccttgtgttgcatgacgggtggcaccacagtccacgcgtggcatttcacccccccccccctccgtagtcattttccccaattgtcagatgtccgtcaatgggttggacaggtccggctccaccgcgttgcactgggcggcgtatgccgggcacacgcccattctgaagcatttgctgtccgtgccgaatgtcacacttttggcccaagtcattccttcccttgcccccttttctctcacattctctgtactttaatcagaataaattgggcgattcgcctctccacgcggccagtgcaaagggtcggttggactgtgttcatttgctggtcgaggcgggggcaaatgcgcacgtgaggaacagaagaggacagagaccggtcgatgtgacaggcgacccgcaagtgggagcactgctgaagacgacgatgacgacgacgggggatgacatgacggagggagacgaggactatttggaggaggaggacgac

SEQ ID NO: 46298 - DNA, 1121 bp, Heterodera glycines; identical to SEQ ID NO: 32322
  Genomic contig location: Contig_ID=SeqID_32322; Location=1..1121; Strand=+
  SCN-specific regions: Sequence locations=1-5,27-36,69-115,148 -1054,1079-1121
  Gene Ontology: Mol. function=ATPase activity; Cellular component=DNA replication factor C complex; Biological process=DNA replication

SEQ ID NO: 46299 - DNA, 894 bp, Heterodera glycines
  Genomic contig location: Contig_ID=SeqID_32335; Location=518..1411; Strand=-
  SCN-specific regions: Sequence locations=1-378,401-628,668-683,761-894
  Gene Ontology: Mol. function=DNA binding; Cellular component=nucleus; Biological process=hindgut morphogenesis
attatgcaatgccaacgaatggcacaaaaaaaaggccgagggccaaaatcattgattgccactgctgctgtcctttccatctgctaaaactcaattcgtccttttcagtttattaatttaattaatgcaccaattccaacgttatgacccggcccagccgaggacagtcacttctttcaaaggcaccgtttgataacactcagaatgccatggctaatttgcttaaatattcaggcaatcagaagctgatctttgagggttaccgttacaacattcaccacgtaataccgtataatgtatcacgagatatcgtacacatttccactcgcttcgtcagattgtgccggcaaagggcgtaaaaacgtggcgatgtgtttgtgccaagaaattgacctgctcgcgctcgtggtgcaaaggcagggcggagacatgggacgacgatggacagggcatttccaaaggcgaacacaatcacccggcggaacacgaagtgagactaactgaaactactacttaattagttaagaaagcgctagactaactggaactattaattaattatattggaatcggtaattgaataattacggagttcctttacaggtggccgaattggaatacttcaaggtaaaaataaaaaaataaaagaataattaatttaattaaagtagccaaaaagtgacttttttcatttttttttgtttttttttattttttaatataatttttctttaataacttttttaaagaatataaaaatccattctcggctcagagtcagctcattttggccgcaattgccagtccgaatgccaatctgaacgaattgatcgacgaggccatcggattcatgagcgaaggcgtcagtttcggcagtcgagaatctttaaaaaa

SEQ ID NO: 46300 - DNA, 854 bp, Heterodera glycines
  Genomic contig location: Contig_ID=SeqID_32352; Location=1..854; Strand=-
  SCN-specific regions: Sequence locations=1-329,352-454,476-674,697-854
  Gene Ontology: Cellular component=membrane fraction; Biological process=metabolism
cttttcgaggtgttcgtcaacgtcgatgagttcaccgactttcctcggcctctttttcccaatttcattttcatcggcggattggaactcgaaggaacacccgagctcaaagccctgcaggtcctttcttctttcgctcatcactgtcctcatttgcctgcatttaatctgacccccgaaggagccgtacaaaagtgagctgctgaaggggcgaaagggcgtcgttttcttttccatgggttccgccgtcaaaacggacgttttgccggcgccgtttatgaaaaatgtgatcggagcatttgcggaactgccggattggcatttcatcgtcaaaatcgagccggacgacgaacaaagccggaggatggctgagaacgtgcccaacattcgccttacttcgtgggcgcctcagcccgccattctctgtgagctcttttccaattaagtcgatgtgttggcaaaagaaaccaaaaaatttggcacttttcaaagtcttacacttcatgttgtccttcgcaaagagtgtttggcttttcctatgcttttcctttttcctatgcttttccttttggttttccctttgctttttcccattttccaattgcctccccctcctcagcccatccccgcctccgtctgttcattacccacggcggttacaactctttgctggagggtgcacaaagcggcactcccgtgctcagcatcggattcttcgcggatcagcgaaggaatgcattggttgcgcagagaaacggatggggaagggcatttgaaaattggaaactgttggaaggaatgaacgaattcagagagacggtcagggagatgttggaagaggacaacgagcagtt

SEQ ID NO: 46301 - DNA, 2269 bp, Heterodera glycines
  Genomic contig location: Contig_ID=SeqID_6733; Location=39..2307; Strand=-
  SCN-specific regions: Sequence locations=1-81,103-685,708-942,964 -1139,1161-1676,1698-1762,1784-1815,1837-2170,2192-2269
  Gene Ontology: Mol. function=ATP binding; Cellular component=nucleus; Biological process=protein folding
atggctgggattgactttgggaatttgacttgttacatggctgtggcgcggaacaaaggaatcggtgggaaaatatacaaaacatttctgacaattcttaaatgttttagaaattgttgagaatgattactctttgcatgccacgccgtaagttccgtctcccattttccatttttgcatttgtccgaatgtcttttgttttcagttcgtgcgtttcctttggacaattcgctcggatgatgggtttcggggccaagcagcagctgaacgtcaattacgggaacagtgtcgtgaatttcaagcacatcctcggacgcactttcaatgacaaagtcgtgcagacatttcgtcagcacattccctgcggacttatggggaagttcaccgatgaccaaattgagataaaagtgtgccaaaacgtcacaaatcattttgtaattaggaaatgtgttttcttaggtcactcatttgggcacgacgcgagtgctttccccggaacaggtggtcgcctgtctgttgacacatttgcgggttcagctcagccgttctctcgggacggatgccactgaatgcgtcattaatgtgagatctttcttttcggtaccaaaaaggatgggcggataggaatagttttgggtgttaaaaatgctcttcaataacccaacagtttgttctccttcaggtcccgtttttctacgaggaaaaccaacgccgcgctttgctgaatgcgggtcgaattgctggcctttcacttcgcctgatcacggacccggccgcgttggcctattgttacggcatgtataacggggcaaagtgagtgagggacaggcccatcaccaaaaaagttggagtgggacctggcaactttttttatcggcattaattcttttttggctttgataaacataagaaaatgaaatttaaaacttaccttgtattatataaatttgattatttttccaacttttccaattgtaaaaccctctttttaacacgcatttttcattctcctctttcagtcttcctccacctgaacagcccgctcggcttgttgcgtttgtcgatgtcggccattcgtctgttcaagccagtcttattgcattcagcgccggcaaagcggaggtcagcaggcgaatgttgtaaactccttaattatttccattttaggtgctcgccgcctctttcgatttgaccgttgggggcgtccatttcgatgcgttgttgcgcgactatttcaatgaggactttggcaaacgcttcaaaatcgacgcgaggaaaaccccgcgggcgtggctccgtttgttggatgaatgcgaaaaggcattgacaatgaaaggcacaaacgaattagaactttcagatcaaaaagcaaatgtcggcaaacagtcagcccattccctttgcaatcgaatgctttgtgaaagacaccgacgtcaacggagtgatgcaaaggtgggtggtgggacagtacctgagttgttttaggatgtatgaaagtccatgggacgcgtaagcgttttccccctctgctgaattttgaaacaaaaatagtcatcaaataattacaaattagggaccaattcgaacaattggcggagaaactcttccaaaaagtgcaggcactgctccaacagctcattagtgacgcgaatgtgaaggtaaacaaaaacagtcaattaaaaataacaagtttttaggtcggcgatattttcgacgtcgaattggtcggggggtcgtcgcgaattccgcgcatcaaacaaattgtggcaggtagtaaatttggaaaatcattaaaaggatgaataaaagtcggctattttaagagtttttcaagaaggtgccaaaaacgacaatgaatcaggacgatgctttggtgagtggccttggactcaaaaaacgaacggaacttctcttaggcccgcggatgtgctcttcgttcggccatgctttacccggcttatcaggtgaagaaattcattgtgatcgatcgctacgaaatgccaatcgacccatcggcactttcggacgaagagaagttaaaagaggagatcagagccgaagtgagtccaattttttttttgtctcgtgcatttggctgttcagcaagaaatgcagacggccgacctacgcgacaaacaacgatcggatgcgaagaacgctttcgaggagtactgctttaaaacccagcacacaatggagggtgaacagctagccaagggcaaagagagcgacgaggagcggcacaaatgtatcgaaaagtgcaaaggaa

SEQ ID NO: 46302 - DNA, 469 bp, Heterodera glycines
  Genomic contig location: Contig_ID=SeqID_6737; Location=700..1168; Strand=-
  SCN-specific regions: Sequence locations=1-469
  Gene Ontology: Mol. function=electron transporter activity; Cellular component=mitochondrion; Biological process=cell cycle
atgactgctagtcgaagattgactcgcgcggaagtggcggaacacaataacagtagcgatgcatggataattattggcaacaaagttagatttgtaaacgaaaaaaaagcacttatctttgactacaattttactgttttgtgggcgtaaaatgcgagctaattgtcaatttctcaaacggatttattccttcaaaggatgagaaaaaacaatacaaattcataagtttatccccataaaattatgccatattttatttaggtttacgatgtgaccaaatttctggacgaacaccccggcggaatggaagttttaatggaaaaagcgggcgaagatcgaaccgaggcattcgaagacatcggtaaatgacaatgttttaataaaatataatggaattattcaaaatttaggccattctacggacgccaggcaaatgaaagaagattttctagtgggagaaattgtcgag

SEQ ID NO: 46303 - DNA, 1044 bp, Heterodera glycines
  Genomic contig location: Contig_ID=SeqID_6738; Location=220..1263; Strand=+
  SCN-specific regions: Sequence locations=1-433,467-489,512-687,709 -1009,1031-1044
  Gene Ontology: Mol. function=protein phosphatase type 2A, intrinsic regulator activity; Cellular component=soluble fraction; Biological process=protein amino acid dephosphorylation
atggtggaccaatgcttttcgaagccaaaacgtgaaattttgggcattggtgatgtttccaaatggctgaactcagaggctcatcacaaatatatgggattcttacgccgtcttaattctgccgttaaaactgtgccgactacttcatcagatattataatcggagaaactgcccgtaaaataatttccattttggacttacttgaggtgaacacataagctttttttcatttcatataattagaaagtgtcctgtacttgtatttgtatcccgaaaatccaggtccaaataaataggtccaggcttttcagtttgtcgaattctacatttttttttgctaaggcctggataaacgaattccctcctgaagatatgggattgcaacgctttggcaacaaatctttcaagaaatgtttcgagcgcctcatgtcggtttgtttttcttttcttttgacgtcccaaaaatatattaaatgccgatcaatgtaatttaatttttaatctttttaaggatggacaaagtttgctgagcgatttgtttcccgaaaatttaaagtcagctgttcttgaaatctggccttatttgatggattcgtttggaaattccactcggattgattatggatcaggtttgtcagtgaaattgacaattaatccttgaaatattaggtcacgaaacttcttttctcattttcctcttctgtctgtacgaaattggcgtgctccattcgcccgacgatgaccgagcttccatcttaagggttttccatcggttattttttgcccaaataacaaataaaaatttgtgatttcgattcgtatatatcacatctttccggttcactgtttttaaccgttaaatttgtttagatatctgaaattagctagacgacttcagtgtgagtatcgaatggaacccgctggttccagaggagttcatgccattgatgactttcagtttttgccttttttgtttgggagcgctcagttaattggtaggattctatgtataatatatttttaaatgaatttcaaatcagaca

SEQ ID NO: 46304 - DNA, 819 bp, Heterodera glycines
  Genomic contig location: Contig_ID=SeqID_6739; Location=2772..3590; Strand=+
  SCN-specific regions: Sequence locations=1-110,137-350,374-562,584 -706,728-819
atgtcctttttgcaacgacctccttcgtccgtgaaagaccatcgacggacttgggacaggacggaatatgaagtcaaggcgcaggagagactgactaccgaaagggaggcgttggaaatcaaaaaaggaaacatacggccaccgccgaagggtccgaagattaaacgggaaatgctgaagccgagggaattcaaagtgggtgctttcgcggcactataatttttgctttctccatcggcgtaataaatcaatttattgctcaggtagacctcgagtcgaaagtgggcaggcaagtggtgatcaacaaaaccacgccttcctccgagacaggcggttattactgcaatatttgtgactgtgtggtgaaggactcaatcaactttttggatcacattaatggtcagagagcgactcactcattagacaaattatccctgaatttgtaggtaaaaatcaccaaaggaatttggggttttcaatgaaagtgaagaaaagcactgtcgaggaggtccgagagcgtttttcaatgaaaaaggcacaaagtgagcagaaaaaaccgaataaaagattaaaattttgtaatgtccttaagaggaaacactgcgcaatgaggacgtagaggagaaacaacgcgatttgaaggaggaagaggccaaaatggcggatctgaaacggatgcaaagggaacggcaaaaggagaccagtcggaagaggacggcagcggcggtgacggcaccgcccacggacgaagaggcggacgcggaactgatgaaagtgatggggatcggcacatttggcagtaataaacggaagaaatga

SEQ ID NO: 46305 - DNA, 421 bp, Heterodera glycines
  Genomic contig location: Contig_ID=SeqID_32404; Location=6..426; Strand=+
  SCN-specific regions: Sequence locations=1-421
aacaccaacactttcaacaatccgcaattatttgaactcgaacaagcggccgccctcggcgttagtcgtgcgaaagacgtcgccaaaatattctctctgatgctttccggcgaactgatctcgccgaaatcgctgacgcggctgttaaaacctcaatttgttgaccggattgattacgtcatgatgatccccgtcagtcgtggcttcggctttatgtatgaaaagcacccgagaaaatcggtaaggaaaaaggagagggcatacgattggaagagaattttatattggacgctttctgtttatgcttaagggcaaatggctgtttggacacccgggatttggaggatcgacgctaatggtggacccggaggaggaattagtcatcgcttatgtgtgcaacgggatgaagacaggcaaatga

SEQ ID NO: 46306 - DNA, 1357 bp, Heterodera glycines
  Genomic contig location: Contig_ID=SeqID_6756; Location=3185..4541; Strand=-
  SCN-specific regions: Sequence locations=1-260,297-405,436-822,846 -894,916-1141,1163-1205,1227-1357
  Gene Ontology: Biological process=reproduction
atgaccgaacaaactgagcgcgcataccaaagacagccgaccgtgttcttgaacgacaagttcagaactcaaggaattggaaagaaggcggccaacaaagaccgttattggaagaatgttgggcttggctttaaaactccccgtgaggtttgaattttcatttgcttggtttggggtactgatttgcctaaagaacagtttttgttccaattcttattaaagtacatattttaagaatgtttttaggctattgagggcatatacattgacaagaaatgccctttcactggaaatgtttcaatccgaggccgaattctcaccggagtagtcatcaaaaacaaaatgcagcgaacgattgttatccgtcgcgactatctccatttcgtgccaaagtaccgtcgttatgaaaagcgccacaagaacatgtctgtgcattgttctccgtgtttccggcaagaattaactaaagagttgtcttaaggtttgacctattttccagggatgtgtccattggtgacatcgtcacaattggcgaatgtcgtccgctgagtaagacggtccggttcaatgtgctcaaggtgatcaaagcatcgggggcgaagaaggcgttcgacaagttttgagagacccttatttgaccaccctattcattgttgctgtttgttatgacaaaattttggttgaaaaactgttggatgtcagacagtcgtacactaatcattcgtatatgagcatgtagttcggtaatactgccgaatgtcagattcgtgatcagcggccctaaaaaccccatgaaacatgtggtcacgactttttagaacagaaaaaacttttttcaaaaagggtgaagtttagagggaatcgaaattcacctcgaaaataattctcaaaacttcttaaatataaaactttaaaagtaccatcgttcgaataatgcaaattattgaaacggaattttcacagtaaatgagaaaatggtggtcgccgatatccggttgcctaataatgcgtaacacgtattattaaatcaaatgaacgaccaactcgataagccgacataacaaataatcatttaatggatattagctatgttagaacctaatatgtaaaccataatttatcattgaaatgtttgaaaatacatttctatttttctccttttcatttgcgacttctctttcctactggcgtttcagtcgattcctttttgacctttgtttcttcactgcgttttctcttgctttttcttttgcgattagtcctctcctcctctgaactgctttcagttgaggacgaagaagctgcgtcaattccaagtgctgaacgccttttatccctactgtctgcaaagaataaa

SEQ ID NO: 46307 - DNA, 2946 bp, Heterodera glycines
  Genomic contig location: Contig_ID=SeqID_6761; Location=2554..5499; Strand=+
  SCN-specific regions: Sequence locations=1-470,492-972,995-1733,1756 -2360,2382-2654,2677-2737,2760-2820,2842-2946
atgggatccaacgaaattcgcaatgcgcttttggacgtcgcggcaccggatgaacagaatggccaacaagcagttcgaaatgaagcgggacgaggcggaggaaatttcgagcaacagcatgttgatggaggtttgcgaattcgattgcaaaacgttgggagaaataacggacaacaatggcaaattagaaacgaaaattcgaatgatggccatcgcattttacatcccgcgccgcaaaatgttagacctaggacttcaaccccatacgaaaatatgtttgaagagttgcgcgtagagcacaccgtagaatgcagaccgcacaatcaaaatttacaagcaaattttcaaaacatgttgaataatggtgtagctatgcagaaccaaagagttaccgcacccaccggtcttcagtcgcatcctcagcaaattcatccgcacccaattcaacaaacgcaaccacaacagccatcccaacccatgccagcccaaccagtttttcaacaaggatttcctgggtttatctggggttatccgggacaatttccttacggtccttatccaactgcttttggctaccctccacagcaaaattttggctatgtaaacccaaacctccaacaaccgccgatttttaatcagcaatttccgccaccagttttgcagcatgcaaattatgcaatgggtgtacctagccaacagcagccaattgtacaagcaaatcagcagagagaagttcttcaacctgttgcccagcagcaaaaccctccgattacaaaccgtccaaacaattttggtactcaaaatgcgggtgctgaaattcgtcaaactgaaaatgaaatccgtggtcccgggatggaccaagtcgcatatgctctgattatgagtcaaataccttatttaaagggaaatgaaggcgctgaaaaaattaaggagtttttcaagcgttttgacgctaataccgctgaatggtccaatgcaaaacgcattacctcattagaatcaaaactctttggtcgggctgagagagcttttaagtctgcgtgttccaccgaaccgtaccgatatgagtccataaaaagagaaatgtttcggcagttggaagaaacggatgcccgtgaatggagtgcttttgatcagataatgaccggtattcgacgaaaaaacgacgaggatttggacagtttggctgaacgtgtcatcaccctggtacgacgcgcatacccaggtttgactgatcacctggtcgatgattatgctatcaagcatttgattcgaacattcgacaattcggaattggcactcagtttggaattgggaaggacacccggaatgacatttgatcattttgtcgggatggcggcgagagcagaagcgactcaaagggcaacccgtcggatggcatcgcaaaatgctatacaaagagggaggcaaaatgaagcgaattcaacgggaggatttttcaacaattcgcaaacacagcaaacgaacgacaaccgcccaaaatgctacaattgtggaaaattgggccatgttgccagaaattgcttcaggcgtcaagccgaacaaaatggccaaatgcgaaacttcgaacatatcccaacgactggtgcaaactgtaccccaatgccgagtaacccaaatacgaattttatgagcaaacccgaacaaaatgctaatcagcaccgtcctcaacattttcaatcaagaaattttttgaaacaaaatttccttattgaaagaaaagaagtgaaagacaatgaggacgcggtcaaatgcacaggtgttctgaacaatgaacccgagatggaggaatttttcaaaagtttttgggaggagcacgaagacaattttgaagctgctggcaaaaaggaactgtgcctaatcggcaaaataatgacaacgaatgttacaatttttgatcagcccgctatttcgatgatggatggcggtgcacaagtttcacttattaaggcggagtttcttaaaaatattttggaaagtcagaaattggaaggcacaaatctcaaaatttggccgaaaacccggaatgtcgttgacattaatggaaagcgtgtcgagtgttatggaattattttgttgccagttgtgagaagaggttgtgaagcagttgaaattatgttccacattacggatgcgcctattggacatccaattttgtttggaacaaatgcacttgggctccttgggttcaaaatttttgatgctcccaacggcgaattagtggaatttgagtgtgtggacaacaagtctgattctatgcgtgtaatttacagtactttggttgaaccatattcaacaaaatttgttgaactttcaatttcgccggattttgacgacaaaaatgttttgatcactccaaaagaagagaatgacagaattagggttgagtcttctgtagataaaggcagaaagggaaaagtgattacggcaatcacaaatttttcacacaaagcagtaattttgaaacaaaacgaagaaattgctgcagttgaagagttgaagcaaattgccaatgctgacgattgcttgggacgcattgtgcgcaacagacccggaccaatgacctccaagaaacgcgtgttggggttgtgcgccgaatgcgacaaaccgatcactgccggcgctcgtcagatgcacatgttctaccaccttggcaaagacatgaatacttatcgtttccgttgcaaacatgcgggatgcaaagtgcaagactatcggaaggatcagatggaaaaccatcagtcgaaagcgcacggaaaagttgacgccgaaatgatggaagacagaagcatggaattgtacaacatggtccaagaaatgtcaatgcaattgctgggcaccaaaggaaacactcccggaccaactgcagtgaaagcgcaacagatttatgagcagcaaatgcgcgaaatggaggccaatttgggg

SEQ ID NO: 46308 - DNA, 1256 bp, Heterodera glycines
  misc_feature (36)..(36): n is a, c, g, or t
  misc_feature (40)..(40): n is a, c, g, or t
  Genomic contig location: Contig_ID=SeqID_858; Location=1..1256; Strand=+
  SCN-specific regions: Sequence locations=1-90,117-119,147-191,213 -350,372-392,414-497,523-716,739-1256
atgtccagttttttttgttacggcgtaattgcgatnttcnccctaaaatcggctccttgtgtttcaggtgactcgggcgtcggaaagacatcgctgatgaaccaatatgtgaacaaacggttcagcaatcagtacaaagccacggttagtgcctttttcctgtttttgtccatttttcatttgtttcccttcagattggtgctgattttcttacaaaagacgtgatgatcgatgaccgacttgtcaccatgcaggtcaaaaattggattgtaactttttgttccgtgtgttttccccgaattgctggtcacgaatttgacacccattcgactgattccgaatcgctaacccaaattttaacaaaaattttgcattccaaaagggcccctcatattgtttttaaaattggtgacttaaaccgaatgcgtaccgtctttactttgctctttattcgtacaaatgccattttcgatttgtttgtacggcacttttccacagatttgggacactgccggccaagagcgtttccaatcgctcggcgtcgccttttaccgtggtgctgactgttgtgtgctggtgcggacggccaaacattgggccacccaattgaaccgttgccccccccccttttaaggtttacgatgtcactcacgcgccgtccttcaaatcgttggagagttggcgcgacgaattccttgtgcaggcgaggtgacccattggaattggcactttcaattagcagacaaatgccgagcaccgaaagcattttaaaaaagtgtctaaaaagcagtccaaatacgaattttaagtcctcgtgatcccgaacactttccgttcgttttgctcggcaacaaaattgacaatgacgcggcgcgtgcagtgaatgcaaagagagcgcagagttggtgccagtccaagaatgggatgccgtactttgaggtgaattccacgcaaaacatttaaaaattgctacacaaactcaaatcccgttccgattagttgaatttaaactttttttggcattttctccatttttcaggtctctgcccgggacggagtgaacgtcgaagagggtaaaccatccctttcgcttttccattctctcccatccaacttttgcagctttccaagcgattgcccgtgctgcgcttgcacgcgactcgcaggaaacgcacgacttcccgggtcggtttgcgggataaaattgggggaaaatgttgccaatcatttttttttggatgaaaaaggcactcgta

SEQ ID NO: 46309 - DNA, 1071 bp, Heterodera glycines
  Genomic contig location: Contig_ID=SeqID_32526; Location=90..1160; Strand=-
  SCN-specific regions: Sequence locations=1-145,167-310,332-495,518 -747,770-980,1002-1071
  Gene Ontology: Mol. function=signal recognition particle binding; Cellular component=integral to membrane; Biological process =cotranslational membrane targeting
agttcactaaaatttgatggtcgactcgcattgtcacgtgggagagagttggcgaacacggaaatgctgaagcagcatgttgaggacgtcctgaaggcggagcagtacgcggcttggcacgtcaacgagtaaatgcagcggtgagaaattggtgcaatatgaaagacgggaatgcgtttgtgcattttacactaaatttagaaaaaatttgtcggtacgctgaagggcgatttgcccggattggatgaaggagagcagcaaattggggacagcgaagagtcggagagcgacagcgaaaatgaccacggggaaaggtgctttaaaactaaaatttgtatgtcagccttaaaattcagcggagcgaaaccgaagggcatttcggcttccggcggttggttttcggcattcaaatcgctggtgggcaccaaacagcttgcccgaggcgacattgagccggcgatggagaaaatgaaggaaatgctgatcagtaagcattatttctttctttaaaaaattgtttaatataatcaaaaagtaaaattccaatttaagcaaaaaatgtcgcgtcggaacctgctgaacgcatttgtgagtcggttgctgccaaattggagggcaaagtgatcggaacgttcaaccgagttgcgtcgactgtgcgcgaggccatgcgcgaagcacttgtccaggcaattaattatagcgaaaaaagggaagggtaggtgtaaaggagggaaatacggagagagcaaaatttaaaaaattgttgtttggttgttatgtccttggacattatctttcgttaagatcatttgatatcgtttttttcagttactcactccaaagcgccgcgtggacattctccgcgacattttggacgccaaagcgcaaaaacgtccctatgtgattgtgttctgtggcgtcaatggcgttggcaaatcgaccaatttggccaaggtgaactcagaggaggaagtgttccctttatctgttttctctgccaacagatcactttttggctcaatgagaatggccatcgcgtgctcattgccgccggcgatacgttcagggcgg

SEQ ID NO: 46310 - DNA, 2017 bp, Heterodera glycines
  Genomic contig location: Contig_ID=SeqID_6773; Location=2215..4231; Strand=+
  SCN-specific regions: Sequence locations=1-264,286-362,384-927,949 -1134,1156-2017
  Gene Ontology: Mol. function=3'-5' exonuclease activity; Cellular component=nucleus; Biological process=telomerase-dependent telomere maintenance
atggtgcagtttattgggttaaaaattgcgggggtcagaagcattggagacaaaccgcagtgtatcaattttttgtcgcctctgacaattattcagggaccaaatgggacagggaaaacggtgccgtaatttacactaaatctaacaattcaattttaaagaatttgcatccaattacagacaattatcgaggcattgaattacgtcacgacgggtgcgctgccggcgggcaaaatgcaaacattcattcacaatgcacaggtcgaaagacacacccaaccaaactcattttgttttatttctaaaaaaaattacatgaattttagagttatgaataaaaattatttttttggatgaaaaatgatgaaaagcctaacggtttttggcatagtaattcattttatttctgtttcagattgccaacaaagctcgtgtcgatgcgctggcgcagctcaacttcagagacatcaaagggaacaaatgcaccgcgacgaaacgaatgaatgcgagcgcaactcacagcgtactgaggggggggggggacggcacggggacaattcgtgaaaatttaaaccgaaatgaattattttttagggcaaattgtcaacaaaatcggacgaatttacgctgagaattgaagacaaatttggcaatttgaagagtgtttcctccaaaatctcggacttcaacaaggagtcagtgatgattctgctcacattttgtactaagtttctttcccaatttaagatgctcaatttgttgggcgtcccaaaggccgtgttggagcatgttttgttctgtcaccaggaggaggccaattggtgggccaaaaaactcaaaagtttaattaaactcactgaagtcgggggggggggggatactcattggaaaaaccataaataaaataattggttacatggtgcaaattttagcaattttgaaattaatgtccaaagtggggctcttgaattttctgcattttgcttgtgtattggcattccgtcgtctcttcgtttttaggcctttgtccgagccaaaagaattgaaattgcgtttcgatgcgatttttgaggtgacaaaatacgtcaaagcattggaccacatcaagaaaaacatcaaagaattggtgggttggcttcttttaaattggaaatgctgaaaaaaaagatttcagggcatgcaaattcagctgatcgacaaggaattgccccatttggagaacaacatgagggcacgtgccgatgttcgtccattttgagggcggagtaatgccaatggcacacttacctcctaaaattcgggttttctggcaaccgtaccctcgtcaaacccccgattttcaatttctctcccaattcgttgtactttttcagctccgtcttcgctttgatgaaacgctgaccgcactgaagcacaatcggaagagcattgagcaccaattgaagacggaaagagaggcggtggacggcgaactgcgcaacattcgcaaacatttggaaatggccaccaaatgcaaccatgagtttggtcagttgaccatctctgggcattttgagattttctgaattgttcgtgtcgtaaaatgcgaaaattcgatccgtaactttggtttgtcgctcttccaaatttttccatttttcagagattatccaaggccaaatcaatgcgcaaaagcgctttctcgagggaatgccgccgttgacgcacaaaggcacgcgggaacaactccaacaacaaattgacgaggtcagtgggggaatgacggagaaataaacaaataaaatcggacgaattggcaccgaattcagtgccatttttaaccccaattgcttttggtttaaatttttgttgtccgttcgttgttcagctgaagcgttccgccactgcacgcgaagcggacgaacaccgcgcgtcggttgtgcggcaagtgaaaagcatcgcttttgagatggaccaatgcaaaaagttggaggaggcgtaccggacaaaactgatgcagcacgagtcgagacgaatg

SEQ ID NO: 46311 - DNA, 869 bp, Heterodera glycines
  Genomic contig location: Contig_ID=SeqID_32605; Location=288..1156; Strand=-
  SCN-specific regions: Sequence locations=1-115,142-631,684-869
atggcattgtgccgtgtccaacagtcgctggaggcaatggcctacatttacttcatgcaccaagtgttggaggtgttcaacacggactggtacactcgcttggacaaagcagcggtaaaaaaattaaaaaaaattttttttcagctaaatttggcgccttcagtttttaagtgccataacttttttcttgggcaactaaattcaacaaccttagtatcattcgataggtctaaatgttctctaaatggggggaggagggaacgatacggggacttcaaaaattgagactttatggcagaatttttcagttttttttttgccatggtgccacttttttcatgtaaattttttccaaattttataaagcctccccgaatctgcgaaaaaatgaaaaaaaatttcccttgtgttttttaattaaccccaccacaattcgcccacattttcagaaagaaatgggcatgtcggtgaacaagcgcaaggagggcatggcattgcacgccatttacatcagcacgttgcacgactatgacgaggtgtggtggtaacaactcaatcaatcatcaattaaattactcacccctaatcagttgtaattaccctaattaattgaagaattctctccctctcgaaaaattaaaaaagtatattgaaaatttttactttttttttaaattttttaacggggatgggggcggtataatgcacccaatcaattagtgatggtttgcgttaaatgactaaaattgcagggatttttcggagatgaccgcgtgttggccgccgccgtgtggcgctcatttttccttcagctgccggacgtgtgcccggcacaaatcaaccgggtggtccgttacatgagggcaacg

SEQ ID NO: 46312 - DNA, 2993 bp, Heterodera glycines
  Genomic contig location: Contig_ID=SeqID_864; Location=531..3523; Strand=-
  SCN-specific regions: Sequence locations=1-569,616-1220,1242 -1514,1537-1597,1620-1680,1702-2889,2984-2993
atgaccggtattcggcgaaaaaacgacgaggatttggacagtttggctgaacgtgtcatcaccctagtacgacgcgcatacccaggtttgactgatcacctggtcgacgattatgctatcaagcatttgatacgaacattcgacaattcggaattggcactcagtttggaaatgggaaggacacctggaatgacatttgatcattttgtcgggatggcggcgagagcagaagcgactcaaagggcaacccgtcggatggcatcgcaaaatgctatacaaagagggaggcaaaatgaagcgaattcaacgggaggatttttcaacaattcgcaaacacagcaaacgaacgacaaccgcccaaaatgctacaattgtggaaaattgggccatgttgccagaaattgcttcaggcgtcaagccgaacaaaatggccaaatgcgaaacttcgaacatatcccaacgaccggtgcaaactgtaccccaattccgagtaacccaaatacgaattttatgagcaaacccgaacaaaatgctaatcagcaccgtcctcaacattttcaatcaagaaattttttgaaacaaaattttcttattgaaagaaaagaagtgaaagacaaggaggacgcggtcaaatgcacaggtgttctgaacaatgaacccgagatggaggaatttttcaaaagtttttgggaggagcacgaagacaattttgaagctgctggcaaaaaggaactgtgcctaatcggcaaaataatgacaacgaatgttacaatttttgatcagcccgctatttcgatgatggatggcggtgcacaagtttcacttattaaggcggagtttcttaaaaatattttggaaagtcagaaattggaaggcacaaatctcaaaatttggccgaaaacccggaatgtcgttgacattaatggaaagcgtgtcgagtgttatggaattattttgttgccagttgtgagaagaggttgtgaagcagttgaaattatgttccacattacggatgcgcctgttggacatccaattttgtttggaacaaatgcacttgggctccttgggttcaaaatttttgatgctcccaacggtgaattagtggaatttgagtgtgtggacaacaagtctgattctgtgcgtgtgatttacagtactttggttgaaccatattcaacaaaatttgttgaactttcaatttcgccggattttgacgacaaaaatgttttgatcactccaaaagaagagaatgacagaattagggttgagtcttctgtagataaaggcagaaagggaaaagtgattaatgcaatcacaaatttttcacacaaagcagtaattttgaaacaaaacgaagaaattgctgcagttgaagaggtgaagcaaattgccaatgctgacgattgctttggacgcattgtgcacaacagacccggaccaatgacctccaaaaaatgcgtgttagggttgtgcgccgaatgcgacaaaccgatcactgccggcgctcgtcagatgcacatgttctaccaccttggcaaagacatgaatacttatcgtttccgttgcaaacatgcgggatgcaaagtgcaacactatcggaaggatcagatggaaaaccatcagtcgaaagcgcacggaaaagttgacgccgaaatgatggaagacagaagcatggaattgtacaacatggtccaagaaatgtcaatgcaattgctgggcaccaaaggaaacactcccggaccaactgcagtgaaagcgcaacagatttatgagcagcaaatgcgcgaaatggagggcaatttgggagtgagaaagcggcggaggcctgaatattttggctgcaatcttctatccgccaacatcaacaacaacgtcatctcccgctcttccggtctaccaatttacgactccgccaaccgccgagtggaggatttggaatgtcgtctgtgcaacaaattcatccttaatcgcatcaaaggcttccacatcctttggcatctgaacaccgacctcaacatcgtccgttacggctgcaaacactgcaacttcaagcatgaccgtcctcaatcggtcgttgcgcatggcattcgagagcacggcgacgaagcatcgtgtgaagatttgctgtacaacttcgaggacgagctcaagcaaatgtccaaggcgtgctttggcgtggagcgtttattcgaaaaggaaatacgccgacgcaatcgcttagaacgttttgcgcgatgttcgactgaaaattcctcggcgggccgtgccgaggacgacgacaattaccagcacggaaacaacgagtccaaactgtcacagcaaattgttcgccgccgttctcaacagcatatcatgaatctgagagtctcgttgaagtctgaaaatgttggtcgcgactggacgcccaaagagccggtgaggaaacgacgaagcgggggccgtcgtttcttcggatcgaggggtaggaagcctcgcgtaaggcgcgggatgtgatgatcaaactgcgcgaggtcagcatgcgacttggcggtgctcagtatttcaagaagcgcagcaacgaagccatttcttgtgagaaatgtggcaaactcgtcatcaatcgtctgtctgatcacgcttactctcacttggaggggtgcgacctgttcaagtgccaacaatgcaacttgggtcacttttcgcgtgagacgattgttcgtcatttgaaggactttcacaattcacacgaggctccgatggacaatcgccttcgttttgcacaagaaatcaaagattccattcgcgattgttacccacaactttttatcgatgcaccgatcccgacgaaagaggacatagaaaaactgagagacagtctgaatctgagcgaccaagtgttggtctgtgacaaagacgaagaaggggaggagggcgagcgcgaggaggacggcgaagaagcggcgatggacaaagaccacgcgaatgaggaggaagaagaggcggaaacgagatga

SEQ ID NO: 46313 - DNA, 2244 bp, Heterodera glycines
  Genomic contig location: Contig_ID=SeqID_6806; Location=392..2635; Strand=+
  SCN-specific regions: Sequence locations=1-65,87-279,378-1287,1309 -1587,1618-1743,1770-1834,1856-2032,2054-2067,2089-2095,2117-2244
atgccattcgtcagcgactccagcaaggcgaggtgccgagtgaatcagccgcaaaatttgaacccggcaaaccttgcagtgagccattagctgaattcgttttcctgaggttttctatttgtttttttattttcagatttccaatgagcacgtgccaacgcccggccctggcggagtccacggcggcgcaatttcgctggaagacgccgaagcggcggcggaagaggaagtggcggagacgccggcagtccacgggggaggagttgcaacgggcagaatgaaagaggaggcggatgaagaattggaagaggaggaggtggaggaggacggcgaagaagaagcggacggagaagaagcggagggagatggaggtgaagagtacaacagcaacggagagacacggagacggaagagaaacgcaagaaggaagacggcgacgagacagcgcagcgacagagaggaaagcggcgtggcatccgcggcggtgcggcgcaacctgcgccagcagcggcaaatgctgcgcgaggcggtggagcaggcgaaggaggcgggcacggccacggaataccacggagtgttgggcagaaagacactggtgggcgagagacgggcagagagacagactgatcagtggcgaaaggacaaacgaacattttaaggaggagggggggggagagcgatttttggagaaacaaagtgtttggggagacgcaaaaaggggcagacatattgggcgattggaagaccaatttagcatttcggtgatcagagattttaacaattagaattgcgcggcactgaactgcacacacatcgaatgcgacatcgaccgattggaagagaatgaatttgttctcgtcgaaatcttctcccgggtgttcatttgatttcccctctttctcattttcctcttttatccctttagctttgggttaacactctgatcgacgaggatttgcttgaggccgatctctcctcgttagcttttgctcgcatttcggcacttccgttcgccccaaagtacagcccaccgccgctggtgatcgctgtgaacaccgaagtgaacccgacagaccccgaggcgggcacttgggaattgccggtaaattctgccgatcatcaggaagaattcatcgaatttctgctcatttaaagtggtggctgtggctgctggccattctgatcgctttgcttctgttggcagtgatcattttctgctgctggaaggtgaacccaagggaatgccattgcgaaagagtgcccttccctttcttttttgcccttccgtttttaaatttaattttgatcagtcaaaagggtcccttgcccattgcaatcgctgcgcctatccttccaattgcttagcaatccctcccattgcttctgatcactttcagtgcggcttcttcaaacgaaatcgtccgccgcgagaaaaggcgcgcctttcgcgtgggcctgccgctgcggcgacaaatggcggcgaacatttcggagaggaaaatggccgcgggcgagggggatattacgcggataaccaagcgagatacgcacagccacaaatgtaaggggggcgggaggggggatttcaatttttatttaaatttattaaatttaattgaaatgtttaaggtattcccccgaaagacacggcgcgcgagtgtgagaagaaaggctaatgaagaagactaattggttgactaaccaacagccaatagatgagattctaaaacccacacttttacttgttattttttcattggttttgccgttgccattttttttgtcgatttttcccttttccgtgtgcctttctttttcttttgtccctcccaccgaccaaaagccaaattcccagagccttaaaatcattgtttttttctttttgtttcttttacccttccattttctgctttaaatttccttcaccacggcgttttcttgccaaattaaccatttaattaagcacagaatttcccccaaattgaaaatgttctgtttttttcacatattttgtcattctcattcagctagtcaatcccttctttcatttcttaatatttcgtggtatttgtaattatttttataaatcctttgaaaattttctggaaaaattttcggcgctaaaacccaaaagaataattgacagactttcgttttcaacgacaaggctaatccagaaaaatatttgatattttcaaagggtcttaaaatcaacaatttccatttctttcccccaatatttca

SEQ ID NO: 46314 - DNA, 1276 bp, Heterodera glycines
  Genomic contig location: Contig_ID=SeqID_6847; Location=791..2066; Strand=+
  SCN-specific regions: Sequence locations=1-30,84-135,159-350,387 -540,569-833,881-992,1045-1071,1102-1276
  Gene Ontology: Mol. function=GTPase activity; Cellular component =Golgi apparatus; Biological process=signal transduction
gtcgactccaaaacggtgaaagcgcaaatttgggacacggcgggccaggagcgctaccgggccatcacttccgcgtactaccggggcgccgtcggtgcactgctcgtctacgacattgccaagcatgtgacctacgagaatgtggagcggtggctgaaaggtgtttgtgtgtgccggacggaaaaaaatggggaaatttacggcggaaatttttggtttaccagaaattttctgtgtgccaaaatccgacattttgaaaaacttggacatggattttctgggtaaaaatcccattccttgtagagacctggacccaggaaaaaaaccaggcctggatcggggtcgatccaatattttttcaaaaattatttctactttttcattttctggcatttttttttcttggcggggacaattttgtaggcctcttcagcctcttcaccggtgtggggaacagcctcagattaattggacaaaatagcgaaatgacgtattttcactataatcgttttttaaaatttaattttgcggcaaaaatggaaaatttaattttttaattgaattttttccgggacatgcgctggggacagcagcctcagattaaattgctttcttaactttaataccccgttttttgtccaatgtatttttttttaatttggtgacattggaaaaaaaaggaattttttttttagaattttttgctaaatttagcccattgagataacatttgcaaaaaaaacattgaattattgagagccggcgactgttttctcgctttttttataatgtgtctgtcacattttttagagttgcgcgaccattccgaccaaaacattgtgatcatgctggtgggcaacaagagcgacctgcgccatctgcgggcagtgccggtgaattttagtgaaaaattccaaagaaaaaatttggcagtcgtcagttttttttgaaatttacgaggccaaaaattgggtatactttgtctcctctcgaaaaatttttaatttataaaattttcaaaaaattaaaaaaaaatttttttttgaaaacttggaaatcatcataaaagtgaaaaattttttaaatcttttttaaaaaaaactccaaaattgtatttcaagattaaatttttactttccccaaagactgacgaggccaaggcgtacgcggagcgcaaccagctgtcattcattgagaccagcgcgttggacgccaccaatgtggaggacgcgttcaccaacattctgaccgaaatttatcgctctgtcagcacacg

SEQ ID NO: 46315 - DNA, 365 bp, Heterodera glycines
  Genomic contig location: Contig_ID=SeqID_6851; Location=186..550; Strand=-
  SCN-specific regions: Sequence locations=1-103,131-275,297-365
  Gene Ontology: Biological process=embryogenesis and morphogenesis
atgaaattattgagattgcgctcttatcttcatttttcatgtaatttgcatgttcgcaatttgacgaagtcagttcgttagttttcaagtatatgcaacaatttattatttctatttaatatttagtttatccaaatttggtacctacaatgagaaagccattcagcttatccagcagcactatgatgaagcgacgtcatcttcacatcaatttgtcgattctccatcccaagaagtcttccgaatggttttgccacctccgaatgtgacaggcaacttgcacattggccatgccatcactgtcgccctcgaagacgcaatatgtcgctaccagcgattactcgggaaaaaagttgtggaagaaa

SEQ ID NO: 46316 - DNA, 279 bp, Heterodera glycines
  Genomic contig location: Contig_ID=SeqID_32867; Location=92..370; Strand=-
  SCN-specific regions: Sequence locations=1-279
  Gene Ontology: Mol. function=aminopeptidase activity; Cellular component=cytosol
atgtgctcctggacccagcagatgggctttccgctggtcagcgttgagcagcgcgtgttggagggcgaccggcgcgagttgcgcctcagtcagacgcgctttttggcggacggcggccgggacgaggcgaacaacagcccaatttggcaggtgccgttcagtgtcgccaccgcggcggacccaacgcaggcgaaggccaagtttttgctggtcaaagtggaggacaaattcatactggacggcgttaaggcggacgaatgggtcaaggtgaatgaataa

SEQ ID NO: 46317 - DNA, 195 bp, Heterodera glycines
  Genomic contig location: Contig_ID=SeqID_32890; Location=49..243; Strand=-
  SCN-specific regions: Sequence locations=1-86,108-150,172-195
  Gene Ontology: Mol. function=hydrogen-exporting ATPase activity, phosphorylative mechanism; Cellular component=integral to synaptic vesicle membrane
atggcgtcgcacaccgccggcatccaacaacttcttgcagccgaaaaacgagctgctgaaaaggtttgacttgatgttgatttttcaaatatatttatttttattttgcagattaatgacgcccggaagcgaaaagcacagcggctcaaacaagccaaacaagaagcacaggcggagatcgaccaataccgacat

SEQ ID NO: 46318 - DNA, 885 bp, Heterodera glycines
  Genomic contig location: Contig_ID=SeqID_6861; Location=122..1006; Strand=+
  SCN-specific regions: Sequence locations=1-60,97-352,374-470,493 -761,838-885
atgggttagaaatttcaactgaaaaatgttttgttctttatttagggaaaaataatatgaaaaaagaatattttattaactcaaaaaagatttcagaatcggataatgttcgtgacttgggaattataattgactcgaaacttaatttttcagaacatattagcaaaattatacgaaacgcatatattagaattttccaaattttgagagtgttgaaaagcagggaaataaaaactctaacagcagcctataaaacttttgtacgacctcaattagaatacgctaccgaagtttggaaccctaatttaaaaaaagatatagataaaattgagcgtgttcaaaaatttttcacaagaaaagcacttagaaaatgtggttttgtgtacaaaaaatatggggaaagactaaaaatcacgggtttacacaaattggaagaaagaagaaaaatcaacgatttaacaacagcttttaaaataatcaaagggttcaccagcctcgatgctgggaaaagtttctttttctcagaaaggcccaggaggcctttacttttacgggtaaagcgccacacggccaaaactcaaaataattttttcaatagaatagtaaaaagctggaataatcttccagtggtagcggtgcaaattaataaggcaaaggaattcaggggtttactaaaagcaatgagttctgagtaggattttccatgttgccatatttacactatatttttatcacctgtgaatttttaacatttgattgaattatttttattcatttttattacggtattcattttgtatttttattttgatcaaatttatttgttgttttctttttggcaccataaagagcactcatgtgcctttggtttgctcgataaattaa

SEQ ID NO: 46319 - DNA, 729 bp, Heterodera glycines
  Genomic contig location: Contig_ID=SeqID_6866; Location=4954..5682; Strand=+
  SCN-specific regions: Sequence locations=1-334,356-358,389-402,424-729
  Gene Ontology: Mol. function=chaperone activity; Cellular component =cytoskeleton; Biological process=protein folding
atggttgccgacgtgattcgcacaagtttgggacctcgggcgatgctcaaaatgctgatggacccgatgggcggcattgtgttgaccaacgacggcaatgccatccttcgcgaaatcaccgtcaaacacccggccgcaaagacaatgattgaaattgcgcgcacccaagacgaggagaccggggacggcaccacctcggtgatcatcttggccggtgaatttttggcacaggcggaacagtttttggagcagagcattcacccgaccgtgatcatccatgtcagtacaaccgtacaatcaaatgaaaaaatacaatcggcgagtgggtcacccatccaaattcattacaaaaatgcttgattcagatttttatgtttataaattattgctttttgtagggctatcgcatggctctcgaggatatcattgagtggacagaggagaaattcaggttttattttggcgttgatgagtctaacactttttcatcgtcccctttcagcaaaccagtcgatttggcctccgagtcggaactgaccaccgtggtgaagtcatgtttgggcaccaaaatgttggccaagtacatggacctggcggtgaacatcgccctctccgcggtgcgcaccatcgacgtgaccaacaacgactttcgtgagatcgacatcaagcggtattgccgaattgagaaaatccccggcgctgccattgaggacagcaatgtcgtgaagg

SEQ ID NO: 46320 - DNA, 141 bp, Heterodera glycines
  Genomic contig location: Contig_ID=SeqID_32955; Location=227..367; Strand=-
  SCN-specific regions: Sequence locations=1-141
gttgacattggctccatcgacttggcactgctcaacttcacttcctttgagggggccaccaaacggaaccgaccgaacgtcaaagtgggcgacctcatctacggcctggtcattctgacatccaaacaacttgagcctgag

SEQ ID NO: 46321 - DNA, 1367 bp, Heterodera glycines
  Genomic contig location: Contig_ID=SeqID_6879; Location=795..2161; Strand=-
  SCN-specific regions: Sequence locations=82-131,337-388,451-451,506 -565,733-737,772-777,847-948,1044-1204,1226-1367
  Gene Ontology: Mol. function=structural constituent of cytoskeleton; Cellular component=cytoskeleton; Biological process=reproduction
atgtacgtggccatccaggccgtgctgtccctgtacgcctccggccgtaccaccggtctcgtgttggactccggcgatggtatgcagccaaatcgttggcataatatcatagctatcaatctccatgcacaggtgtcacccacaccgtgcccatctacgagggttacgccctgccccacgccatcctccgtttggacttggccggccgtgacctcactgactacctgatgaagatcctcactgagcgtggttactccttcgtgaccacggccgagcgtgagatcgtccgtgacatcaaagagaagttgtgctacgtggcactcgacttcgagcaggtcggacatttggccaatttgatgccaaaattacccttcctcccgtcttggttcaggaaatggccactgccgcctcctcctcctcgctggagaagagctacgaactgcccgacggccaagtgatcaccgtcggcaacgagcgcttccgttgccccgaggcgctgttccaggtgagtgcccggcggagggcgcgtgcctatggcaacggcacaatttgatttggctctgttcagccgtccttcatcggcatggagtcggccggcatccacgagtccacctacaactcgatcatgaagtgcgacatcgacatccgtaaggacctgtacgccaacaatgtgctgtccggcggcaccaccatgtacccgggcattgctgaccgcatgcagaaggagatgaccgcgctggccccgtccaccatgaagatcaaaatcatcgctcccccggagcgcaagtactccgtctggatcggcggctccatcctcgcctccctgtccaccttccaacagatgtgagttgtggttgcattgggctgatctgacccaccaatgcttttccccctctgatcagttgcccaattagctgatcattgtccgttgttttccccctctgagcactcttttgccctttctcaggtggatcagcaagcaggagtacgacgagtcgggcccgtccattgtccaccgcaagtgcttctgagcagcagctgcacgaccgcacggaggaggagagcagaaaatgcctttcatcaagagcatcggagtgcggggattggcacgaacaccaaaaagagcaatggcatccaatcacatttttttttgtttttatggcttttcttttcattttctcatctcacttcccgccccatcaaatttcattttccaatttttcatcaaatttgctagtttttcttcgtccctttgcttcttctgttgatgtgttaaaagtgttgccaatcctaggccaatgccactaggactgcacttttgccgtcgtcactccccgaaaaatagtttcattttttgcgagaataaa

SEQ ID NO: 46322 - DNA, 672 bp, Heterodera glycines
  Genomic contig location: Contig_ID=SeqID_33003; Location=173..844; Strand=-
  SCN-specific regions: Sequence locations=1-159,182-462,485-672
  Gene Ontology: Mol. function=translation elongation factor activity; Cellular component=eukaryotic translation elongation factor 1 complex; Biological process=translational elongation
tttccttccgtcacaagaagaccaatacgtatttaaaagtatcaagtctgttccttccgagaaagaatatgcgcacgttgctcgttggtacaagcacattcaaagcttcgatgatgttgaacgtttgaagtaaaatttttggtgtcttttgagtccctaaattaaatgaaataaaattctttctacagctattcccttttttgccatttccaaaatttttccatttaccatgtgacaataatagtgatgggttttgcaaaaatttgggaccgtgcttttaagttggtcaaagaaagctggacaaacaacacagactgtcgcttccaaagagactccggcaaagaaagttgaagccgaggtttggagagagtcattttacttttggttctcatctcatctttttaggaggacttcgacctcttcggagatgaggaaagcgacgacgaggaaaaaaagcgcatcactaaggagcgcctgaaggcttatgcggagaaaaaggcgaagaagcccgggccggtcgccaaatccaacgttatttacgacgtgaagccatgggacgacacaattgacatcaaagagattgaggcgaaagttcgttccgtccaatgcgacggcctcgtttggggcgcttcaaagattttacctgttgcatttggcgtgcagaagcttcag

SEQ ID NO: 46323 - DNA, 2466 bp, Heterodera glycines
  misc_feature (2461)..(2461): n is a, c, g, or t
  Genomic contig location: Contig_ID=SeqID_6896; Location=2558..5023; Strand=+
  SCN-specific regions: Sequence locations=1-570,592-775,837-1279,1302 -1838,1860-2169,2192-2195,2220-2313,2336-2466
  Gene Ontology: Mol. function=tRNA (cytosine-5-)-methyltransferase activity; Cellular component=nucleus; Biological process=tRNA methylation
atggaagtttccccgaaaagcgattcgaatgcatttgatccgaaacatcggaaaaagacgtgcacaatttcaaaacaaaggtcaatcgttgttaatctctcacaataagtgttaatcttttgccgaaatgtgatgattttagacagcccgaaaaagggattcgccaaaattatgagctgaacaaattcgaacggaggaatgattcgctttttgggttttacaaaaagcaacgcatcgttcccgactcggaatgggaccgtttctgtgagattttggccacggagttgccctcgtcgtttcgcattcaacgaagtcttccggagagggattgccttgccaatttccttgagcaacactttttcaagcaaatcgcttccattgcggcgacttcggagagtgacggcgttggcattcatccgccaaaatctgtcccttttgtgccctatgcctaccagactaaaatgccgcgctcaatgcttagacggcacccaattctaaaggaattccacgagtttttggtcaatgaaactgaattggtgcgtattaatgggcattacaatggtaaaaacgtccaaaaaatttaggggaacatgagcagacaggagacgtgcagcatggtcccaccacttttgttggatgttcagccccaccacaggtgaacaggaaggggcctttgcaattggatgcttgggaaagggcaacggactgattgtgaaggagtcaatggcaagtcgtacaaaagccagtgcattcaatgtccaacacgtacacatcctttaatttatttatttttaattagaaagaaaattcattttgattttttttttgttaaatttctaattgtaagtccccccccccccacccttcccaagtcggtccctctgtttttgtacattttgttcgcctcttcgtttgcttcagagtgctggacgcctgcgctgccccgggcagcaaaaccatgcaaataattgagctgatgcacgagcactgtcccaacccagccagaagggttccctttcccacttaaatttttcgctgtctgttcagaagggtttgtgctggccaatgactccgattacaaacggtgctatttgttggttcggcaaacgttgaagcgaatgccaaccgcaaatgtggcggtggtaagtcacgacgcctcccaactgccggcccttttggacgccaatggccgaccgatgcttttccatcgggttctatgcgatttgatttgcaggtacttcccctgtccacagcagtagcaattggaatttttttaatttagcggtgacggcactctgcgcaaaaaccccgaactttggcggagttgggacccactgaaaagtgaacacccgcaatttacaactgaaacaaagctttaaaaggtgtaaatttgcacaaacttcaattacaaattgcgcggcgttgcttggaactattggccaacgacggtttgatgtaaatttgtgcattttaagtgaataattttgaattttgaactcccttagggtctattcgacttgttcattgaacccggtggaactgaaaagcatggaaaagtaatcaaattaactgcattaagctagaagatgaagctgttattgctcaacttttacgtaaatccaacggaacagtggaattggtggacatttccgaccgattgaaagagttgaaaagaatgccgggcatttccgaatggaaagtcgggatttaagagcatgagtggcatttttcaccgcgttgcctttcaggtgtttgacaaggagatgaacgaagttcgggcagttgacgatgttcgtgcggaatcgaaacgccttttcaaaccgtcgatgtttcccccgactttggaggaagcttcgcaaatgcatttggaacgctgttttcgaattttgccccatttgcacgactcaggaggctttttcgttgctcttttgcgaaaaaagggaccaaaatcggagaatgatttgcaacgacaaatcgaaggaacgaatgctcaaatgaaaagtgggccaccatcatttaggtagttgttgagaatcttcgacagaaattaaagtcattgttcaagaaaatcgactgcaaagcgagcgcgactttcgaataaggaggaccccttcattttcctggaggaaaatggccaacgcgacgatcgcttcgtctccgaattggacacgcactttggcatttcccccagcgaactcccccactccaaccttctcctccgttcccataacaccgaacgaaaaaaggaaatttactttgtgaacgatgccatccgcgactttcttcgctttaatgcgaaacgctttcgaattgtgagttttatttgtttattttggatttcgattcgaatggcttttctcctttttcgcaggtcaatgcgggcgtgggagtgctcaagcgaattgtgtctgacaaagtcgcccaatgtccataccgactgaaacaagacgtaatgggcggngatgg

SEQ ID NO: 46324 - DNA, 983 bp, Heterodera glycines; identical to SEQ ID NO: 33105
  Genomic contig location: Contig_ID=SeqID_33105; Location=1..983; Strand=+
  SCN-specific regions: Sequence locations=1-387,409-748,770-860,899-983

SEQ ID NO: 46325 - DNA, 517 bp, Heterodera glycines
  Genomic contig location: Contig_ID=SeqID_33130; Location=52..568; Strand=-
  SCN-specific regions: Sequence locations=1-217,239-517
  Gene Ontology: Mol. function=hydrogen ion transporter activity; Cellular component=hydrogen-transporting ATPase V0 domain; Biological process=proton transport
atgacgtatgacctcgagaccgctgaaagggctgcctatgcgccattctttggctacattggtgctgcatcggcacaaattttcaccgtgttcggcgcggcttatggcaccgcaaagtcggcggtcggcatttgttccatgggcgtgatgcgtcccgaattgatcatgaaatccgtgatcccggtcatcatggctggtattttttaacataacattcgaaaaattattaaaaattcaaccgaatgtggggtttctataaaatccagggccaaaattttcgaaaatgagtgttttacaatctcatttaccaagattgttacactgtcttattccccattttaaaggtatcatcggcatttacggcctcgtggtggcgatggtgctcaagggtaaagtgacctccgcttcaaatggttacacgttgaacaacggttttgcgcatcttgctgccgggctgacctgtggcctgtgcggtttgggtgccggctatgccattggcattgttggtgacgcgggc

SEQ ID NO: 46326 - DNA, 1326 bp, Heterodera glycines
  Genomic contig location: Contig_ID=SeqID_6915; Location=388..1713; Strand=+
  SCN-specific regions: Sequence locations=1-29,62-1125,1151-1203,1227 -1267,1289-1326
atgataaatatcgtcgattaccgagattcttgtgcttcaacagatgaagaagatgatttattttttcaccgcgtttcttcaaatcaagcacaggaaaataacgatgatgattctgagtccgaatttatcaagtaattatcccagtcactgatgttattttcaataaaatttacatttagaatcttggaaatgtgtcgaaagcatcgtgaattttctgctgctaaaatgggagaagacagtcaaaataagccgcgttctttaaataagcgtgataaggtctttgattccgagtattattctttacctgcgatcgaccaacttaatatacaagtcaaagaggagactgaattcaaaagatttggtgttgttgattcgcacataaattttttaggtgagttttcatttcaaaagtactttttcatataaagaatttaagcgaagataaagcctgacaaggatacgccacatcttggatatgagacaattctattcaatcacgacaaaaagccaattggagagatttttgaaatattcgggacagttactgatactttatatgcattgcgattcaatgacgaaagtgacgctgtagcgaaactccctgttggtgaagtaatttattatgcaaattcggacaatgccatgacaaagcccgtcttcccaaaggaattggcaaagtatttgttagtgattgcaagctgttgacttgcatatttatttacaggctaaagaattgggaccgagttcggccatcgggtggcggctcatccagttccgaagagtttttcagtgacgacgaagaggagaagcgtcatttggcatgcaaaggacaaaaaactcgaggagaccgaaaagcaacagaatcacctacaagtttttgtataatttttcttaggtatctcattttggtattttatgtttagctaatgtcataccttcgaagcggtcgaggaatggaaagaatcggcctgagaagatatgcaatttcagtcacacaaatttccaacgtcaattatttgccagaccatacacaacattcgctcagcatcactatatgcacatgtatccacagttttcgccttaccatcaaccatttggtgttcaattgcctcctcatccatgggttcgtccacctcctcctccgccagtttatccactcagtgccgcttctacatcccaatacttttcgcaagcacaacctacttttccaaattttaacaatcctttcaatcaaggttatattccccaaataactcattccaatgctcaacaaaatggcaaacacaaatagaggagttattgttatttgttttttttcctttgtta

SEQ ID NO: 46327 - DNA, 3622 bp, Heterodera glycines
  Genomic contig location: Contig_ID=SeqID_6915; Location=2494..6115; Strand=+
  SCN-specific regions: Sequence locations=1-325,347-458,480-884,908 -1384,1406-2631,2653-2897,2920-3447,3469-3601
  Gene Ontology: Mol. function=Pol II transcription elongation factor activity; Cellular component=DNA-directed RNA polymerase II, holoenzyme; Biological process=embryogenesis and morphogenesis
atgaccgaggaggaaatggagcggtacttccaggaaagacatgcagcacaagtggcgacacaccagggcgacatggacgaggacgcatatgacgacatcactcagaacggactgttgccaagcacgaaagacccgaatttgtggattgtaaagtgtcgactgggcgaggaaaagacgacctgtcttcgtttaatgcgcaaatacttgacttttgtcaacaccgacgaggtaagttattgtaaaaaaagcacaggtttcctgttcatttgtttattggatattttggcaaatacgactgatttataaattgtatttaagcctctccaaattaaatctgtcattgtcaaagagggcctcaaggggatgatctacattgaagcgtttaaaatggcccacgtggccaaagcaattgaagggatttcggcgctgaaccaattcaaaatcacggtaatatcggcttattattaccttttttcattcccttcatttcaaagatggtcccaataaaagaaatgtccgatactctccgcgttgtcaagaatattccaactttaaagcccggtgcatatgtccgtttggtatgacactcttaattgtatttaattaatattctcatcaatgatttgcagagcaagactctttacaaagacgacctcgcgcaagttgattgggtggatatatcacaaaatcgagtcaacctcaaactcatcccccgcattgattacacgcgcttaaggggggctcttcggtcacaagttagtttttgacgagaaacacgttaaaatcgacattataatttaaatttaggacgacagaattatgaagaaaaaacgccgtccattgcctgctccattcgatttggaccgtataaagttagcatattcggaattagttctttgttcaatgtattccttgggttttagatcaatcggtggtgaagtgacaaacgatggcgacttttacattttcgaaggtggccattatcgcagaggctttctttacaaatcttttccaatgaatgctattgtaagttagtgattttgattggtaaaacgatctatgtttaggaagtcgacattactcatccaacccttacggagttggagcggttccaagattccaccgacgacttaaaaaaagaacgtcagccagttttggaatttcaatatatttggggaagagaaaataattcattttcccattttagtggagaacactcacctaagggagaagcgccatagttttgctcctggtgataacgtcgaagttatggacggtgaactggtgaatctccgtggcaaaattcaaagcattgatgggcagaaagttgtcatccttcccgagcatgaggatttaaatgtaagcgattctaattttcagaattggaattacttttcctttaaggaacccttgactttgaatgcgagtgaattgcggaagtattttaaacctggtgaccatgttcgagtgattgccggtcgttacgagggtgacacgggtctgattgtacgagttgaggacaacgtagtcatcatgttgtctgatcttaccatgggagaggtaattagctcagttgcgattaccatttgtctttatatgctattcgcagatgaaaattttgcccaaagatgtacaactttgtgctgaggttgcgactggtgttgaacggatgggccaatatcagtaccaagacctggtgatgctggataaagaaacagttggagtaatcgttcgtttggaacgcgaaaatgtggaagttttgagtatgcatggcaaaatacttcgtgttaaccctcaaacgattgaatgcaaaaagaattcgcggttcgtcaaggcacttgattctcaaaagaatacaatccaagcgggagatacggtcaaagttgttgagggcttcctggcggttagtgctgtctttttgaacctaaaaactttaaataatagttattttttagcgaaagaaggaaactgaagaagaacgtcagggcgagatcaagcatcttttcagaaattgggccttcgttttttcacgtaaatatccacaaaacgggggaatgtttgtttgcaaagcgcggaatttggcattgattggtggaagcaaagcgtcggagtcacaaatcaacactactattttggataacagtcaacttatgagtcctcgtcctaatccgctcgaaagtcctcgcaccattcacggcggaatgactccccattccgggtcaagtgttgttggtgcacaatctgtccgtggcgatcatggttttaaaggtctttttctagatggtcatctgttcttgttaattcagatttttttagcaccaagtgtggtcgggagcatcgcaacatcagcaaccggagttggtcggcaacatgtacgtcggaacatggaaataatgggcaaaactgtgcgcgttctggctggtccaatgaagggttacattggaattgtgaaagatgcaacggaatcgactgtcaaggtggaactgcacaccatgccaaaagtgaagccctaattgtttcagtttggatcgataaatctttaactttagacggtcaattttgacatcaacaaagtgatggaggttggtggtgccgtcccgagggaattgatggacactgctggcgcaatgactccgggaacggccaccattggcgggcgaactccgatgtacggaggagcgcagacgccaatgtacggtggagcagcaacgcctatgcacgactcatgtaatcaatatctttactattctaattcggaattcgcagagttgtttcaaagattctgatcttttaatttagtcggtgctcgtactcctcattacggctctatgaccccggcttacgacggcagtcgaacgccttcgcaccaaccatcttcgtcttgggaccctggtcatacttattttgtttgatcttaaaactcaattttcgttcactttagctttggccaatacgccggctcattcaactgctcattttgacaatgaatttgacacaatgggatttggcggaggagcatcaacgccggcaggttctgtgagaagccgacttgggggagcgaatactccaatgggtgcgtgaggatttaaggtcttctgaatattgtttgtttttatcaggccaaatgacaccgcgagatatgttcggcgattattcttcaagcccttaccccaacccaagcacaaatggcaatatcattttttggtatttataacagatatcctttaagcttcactgcatccgtcgaaaacgcccattggtcagtcaccggcacttcaggaaataatgcgtaagaccactaaaactatccgcgaatattattgcatgcaatgcttcagccgattccgaaattcccactggttcatggtgtatggtcgacctgtgcgtcaatgttcttccgacgtgtggaaaggaccaacttctcggtttagaaggctcaatacggtcaattagagtaagtgtatttaattagtaatgattcggttgattcttcgtaggagggcgaatgttgtttgtatttcgaggagcttgacgatgacttcactattgagcacgaacatgtggtgcccattcgaccggcaagtggagaccaggtcagttgttgacaaaaccaaatacaaaa

SEQ ID NO: 46328 - DNA, 534 bp, Heterodera glycines
  Genomic contig location: Contig_ID=SeqID_6923; Location=228..761; Strand=-
  SCN-specific regions: Sequence locations=1-115,138-534
  Gene Ontology: Biological process=regulation of protein activity, epigenetic
atggatgtccctagacagcaattgacaacatatcgctgctacaataaggaagaattgctgatgattcgagaaagcaattattgtcggacacgacctgtctttttattgaaagattttgacaagtaaattttctattaagaggggtttaatattgtctaaatataagagtaaaaacaaacagcaattgaaaattcaagcattcatttcagtgatgatgggttattctcgccggacaaatggctgcagcacaaatggaaatgtgagggagtggagaatcgtgtgaggcggaaagcggccagtcagacttccgctgggagcggtggaggaggcggaagcgtttcaggaaattcaacagcaacagtgatcacgccgcagcaggaaactgacaaacaacaggcgaacatcaaggcggctcgactgcggagaggcgcttcgactactagcaatgggatggacttcaaaccggactttgtgggtgcatttggaatgggggagcggtcagaactgagcgagtgggccggggatgataattag

SEQ ID NO: 46329 - DNA, 782 bp, Heterodera glycines
  Genomic contig location: Contig_ID=SeqID_6923; Location=1265..2046; Strand=+
  SCN-specific regions: Sequence locations=25-782
  Gene Ontology: Mol. function=structural constituent of ribosome; Cellular component=cytosolic small ribosomal subunit (sensu Eukarya); Biological process=protein biosynthesis
atggctgtcggaaagaacaagaagatggggaaaaagggagcaaagaagaaggccgtcgacccatttacgcgcaaggaatggtacgacatcaaagcgcccgcaatgttcacacaccgaaacgttggcaaaactttagtgaaccgcacccagggaacacgtaaatgagcgtttaggctttctcaaaaattttttggtttaggcatttcaagtgactttctgaaaggtcgggtctacgaagtttcgttgggcgatctcaacagcacggacgccgactttaggaagttccgattgatctgcgaagaagtgcaaggcaaaatttgtttgaccaatttccacgggatgacattcaccagggacaaactgtgctccattgtcaaaaagtggcatgtaggcgtatcttatttatacaaagtgcccggaatggaattaaactcctattttagacactcattgaggccaatgtggcagtgaagaccaccgacggtttcttactccgactcttttgcattggctttaccaaacgaaatgccaatcaaatcaagaagacgagctatgcaaagacatctcaagtaagacttatccgcatgcgaaaattttaatctgttccttagaaaattatttctaacttctcattatacatggaatttaatattctaaaattgctttaggtacggatgattcgtgccaaaatggtggaaataatgcaaaaagaggtttggtcgtcgaatttattcccatgttatgttgtgtcaatgtcttctttgctttgttaggtctcttcc

SEQ ID NO: 46330 - DNA, 402 bp, Heterodera glycines
  Genomic contig location: Contig_ID=SeqID_33196; Location=84..485; Strand=+
  SCN-specific regions: Sequence locations=1-56,78-402
atgaacccgccgaacggagtgctcggcccaaaggagtccgtcaacgtggccgtctcctgcgacgccttcgaccccggcagcgaggacaccaagggcgaccgtgtgaccgtggagtggaccaacacgccggacccagccgccaccgcgttcaagctcgagtggttccagggagacgggatggtgcgccgcaagaacttgccgatcgagtacaacgtctgatggaaggatgcttcgtcacctcaacatggacatgataggatcccacccacccaccgtcccaaaattgtcattttgtcccccatcatgtaaattgttgtatctgtatgtaaatttctgtgatcatcacttcaaatgaatgtatatttaattgttgcctatgtaattgtattgttgttgtgctta

SEQ ID NO: 46331 - DNA, 3147 bp, Heterodera glycines
  Genomic contig location: Contig_ID=SeqID_6933; Location=1346..4492; Strand=-
  SCN-specific regions: Sequence locations=1-166,188-265,287-311,335 -722,744-1361,1394-2015,2037-2296,2318-2569,2591-3147
  Gene Ontology: Mol. function=protein kinase activity; Cellular component=chromosome; Biological process=cell organization and biogenesis
atgcttctccacaaccaacggcttgttattattgatgtttctcagtccgtcgaacatgatcacccccactcgttggagtttctcaggatggacattggaaacgtcacccgttttttcaagagcaaagacgccgctgtactcggaatgaaacgtctttttgaggtgttgtttacaaattaactatttttgtgaatgattatgtatccaggacctttacacttcaggcgattgttgacccgctgatcgatgatttggcatttgaacaaattctccaaaatgaacgaatggatgggccacttcctgacgatatgcttttcatgaaggcttatattccacacaaactcgacaacattactcattacgaacgcgactatgaaatggagaaaagagggattgaactgaacaatccgtttcaaaagactattggacgaacgatggatgtcaaaaaatcggaagaggaggatttctgtggtattatacatatacacgttttgataaacaaaagcattcagggaatgatgaacatttggatgggttggattctgatacgaacaacgaagaaccatttgagtcgagcgaagaacagagtgatgtttcggatgagggagaaaacgacgacaaacagctcaaaaagaataagaagactgtttatcaaaaatatgttcgggttaggggcgagtcgtcgagtgcgcggaaggcgaggaaagaaaccgttaaggatgaaaagagagaaaagagggcagagaaagtgcccaaaaaggttaaaaaacggaaggataaactgcgaaaaacgggcaggaagtgaccggcattgtgattaattgttgatatttgttgcttttcccgaattttatccccaacaaagaaagtgcatattttcttgattgttatttttaattggttcattccatacatcattttacctttcaattaatataaaatcgaaattaattcatctcttgtacagtcataattatggacgggggcgtgaccagaagtctttatattggacgagacaaaacattggaggtgcttaagcggaaggaggccgttgaaagggaacttcgagccaagtgggttgaatttggttgtagttaaattgtaagttttagggcgatagtcaaaatttgattttagcgtagacatattcatattgttatgtttaggcgtgaagtaaaaatccgtgagcaacatgagcgaatggaacgtgcggctcagttgaaagaagccgagttgagggaccgggcgagaatgaaacaacagcgtgagttggagagacagaaggcggtgttggaccggcgttgtgcacaaatggaacagctgaatgcaaggaaaatggtgcgttttcacaagggaaaaacaaaaattttaatctttattttcttcaggaacttctcaaacgtacccatcatggctcttcgcgtattgtcacgttgaatcaggcgaagaaacctgtttatgcgttcggtagcagcactccacgcaagttggcctttttggagaacattcaacagcagcaacgagacagcggtggctcgagaaactctcccatgggcatgcgtggttcgaccccatcacttgcacaggtcaaaacacagtgattcaccattcacatgaaaaaaggggggggggggtaagcggccaaacgacgggatatttcagtcatgtaaatcaactatttggagcttcaaaaaggacccatcaaagtttcagcactttttgagcctctactgtttagggaccatcgaataccgcaccgacaacttcgcgttttcaaaacccattatcgctggacggaagagctggaggatcgtctataatgactcgcagcgttgttggagctttgggaaacggaatagggacaacacccaacagaaagaacaatttcaacaagccaccggctcaaccgacaaagcaaacgccgaattccatcaaaaaacagcgaaaaatggccaaccaaggaatgattcaaaccaacgaaggaatgttgactgctggccaaaatatcacaaaagaagtgcagcaggagaagcagaattctccgactctaactgccaccaataaaaccaacgagggaatgttgactacggaacaaaatatcataaatgaagtgcaatccaacgagggaatgttgactgctgaccaaaatatcataaatgaagtgcaatccaacgagggaatgttgactgctgaccaaaatatcataaatgaagtgcaacaggagaagcagaattctccgactctaactgccaccaacacatccttttacactgcccatgagagttcctccattggcgaagttttaataaattccattcatttggaaaaaattcatttaaactactcaaggtttcgatgtatgagcacgttccattgacggaaaatgagcccataataacgcctccgaagtcgaccacaccgcccgtgctcatcgtcatcccgaaccaggaagaaaaggaggaacgccgtcgacacatcaaagaacttctcgcccgcactcgccaagaagctaatggcccgccaaatgcgcagaataatggaatgacaaatgttagggaagtgaaaattgattttattcaacaaaaacaaatgtttgaggtgaacggggaaagttctgttgtcccttcgacaactccgtctttgccgatttcagcttctaatccgcttctcccccaaagggacgcctcggctttggttcaggtgagcgaaatgcaaaaagcatttgaaaacaactgttgtaattttaaggacattaacgcgaaatacctgcataagttccaaaagcaacaacagaaagacggtgaaatgacagcaaattctcaggcgaacccgcgtaattcgacgaacctctcgaaagaactcgacgaaagtggcagtgccgacaaagaagggaccttttgcctccctggacaggcaattacagcttttcattccatatcttttaatacaaatcttctcttgaaggttatttctgccaacgatcaattttcccatatggcatcgctgactatcttctcgaaaaatgaggaagaacgcgatgaacgcatccttttgaagcagcatccgagtccgccggacgacccacagatcaatgggaacgaaatcaacgggaaggaattccaccctcccgagccaacaaatgcccag

SEQ ID NO: 46332 - DNA, 965 bp, Heterodera glycines
  misc_feature (908)..(908): n is a, c, g, or t
  Genomic contig location: Contig_ID=SeqID_6936; Location=1..965; Strand=-
  SCN-specific regions: Sequence locations=1-48,70-130,155-355,378 -474,496-502,524-965
  Gene Ontology: Mol. function=endopeptidase activity; Cellular component=proteasome core complex (sensu Eukarya); Biological process=embryonic cleavage
tcgtccgtcatgttttatcacgacttgcacgacaacgaaaatagtcatgataaagagttaaaacagttggtacaaatggacgaccttgcaattcccaaatttgtaatgcctccgctcggcattaaggtaaataattcttaacatttataaatccctcgggctctttcttatatttgtttatttagccaaaaaaatttgtgcgcaaacattttgggccgaacagtcggcttccaatggcgcagtttctgaagggcactaccacactgtcctttgtgtacaagccgaagacaccgcaagacaaaggcggcgttattgtggcggtcgattcgcgtgcaacgggcggaacttacatcagtttgttttgttgtttttataaaatggcatcggcatgggcttcataatgtcaaaatttttccttaaagaccacataatttagttatttttggacgaaatagtaagccctcattaaatttgatggatttattatgaaatcagccaggatttttcacaaattttcctctcctttcgctacgccccccctgctgtcttaatcgtccgtctttggtctgagactctccttttgtatgtataattattgactccaaaaaattcaggctccaaaacggtagagaaaatcattccgatcaacgaccaattggtcgcgacgatggcaggcggtgcagcggactgtcagtattggacgcgggtggtgagcaaatattgcaagtgcgtccgtttctgtggccattttgccagttcgccccatccaattattttttgtcatattttatttctgaccctttggcacttcagtcttttcgaacttcgcgagggtacgcaaatttcggtggctgcggccagtaaatattttgccaatgttatgtacgactatcgtggccaagagctgngcgttgtgagttttgttgctgttcactttgatgttgttcaatggcattttaagcact

SEQ ID NO: 46333 - DNA, 2042 bp, Heterodera glycines
  Genomic contig location: Contig_ID=SeqID_890; Location=554..2595; Strand=+
  SCN-specific regions: Sequence locations=1-410,433-845,867-1076,1098 -1327,1350-1458,1480-1690,1715-1729,1751-1874,1896-2042
  Gene Ontology: Mol. function=GDP-mannose 46-dehydratase activity; Biological process=carbohydrate metabolism
atggacaaggacgacgccaaacaatttgaagaatatcgggcgaggaaagtcgcaatgataactggcatttctggtcaggtaattgaccgtaaatgaattaataccaagtacaagatacatacctacttattttttctccctaggatgggtcgtaccttgccgaatttctcctcgccaaggggtaccaagtgcacggggtcatccgtcgttcctcctccttcaacactggtcgaattgagcatttgtactccaatccgatgacacacgctgtcggctccagcttcaacttgcactacggcgacatgaccgactcgtcctgtttgatcaaactgatcagcaccattcgtcccaccgaactgtaccatttggccgcacagagtcacgtcaaggcaggagatttgcttcctctcttttcttttatatttgcaactttctcaggtgtctttcgacttgcccgagtacaccgccgaagtggacgccgtcggcactttgcgcctcctcgacgcgatccacgcgtgcggactcacccgattggtccgcttctaccaagcatcaacatcggaactgtacggaaaagtgcaggaagtgccgcagcgggtgagagggtcaaattaattgcatttaaaaactcggaatgaatttaggaaaccacgccattctacccgcgttctccttacggtgagagactgactttcatttccatttttgtatgagaatcaaaggcatttgtttttttctaatttttacattggatcatttttgtacatttttcagcggttgccaagttgtattcctattggattgtggtcaattaccgcgaggcctaccaaatgtacgcctgcaatggcattctgttcaaccatgagagtccgcgaagaggtgaagcaaaagtgtaaagacaaaagcaatttcaattgtttaggcgaaacctttgtgacgcgtaagatttcgcgtggagtggccaaaatttcacttggccaacaggaattggtcgagttgggcaatttgaacgctttgcgcgactggggacacgcgcgggaatatgtcgaggtgacactcaaattcaaaacggaccaaaaattaaaaacaaattgtgcggtgtatttccctgcattccattttttgacacaaatcatgtcttgaatcatggttataatatttacgaggtttatgactctctgagttttcatttcctgctggcggtacggactgattacacaagaaattggggttttgtgtctgatcaaaatcgactatttttagaaatttacagggattttattatttctaatttgtgtcggatgaatgactgactcccttctgtttaaggccatgtggatgattttgcaacaggattcgcctgacgattttgtgattgccaccggaaggaattacacagtccgacattttgtcgaattggcctttaaagagatcggcgaaacgattatgtacagcattaaataattcactaaaacatcggacatttccccgagattgcctttttcagttgggagggcgaaggcgtcgacgaagtcggccgcgagaaagagaagggcactttgcgcgtccgcgtcaacccgaagttttaccgcccgacggaagtcgaacttttaattggggacccgagcaaagcgaagaaacaattgggctgggaaccgaaagtcgagattgaggtggaaaatacaacgactttaatttttaaaaatatttaaatgacaggaattggtaaaggaaatggtggccagcgacatcgaactgatgaagaagaatccgatggcatagacgcgggaccaatggattaatttaattatttttgactctgagccattttcacataattgcataactgtgattggctgggctcagattttcagtctcaaaaccccaaaaattaatttttgacaatttaccaaaatccgagccctagtaactgtacctcctcgcctctttctttttaattttaggccgtgatagttgcacttttctgttattttatcttttactgtgactcgcatagctttacgtaccataatggagcttta

SEQ ID NO: 46334 - DNA, 1582 bp, Heterodera glycines
  Genomic contig location: Contig_ID=SeqID_6946; Location=900..2481; Strand=+
  SCN-specific regions: Sequence locations=1-253,275-348,381-392,414 -657,679-792,816-914,936-987,1014-1095,1150-1259,1295-1355,1377 -1387,1415-1473,1571-1582
  Gene Ontology: Mol. function=calcium ion binding; Cellular component =extracellular space; Biological process=regulation of transcription, DNA-dependent
ctcttagggatgctcagttctttccccttattattgtccttggtcggcctcatcgccgtccacgccgaagtcttcttcaaggaggagttttctgatgacagttggactgatcgatgggtcacgtcgaaggtgattctgggcattagtgcttcgttttggtttttagtttggaacattcagagcaaggatgactacgggaagttcgagctgtccgccgggaagttcttcggggacaaagtgcgggaccagggcctgaagaccagccaggacgcccggttctacgccatctcggccaagttcccgaagaagttcagcaacaagggaaagccattggttgtgcagtttaccgtcaaacacgagcagaacatcgactgtggcggcggctatatgaaggcaattaattcaaaaatattggaacgaatttccagttcttagctcatggcttctgacatcagccaagagaacttccacggggagacgccgtaccatctgatgttcggcccggacatttgcgggcccggcactaaaaaagtgcacgtgatcctcggctacaaaggcaaaaaccagctaatcaaaaaggacattcgctgcaaggtgggcacttttgttgttcattttccagtgattcactcattcgttgcttaggacgacgaactcagccacctgtacacactgatcttgagcccggacaacacttacgaagtgcaaattgacggcgaaaaggtcgagagcggcgaattggaggccgattgggaccttttgcccgcaaagaaaatcaaggaccccgacgcgaagaagcccgaggactgggacgacaagtgaaccaatgggactttgacataaacaaacgatgccatccatattcagggaatacatcgacgacccggacgacaaaaagcccgacgattgggaaaagccggaacacatcccggacccaggttggacagtaacgagcggtctttgctagttgtcatatgtctgctttgagatgccaagaagcctgatgactgggacgatgaaatggacggcgattgggagccgccgatgatcgacaacccggaatacaaaggcacctggaagccgaagcagatcaagaaccccaactacaagggcaagtggatccaccccgagatcgacaaccccgagtaccagccggacgacgacctctacttgcgagaagattggggcgccatcggaatagacatttggtgactgacgctggaccgggtgggactggcgctttaatcaaccgaagttcaggcaggtcaagtcgggcaccatcttcgacaacattttggtagcggactctgtggaggacgcgaagaaacacgcggcggacactttcgaccagctgaaggaggcggagaagaagcagaaggaagcgcatgacgaggaggagcgcaagaagttcgagtgagttttgttggattgggtgatgggagcaattgtgggagatgaacacgggaaattcagggaggaagagaagaagcggaaggaagaagaggagaagaagccgaagaaggacgaagaggaggttgaagaggacgaggaggagaagaaggaggaggagcacgacgagctt

SEQ ID NO: 46335 - DNA, 915 bp, Heterodera glycines
  misc_feature (9)..(9): n is a, c, g, or t
  misc_feature (49)..(49): n is a, c, g, or t
  Genomic contig location: Contig_ID=SeqID_33280; Location=1..915; Strand=-
  SCN-specific regions: Sequence locations=1-361,383-793,817-915
  Gene Ontology: Mol. function=DNA binding; Cellular component=alpha DNA polymerase:primase complex; Biological process=DNA replication initiation
gacggaatntggcaaatgcgtgtacaaagaccaccaagtgttctccatncaggtcgaagcatttaccatctaagtgtcgctttgagcattttccacctttaggagttgcccgaagcggcgcctcccggacatttgccacggaatatcgatgtcattggtggcacttttaacatttatcttttgcctttttggtgcaattaaatttttctttaagctgacgatgacttggccgactgttgtaagcctggagatcgtattcgagtcattgctctcttccgcgttttgcccaacaaacaagctggcatgtccactggcaatttcaggtccgtcttttcctttttttgtgcgttttctatactaatgacatttttccttattttgtctattaatgcaaataaatgcttttctaactgctaattaaggtccgttctgattgccaataacatccaattgttgagcaaagagatggagccgagttttgagcccgaagacatcaaagaaatgcgtaaaatgagtcggcacaaaaacatttttgaacttctcgcccgctcattggccccgtccatttacggccatgaagaagtgaaaaaggcgattctctgtcttctgttgggcggctgtgaaaaaatattggaaaatgggacgcgacttcggggcgacataaacgttttgctaattggcgacccatcggtggccaaaagtcaaatgttgaggtgtctctgacagtcattagataattgttttatactccccctttaacagatacgtaattcacactgccccacgggtaattgccaccactggccgtggctcctcgggggttggactgactgctgccgttgtccacgactccgacacgggggaacgccgctaaaaggccggggcaatggttttggctgaccgagggattgtttg

SEQ ID NO: 46336 - DNA, 2492 bp, Heterodera glycines
  Genomic contig location: Contig_ID=SeqID_6954; Location=369..2860; Strand=+
  SCN-specific regions: Sequence locations=1-93,115-311,342-372,394 -809,831-1198,1220-2492
  Gene Ontology: Mol. function=ATP binding; Cellular component=nucleus; Biological process=signal transduction
atgaagccatccgtgaaggatctactggaccgggtgttggacgagtacaaccatttgcagcagcaattgcacaatgttcgggttgagctggagaagagccaacaggagagggacacgctgcaccgatactcactgatggtgggtcagggaagagaggccgacccaaaattgtcattctttacccctccccccaccaaaattggcattatttacctctcccccaccaaaatgtaaaattgcccttctttaccccccaccaaaattggcattctatcccccccccccctcttatgccatggattcattgttttttgttccctttacattttcttcactttttagtactccgaaacgtttttcactctcaacttcgaaatgctaaaacatggtgaaattgttaaacgtctcagcggcatcctttcggtactttcccggcattccgcttaaaatgtgccctcccatttgagcatgtcatccctctccttccccaagaacaccaagcaccggcagttcaggcgattgagcgtgccaagaccatcaaccaacaagtcgtttttgacttcattttctcaatttgggcacttcgtttaggatgttacttcgattgtcaacggccaagtacagcagcagcagcaatttgcttcgattctgcccgggcttggttccatgatgaatccgacggcatttgggaatccgatgggggcgatgatgtgagcgaaatgcgaaggcaaaagcattacattcgaataataatgaactgcaggggcatcaaaccggaggacgcgatacaggcggcggctatgttcaacaatttgttaaaaaacccaatgcttggtgccaccgcggctggacttcctcccccggttggactaaacggacccggcacaagcgttgcctcaaatgtcgggccaatggtcgctccgaattcgacatctttgccaccaaatggggatgacggccccacgccaacaactcaacctggacgcagttcgtccgcacttaacagcagtagcggggccgggattggacataatcggccgcggtccggcagtcggacgagtacgcccaactcaatggctgctaagaggaccaagttggagccggaggaaggcgatggcgaattggaaattgacgttagttggtgcaacgtccggactgaagaattattggagtttcaggtccaaaacgatgatgcgagttcatccgctgctccttctcatcatacgaacgggcggacgagtcaacctcctcgtcaaaatcacagcgtcaaagacgcggaaagggattccgcgtcggcttcatcttcccgcgactcgaccacccctcggtccggcaagcaacaggcactgactgtacttccgtgccattcgtttcaactttccccttgtcagttgtcctccacccccggctcttccgctgccggcttcgcttccataatgccgactgctgatgccaacatggcgcatatgtttctgaacacggcctttggtggacattttcctggcaatctgaacagacaaatgtttcttgggttgggtgctggcaatgcgccattgggtgctgctgctggaatgccaaccgcaaatgggaagccagcttatgcgtttaaagtttctcagggggagccgaatttgatgccagtgcaattcccctcggatgcttctcaagggccggaagttccaaagtgattttcgtaaaaatgataatttttgtctatctttattctttaggggtttgaagagaattggtgatttgccacacggagacgtcgtttgtgcggttacaatggcgcggaatggtcgccacgtgttcaccggagggaaaggcgccgtcaaaatgtgggacatcggagagcgtattggccttgcttcgtctgccggtggttccatttccccctcctcgtcgaccatcgccgatggaaccaatggccgagtgggcagtgccgagccgtggacacccgtgaacacttttccatgtctgaaggacagttacgtccgctcttgcaaactttttccggatgcatcaacgcttattgtgggtggagagacgaggaccatttgtgtgtgggatttaaacagtgaaaaggtgagcgtcggaataagaacggtatgccatgaggagggaccaaacttggcaacttaactttgtttggccatgtcactgaaacccctcttggatttccattgcccgcttataccgctcattaacaggtgaaagccatgctcgactgcgatgctgaggcgtgctacgctttggccatttcggccgactgtcgcttgtgcttcgcctgctgttcgagcggttccattgtcatttgggacttacaaagtgaacaaaaagttgcccaactcgatggacacactgacggggcgagttgtgtggatttgaatggcgatgggttgcgactttggactggcgggttggacaacacagtccgatgttgggacatcagagaacgcagtgagctgagcaagaacgttcttgagagtcag

SEQ ID NO: 46337 - DNA, 1582 bp, Heterodera glycines
  Genomic contig location: Contig_ID=SeqID_6960; Location=151..1732; Strand=+
  SCN-specific regions: Sequence locations=1-151,200-248,270-455,477 -533,555-858,932-974,995-999,1110-1117,1139-1305,1327-1422,1444 -1486,1509-1582
atgtatgccgatgatgttaaattatattatgcccacgaaaatgatgaccattcgaatcagttggataaagcaattgaggctttggaaaaatggtcaaaaataaatgggttagaaatttcaactgaaaaatgttttgttttatatttagggaaaaagaatatgaaaaaagaatattttattaactcaaaaaagatttcagaatcggataatgttcgtgacttgggaattataattgactcgaaacttaatttttcagaacacataagcaaaattatacgaaacgcatatcttagaagctttcagattttgagagtgttgaaaagcagggaaataaagactctaacagcagcttataaaacttttgtacgacctcaattagaatacgctaccgaagtttggaaccctaatttaaaaaaagatatagacaaaattgagcgggtacaaaaatttttcacaagaaaagcacttagaaaatgtggttttgtgtacaaaaaatatggggaaagactaaaaatcgcgggtttacataaattagaagaaagaagaaaaattaatgatttgacaacagcttttaaaattattaaaggattcaccagcctagaggctgagcaaaatttctttttctcagaaaggcccaggaggcctttacttttacgagtaaagcgccacacggccaaaacacaaaataatttttttcataggatagtaagaaactggaataaccttccagtggtagcggtgcaaattaataaggcaaaggaattcaggggtttactaacagcaatgagttctgagtaggaaattttctgtgccacatatacactatattttaatcacctgtgaatttttaacatttgatttatttttattcatttttattacggtattcattttgtattttttatttgatcatttttatttgtttgtttttggcaccatataagagcactaatgtgcctttggtttgctcgataaaattaaattaaattaaattttctgaaaattatttaatttattgttattttttatattaatattttgcgattctatatgaattatgtaaaaattttaaaattttgaaattttttcattaatttttttgttaattaccccatcagatatcattaatgatcacagcttagctgagacatatgctaatattttgtcaagagacgaaacaacacggcataatgctgaacatttgttggccattcgaatttgttccgcacgaatttggcaaatttttcagcaaattcatttggcactcaaacagaagcataatgccagattgaaggatgtcaaaacaaatgaaattttggcacaaattcaatcaaattggcgtcgcttttggaaaacacggcacgcaacttacaaatatatgccaaatgatttgtatgaacattgggcagcagtgcaaggtcaatggcaagatttgacatttttggcgcgccaattagtccaacaattagtgaccgataaatataatgttgctaaatattttcaacacataaagcaattgttgccagagcggaatctgttttatcagttggctgaggagcatgccaaaaacataaccaggtga

SEQ ID NO: 46338 - DNA, 2914 bp, Heterodera glycines
  Genomic contig location: Contig_ID=SeqID_892; Location=2010..4923; Strand=+
  SCN-specific regions: Sequence locations=35-601,623-1325,1431 -1553,1575-1765,1804-1832,1908-1915,1937-2351,2373-2464,2486 -2536,2582-2787,2810-2914
  Gene Ontology: Mol. function=transcription factor activity; Cellular component=nucleus; Biological process=regulation of transcription, DNA-dependent
acaacaacaacaacaatagccacaacaataacaatgccgccaataaacgtttccgcactcatttgacgccgatgcaagtgtttgtaagtacagtatgaacataaattaagggcgtaatatgggagcagcattggtatactgtggcgcataaaaatggtgatactgtggacgactgtaccatatccccttcaaatggccactctttatcgtattcttttcagacagcatatcgtatccattattttacataggatactacagtatattagttgtatcgtaccccttatgatcgacaatttcgattcatctagcgataccatattcccttcctacgctaccgtatacctgctggatttaataaatttttcattttttaatctcgatgtttaaaagccaaacataataattccgggacagatcatgaaatcactgttcaacgacttcaaaacgccatcgatggccgagtgcgacgcgttgggccaaaagattgggctgcacaagcgcgtggtgcaagtgtggttccaaaatgctcgggccaaggagcgcaagtgcgcgggcggtagctgcaccggcagcggcgcaggttggtgccaggccgccaatggcacaaattgggtgggattagtgccagcgcctccgatggcagaaatgggtgaattaatgccagccgttcggcattttgaatttaatgctgataaaaaagaattggagagcgggatgacagtcactaaggacacaaattgattggaatactgccagccaaacggggcatttttagttgctagctaaaaggaacttgtctggggcttaccggtaatcacaaaaattgaataatttgtgacagctggttacggtatttacgggataataccgactgatcaggaacaattttacagtatgttgtcctttggacgaaataattgttttaagcttttgtttaggacatccaccataattgcctgtaggttttttgatactataattgtgatttctgatactctaactgtctatgggtttcacatactgtatttgtcttggggatcttgcatacagtttttgacttggatactgtaattatcatttttttaaatgtgtatcctttgtacagaatcctctgatgatactgctgttacggtgccgcactgcgacttggctggccagcgctgccacctgtgcggcgtggagtttgacgcgcgactgtcgctgcaggaacatatcttcggcatcgaacatgtggagcgagtgcgcgagcagggcgtccaaatgcgcggaatttgcaccggcgtcgctgcggcaccgacggcacagccgctgacagacaatgccggcagcggcggtggcgacaaggagaagcggcagcgagtagcgagcggtgacgcggcagcgattgaagcggcggcggcggcgacgaccgctgcgacaacaacggcacaccaaattgacgccgccgcggcgatggcagcagcgcaacagttcccctatgagctgatgtacgcggcggctgccgccagcggtctgtcacctggtcagtgagtgcggttgatcagaggggctaattaccatgccccaaggaatttgggtacaaatttgttcggcactggttttcccggcatgggatttgacggcacaaattactaattggggttcactccatttttcaccattttttactccccaggcctttcgccctaccttggaaaatttttttaaaaattcaagtttctttctaaaaaattcaaaaaactttccttttttaagaaagttcaataaaaatttaagaaaattatgttattttttaaaattctgtcattttttaattttgtgagttttgcaaatttttattttggttttttttttctaaaattttatagttttcataaaaaaatttattttgttaatttttttttcgatctatagaacagttttcaaattcatttggccgcgccgaactgtctcattggcccaaattttcaaaattgagcatttttctttttttaaaatgaaaatttttggattttggctgtttgtagggctcttgctgggccccattttgaaaatgtgacgccaagacttgatcagcatagtgatcaaaatattcaaggacagcccaatcattttgcaggcactctcccatctctgctctatgatccgacggtgttcggcacgccggtgcccgcgctcaaaatccccaaatgcgtcatgcaacaaatccttgccgacatggcacagcgccgggagcacacgctgttcacacaggacgggctggagctgggtgaacttgcagcaaaggttgacgccgatgactttgccgccgcgggcaccaccgatttggaggtggggtgaaatggcactttaatgaactgtgtagcattttgttggcatacatttatggcattttccattggatttagcacaatccatttgacattcggacattttctctcattggcgccctctcccgtgacaaaattttgaaaaaacaaaatttttttctaaattgcttaaaggtttttttcaaaaaaaaaaaatttaagtaggtagaaaagatttaatattttctttcaaaaatgaaagcaaattaagcggggatttgcccatcatagggtgccattcgatttccggaaaatctttgacatcgtagtcccgatttccggaaaatttttggacctcggaatgccaaccttggatgattagacagtgatttaccaattatttttggggccattaaattagaccatggattatgccaatgtgccaatttcagttgggatttgtgccaacattttgaatggatttaggtgggctggggctgcacccaatgcggcaacgtgttccaacagtccgagcagttgcagaaccaccagaagctgatctgcgtgggcgcggacggcgtgttccggctggtccaaaccca

SEQ ID NO: 46339 - DNA, 1135 bp, Heterodera glycines
  Genomic contig location: Contig_ID=SeqID_33404; Location=1..1135; Strand=-
  SCN-specific regions: Sequence locations=1-207,230-1135
  Gene Ontology: Mol. function=dynein ATPase activity; Cellular component=fusome; Biological process=oocyte cell fate determination (sensu Insecta)
tttgacttttctaatttgaataaggtattcaagcgagcattggagcccaaattgccaagcaccgacatccggccaatcccggatgaacgctgcgttaacacagctcatctcggcgaggcagagaaagagcgcttggaacaaatcggtaaaaaacaaaacaaacaaagatatgtaataccactcggtggtgagggtctcctttttcagaaaaaaaaaaaattatttttttggtaattgcacgaaaatttacgtttttttggtgcataaatgttaattttgtgcttgttcattttcggtttttggttcgaatgaatccaaatgaatgtaaaatcgcaaatagatgtttatttacactaaatttttcgtaattaaggcttgaaagccattgcggaaggtcgcgtggcggccgttgtgttggccggcgggcaggccagccgtctgggctctgcccagccgaagggcgttcttcgcctgggcaccggacttggccaggacgacgtcgactcacttttgttcattcaggttttaaatggaaaaacaagggtacaaattgggttttttgggtaaaatttttcagtttttgtaccataaatgaaaaaaaatgtccgatccttttgatcaattccatcgttggggggcgcctgaataatttagttaagagcaaaattttgacgcctttccattaacctccaagtgattttgaaaaaaaaacgaaaaaaattgaatttttttttaccaaaaatgggatatagaggtgtacatactcaattaataccaaaacaagtgttaatttgaccaaacttggactcaatttctgaaataggctgaacaaattgtacgccttcaacgcatggcggccgagctgttcccggccttctaccgcacgatcgaccgcacttgggtgacacttgagcgtatccaattcgtcggggcatgcaatccaccaactgatccgggcagaaacccattgtctgcacgttttcttcgccatgtgccagtcatttacgttgactaccctggacgtacatcgctcaaccaaatttacggcacttttgctcgagcaatgcttggtcaacaatgcaaatacgaggaatggctaaaccgctcactgaagagatgactgatttttacctgc

SEQ ID NO: 46340 - DNA, 938 bp, Heterodera glycines
  misc_feature (910)..(910): n is a, c, g, or t
  Genomic contig location: Contig_ID=SeqID_898; Location=81..1018; Strand=-
  SCN-specific regions: Sequence locations=1-938
  Gene Ontology: Mol. function=DNA binding; Cellular component=nucleus; Biological process=transcription termination
atggccgtcgatgccaatttcaaagcttactcctgcattctttcactgctgctccgacttcgtcaggcgtgtgttcacctgtctctgaccaggaatgtgagtactctttacacaatttcagtatataaaacagtgagcaaacttaattgactctgattttttaggcaattgacattgacgcatttaaacaagacgagggtgagacggacagcgatgcggagaatttagttgcgaaagccctcgaaatgtcaatggctcaaatgagtctcgaagaagaagccctcgagagaaatgaggagcgggaaaaggacgaagggcagcaaatcgaacgcctttttgagaaggaacaccaaagcaccaaagtattcaagagagtcttgtccatttttcttttggtttttaggtgaacgctttgatgaaccgtttggatggagtcgttcagaacggtgataaatggtaaaatggggacgaggacggcaatggaaacttacggaataaaatttttgctttcatcgccctctcatttttagcgttatcgtaagccaatggacttcgatgttggctctcattgaatttcacttgcgacaaaaggccatctcttttactagcataacgggagaagtgcgcacggaagaacggtttgtgtttctttcgaaaaggcgagtgcattttctggtttgcttcagtcagtcaagggtggatgctttcaacagaaccaacacgggacccaaagtgatgcttttatcattgaccgccggcggcgttggattggtatttgcttttgggtttaaatgttaccaatactattattaattttagaatctgattgggggaaatcatttgtttatgattgatttgcattggaaccccgcgttggagttgcaggcgtccgacagaatccaccgtttgngccagaagaagaatgtgttcatccacaa

SEQ ID NO: 46341 - DNA, 1103 bp, Heterodera glycines
  Genomic contig location: Contig_ID=SeqID_900; Location=875..1977; Strand=+
  SCN-specific regions: Sequence locations=1-376,398-693,716-726,760 -768,804-1103
  Gene Ontology: Mol. function=actin binding; Cellular component=actin filament; Biological process=cell organization and biogenesis
atgtcgtctggtgtaatggtgaattccgaatgtcaaaacgctttccaacaactttcggaagggaaacgctatcgttacatcatctacaaaatagtggacaaggaagtgattgttgaggtggcagtttcttcggaagacgtaataagagaaggggaattaatttgaccatctgacagcaaaatattttcagattggctccactggaactgaaagttatgatgacaattcaaaggccgcgtatgaaacatttgtgaaagacctcaaggagcgaactgagggttttgtggactgtcgctacgcagtgttcgacttcaaattccagacacagcgccccggcgcaggcacttccaagatggataagattgtcttcattcaggttttaccaaatttgttttttcggtattcactgttttagctttgcccggacggtgcgtcaatcaaaaagaaaatgctttatgcttcatctgcgtcggccatcaaggcgtctctcggaaccgctaaaattctgcaatttcaggtgaatagaagccgcaaaaaactgtgaaagactaaggaacaaggcgtaataatatctggtagtcctcccccccccccctctttctacaaaatttttgtccgtaaaaagtcatgaaaatgttttatggggttttcgagatccctccgtacgaaaattacatctattttcgaatcaatagctttgaattttggtccaaaaatggactcatgatcattgaaagttattttctttgtattttcttagggcaattgttttttttattttcattatcttttttttaataattgaggtgtctgatgagtcggaaattgcccacaaggaattgctgagcaagctgaacgacaaataccgcgacaattgaatgattggttgggatatgatgtcctacacattcctctcaatttttgtcatttatacccaaatttaatgacgcttttatgttaaaatcaaatcatgtcacttgatcgccacaatatgtttattttaatatcgggtggataaaaaagacattaattcattcatatccgagaaaatttttgttttcataattcccgttatttactatttcaaaaaagaattgtcataa

SEQ ID NO: 46342 - DNA, 1257 bp, Heterodera glycines
  Genomic contig location: Contig_ID=SeqID_6995; Location=219..1475; Strand=+
  SCN-specific regions: Sequence locations=1-19,41-41,111-149,248 -366,442-442,474-590,616-637,661-698,720-1044,1066-1257
attatgtccgaagatgagttggacaaactcaaaggcgaggtggacgcgctgcagacttttgtcaacaaacggctcgagaaggcacttcagctccaagcggagagcaaacggtgccacggcatattttattaatttcaaatttcgtttcagaatctttgagaccattcgcccgtccatcaatagtttcaatgaagactacctccactttttgcgtgttgacttggacagccaatccaccgtgttatcgtctgactttctgaagaagatggaaaaattgaatgaaagagtgagtttaaagaagggcgatcgaacgaagtgcttaacgatctctgtttgcttatgcccctaaaaatttagctgaaagaccatcacgacttgtgggctaaacaggtcgtcttccgctatgacgagctgctcgttaaattagacgagttgtccgcaaaatgtttccaaccttctacggagtttccagcaaagccaaatttgagtaagtgacaattgtcaaaataaaagtcattaaatccttgggaatttcaaaccgcttatttatttgcgtgattaatcttattttatatgtaatatttcagaaaatctgagtgagaaggaactgctaaaattggaggaggaagttcgaatccgtcagcaaatgtacgagcgagcgaagcccgtatttgacaaactgaacgaatggatggccaattggaagcagaagttggacatcgaacggcgtgtgtgtcgtgcgtctttctacaagaacagggcggggtgtctggacacaaaactgaaggtcctttaatcgaatcataattttacatgaataaataatttagcaacaaaaaatcgtggaacaaaaacttccgaaattgctgaacgagctttgtgagttatgcaacgactacgtcaaaaacttccaattaaacgacattatcatcgacggattgcgagctgacaaatacgccgaatcgaagatgcaaaattatcaccaagacaaaggagtgcaaaaggctcagaaggtcattcgttatcatccatcctttgattgtttttgttctaattacagcagttttcgaatcctcctttgaaacggtcaacgtcgaaccgtcccgcgacttcgtccacttctcgacgcaatgtattcgtacccagaaattcgtgtggtcgtgctgctcctcgcgcactgaacccaatcggggaaaagcagcagacgccgacgacttcccgcaaagaaggcgagacgaagcacgccactcgtaaacg

SEQ ID NO: 46343 - DNA, 118 bp, Heterodera glycines
  Genomic contig location: Contig_ID=SeqID_33473; Location=27..144; Strand=-
  SCN-specific regions: Sequence locations=1-118
atggaaggtcacggattcctctattcgctggaaatcgaaaattttaaatccttcaaaggcaagcattacatcgggccttttaaacgattttccgctattatcggaccgaatgggtcgg

SEQ ID NO: 46344 - DNA, 540 bp, Heterodera glycines
  Genomic contig location: Contig_ID=SeqID_33491; Location=68..607; Strand=-
  SCN-specific regions: Sequence locations=1-540
  Gene Ontology: Cellular component=Arp2/3 protein complex; Biological process=growth
gaaactcgacgtggacgcctttgaccccgacaaatttattgacggcgatgaggctgagacgccggtcggacaagggccggacgagggacaagtccgtcaatttcttcaagccaaccaaaacgtcgaagcgttgaaggcggctctttccaatgccccactgagaacgaagaatcaggtccgaaaagggcatcacgagacagccgaatggacagattggcaaatgaaatcccaagaaatggcagggaatgccgaatttgttggtcattgattgtgcctttgccttttattacttttcatttgtcaattcgttagattttctttgagacttccgtcattctttttacattttaggcgctcaaagacaaaacgacttcacttgttgtccgtgtgttgaccagcttcaaaagtgcggatattgaagcggcattaaaatcgttgtcagccgaagaaatggatttgctgatgaagtacatttacaaaggcatggaactgctgccggacggacagaattgcgcttcactgctcgcatggcactcacaa

SEQ ID NO: 46345 - DNA, 729 bp, Heterodera glycines
  Genomic contig location: Contig_ID=SeqID_33533; Location=169..897; Strand=+
  SCN-specific regions: Sequence locations=1-84,106-150,172-606,646-729
  Gene Ontology: Mol. function=phosphatidylinositol 3-kinase activity; Cellular component=1-phosphatidylinositol 3-kinase complex; Biological process=hermaphrodite genital morphogenesis
cttcaatttaatgcagaaaatgatgaaagtaaacagcagaaattgggttcaattggcaaaacaataccgacaaagcaacaaagacaaagtgcacaccttaaaaaaggtgttggtaaagaaagtggggaaacggcggacaatgcttccatcggtgggaaaaagaaagagggggacaaggagcccgagccagagcgaccgatggaacagttttacaacaaattgaaggcagtttttgcggcgaatgtttgttttttttctcaaagtttatgccgtaaatacaaaatttgttgttttttccagagagtgccgaaagaatgtttgaatgacagaaaacggtggcccaacgaagtgctcaaaatcgtactcaaagagctcggagatgaaacaccaaaagacattttggccaagtctgatgatttaaaataaaaaaagtattagtagtgaatgaaattaccaaggataattaagagaactatggatttatgcggccacttctgatgattggtggatgaacacacaaaattttgccaggacggccgccgttagttctatgctcggtgcgttaattgggctcggagatcgccatttggatgtaagttttagtggataaggggggagggaagtgtttgttttaagaatgttctggtggacctccattctggtcaaattgtgcacgtcgactacaacatttgcttcgggaagggccgaactcttcgcgttcccgaaacg

SEQ ID NO: 46346 - DNA, 896 bp, Heterodera glycines
  Genomic contig location: Contig_ID=SeqID_33536; Location=1..896; Strand=-
  SCN-specific regions: Sequence locations=1-603,625-792,833-896
  Gene Ontology: Mol. function=translation elongation factor activity; Cellular component=mitochondrion; Biological process=translational elongation
tagggatcgaatcgtgtttgagggtatcatgatttggtagaggagttggcctttttcaatgaggtcgaagatggttccgttctgagaaaagaagaaattccgcaagaataccgcgaagaggcaaagatactccgccaagaacttctcggtaaagctttggtcatgtattaactgaacttgccctttacagaaaacctcgcaaattgtgacgatgttattgccgagtgttaccttaacgaagtgacgccgtccgtcaaagagataaaagaggcaattcggagggcaaccatcaaacggtcctttgtccccgtgctcgtgggcagtgctctgaagaacaagggggtccaacaaatgatcggtgcctttttacttggacattaatcactccaacggaccccctcccccttagatgctattgtacattatttgccaaacccttctgaagttgacaattttgtgaatttatatgagtaagtgcaatatttattctttttttaataattctttccttaagcaaaaatgacaatgcagaacgcgtgctgatggaccctttgaggaccgcaaactccgaaaaacaaaagccatttataggacttgcgtttaaattggaagtaggattttgtattcgttttgttaaatgcattcagtgatctaaggcaggaaattttggacaattgacgtattttcggatttatcaaggacgtctggtcaaaggcgacactatttatgcgacaagggacggacgcaaagttaatacaatatgtataatagtacggattgttcaacatgaactttttttaaatataattttgtaaatttcttaaatttaaatgcatttgaatttaaggtaagaattaagcgtttggtccgaatgcatgcgaatacaatggaagacg

SEQ ID NO: 46347 - DNA, 329 bp, Heterodera glycines
  Genomic contig location: Contig_ID=SeqID_33549; Location=369..697; Strand=-
  SCN-specific regions: Sequence locations=1-117,139-329
  Gene Ontology: Mol. function=L-malate dehydrogenase activity; Cellular component=mitochondrial matrix; Biological process=malate metabolism
tgtgcgtatgtcaagtccgacgtggtggaagcccttgattactttgctggaccattggagctgggacccaacggcgtggtttgttgtcccattttattaaattatgactactttttcagaatggggttttttcttaagtttttgctaccacagctataattaatatccgttatgtggaatgctttaaccacgtaatccaaaatcgtttattttaaggaaaaaatactgccattgggtgacctgaccgcttacgaaaaggagctgatcagcaaagcggtgcccgaactgaagaaggaaattgcgaagggtgtcaactttatcaagcaagg

SEQ ID NO: 46348 - DNA, 5033 bp, Heterodera glycines
  misc_feature (962)..(962): n is a, c, g, or t
  misc_feature (1916)..(1916): n is a, c, g, or t
  Genomic contig location: Contig_ID=SeqID_7026; Location=1423..6455; Strand=+
  SCN-specific regions: Sequence locations=1-718,740-829,851-1092,1115 -1160,1189-1324,1346-1622,1696-1863,1886-1903,1942-2149,2171 -2276,2303-2364,2386-2469,2544-2685,2707-2740,2769-2834,2856 -2914,2993-3060,3082-3391,...
  SCN-specific regions: Sequence locations=...3413-3440,3462-3536,3576 -3617,3673-3818,3840-3852,3874-3993,4058-4342,4365-4514,4537-5033
agcgcgtgcacaagtgcgaccagtgccaaaaggcgttccgcttcaagtccaacctgttcgagcacaaatcgctgcatttgggcagcagcagtcggaaccctttcgtgtgccctttctgctccaaaacgtgccgtctgaagggcaatctgaagaagcatttgcaagtgcacgtcaccagcgcggaggacttggaatgcttgtggaaacgctctttctcacggtccgtccgtccgtttcgttacgcattatttgtgtctattttctaacgaccaatttgaatttcagcagttccggtcgtccgagtaaaaatgcaccgcccgctccgttgccaaagcccggcgacgacctcggcatggtgccggtgctcgtctctcagcaggcaccgtttttgccattttggctctgttagctttgctaacccttccctccctgttcaggatgcttcttcctcctctccatttggctcctcccccaccatcaaatggactttgccccaaaatcgaagtgccgcttcatcgcctggccaaagcggcgccgcagaaagtgtcccccggcaacagaagagaagctttgagttgtcacggcaaagtgaggcgaacgggcggaaaagcggacgacggacagagcgaaaggcatcggcgaatggccaaagtgtgctgcgatcactgctcggagacgacgacgcgatgggcaccacggcatgagaatattggcaaatccatcaaatccctcccccaatttgtgatacgaatttattccgtccctccgctcaattttctctgtcttcccttttttcatttcattttgcttttctctttttgttggattattctgaggaacaaataaatttaattgctttaaaaactgaatgaaatttggaatttacaataaattcggctcgaaatgttcaaaaggcaaagtaaaagcatcaaataaaagcgcaaaagcatcactgaactttnttcgggtctttttttgtcgcttttctctccaatagtgcccccccccccctttcatttcgttttgtctgtgccattatgtgatgggtttctttggcacggattcccccggggctagccgagaattgccttcttttgtccccttttcctcttcccaaattggctgttcttctcccacttggtttcccctgctccattatcattaattaatattaattaattaattaatggtccgtttaacaccaaatgagtgtcattgttatcgctttaaaacaaagacactaacccaaatgccaaaaggatgttgcgaagaatattttgcggaaaatcaaagaaacattcgcattttgacactttggcgaagcgaaaagagaacaaataaaaaagaataattaatgaagcaataaaaagtaattagtccaattcacaaacatttgtatgttttgttaagcatttgcaataattatgcactgattaatgaaagtaatgctcgagaatggaatgaaaaaggaaattcccgagttgggctcggaatccccgagcattttcaattaatgaacgcttaattgaattgtcggtctctgccgttatcagactgattattctcaacaatttgtcaacttatctttcgcttttctctctctctcttcataactttagctgtctctctcaccgtctctctctcaccgtctctctctctctctctctttcttttgtttgtttgtctgtctgtccattcatttactgtctcataccctctttttttttgtttttaattctgctgattgacctcgctttaattacgtcacttagctgcccaattagtgatgggtctccgccgtcaccgctttgctttgacgtcacttttcgcttgtgtttccccgtgcgccctcaatttctcgtaaaatgttacaaattccaattaggaaaataaaatgcgatggttattttgatttnaaatgtttttttttaattattatatgctaaaaaccaaaaatgaaagaagtgccaaaatgtgtattaaaattgccataaaaattcaattgttttttaatgagttaaccatttgactttaatttcgacagcctaacctctttctttcttatgggctggattttctggattgaatggtgctatgaagttagtcaaaaaaccatcaaatgaaaatattttctgatataactttacacaaaagtaaccaatttttaattttgatataattcgatagccctaagtattttttattatcctgcaaaatttcaaaaagtttcataaataattaaatctcatttctctcctcctgaatttgtcgaaaagttcgatttaatttaattattctttaattattcagtgaatcagtgggttttcagttcccattaacacttagggctatcaaatgataccatggatgcttaatttagatgcttgtaaaaaagttgggttgcattaaattgtcaaattatttgatggtctcgtttttttgaagggtcgtgtatactaaaatagagccaaatatatttattattaaaagattgttattcaattataaatgaattaattaatttaattatttaaattaattttctgtactgaaatgacccgcctctttcgatcacccatcatccatacttttgactcttcgactcaccacgagaaaaactttgtttagaagaaagcggacaatgttatttcataatgtacatttacgtagttaaacttttacgatttttgacaattaccatgattttatttatagtctgttcaaaacctgagaaatatccaattaattatttttaattgaattcatttcgaaattattactaaatttggtcacttaaattatatttcccgatcattcagtaaatttcgtaagtgtttttcccatttctaatttttgtgcctctggcggtgcctaccgatcaaaacccatcactctgtgccctctcatttgctcatctctccctctccccttcccctctctctcgcccccttactattctctctctccatcccctttctctctctctctctctgccgctgattgcccctaattaatctctgatctcgtcccatctttgcaatttcttctctaaactggttgtgctgtgctgttcagcattttaatgcatttgaagaatcgaataactacacaaaaaatgctgaggttgggttgttgttgagtagttgattttcagttacttataaatttgggagaacggacggagggatcgattcgatcattcattggccaagggaaagacaattcgaaagaaaagaccttttcgaaaaaggcagtgccaccaaaacgaaccaaaatcggccacagaatgctaaaaacgtgaacagcagattgaatggattcggcaaaagtttaaatgacccaaaaatggcaataccaaaaaaaaaatgaaaggaagggccacattaaacgagttccctttttctttaccttttcccattctctgctcatccgtcgtccttttccatttcccctcaaaaaatgttcgattctttcgtcctcatttgtcagtccgccggagtttaaaggtgggaaaattacagttaaaatgcgtttgttttcagcagatggccctctttctcttctctctgtcctttctttggttcaattcgtttttctccatttttttttcgtttagtattaattaattaattttcttaataattaattaattttcttaataattaattaattgaactctcatcttggcacttatcatttatcaaattatgatttagacggtaataaatgttccgtatattccaaatttccactcgcatttttctgcgtttttttcgccaatgcccaaaatccgtcgtttgccagcgattttttcccttcttcgccgggtttgctgctgcccccagtgccgggggatgaacagaaagcaaagaatactccgacggaagaagaactgatcggaaaattgctaaagtcgggcgcgggattgcccccggggccaccggcggatttgccgagcgacggggaggaaaaagcagcgaagacgacggacggagcagcggagggacagccccaacaaccgcagcaacaacaacagggccaacagcaacagcagcagacggacacggaacagcccattcagccgatgcctccggtgagtgccatcgccgacgattccttccgccattcatcgcttttactttcccgccccccccccaggcagtcgttgccgaatcgccctcaatgcctcagggcaccgatggcggcgcgcccgcggcaccgccaaattacgtgcaatgtttacttaaaatcgcgccaaaagtgtgcgacccgggaaacattctgaacgcacaacaaaagcaagagattgaccaaacacttgcagaattgaaaatggccacgagaaaggcaaaagggggaaaatgaagcgaaatgagcgaaatgaaacaattagcaattaattaggaggacgcgaaagacgaatgtgccaagagtgggctggaggcgatgttcatcatcatcaaacactcgaaccttctcgacgaacagacgagcgtaagaaaagaaaagcggcgaatttcaaaacaaaatgccaacacttaatgaaggaagtccaaagaacgctgaaccaggcgatggacttttgggttcgggaccatccatgtgaaaagcccgtggtcattatgttgagcacggacccgtcaatttacaaacgaaaggtgtggacgggacggcattgggacgtgccggtcgacccggggcaactcgtcaaacttttcatggatcaggtgatcattgggagagagtcattcagcagaatgtcccggcaaagcaaaataacagttttttgtaatttggttttgataacactaatttgcgttctgctgaattgaattggcaaaacgaatcgaacttttggccttggggacggacgaactgtgcccgtggaaagggctgacccatccttaccatttcacacattatgccaactttatgactttggtgtgaatctgctgatgccattttcgacgcgggaacgacaaaaaaaccagaagagaagccattttcaggttgagtccattcggcaacaaaaa

SEQ ID NO: 46349 - DNA, 146 bp, Heterodera glycines
  Genomic contig location: Contig_ID=SeqID_33592; Location=139..284; Strand=+
  SCN-specific regions: Sequence locations=1-11,36-146
  Gene Ontology: Mol. function=pre-mRNA splicing factor activity; Cellular component=small nuclear ribonucleoprotein complex; Biological process=mRNA splicing
atggtgctagaagatgtgaaggaaatgtggacggaactgccgaagaaaggaaagggcaaaaagaagtcgaaacccgtggcgcgcgaccgtttcatccccaaactttttttgcgcggcgacagtgttattctcgtgctgaaaaaccc

SEQ ID NO: 46350 - DNA, 388 bp, Heterodera glycines
  Genomic contig location: Contig_ID=SeqID_33605; Location=728..1115; Strand=+
  SCN-specific regions: Sequence locations=1-86,108-150,172-203,225-388
  Gene Ontology: Mol. function=hydrogen-exporting ATPase activity, phosphorylative mechanism; Cellular component=integral to synaptic vesicle membrane
atggcgtcgcacaccgccggcatccaacaacttcttgcagccgaaaaacgagctgctgaaaaggtttgacttgatgttgatttttcaaatatatttatttttattttgcagattaatgacgctcggaagcgaaaagcacagcggctcaaacaagccaaacaagaagcacaggcggagatcgaccaataccgacatgtgagtgtaaaaacagaaaaggaaagtcttgaattgttaattgtaagcagttgtaatggatctattacagttaatgagtccaatcgctttttattttatgaatccaatcaaataacaaaatgctttctttctcggaacataactttctcataaattttaatttcattcgaaatattacctagtcaacaagcaa

SEQ ID NO: 46351 - DNA, 428 bp, Heterodera glycines
  Genomic contig location: Contig_ID=SeqID_33652; Location=225..652; Strand=+
  SCN-specific regions: Sequence locations=1-361,384-428
  Gene Ontology: Mol. function=protein domain specific binding; Cellular component=cytoplasm; Biological process=protein targeting
atggacctaccattaattaaactttgcatgcttaaggtgattgaattggatgccaaactgaacgaaaatgaacgcaaattgttgggcgtcgcgtacagaaagtcagtcactgggcaacgcttcgcttggcgtgtcattgcgtccgtcttggcacgagggaaaggcacgaagagacagctggagatggtcaagcagttgctgaacaagctggagcgcgaggtggaagagaggtgccgtgaaatattggtcagtggtgggtgggcgcattcttgtgccgcgaaattcggcactaatttgcgtaacttttcaggatttgttggaccgggttctgatcaaggaggctgcagatgatgaagcgaaagtgttctacttgaaactgaaggctgaccacttccgctatttggctgagacacgggcggtgaaaaacg

SEQ ID NO: 46352 - DNA, 2733 bp, Heterodera glycines
  Genomic contig location: Contig_ID=SeqID_7047; Location=582..3314; Strand=-
  SCN-specific regions: Sequence locations=1-5,27-1429,1451-1599,1621 -2234,2256-2635,2657-2733
  Gene Ontology: Biological process=locomotory behavior
atgtgcgaagatgcttcaatgaaaatgttggagaaggaatgcttgagcttggagtattaccctcatttggcaaacttatgcaaaaacagtgagcagaatgttcgtgtcgttgcgcttcgtattttgacaaaatttgcccttgtctaccctgaagagtatgtaatagagaatggaaaaaattcatgtcattataatgtgcccgaataatattttatgccttctatcataattaaaatattttgagtcgcataataccgacaaaaacaaaaaaatccatttctatttatttaggaaagtcatggcatcgaagggtttcaaaattcgtcttcatgacgatgctttctcaatcgtttgcgatgcaatgaatgatttggaagtaaaagttcgcgctcaagctgccaatctcttggggttttttgaaaacgtctctgagtcgttcctcgaccaaacattggacaagaaattgatgcggaatatgactgtaacgtacagtcatttataaattgttattttccaatcacagatgttgaacactaatgtcagaaatacgaaaaatgcgttatctgctggtgttggttatatcggaggatggagcactggcaaaaaaatgggtgaggacatgccgatcgaaaagctggaggacgaaagccaatctttgatccctaccggctcttgtggcgccttcgttaccgcactcgaagacgaatttatgggtatttttaactgaaaagagacctgtccatcctaccaaatgttctttagcggttcgtcaggcagctgtttactcactgggaaaacttgctaggaaccgacctgtttttgcgagtgcgtgcatcgatcatttggccgatatgttcaacgatgaaatccaacaggtgaaattttttctgagtggttaattttcggttttataatgttagaatttaagtgttcaataatacgactgggacttttttttactttagtaggcccggtttgaaccctgaacccaagcctggacaaaaatcaaaataactttttctttgcaaattatcgtgtaaaggaatttagatccgtctcgacgccattcgcgcactgactccgctcgtttcccatggccttctctaccgcgatcaattggacactattctgaccgttctcgatgtaacagaatttatttttcttttttgcaagatccctttgcttttcatcttttgcatttttaggatgcaactgctgacaatcgaatggcacttcacactttgttggcaaagtccaatttggcagattccaactgtgtatcccaatgtcttaagaaattgctgcattctctgcgtcgttttcccatggacaaattttctatttttgggttaattggtaggcactaattatgccaaaaatgaaaatgtttaagttgtctcagtggtatcgggcagaaccattcttcattagttcagcctttggtgaatgatttgttggatgttcatcccatttttgacacccctgaacaaagtatcgacgatgacttttgtaaggattgtaaattaaagaacgattcctataatttttatgcattggagtgacattgtcatttcagccttctctcgtccgtgccatttgcttttgccattattaaataaacttaagatttggcccgactcatcctcgtccttaacgctgcatcccatcggtcagtgctctgttcgcttattccctcttatgcactgaaacattaccgttatttgcgtcgttcttggcctgagattgttcccaaaattctcgtaagagctcttgatatttttcgagtatatttttttaaaggaatttgatcatgaaaagttacaccaatgcgattcctcgccgtttttatgcccttttttggctgttgggccggaggataaaacaattgagaaggaaaatgatgctaaaactgctagagtatttcctattcattgtgaattagcaacaattaaatcttaaggtactcgagcctagcagagaatttagaaacaatgaaactattcgattcgttgctggcttaccaacggggatatttatccgaattttgctttgcaatgtaacggacgaggagttaaatcggttccgaattcaggtcccttaaaatattcgaagctattcccatttagactggttatactacataggtaaaacaagaatcagattcaaaaaaccactacgaaaacccacacaaaaaaaactgaagaggaacacaaaattttacaattagcgttaaaaagggaaagatgaaaatacttaaaacacccaaaagtttctttttgttttatataatgtgaacaagtttaaggtttctttcagtcaataaaatttttaataaatcgaggttttgatgggttttttttaaatgtataacgccctttttcatggcttttatataacgacatagcaccaattctctttttttagattgaatatcccgaccagactttcgaccttcatcgaccaaggcgcggggactttctaagactggacagttcaacagttcatttgcagactaatgttgtcgtttcggctcaaagatgggcgacttcggcatcagtcattttcacccctggcattatttcaacgaaaagtgatgaaagtgtggcacaaagaatcgttggaaagggacaaaaggattctttaaaccaacacataatgccttttgcaagcgcagaaaatatcgcgagaaaatgcagaatctccttcaacattcatccgatgcagcaagcctaa

SEQ ID NO: 46353 - DNA, 2472 bp, Heterodera glycines
  Genomic contig location: Contig_ID=SeqID_7050; Location=592..3063; Strand=+
  SCN-specific regions: Sequence locations=1-214,236-973,996-1180,1207 -1293,1315-1443,1471-1587,1609-1670,1692-2106,2128-2472
  Gene Ontology: Mol. function=delayed rectifier potassium channel activity; Cellular component=voltage-gated potassium channel complex; Biological process=potassium ion transport
ctcagcccgggttcgcctctttccccgacggacatttcgcgtgccttcgatcgtcgaacttcggcgcccgtccaaattcgcatgaatgtcggcggacgaagtgcgcaactgaccctggagaaggtcagcacttcggaccttaaaagaaaggaatgaatggtgccatggctaaagattatccccacaaaacaccgcaaaattcagtcccataaactttttggctttccaaattttaaactctccaattcccatcccaatcaatggtcggatgacctcaaaaagcactttccccacagatccgtcagcgtgccgaccgcagtcgattgtcccaattcgcggaaaaggaccacgcccagcgcgtgttggagtgcgacgcgtttctcaacggcgaatattacttcgagcgttccgccacagttttcgagaatattttggattattacgtgaccggcaaattgcaccggcccatggaagtgaacattttcactttttattcttccgtccggaccattaatcaatctgttcaaaagatatgcccaattcggtggcgtgatgaattggaattttggcgaattccgttgacggcactggcggagtgctgccggtcggatgccttcctgtccaaacggtcgctggcatcgccggcgcttttatctatggacaatgttggtgaacaccaaacgaatggttttgatcagtcagccgattttacccgatcggcttgctgatcagctgctgaacccatccaatgatgtgctgatcagtctgcccatctgatttgtgctgatcaattaccagacgattccgtcctgcttttgctcattcatccctcccccttttgaaggtgtacgtcgagtccacttgccctcccgcagaattcgaggcaattcttcccggcattcgtcctccccccccccctcatcttcatctttcccaatttgccagggcgtcgctttttcccgcgtccgtttaattctgtggactttcctggagaatccgcgctcttccgctgctgcgaaggttctttccgtggtgtccgcttcgttcgtgcttctttcattggccggtctcattctctcttcgatgaaagaatttcaaataaacgatggaatgatgagccctgttttacctcttcaattggccgagatttggtgaatttttatagttttttgatctgatcagtctcctccctttctctcctcttttcatccgatcattttccacttttcgtctgatcacttcccctcttcattgatcactcttccacttttgtttgatcactgtcccaccacgctctcttccctctctcctctttttatcagatcattatcccatttttcgtctgatcaattcccgttcagttgcatgcttttcttcactctcgaataccttctccgcttcgctgttatcccccacaaatggaggttcgttcttcgatcactttggattttctcttttcaatttcttttagtttcgttaaacagcctctgaatataattgaccttctcaccattgtcccttttcttctcgaagcttgccttccccttctcggggttaatgacatcgaattgcgcaactttcgaggctttcttcttttcttctataatttgcttaattaactttttaattgatcatttaggtgctcttattgtcattcgagtgcttaggtgggttaattaactcattgaatgatcaattagcaagcatttaacactaattgccctaaggttggcccgagttgcacgcatattcaagcttgcccggtacagcattggcctgagggcgtttggcgaaacaatgcgaaagtcggttcctttttccctcgtaaaatcaccttaccgtaccaccaaggtcggctgctgagttgtcaatgcttggcatgttcctccttacggtaccttttgtcctactgtcacttttggcatttcccctcagggcataatgcttttctccaccgccatttacttcttcgaacgcgacgaacccaactcaaaattttactctatcccttctgcttggtggtggtgtgttgctacagtaagaaaaggcgaattcgatgagtaatccctccgttccctttcagatgactactgtcgggtcagtcaattttttattcaaaagttttttggccccaatgccattcaattcaaagttacggcgatttggtgccggtgactacgggcgggaaggtcagtcccattgtgccaaaatgtgtttttgggtccgtgccaatgcttttgccattgaaaggtcgtcgctgccattgcctcagtgtgtggcatcatcgttttggcctttcccatttcaatgatcatcgacaaatttgccgagtccacaggccatggccaacgcgtttttgacgaaacggtggcacagggcgaagttccgttggaggccaacaaaagcaatgttttgttggggtcgccgacggggcgaggaatgagcaggaggaggaccaaatcgaggcgatat

SEQ ID NO: 46354 - DNA, 797 bp, Heterodera glycines
  Genomic contig location: Contig_ID=SeqID_7052; Location=1290..2086; Strand=-
  SCN-specific regions: Sequence locations=1-118,140-322,349-757,781-797
  Gene Ontology: Mol. function=lipid binding; Cellular component =cytoplasm; Biological process=lipid binding
atgtccgagaaatttgtcggcaaatggaatttggagtcgtcggagaactttgacgacttcatgaaggaggtgtgctgactggcttccgggattctccccaaaaatttcgtcatattcatttcccacactttttctttttcacaggtcggcgtcaactttctcacccgcaaggccgccggctgtgtcaaaccggtgctggaattcgaagtgtccaacgccggcgagcactggaagatgacgtccacgtcgacgttcaccacctggaactgcgagttcgacctgaacaaggagttcgaggtgaagacggccgatggacgcacggtgaaggtgtgtgtggtggtggtgattgttgagactgttggctaaacattctgtccctttttcagaccatcttcgcctacgaaaacggcaagctgaccgagaagcagtccaagctcaaggtgggtgtggcggtggtgtgcacagtttggattgcacatcttctaatttcacccccttttcaggacgacgagaaggacagctactacgagcgctacatcgatgaaagcggcaaactcgtcattgtacgtgatcaacttggggaccccttttttccattgatgatttcgtcttttccagacgatggaagccggctcggtgaaggccaagcgcgtgtacacgaaggcggcctgagaaccgaagaagatgacgccgatctccgaagacgacggacgcttctgacccgttttcgtcattcttgaggccttttgatccgcaattcttaatttccatctaatttatttaatgcgatcaataaa

SEQ ID NO: 46355 - DNA, 945 bp, Heterodera glycines
  misc_feature (919)..(919): n is a, c, g, or t
  misc_feature (926)..(926): n is a, c, g, or t
  Genomic contig location: Contig_ID=SeqID_33727; Location=202..1146; Strand=+
  SCN-specific regions: Sequence locations=1-482,504-945
  Gene Ontology: Biological process=physiological processes
aaacgactacgacctatgttggatacacattaagtggcgataaaatcaaaaaagatgccattaaaactgacgaaattgacgcgtttttacaaaaagaggaagactcggactattggtaagccaatttaacaaaattatagaagacaacctttgaaaactggtgtggaggcaataggacagccaaaaacaattgatgtctcaaaccctataaataaaacctatggaagagggggtgaattgtgacgcccaatgcaagcaaacactgtgatttgtcgaacgcagttgtgagggcgtttctgaaaatgttactaatgctgaccccaccttcttctgagcgcaattcaataacaatatagtgctatcattatcgcttaactttaaaaaaaagagttttcaatattaaggcgtaaggttttcgaccgtcagtcgggtcagcaaatggcactcactgaccaacaggtggagaaactgaatgccattgcggacaaccggttcccggaaataggtatcaaagagtgctcattgtggggcgacgaagaatgccttttttgaggttacaatccctaccctcctttcttggacattttctcctccgttcgcgagattcacccaatttccaatcgaccccccgacaaacgctctttcgttccgagtgccgatgaacgtcgaattgtcggccgaatggtccacgccattaaaatgggatggctaaaaaggaaagagccccccaaaggctcagaagaagaggaggagccgaggctttacgacctttgggacgacgagggggacgagcagcggaagagcaaatcgcaaatggcacgcgtccgaatgcatttgccggcaccgaaggtcagtcgtacataaaacaaattaagagcaaaacgagaaagtcaccattaatttgcaggtgaaccaccgnagcacgncgagtcgtacaatccccca

SEQ ID NO: 46356 - DNA, 993 bp, Heterodera glycines
  misc_feature (51)..(51): n is a, c, g, or t
  Genomic contig location: Contig_ID=SeqID_33766; Location=1..993; Strand=-
  SCN-specific regions: Sequence locations=1-228,252-460,483-716,738-993
  Gene Ontology: Mol. function=potassium:chloride symporter activity; Cellular component=integral to membrane; Biological process =embryogenesis and morphogenesis
atcaaacccgaactgatcagagacagtgggagatatattcactgaaattcnaccttcatgagcgatttctcaggacgatgtgggagaagagcgtggacaaagggcggggaaatggtcatttatggggatacgatttttaggtgctaaaaactgcaaaaataggtgctaaaaatgggaaaataggtaaaaacctaaaaataatttcattccctcgccccctctcgctgcttttctcccccgcgtccttttttaaacgcaattcatttttcgaatgaatgtttggataaaattgttcgggggtaggcccacttcccatttacgcttaactcgtccaaaggaccggcctctcattggacgggcgaatggtcgttgcgcagttggcatggcctactgaatgggtggttctggtcggctccttcctttctaccttcggtgctgctcttcagtgtctttgcagtatgaaactttgttttttgttctcacctttttcatcgcaaataggcgcgcctcgacttttgcagagcattgccaaagacaacgtaattcccttcctcaaacgtttcgccaaagtgaccaaaagcaatgaggtattgttttgataacagtttgtgattttgttgattcgttcgacaatttcagcccttcttcggcttgctgctcactactctcatcgccgaacttggcattttgatgggcgcaatggacactattgcggctgtgcttgactttttctttctgatgtgttacgccttcgttaacatcatttgtgctttgcattccattttgggtgctcccaattggcgtcctcgtttcgtttactatcactggtcccatattagccaaaatcggcgaaacattctttttttaggtcgttatccgtcctcggggccgctctttgcttattcattatgttcagcacacattggcaatatgccgttttctctattatgttttgctttgccatttacaaatatgtagaatggaaagggtaat

SEQ ID NO: 46357 - DNA, 1240 bp, Heterodera glycines
  Genomic contig location: Contig_ID=SeqID_7067; Location=2761..4000; Strand=-
  SCN-specific regions: Sequence locations=1-687,709-946,991-1240
  Gene Ontology: Mol. function=translation elongation factor activity; Cellular component=cytoplasm; Biological process=protein biosynthesis
caattgttgccaacagctaccaatctccagcacgatgatggaactgattttccgcgtgaacgaatcgtcagtttttttctttatataatgtgctgacttctttttgcttccaggaagcttttagtaacgttgccattgttatcggtgatctgatttccgatgcagttctgcaaattcagaacttttctgagcatccggagtttgaaaatttttttttgtttgaatcattcaactttttagcggtcaccagccgattctgaacatgttgaccagttgcgagcaaataataaatacgagcaatagtttttatggacaatgttgtgatttttttcgattcacaacccgttttgctcatcgctcccgcagtcttgaataatcaatgtttccattgttcatttgttttgttgtagcagataaaaaataaaaaggtggtacattgaagtggtatacaccaaaaagggtacgacatggaatgtttgcttaggactgagaatggaatactgtggcattgaaaaattaggacggggccttacaaatcggccatttcaaaaatccgaaatcggaattgaaagttggggaaaaaatctgacgttttgccattaagtaaaaatcttatttttggttttggaattcaatttgccccttacaaattttgtcgtttcccgtgattagcttaaacaaattgtatgttcaacatttagttgtgcatacacatcgttggcggtgtcaattttggcgatttcatgctcaacttgcacccgcgcgatccaaccgttgccgacaaaacgtacgacgagcgcgtgatcgaagtgcgccgtgaccccaaccgaacgccgtacatggcgctggttacaggtgtcaaggtttcctcctttttaagtgtagtttgggtgcggacagcaaagctagtgattgggtttgggtggggaatgatgatgaacggtatggtgatgatactagcagtggtgggttagtgcaaagttcaatatttttgcttcacttaaaatttagtgccatttcgatgttctttgaactcgagcgcaaagacttggcgttcgtcaagggcgaaagccaagctgacattgagcaggtcgatgggaagagccaaaaatacaacggtttcttgatcaatctgatcgactcgcctggccacgtggacttctccagcgaagttactgctgctttgcgtgtcactgacggcgcattggtggtggtcgactgtgtgtcaggttttatttga

SEQ ID NO: 46358 - DNA, 426 bp, Heterodera glycines
  Genomic contig location: Contig_ID=SeqID_33779; Location=489..914; Strand=+
  SCN-specific regions: Sequence locations=1-426
  Gene Ontology: Biological process=reproduction
tacaatgaaccaccggaagccaaacttcccaaactccgctggcgcttatatccgttcaaggtaaaaacaatgcgttttcattttgaaattcagccagtttttttttcaaaaataaattcaatgccatggattggcacaattttacatttctcaaaaaaaaaataaattgtttttcactgatttttcctgccttcctaaatttgtgggtccggtgacaatcggtgctctgtcacttattcattcacttctccccagggtgacgatactttaccggtgttttacatacatcgtcagtccgcttatctgattggtcgtgatcgcaaaattgccgactttcccgtcgaccatcccagctgctccaagcagcacgccgcgctgcagtaccgctcattgcaatacgagcgctcggacgggtccatcggacgg

SEQ ID NO: 46359 - DNA, 973 bp, Heterodera glycines
  Genomic contig location: Contig_ID=SeqID_7069; Location=645..1617; Strand=-
  SCN-specific regions: Sequence locations=1-114,136-612,634-793,815 -816,849-973
atgcaacaattgtctaaaaagtcggcttgggtttccaaagtttcgggcgagttgctgttggccaaagtgaagcaaatcaccaccatcggactgcagagggacacctgtgtcaaagtcaaaatctccaaaaacaagtgggttctggggggtactacatggcaaattttcattgattttcggaatatgtaaatcgggcaatttgaaaaatgtggccagcaaatggttcaaattatgagtctcttaattgaaactgaatacatggcaattcatcgcttgacctctctgttgtcaccttaagtgtttttagggatgtagctgattttcagcaattttgctattgccccaccccccgaaaaatactagaattttattggtttttgacagaataaaacataggggttttcgtggtcactgattatgctcttacactcatttttaccaatccttcgccaaaaatcttaaattcaatttttttagttgcaatttttgttcaagcttgggttaggatttgaaattggttaaaattatgtcatattcgtgatcaacgtcctgaaaacttgtaaacgagtttcactattctgaaaaaagtaaaccaaaaactccctggctttggtttttaataaaattccaaaacctttcggggctccgtcaacaaaagtgcctgattttctccgttcattctccctcacttctttctattttcattttttcattcatttagtttctacgaatacaaccgaatgttcttcatgagttctgcctatgaatggtcgctcgaccccgagtccaaatgcaggtggaaaagaccactaaattatttgttttaattttgattttggcttttagggtgggcgacgttgtgttgatcagacgcctctcagagatccacagaccatcaaaaactgtccagtacgctgtggaaaaggcaaggaattcatcattttgtcgtcacgcaattaacaaatggcattag

SEQ ID NO: 46360 - DNA, 618 bp, Heterodera glycines
  Genomic contig location: Contig_ID=SeqID_33800; Location=55..672; Strand=-
  SCN-specific regions: Sequence locations=1-146,169-400,424-618
  Gene Ontology: Mol. function=chaperone activity; Cellular component =actin filament; Biological process=cell organization and biogenesis
ttggtcgagctgtccaaagcgcaggacattgaggcgggcgatgggaccacaactgttgtggtgttggccgggtccttgttggacgctgcagaaaaacttcttgccaaaggtcacttagactcgtttatacgccaaattttagcacttttgtttttaaaggaattcatccgaccaccatttccgactcattccaacgggcggccacattttctgaaaaagttctcgaggaaatggccacacccattgacattaacgatgacgacgagttggtgaagctcgccatgacgagtttgaactcgaaggtcctcagttcactttctttcgtttgcccattgtttccttcgattttccttttttcaggtcgtttcgcaacattcccatcttttggccccaatggcggtgcaggcagtgaagaaactgatgagttcaccggaggactcaagtgtcaatctgaagctgatcaaagtcgtgaaaaagttgggcgaaacggtggaggagtcgcagctcattgagggagcgctgatcgatcagaagtcgatgggccacggaggcccggcgcgggtggagaaggcgaagattggcctcatccaattccaaatctcaccaccaaagcccaac

SEQ ID NO: 46361 - DNA, 1013 bp, Heterodera glycines
  Genomic contig location: Contig_ID=SeqID_33821; Location=45..1057; Strand=+
  SCN-specific regions: Sequence locations=1-171,241-280,302-567,590 -608,630-1013
atgcggaggaaatttacgagggtatgaaagcgttccggggtgtcgatgatcggattcgactttttcggccggaaatgaatatggcacgaatgaaaaagtctgctgctcgtgctgcaatgccggtttgaaaatgattttcaccaaaaatgccaatttttgcgattttaagccaaataatttgtaaataaaatttaattcatctatcaaataatattatttatatttattaattttttttttgaatgccagattgcttcttgggtggatatttatcatttcatttatattataaaggattttgatgcggatgagttgctgaaagtgatcattgagctggtccgccttgatcgcgattgggtgcccgccaagtcacccgcttcactgtacattcgtccgacactgatcggcaccgacccagtcagcccggtggacccgccacgatcagtcaaaatgttcgttttaacaggtaatttgaaaaaaatatattgaaaggtcccgttcccaagaactgagaccaataccgaaagagtcatctagttaaacttgtaaattcataagtacaatatctttatttttaattaaaaaaattggaaattttttggagtttttaaaacaaaattttaaataaacgactatcgcgaccgatactctcgagcatctattactcaaattcatacctgtctactatattcaggtcacggtaaataaaaaagaagtgaaacttttttagaaaaaaatttgcctaattaattttttgactgtttttaacactttaattattgttcatggagtaaacatgaaatttaattaatttttggcccggtcggcatgtactttgccgtcacacagcccgtgtcactgtatgcggacccaagtgttgtccgggcattccctggcggagtcggtggctttaaaatgggatggttagttgaaagtttcaaattttaattaatgcgaaattttcggggtctgtgcattgtcggggaatggaaatttacatcagaaaaaatgca

SEQ ID NO: 46362 - DNA, 1707 bp, Heterodera glycines; identical to SEQ ID NO: 7082
  Genomic contig location: Contig_ID=SeqID_7082; Location=1..1707; Strand=+
  SCN-specific regions: Sequence locations=1-368,392-550,593-709,731 -773,795-985,1019-1056,1078-1707

SEQ ID NO: 46363 - DNA, 1356 bp, Heterodera glycines
  Genomic contig location: Contig_ID=SeqID_7090; Location=681..2036; Strand=+
  SCN-specific regions: Sequence locations=1-437,517-533,573-836,859 -1356
  Gene Ontology: Mol. function=serine esterase activity; Cellular component=endoplasmic reticulum; Biological process=acyl-CoA metabolism
ttgaccaaagcgagtccatttccaggggttttctaaattgtctaattgcctcaaatagtgccaactgttgtgcacacaatgttcggaccggtcaaaggcttcaccgacattgacggggccaactcgagtctcgtcgacgttttcctcggaattccgttcgcccaaccgcccgttggccatttgcgatttgaggcaaatgctaacgaattttgacaaactttattaattgcaatttcactgttatgccaaagaaatgaaaaaatctgctcagaagccgcgtcccctcgtgacgcattgggacggcattttggacggcacggagcacagaaaaagctgtgtgccgcacgcacggcccgattggcaaaacgaattgctgggccagtacagcttcagcgaagactgcctctatatgaacatttttgcaccacacggagcagtaaataaaataattaaaatatatttaaattaaatataataattattatttaaaaaaggaaaaaaatgaaaataattaatgacaaaatgccgcagaacaaaggcagtgaggagcagctgctgcccgtgctggtgcttatccacggcggtgccttttccattggcagtgtccgccaatttagcgaccacagagacatcggtgctaaattcgtcagccacggcattgtcgtggtggccatccaataccggcttggggtttttggtaagccgagagaaaatttaaaaaacggcacaaatgaatcggttatttagcaagtctcattaaggtaaataatgatgattaattggatagtctcaatttaccaaaggcttcgcctcctccggtgatccccaaatgccgggaaactttggcctttgggaccaactcgccgcgctgcaattcatccgacagaacatccgacgttttggaggaaacccggaggacattacgctttttggccattcggcgggtgccgcgagtgtcagcgcattgggcatttcgccacacagccgacgtaaaagcaaaggcatcccgaaaagccaatgagaatgtaaattgggagttcagatttgttccaacgagcaattcaaatggccggctccgtgttcagctcctttctgctcggtgcccacgtgcaccgtttgacccttggccttgtcgagactctcgactgcgaagagccgccaaaggaatgcctaaagcgcaaaagtgtggacgaaatccacgccgctgttgaacggatggtgagggaatatttcgagaattaacaatgccaaaattgttgtattgagggccctgccaaagtgcgacttgggccgcgcatcgacggcgactttttcccccgcgacattccctccctcgtggacacatcgcccaaaaag

SEQ ID NO: 46364 - DNA, 527 bp, Heterodera glycines
  Genomic contig location: Contig_ID=SeqID_33900; Location=183..709; Strand=-
  SCN-specific regions: Sequence locations=1-174,196-388,414-527
  Gene Ontology: Mol. function=structural constituent of ribosome; Cellular component=cytosolic large ribosomal subunit (sensu Eukarya); Biological process=protein biosynthesis
aggctttctcatttaccgcgtgcgcattcgccgcgggggtcgaaagcgtcaagtgaccaaagggcaaacgtacggaaagccgaaaacgcatggcgtcaaccagctgaagaacacgcgcagtttgcaggccgttgcggaggtttgtttcaattagatgggcctaacaaattgtgcggttttcccaaaaaatggtcaaaacttggggattttagagcaaagcgcattgaaaaccaatgaaaaaaaaaatgcgtcaaattttacctggcggtaacaagaaaaaaggaaggtatgggagctgccacaatttcacccgccccttgtcatcccaggctaagtagcccggcccatcttttatttcaacccttaaagtttcacaaattttctgactgattttccccccttcccttttcccataggcccgtgccggccgccgtttgggcgaacttcgtgtgctcaattcgtactgggtgggccaggactcgacctacaaattcttcgaagtcattctcgtcgacccatcgcacaaa

SEQ ID NO: 46365 - DNA, 472 bp, Heterodera glycines
  Genomic contig location: Contig_ID=SeqID_33919; Location=943..1414; Strand=+
  SCN-specific regions: Sequence locations=1-26,48-153,176-472
  Gene Ontology: Mol. function=ubiquitin-like conjugating enzyme activity; Cellular component=chromosome; Biological process=growth
atggccggtatcgcagcaggaagactgacggaggagcggaaagcctggcgcaaagaccatccattcggtttcatcgcacgacagtgcaaaaaggaggacggcacattggacctgtaatttttttgttttgaattaatgttcgaactagccctaatctcatatatttggatattatacagtttgtaatccacttttcatctaaatttcaggtacaattggatctgtgccattcccgggcccaagtcgaccatttgggaaggtggtctgtacaaattgcgcatgatcttcaaggacgacttcccatccacgccgccaaaatgccgttttgagccgcctctcttccacccgaatgtttatccgtccgggacggtctgcttgagtctgttagacgagaacaaagactggtgcgcaacacatcgcggtttttaatccttggcttttgtttgcagaaatcgaaacgatttttcgggca

SEQ ID NO: 46366 - DNA, 1116 bp, Heterodera glycines
  misc_feature (121)..(121): n is a, c, g, or t
  Genomic contig location: Contig_ID=SeqID_33921; Location=1..1116; Strand=+
  SCN-specific regions: Sequence locations=1-933,955-1055,1085-1116
aataataaatggaaaaaaaagttggactgtatttatattgattttcaaaaagcatttgactcagtgccgcatgaattacttttatacaaattggaaaaaataggtataaggggcaaacttntgatgtggataaaggactttttgagtaataggacttttcgtgttaaaattggggatgatttatcctccagtaaaaaagttggctctggcgtcccccagggctctgtccttggacctttattatttttgatttatattaacgatcttcctgatgctttgccatcaggagtgaaaataaaattatatgctgatgatgttaaattgtatatatgctataaagcaatagcagatacagaaattatgcataaagcattgcataatttatcagaatgggcaaataaatggcaaatcagaatatcaattaaaaaaacttttgtacttcatttggggaataaaaaccccaaagaaatatataaaattgatggaaatataataaatgttgtggatacaattagggatttaggcataaatattgataataaattgcaattttccaatcatgtcacacaaataataaagaatgcatatttacgtatgcgttctttatttcgggttattaaatcaaaatctactaggatttggattattttgtacaaaacttatgttagaccgttattggaatatgctcctgaggtttggaatccatctcttctaaaaaatattaaaaaaattgaaaaatgtcaaaaatatttcaccaaaagagttcttttcaaatgcagccttccacccattccataccaacaaagattagaataccttcaactgccgacacttgaaagcaggcgaaagctgtctgatctgttcatggctcataaaataatttatggccgaacagatcttaatccctttgaaatattcaaaccttctgaacactttaacattcccttttatagacttaactcgaaatataaattaggcaaaaaatttataccttttgcggggcgggtaactaaaatttggaagccactctataaaaggatcattgaaataaactcattaaatcaatttaaaaataaaattaaaactatctctattcccgtaaaatagaccgaaaaa

SEQ ID NO: 46367 - DNA, 2382 bp, Heterodera glycines
  Genomic contig location: Contig_ID=SeqID_911; Location=281..2662; Strand=-
  SCN-specific regions: Sequence locations=1-141,165-607,650-683,802 -1395,1432-1503,1525-1971,1993-2128,2169-2336,2358-2382
  Gene Ontology: Biological process=gametogenesis
atgcgtccggatgagcaccgcttcaccgccgctgactcgccctacttccgcagcaacagctcatttcttggcatcggaatggacaaaagtgtccgaattgttgaaagtgggtttaaaacaaaaattcgaaccgtacgtcgcaattaaaaaaattttttttttttcgcagacggcttgaagcaaggcgatgtcgctggagcaaaagctgcgatggtcgtccaagtgcaaaaagtgaggattttaattcgaattttatctccttcattggtatttttcggaattagtatcccggcggaaaataatttttttttttttgagtcttactaaaattccaaaggattaattacgcattcattaaagactctttctcattgtcatcacaagaacaaaacgctccttcactttcagacgccgtttcacttggtcgaatcgatgctcgaaaagttcgaaaaagtggtccctcgatggaatggcggactgttggaaaacggtgaattggcccatgtcagtcgcatgttgagaggtaaagtaggacgggatgggcacaacatcatcttaaaattcgttaaaaattgcttttatccttatgcatctccccctccctcgcaaaaatttttttattttttcaataaaacattaatttttataagacaatctcacaaattttttattagcgttttgcgattttattttaaaaaatttccaaaaaatttgattgtaagaaaatttttcaattttttttttcttaaagtttttataaaaaaaacaaaaaatttaagtttgaatatattttaaaaaaaacaattctgaggaagtgaaacggggcggaaacgagctgattgtgagcccttttcctcccctgtcacataccatttttacaggcctgtatgtgcacaccacttataaccagcaagcaattcaacgctttccgatctccgctttttcgccaaccaatgccaaaacagaaattatgatggttgaagacgggcaaatcacggttgagcaatattatgcccgccgatacgacatcaaattgaggtcccccattttttccgggtgcaccccaaaattccgccgccgaaaaatttttttttatatgagaatttcaataaaacaattagttgaaaattttttatcgatttattggaaaaatttcgaaaaaacttaggtttggaaaaatttttttatggaatttaaaatttttcagtgcgccttgtgcacctttggtgatccgtcgagagcgtggcaaatccacgcattatccgatggaactgctgaagatttgcgactaccaacgtgtccgctccgctcagatgacaccagagacccaccaggtgcacacaatttgtcccgtataatacaaaagaaaaaaacgaataaaaaggcaaatgtttcatttttaaataagtttttcaaaaaaatattaattttctttacaagaacaaagtaaaaaaaaattagaaatttttttacaagaacttagtttaaaaaaaattagaaaacttttttggcgattttttttttcgtgaaacggcggggggggggggggtggataaaattttgcacccctttcatacacattttttttggaaattttggttcctattttcaggaaatgatcaaagcttgtgccatccctccatttttgctgcgaaggcagacggatcagctgacaaatgtgcttgcgctgaaccaaagtgaccatcttgcgagggcgtccatccgatttgctgaacgaccaatggaagtgccggcgcgcattctgaacccaatgaaactgaaatatgccgacgacaaactggaaatgccgaacgacacctgtcggtggcgtgccggcagatacctgttgccggcacagatcaacagctggtgtgccatcgcgttggtggacaacagccgcgacaacaatgtgaggggacattatttagaatccgttttttaggattttcaacaaatttttttttgtggctttaaaaattctgggaaatttgggtgcagtagttcttttgagtgagtaccaataaatcgaaaatattcagcacaaaatatttatttttatccctaaaaaaatttcgactgtgaatgggtccatggcggggcggagtacgaaccccgtgtcgatttttccaaaaatttttttaggaaatttaaaaaatatatttttttttcatacatgatccattgccgacctctttcagatcagtttggccaactggagagactttgttgatcgttacaggcaaatgatgcaaatgaagggaatgaaagtccttgcgccttccgtcactgaagtgtacaatgttggaaacttcgatttgcgcgaccgcttcacgcgaatgcaaaacagtggtgttgaatttgtgctggtcggccatccaaaag

SEQ ID NO: 46368 - DNA, 1033 bp, Heterodera glycines
  Genomic contig location: Contig_ID=SeqID_7112; Location=1900..2932; Strand=+
  SCN-specific regions: Sequence locations=1-203,229-240,270-417,440 -445,467-1033
  Gene Ontology: Mol. function=structural constituent of muscle; Cellular component=muscle myosin; Biological process=muscle development
atgaacaaaactgacgatcaattagctgaatgtcgcgaaatcttttgctacttcgattccaaaggcgacgagaaaatcaatgtgaaacaggtcgagaaggggcagtgggaaagtttaatgctatcaaatggattgattgttttttccgaatggtcacttttaataatagacttcctctgatgtattttatttaattttaggttctttttaactttaattaacattaattaggcgaaatatctcaatacatttactgttttttgtaatttggtttaggttggcgatgttttgcgggcactcggccaaagtccgacggagtccgaagtgcgaaaatgttgtgagcactggaccgaaccaggtgaaactgcgaggttcagcattttcggggcaaaatgcgccaatcctgaatgggttccctaattttaattattttaaatttggggctcaaacccattttaaggggtttctagggtgttgattacccgtcttaactagggttgccaattctggacgccgggcccgaattcgaacaaaacaatgggattccaaggaatttttctggggtaaactattgcgcccaaaataaaatagttaaattgggctttccttttttcagatacgcgcatttcatttgaggaatttgtgccaattttccaaacggttagcaaatcgcgcgctcagtacacaaaggaccaatttgtggagggattgtctcatttcgaccgcgagggcaatggcacaattgccgttgcggaactcaaacatttgctgaccaatttgggtgagtcggatgggagccgaatgtccaacagttcgaactttaattaccgttgaaaactcaaaaacattttaaagggttttctcttttacgtaacgtgtgaaatctttgtttaacatttccgagagcattaaaataaccattttttaaggtgaacgtctctccgaggaagaggtggagcaactgctcgccggccacgacgtggccaatggttttgtcagcatcgattcgttcattgaaacagtgcttcggtaa

SEQ ID NO: 46369 - DNA, 1210 bp, Heterodera glycines
  Genomic contig location: Contig_ID=SeqID_7114; Location=2..1211; Strand=+
  SCN-specific regions: Sequence locations=1-66,96-217,368-732,754 -801,834-847,869-1210
  Gene Ontology: Biological process=positive regulation of growth rate
atgacggaggaggaaaggcgcaattacttacgaatgaacccaaaaatcatcaccaaccaacagaacaagggcaaatacaaattcctgcagaagtattaccatcgtggtgcctattttctggacaaagaggacgatgtgctgaggcgtaactttgccgaggcaacgggcgaagacgtttttgacaagtcggtgttgccgaaagtgatgcaggtgaggcgagaaggaagagggagtggagggaaatggacgagggatagactaaaaagatgagaaagagagagaggcagtggaagaaaagcggacaaaaaaatgagaaaaagagagagagagggggggggggggtgagagagtggcaagagaaaaaggggaactccgttcagttagaaaatcattgtttgggtgcctttggccctgtccacctctgatccattcgatttttaggtgaaaaatttcggcaaagcgagtcgctccaaatggacccatttgacggcggaggacacaacggaccaccagggagtgtgggcaacgccgaccccactgagtgctaaatttgtggcaaaacacgcggcggggatgaaaaatgtattcgaaaagccatcagcaaaaaaacgaaagattggtggggattgaatgactctgtgcttaattaaatgataaatttggcatttaaacggatggataaaatttgaaaaaaaagtttttttaatcgacaaaatcttttacatgaagctgtaaaaataataagtgcaatttgcgcttgacttcgtttgttcgtttgcttgtcttttgaaaagttcggtcattattttgtttttaaattaaaaacatttttgaatacaaagacgaactccggttaattcaactgtttcgtgcaaattataaaatttcagtgatcttatgaaaagatggccattgattgggccgattggtcagcccggggctgcgacgaggggacccattttgggtgtccccgagcccaacagaccccagaccagggcattgtcaagtgactattcgaaaaatttagatagtttccctctctattggaatagtttaatgagtgtaaattaaattcaacgaaatcccctgctgatttaactgattatgagtcactttccctcccccctccccctccctttccatttgtctcatccgtcgtcgattttttggaccattttactgacaatccttcaaatatttgtgactgtta

SEQ ID NO: 46370 - DNA, 988 bp, Heterodera glycines
  Genomic contig location: Contig_ID=SeqID_33962; Location=169..1156; Strand=-
  SCN-specific regions: Sequence locations=1-204,239-287,338-341,367 -597,623-641,700-784,811-840,862-988
atggacaaggaatacatgagcaaaattgtgaccaacgcatggacatttgtcaacgattcgctcggcacaacactgtgccttttgtgggagcccgaggtttatcagaaaatcagtgaaatgtgacagcaaaaaaataataaagatttgtccgtatcagtcatttcttttttgatagtttaatccaatttctcggggaaatctcaaaaatgaaaaattattaaaaagtattttttcctgtgaccgaattcgacgttaaaatgacattttcaaatttttaacaaataattagattttcttggagactttgtttatataaaatatttatttgccattttttggagtgccccaaaatgccaattttatacgcttttaagaattagtttgaattttgcttctctttttttgtttgtttcttcgcttccctctcattgtcaggtcattgccattgcccttttgtacatgtccttcaaaatggagcgcatggaggagcagcaaatcggacggacattccattttgacgcgagcacagagtggtggaatttggtaagaatatttgttgaaaataatagaaatgcaactacgtccccccccctcacatttttaaaattttcaaacttaattttcaagaaaaaatcagaacctttttataagaaattttattaaaattactgaaaatttttttgtttttttcaaaattttcccaaaaaaatcgctgagaaattttaaaaaatttcaattattacaaaaaaatgtctagcaataagtttttttagtgaattctaacaataaatattaaaatttaaaaaaattcggggagcgggaaacgtgctgcttccaaagtaattaaccccaattttaaatacttttttcacagtatgtgcaaaatttgaccgtgcccatgatggacgacatttgtcacaaagtgttggattccatcgcaccagcgaacggagaggacgcgccaatggcaaacggaacaaaaaattga

SEQ ID NO: 46371 - DNA, 851 bp, Heterodera glycines; identical to SEQ ID NO: 33982
  Genomic contig location: Contig_ID=SeqID_33982; Location=1..851; Strand=+
  SCN-specific regions: Sequence locations=1-57,80-201,224-231,269 -683,705-851
  Gene Ontology: Mol. function=structural constituent of cuticle; Cellular component=extracellular; Biological process=cuticle biosynthesis (sensu Nematoda)

SEQ ID NO: 46372 - DNA, 606 bp, Heterodera glycines
  Genomic contig location: Contig_ID=SeqID_33987; Location=91..696; Strand=-
  SCN-specific regions: Sequence locations=1-215,237-249,271-332,356-606
  Gene Ontology: Mol. function=[RNA-polymerase]-subunit kinase activity; Cellular component=polytene chromosome puff; Biological process=regulation of cell cycle
atgttggaaatgaacggtgttggaaattccaaagactatgacaccaaagtgaaggttcgttcactttgtcaatgatttgtttgtttatcatttgtaatattttaggcaattctcgaacaatgccgaatatcacagaagctcttgaactatactgagcattttaactatccctatgtcagcgaagtgacatattacgagcagttgttgaagattggacaaggaacatttgggtgcttaagacggagcgaattttttaatatagtgaactttctagcgaggttttcaaggcgcgttgcaagcgaactggcaaattggtggcactgaaaaaaattttgatggaaaatgaaaaggaaggggtgaattggcaccggaggaacccatttgcatattcattttcagtttccaataactgcacttcgcgaaataaaaatgctacaaaggcttcgacatcagcacataactgaactggtggaagtgtgcacaagcaaacgtaaaaaaaagcaaagcaaaagccacgaatccactaaaaagttgttttagaaaagagtgggaaggagaaattctgcttttacttggtgttcaccttttgcgagcacgatcttgccg

SEQ ID NO: 46373 - DNA, 370 bp, Heterodera glycines
  Genomic contig location: Contig_ID=SeqID_33994; Location=171..540; Strand=-
  SCN-specific regions: Sequence locations=1-76,99-370
atggggctgtccaacttccagtccagcttacaacagtttgaaaaggccatgaaaatagcgaatgcgaacgcggacaaactgctggagctgcagctgagcctcgggctgggcaacctgttcacactgatcaggtggctaaacatagtcagctaaattattcggaaattctaccctaagctgtcaattcctttgacggcattaaaaatgacgaaatttcagggacctgaacaaagctcttgtgttcctgcagaacgcactcggcattttgcagggaattgaggcgaatcatgtgcatgccaagtacaagtcggccattctctaccaattgtccgtcattttacgcctcaagggacgctattcaggcgattaa

SEQ ID NO: 46374 - DNA, 890 bp, Heterodera glycines
  Genomic contig location: Contig_ID=SeqID_34027; Location=1..890; Strand=-
  SCN-specific regions: Sequence locations=1-199,221-372,394-890
  Gene Ontology: Mol. function=RNA methyltransferase activity; Cellular component=nucleolus; Biological process=nucleobase, nucleoside, nucleotide and nucleic acid metabolism
ataaaaaaggcgagaaaaattgaaaaaatggcaaaatttagagttaaaaggttatttttcaattatattttcatattttctccgcttttcagcttctcttaaaagacctgtgctcctattacgactacaacgaatttttgatggaaaaattcatggagcttttccccaccggggctgaagttggttttataaggaaaacccaaaatgaaatttattccaatttttagttactcgaatttttggacagcaatgaacagccgcggcctgtgacaattcgctcaaatccgctgaaaacgcggcgcggagagttggcaaaggcattggtttgtgagaaaggacgaccgattttaatcatttttgcgaaataagctgaaaattacccttttaattttggcattccctcgccctgatctgattttgggcttttaataaacaattatcccatgcgaatgttccttcagatttcgcgtggaatgaatgtcgacccggccgcaaaatggaccaaagttggcctcgtggtgtacgactcgcaggtgccggtgggtaagtggcgtaaagcggccataattgggcacttccttttatcatttctaattcttttttgagtcgttagctaaccaattgtagctgcttaactttttattgatgcgctttcaggcgccactcccgaatatttggcgggccattactccatccaaggcctttcctcatttttgcccgttatggcattggcaccacagccgaacgaacgcattttggtgcgtcgttaaaaggagggggcggctgggaatctatcaatttggcttaaattttgacgtcccgttgaaaaatggtgaattcttgcaacaacaaatgacttttggcggttattttgcaaaattctttttttt

SEQ ID NO: 46375 - DNA, 2087 bp, Heterodera glycines; identical to SEQ ID NO: 7132
  Genomic contig location: Contig_ID=SeqID_7132; Location=1..2087; Strand=+
  SCN-specific regions: Sequence locations=1-180,202-395,494-506,664 -751,773-807,868-931,1035-1121,1143-1348,1376-1425,1455-1710,1735 -1747,1769-1773,1795-1898,1921-2087
  Gene Ontology: Mol. function=DNA binding; Cellular component=nucleus; Biological process=positive regulation of growth rate

SEQ ID NO: 46376 - DNA, 631 bp, Heterodera glycines
  Genomic contig location: Contig_ID=SeqID_7144; Location=25..655; Strand=-
  SCN-specific regions: Sequence locations=1-240,285-313,335-631
  Gene Ontology: Mol. function=oxoglutarate dehydrogenase (lipoamide) activity; Cellular component=mitochondrial matrix; Biological process=embryogenesis and morphogenesis
atgtgcaacgaagacgatggcatcgacttgaaggtgtgaaaaatggaatttaacgaaaagtttaaaaaaaaattcagagtgtcgctttggacgaggcatttgtggcccgtcagctgaacgagaccaattggattgtggccaactgcacaacaccggccaacttcttccatctgttgcgtcggcaaattcattcgccattccgcaagccgttgattgtgttcacgcccaaagtgcgtgtgcataaaaagaaatttaaaaaaaaacattttttgtttaattaaaatccatttatttgagtgatttttgttatttctaacgcttttttgaaattgattaattaaaatttccagtctctgctccgccatccgttggccaaatcgccggtggacgactttttgcccggcacatcgtttcgccgtgccatccccgaggagggcagtgccagcaacaacccggcggccgtggagcgactcgtcttctgttccggtaagaaagcgttgattgatcaatcaagagtaaaattgttattaatataaaactttttggcgtgttattacgcaaatgtttttttccagggaaagtttactacgacatttttgacgagcgcagaaaacaaggcctggaggataag

SEQ ID NO: 46377 - DNA, 1257 bp, Heterodera glycines; identical to SEQ ID NO: 34082
  misc_feature (67)..(68): n is a, c, g, or t
  misc_feature (109)..(109): n is a, c, g, or t
  Genomic contig location: Contig_ID=SeqID_34082; Location=1..1257; Strand=+
  SCN-specific regions: Sequence locations=1-672,694-1257
  Gene Ontology: Mol. function=nucleotide binding; Cellular component =condensed chromosome; Biological process=meiosis

SEQ ID NO: 46378 - DNA, 1349 bp, Heterodera glycines
  misc_feature (1313)..(1313): n is a, c, g, or t
  Genomic contig location: Contig_ID=SeqID_34096; Location=110..1458; Strand=+
  SCN-specific regions: Sequence locations=1-363,385-423,445-1064,1086 -1349
atggttcacattgttcagacattgcggaacaccaaacagtccgacaacggcggcaaaacgcaacaaatggtagaagcgacagtagcggaaaacgggcagcaacaaactcaaaaaaagcactccgactccgctggaagcagcagtatgttgtgaattgtttgcttgcttttacccacacggaaatccgtctctgttggcattgccattctcaatgggtttatacgattaatattccgatgtccttttgaagcatcttcggttgtgccctgtcccgctgagttggcattgtgccgtcaggcggtgttggtcaattcggatcagcagcaacaacaacagttgcacgactatgagcagcgtccggtcatcgttggctatgatttcaacgccggcattcaatgggaggcgttgttggattcctttttgaccaccggcttccaggccagccacatgggcatcgccatccaggtacattttcagcaacaatcatctccataaaacatattgctgtggcaaagagagccgtggattcaattccatgccaggagcaatgtatcaattctatcactaatccaccgcagccgacactgtagcgccggctcaaacagtgcgcagcccaacaacagtcacgaagcaatctccagaatggacgtggtttgtgcacaagggaccaaccatttttgagggtggaaaaatgatggaaatggtgccatcctccgacgctcttttaaaatgcctaaataaaatggtttaagcaacaattcatttggcttttaattcagttaagtgagcggatccgtgacttccattacaacgaggaccaaacgcacgcacagctcaatcgaaaattgcaattacgcgaccaactttattacgcaatttcaccgattttcccaagtacaatcgaattatttttgataaatgatgcgccaaatgctccgttctgttgttcagtgtgcggactttacattgtcggctcgtcactgaacggattcgggacgaagcggtcggacttggacctttgtctgatgataaccaatcgcgatgtgagtttaggcatgaataaagggcagaaaagcaaaggaaatgtccagagaaattgggccccaattctcttttaaattcattttgtcgtccgcagattgaccaacgctctgatgcggttgttgtcctgtcgtcggtgatgcggacattggagagcaatcaaattgtggccgagcagaatctgatcctggccaaagtgccgattctacgcatcaaatttatcggcactttccacgacataacggttgacctgaacgcaacaactcggtggncattcggacacgcatttgatgtgtactacagtcctt

SEQ ID NO: 46379 - DNA, 2058 bp, Heterodera glycines
  Genomic contig location: Contig_ID=SeqID_7152; Location=614..2671; Strand=-
  SCN-specific regions: Sequence locations=1-223,245-541,563-1034,1057 -1146,1168-2058
acaattcagaatttggtagctttggctgctgaccaatttgatgacggtggttccaccgcttctgctaaaaaagccctgccgcgtgttcggtcgtccaccgaagttctgaatccgttagttgcctctccccccaaatgctttttataaatcattacagacagagggtcatacgtcgccgtgattccatttgtacttcgacaagtgcacccaaccaaatcgaccagactgaagaaacccattggatcacgcaatgtgagcaaaaggagggcaacaccgaacagataggagggcaaagagcagcggacgacgcaaagggtaaagaggggctgaccgacggattctgattttgacaacagatcgccagcaaagcgttcaaagtgatcgaacacgacaaaagtgtccaactttggggggtttggcgctgccgtgccgtgacatttcccagctgcgaatcgcaatccctcttctgatcagtcatgccattcagatcagcgaagaaagagtggcaaaactcatttcggcacgatacaaagtgggctgaaaataaacccaaatattcctgttattcttccgctttcaaaggacaccgtgttgaaacattgccgacccaagcatttccacaaaatatgccaattggccaccgatgccgtagagcgttggaataaaattgcagccgaaggcaaagatggtgggtcattctcggcggacggtaacggcactcaccgatcgcccgtttttgcgactattcatcaacaagtgagggacggggaaaggctcaatgatacgaagcgacgcattcggtccattcagacggccaaattcatcagcaaattctcagaggcaaaacggcgtttcttcaagtgacttcgcacacacatttttaatcaatccaaccttttttgcaccgttaagtgaacgaattgacactgagccgtggcagccgaatcgaattccctacgtttaccagagaattgtcgacaaattccgactaagcggtgcattgagtgacgtggaggaaaatgtggaggatgagcacgaggacgatgatgacgagagagaagggaaccgcgactatttggtccttggcggcagcaaacgcttcatcgttgtcgggtccgttttaatcccacccttgtcgatctgttgtcttttttgtgtccattttctcgtgccatcactttcccccccccccttttaagctctgcgacttcgcttctccgcgtgttggcccagtacagcgacttgctttttctgttcccccaatgttccatggaactgactatggacattgtccaaattttgaaggcgtttaacagtcgcacttgccaattgattttgggcgcgggtgcgcgtcaattggtcggactgaaaatgatcagtgtgaagcatttgggtgagtgaattgggagaaatcggtcttacgctcaaaatggaacatccgaagcattggcattgcgttcgctgcaattcatcgcccaattcatcccagcacttcgccaaacatttctgaatcaattgccatccgacagacacacactcctacgatactttgaccaaacacaacgcgattttgaagaccacgagggcgaaataaagggcaaaatgttgggactgatggacagagaactgataggggcattggaggaggttattttcgagaaaaaaaacagaaacaattacaatgtttcagtggaaattggaaggcaaagtgcccacggcggcatttcaacaaattgtcatgcaaattggcaaattttacagcagttactccgccgttatgccagccgaactgacgacggtatcttctaaagaatactactgtatgaggcgacatattttcaggatatcttgctaaaaatccacgagaatttcaagctgtatctcagacagcatctgaactcccgaggcatttcaccccacgattcgattgcctatggaatggctggtcaagactttgcttattacatcgagaatgtccgtgcattgcccgactgcaagtcattcccagtcgacacaattggcgatgttatccaacacaaatactcactccctccctaa

SEQ ID NO: 46380 - DNA, 1611 bp, Heterodera glycines
  Genomic contig location: Contig_ID=SeqID_7155; Location=3084..4694; Strand=+
  SCN-specific regions: Sequence locations=1-269,293-469,491-743,766 -868,890-1033,1055-1327,1349-1611
atggagctgactcggctgggcgatgagccgaccacccggtggacccttctgaacatccgaattctcgtggaaagtgccgaagtcggagagggacagcaaatggtccatccgctgcaagtaaagaaagcagcgagaaaataaggcaatttacaacattttaaagatcaatttcctccatcaaatggtgcaggaaaaactcgacacagcaaacgaagtaaattatgggccaatatgtaattaattagacctaattaaagtgggtgtttggatttggcaatgcattcattcattctttcccacaatcattccattcttctagcccattatggcggcttacattgttttgcattggttctgtcgctctctccatttggacattcttttttgtcaggtcgtgttttttcaaatttccataattttttccgttttaggctctccaaattgcgaaaataaaccgaagcggcaaagggagtgagggctcctcgcagcaatacatccgagtggacgagtacaatgagaaggagtgccgtttggcgatcagttattggctgaggagagaggacggcaccattcacggaaggtcggagagtgaatttggtttataaaaacgaacatttaggcattaattggggtgagttgtcgggggggggggggatgcccaaaaaagatatgggctggaaaatgccaaaggatcgaggcaaagtcaaaatgcttaactttttagttggagaggattcatccccaattaaatttctaaaaaattccaggctgtcgtctcattaccgaatgctcatttttggagacaaaaacaattcccatgtcggactgaaaattcgtcaccatccgcccagcacggaattgcccacaattgaccatgaacagaggtgttttctccctcgtttatccattcctcctccccacccttcttcaaattgtttgtttcagtccctccctccaacgattgctcaacgaaactgtccttttccggtgccgagaacgtctcctggcggtcaaacaactgcttgaagcagcttttaggttaattttaagttaataccacagaaatccgttccgttttgtttgaattttcgtttcatttttccatttttatctctcagaactctctcctcccaacccaacacaaaatgtccgtcgtccgcctcgccttcgtccaccaattcggaggacacagcccaacagtttgtccaccaatctggtcactctctgctcacattgagctgtcccctcgtgctaatcggcgactgccatcccgacgaatgtctcaccgtggcagtgaacactttcagcggtgcggtcattgcccgggtggaagtgctcggtcagttggtcacttccttgggacggcctttcctttttctatccctgcctttttcataaacttcaggtcaacgagaggagatccacaagttggagcatcagctgaacacgtgcccaactgtgctcctccactcctccgcctcgtctctgtcggccttttctgtcagttcgattggccgtctgctggcacggctccgcgttctcgtcattggcgaaagactgaacagggcgttggtcggaatgcaggcaacaaaagcactttcaactgactga

SEQ ID NO: 46381 - DNA, 2655 bp, Heterodera glycines
  Genomic contig location: Contig_ID=SeqID_7158; Location=281..2935; Strand=+
  SCN-specific regions: Sequence locations=1-68,91-320,344-357,379 -486,520-653,706-779,811-891,945-1060,1082-1414,1436-1479,1503 -2211,2233-2454,2485-2543,2571-2655
  Gene Ontology: Mol. function=hydrogen-transporting two-sector ATPase activity; Cellular component=integral to membrane; Biological process=proton transport
atgtggcaatctgaacaaatcaccgagattggcacaattgtcgaaatcaatgaacgctttacaccaaccgaggtcattccaaaatatgtgatgactacttcgggatcagcgtcttgcccaacaaaggtcatacgacgtcaagcaaattttccgcttgaacacttcagaagagatcatcaagtcaatgttgttctcaaaagtgttcagctctcatctggaattaaaattcacccatcctttattttgcccggaaattcacctttccgatggcaccctgacatcattcgtcccaatggttcatttgttatttctcgcatttatatttgatattttaaaataagctctgcggagctactctacatatatattcacacaaatttgtctaagctctgcggagctgatttaattaaataaacacaaaaaacaaaaacacaacaagtgagaaatgataattaaagggaaaagttcaatacataaattttaaaaaataataataataataatattaaaataaaataaatgaatggagtattggtatatgaatcccgtgggatttaagttcttggatcagggacgatccttagatatgaaggggaggtatagtcatacagtcacaccgggctatatcaaaaatctaaattttagtcgattggaaataaaataaaataattattaaatttatataattttaaaagttaaaaatttcgtcagattttctcttggcttataatttgaaaagcaatgccaatttaattcaaatccaattgaatcagaatttcaaaaaaaaattaatttaaaaaaaaaaaaaaacgcggatttattttggtagttcattggcagagcttctgtggattggttgaaggaatgagttcattcccatcgaggctcggaattttccatttttattttgagtaattaaataaatatttaaattattttattttcagttttggcttaaaatcaaaacaaatttctcatcgtaaaacaaatgaaaagaaagaaaaagtctgaggacttcattcaaattttggaaattatttaaattttaacgaccagggacggtcttttggagggccggaggtgtaaggccgggaccggaaatggcctttacccttcccccccccccattttatctctccgatagggctcctcccatcccgaggggcgcttaaaaggcaacggataaccagccaaaggggacagtcggatcagtcgggagccatcagtggaacggccaatcgatccccacctgggaggtacccccaggcatccatcaacatcccttcccttccaagccctgcggggcctaattacggacgcgtaagagggctcctctggactatttccctcataagcactgggtatgggacttcacggctttactattagttaaaataatttgtccgtaacttcgtttttcataaaaaataataatgtatgaaaaaataagggtacaatccgaaattcctgaaattctggtttaaattatttaaaaaatttttgattttgccagacgactaattttctaattttagcattttacaaaatcgtgccaacaatttgaagatgtccggtgacaattcggcacttattgcagcggagcaagcggcgtatggccctttttttggctcgcttggcgttactgcggcgatgattttcaccgctgctgggtcggcctacggcacggcaaaatccggcaagtttgttttgttttgaggggtcttggaattttgaaaatttgggaacgtttgaagcaggccttataacctgaaaaaatctgggatttttctccgaaattttcccttcgaaaaaggggttgttttcagaggatttttgttgaacaaattgaatttatgaaatttttgttaggccgctgatttatgcgctttagcgaaaatttacccagccctctcaaaatttaaatgtatcatgaaatttaggatttacgaaatttcattccaaaatgcctaattttgagcctttcctttttttcaggtactggcattgcctgtatggctgtagcaaggcctgacctcgtgatgaaggcgatcattcctggtactctatgcaatttttttatactaataagaggccgaacgagaggatcggtcgaagggtttcggttaaaacccaaaaaaaaaaccaaacctaaaaaaatttctcggtcagtttttttcggtcaaaacccgaaaaaaaccgaccggtctgactctactaaaaatggcaatttaaattaatcttttgcctttttttaaactttctgggttttttttgtgcgttatgacaccggaagagtgaattcgttttttacattttccaagtgaaattcaaaaaaaaattgctattttgaaatttgttaaacaccaaccgaggaaccctatcgttttttcgaatccttaactcaaacaacaaaatataatttcgactttttggttcatgttttagaattagcgcttttttatcattttttaaaattaattttttccattttccaccccctccctaaaaaaaccgaaaattcagtggtcatggccggcattgtggccatctacgggctggtggtggcggtgatcatttccggccggttggaagcggctgggcccggctacaccatcgaccgcgggttcagccagttcgctgccggcctcgtgtgcg

SEQ ID NO: 46382 - DNA, 435 bp, Heterodera glycines
  Genomic contig location: Contig_ID=SeqID_7159; Location=1..435; Strand=+
  SCN-specific regions: Sequence locations=1-67,98-156,184-435
  Gene Ontology: Mol. function=hydrogen ion transporter activity; Cellular component=integral to membrane; Biological process=proton transport
ttcgaatccttaactcaaacaacaaaatataatttcgactttttggttcaagttttagaattagcgcttttttatcattttttaaaattaattttttccattttccaccccctccctaaaaaaaccgaaaattcagtggtcatggccggcattgtggccatctacgggctggtggtggcggtgataatttccggccggctggaggcggccgggcccggctacaccatcgaccgcgggttcagccagttcgctgccggcctcgtgtgcggtctgtgtggactgggcgccggctacgccatcggcgtggtgggcgacgcgggcgtgcgcggcctgtcgcagcagccgcgcttgtttgtcggcatgattctgatgctgatattctcggaggtgcggcgcagggacggtcccaggattttggcttggggggggggagta

SEQ ID NO: 46383 - DNA, 228 bp, Heterodera glycines
  Genomic contig location: Contig_ID=SeqID_34140; Location=219..446; Strand=-
  SCN-specific regions: Sequence locations=1-103,148-168,190-228
gtcagtcgggcactcggctgtctctcccagctgatctgggcgcgtgcatgggccttccgttggagcggcccaaatcgcacagcacggacggactgataaaattggcggcggcggcgacagcagcgaaataaatattttagaccaaaacaaaaagagaatagaaccaaaccccaattattattattattagatgtattatggttgttaaagtgtgtgtgacttgtgagc

SEQ ID NO: 46384 - DNA, 3221 bp, Heterodera glycines
  Genomic contig location: Contig_ID=SeqID_7170; Location=1390..4610; Strand=+
  SCN-specific regions: Sequence locations=1-290,457-457,541-665,695 -697,792-1745,1767-1785,1807-1846,1868-2518,2540-2570,2592-2594,2616 -2803,2825-3161,3184-3221
  Gene Ontology: Mol. function=importin-alpha export receptor activity; Cellular component=cytoplasm; Biological process=pronuclear envelope synthesis
atgcgatcgaataaactgtggactgaaattattcttgtcgtgaatactgtaagtcgtcatgtttgtcatcgcttgactttgctctctaaggtggctgaaccgttgacgcagctttacgcgcgtatgctccagtttctgcccgacccggccaaccaaaacacgcaacttggaccttctgatcggctgtcttggctgcaaattgtgttggaactcacacgcatttatcactcactgatttcgcaagatctgcccgagtatttcgaagtaagttcgcctgagtattactccgtatttatagcattttaaggacaatcttacaccttggatggagggctttttgcaattgttggagttaaaactgcccgagcttgaggcgaagtcggtcgacttggaacctaatgagcatgacaaacttcgctgtgaaatttgcgagatcgccactcttttctcgcagcgttttgaagagtgctttattccctataccgagcgattcattgcctcggtttggaatctccttgtcatgacggacagccgaattcggtagtgcagcaaattacttcgttttctgtcgtataaaattgggaaaattaagaaaattgccccctccccattttcgtaaatctctccatttcatacttcgatttattctgtccctttttcaaagtttcgattcgttggtcagtgctgcgctcagttttctcgccgccatttgtcagcgtcctcattatgcgtcgcatttccgaagtgaaggcgttttgaaggcaatttgcgaaaatgtcgtcgtgaaaaatttgatgttgcgttctgaagatgtggaaatttacgagaacgaaccgttcgagtttctcaagcgggacattgaaggtggttacgaattcgttttactttattcggttcgtctcattaaggctccgacctcgaaacgcgccgtcgtggcgccgccgattttgtgcgggccctttgcaagcagttcgagtcggaagtgtgtgctctcctttcctcggcaattcagagctttctttcggaataccacaaaaatcccgccctgaatttcgccaaaaaggacgtcgtctattacttggtcagtgctctcgcttcgaagagcacaaccgcccgacacggaaccaccgacgccagccaactggtgagacctgtaaaaagaatgctcttactgcttttcagataaatgtcgccgatttctaccaagaacacgtccgttcggatttactcttgggtcccgtcaatgatttgcccattttgagaggcgacgcattgaaatttttggtgcttttccgtaaacaattgaagcccgaacagctgattgagtgtctccgcggccaaaatggtttattggagtgctcaatcatccgctttttgtcctctgcccatgttctgattcaccattacgttgcttacgctgtggaacgcttattcttgatgaaaaatccaactaatcctcaggtaatcgtcgtctcattttgggtaccaattttgatttctgttcaggaaactcttttcaatgcatccaatgtgccaattgaccttttaatcgatgctctttttgattgttttcaagtcccccaggcgtgtgaaacgcattatgtgatgaaggcgctgatgcgggcattttcattaattgacgtacccaattatcaattaattaatcgcaatatttattttatttcgatttctatttcttaggatcgcatggcagcaaattcccatcactatgtgaacaaacttttccagatgatcacagaagcagtccgcgtgccgaaaaatcctctttttgtgcattatatttttgagtcgctttgcgttttgatcagaagggttcgtttgagtattccccatctatttttgttttattctcctcctttaggcttattccaaagtttctggtggtttggatcagcatgttattccgatcatcgaactgattttgggaaacgacctttctgattttgtcccctatgttttgcagattatcggttgagttgcatggcaatttctctctgatttcttcgtttttagctttgatgttggaccaaagtcaatcggagaagcaacgcggcatcgaaatgtctcaagaggcttacgtccgcttcttccccactttgttacggcccgactattggttgcgttctgccaatgttcccgctttggtcctcgtcttcgagtcgtttattcgctgcgttccccaattggtcttcagtgcacaatattctgatcaaatcctcggaatttttcaacgtctgattgggtccaaagcctacgaccagcatgggttccgtttggccaacactttcatctctcatttggatttaaatgttcatttgtggcctttttggtttgactttacatcgctttaaaggcttacgaacgcccactgaacagcaatgttgttttgctaacgatgctcaacagaatgcagcaaaataaaacttccaaattttcacgacaattcacaatttttgtgtttcgctatgcggcgatcaaaggcggcgcgactttagccaatgtgagaagagagaggggagaaccaatcgaattcacttcatttcccttccgccccccgggggtcatttccccgagaaatttttaaaaaatgttcacaatgtaagatataaaaatatctgacttcgaaatattaagtcactggaggcgatccaatccgggatttacgggatgatgttggacaaaattctgcttaacgaaatgcaagcgatgccccaaacgacgacttacgaagagaaacgaatcgtcacaattggggcggcaaaactcataacggaaacgaccgcttttctcgggttgtctcttttttcgttgtgcgatttgacttttaacttgcaatttagcccccgttacgctcaaatcattgaattggcagtgaatattttggaagcattcgaacacaaaacttccgccgtggtggacactgccgttcaggaaagagaggaaaccgccgaagtgagcgaactcgaatacagcgacccgtactgcaaactgtcctatgctcaacaccccgaaccatttgcgcccgaaatcggaaacataaaaagtgggtgccaattggactattaatttcgcatttttcgtttttagtgcactttgcccaagccgttcttttcactgtccgtgaaactaaccctgaaaatttcgattgtctgaatgcgagggttcagaattgtctaagggcttattcttcaacaatctga

SEQ ID NO: 46385 - DNA, 2200 bp, Heterodera glycines
  Genomic contig location: Contig_ID=SeqID_7171; Location=124..2323; Strand=+
  SCN-specific regions: Sequence locations=1-818,841-960,986-1006,1028 -1070,1093-1093,1152-2200
  Gene Ontology: Biological process=growth
tccgcccatttggggctgggcgaccgcctcggcaatctgacggccgaagcattccgtgcttatggcgcattcgttggccgaaaccccggcaaagttttggtaggcaaaaggggggcaaatgaaaaagcgaaggcattgaccgatcaatgaatggcttttgcgttgcgattgatctccgatcggtccgtttgaggtgtttatggccattttcacgttggccactcttcccggactgttcttcctcaaaatcaatttggacctttacaaagtttgccctttcctttcctttttccctttgcttccccctttttcagcttttcgtccctttggatgcgcccgttcggttcgaatttgaaagccaaaaattgtacaaccaaatcccccctggcaaattggactttcccctcgggccgcccccttcgctgatcgccaccgaccctccgcccgcttcttctcaaatgaatgaagcgccccccgccgaatcggccgccaacgaacttaaagacattccgaagaagaggaactcgcgaaacccaaccaaaaaagtgcacgaaggtaaaaaagaacagtggaaagagaaagtcgaaatttgaagggaaactgttaggcctcgggtgggcattgaacccacgccccgcccccattccgtggaaagttcgaccattgaacgaccgcggcaaatgtttacttgctttttaatgaacctttccaatcccactcttcttcttcttctttccctctctctctacagacccctccgtcccccaacacaatgatattttgcgattttacgttgtccatcgtgattatgaggtaaaaagagaaattgtgaaaatgcaatttcgaatttctaagaatttgctgcacagcgacactcttggcaaattgtttatgtacaccaacgaaatgatgaaagtggcgatggaatatgacggggaaacggtcagaggaaaagccattccaaagagcaaaaacaaaacagaaatgaccaatcaattgcttttcagtgggtttttgaggacttttgcaagcgggggccagcacaggagcagtgcagcaatgagtgagtaggggagaggggaaaaagggaaatgagggagaaggggagacggagaaagcgtaagacagagagagagagagagagagagagacatgcgttaagtgccgggccatcccaactttgataattttgcagactgaacatttggctaaaacacgcggagaatcttttccggagcaatggcacccgtcacaacccaaacttgcaactttcttaccccgtcatgtatttgttcaaccgaccaaaagtgaaacagcttttgccttctcatttcattcgctttcttaggacattggcaacataatttatggagtcaatgtgacgggtcaaaagcacgaaattgtgggggcgcgagttttgacgattcattgggtgaggggggggggggcatttggtcatgaccaaatgaattgcaatttaatttatcgctaattgacagttcgtcgcctttccgctggcaggcaacaatttggccgcctttttaaagtaccgcgaaggactcaaccgattttgggatgagaaaactgccgagtcgcagatcaatttcattcctcataagtcggtgaaagtgaacggaattggcatgcttttcctgtcaaaacggcatttgttcagtgacaaggcaatggacgacgaacttcggttgattatcgaaacggccgttcccttcgccgtgcccgccaccctccaactgatgctgtcctgtcaatctttttgcttctcccccccccccctcacttccctttttgttcagcttcgtctatctcaccaatttggccagcgacgtgcgcaagtgatttcatcccgattttataaaacgataattagtccatatcaaaaggtcaaagccaattgaggccttttttggtgtgatcagcgtttgtctgagtttggtcgctactttcgggtgagtttgacttcctcgccatatttctctgaatttgattgggtgatttctccacccgatcactttcccctttcttctgatcattccgatcactttctttcatctgttcgtccccatcctttggtcacttttctactctttcctaggatcactttctttgctggccttcatttcagccccgtgtgcagcacgatgcttttcttaattctcgccgtccggagttgacgatgcct

SEQ ID NO: 46386 - DNA, 1888 bp, Heterodera glycines
  misc_feature (33)..(34): n is a, c, g, or t
  misc_feature (37)..(37): n is a, c, g, or t
  misc_feature (39)..(39): n is a, c, g, or t
  misc_feature (65)..(65): n is a, c, g, or t
  Genomic contig location: Contig_ID=SeqID_7178; Location=1..1888; Strand=-
  SCN-specific regions: Sequence locations=1-291,313-395,417-444,466 -614,637-702,731-854,876-1778,1800-1888
  Gene Ontology: Cellular component=COPI vesicle coat; Biological process=intracellular protein transport
cgacgctgcgttttgcggccgtccgaacgtgannacngnaatttccatggactaccctcaggcgngtgatttcgtgcaacgtggacctggagcagttgatcacggatagcaatcgtatggcgcactcaatcaactttttttttgtcgatttttgcataaaatattttgacaggttccattgccactttggccatcaccacgctgttgaagacgggtgccgaggcgagcgtggaacggctgatgaagcagattggcacttttgtcagcgagatcagcgacgaattcaaggtgtaaaatttttcaaaagaaaaagggcataattctttttaattctaacaatatgcacttttctaaataagcattaaaatttctaaaacccgattaaccatatttttgaaacttgatctcaaaatagcataattattcatttttggtgataaacagctataaattcctatttttaagaaaaaaattaggaatttttttctagagtttttctaaattttttctatcattttttaaaattttctaaaaaatcgaagaaaacttcgtgggtggagcgccctgcttcgcataatttatccctataaaaacattgaaaaatcgcgaaaaaccaattttttcttctaatttttcgagggaaaacgatgcgggggaaaggacctatcctcaaatattaattaacccatgccaaatctgttcttaaaatcttatatattttttttaatatcccaaatctttgtcagattgtcgtcatcgaggctatccgttcgctgtgccatcgctacccgcgcaaacacgccacactgatgaactttttggcctcaatgctgcgcgacgagggcggtttcgactacaaaaaggccattgtggacaccatcatcaccatcgtggaggacaaccccagtgccaaggacttgggcctgtcccatctgtgagcacttttcatgggcattgattcccctaatattactgatatttttgagtagtttcatccacctgtttcccaaattatattttatttggcattggaatgttatatttttgtcgacaaagccaaaaaatttctgattttttttttttttttttggtattttccggtttgatttactaagtaattgctttttctgccctttcagttgcgagtttattgaggactgtgaacacgccgcattggccacccgtgtgctgcatttgctcggccgtgaaggaccgaccacggcgaacccgtcccgctacattcggttcatctacaaccgcgtcattttggagagcactcaggtgaggctctaacacctagaaaaatctggctattcgatacggcgtgacaattcgttttattgttagcaaataaaaaaagtcctaattcagagacggaatttgatgttatatcataagagtttgcctgcaatttttttaaaattcatctttaaaaaggtatccaaaaaaaataaataaaacttaggttccgtaaagttttggcattttttgaaactcaacctttgaaattctataggctaatagcaacattaaatgattgtcgaatgctttcaaatttatgcaattcaaaaattaagtaccgtcaggatatagtcatttttgggatttaatcgtttgaggttcaatcgcgttttttcttggtcaatgatgaaattaaaaggccgctgaaagacagcattttttttaaaattgttcgattctttgacgataaattatattgagaagcaacaaaaaaaattctgagaccaaccaacactaggaaaacagtcccaattttgaaattttcctcaaattttcaaacgtctttattttattaaccccataaaaaaggtccgtgccgccgctgtcactgcgctggccaaattcggcgcggagtgtggcgcagctg

SEQ ID NO: 46387 - DNA, 1772 bp, Heterodera glycines
  Genomic contig location: Contig_ID=SeqID_7181; Location=1977..3748; Strand=-
  SCN-specific regions: Sequence locations=1-459,482-801,823-969,992 -1017,1039-1693,1715-1772
  Gene Ontology: Mol. function=protein serine/threonine kinase activity; Biological process=protein amino acid phosphorylation
atggctaacattttgtatttttttccgtccgttcgtccattatttcactttgttccccaggaatccgactttgttgagcaacagatgcgctctcaggaagtgtttctgcttcgggcgcgggaccggcaccgggagaagctgtgcctgctggagaagcagttcctggagcagaagcaccagctggagcgcagcatggagacggcgctgtgggagttggaggaggcgcaattggcggagaaacacgcgctgctcacccaacagtttcgagtgagttgagtcaagcagataccaagagttgttcaacaaggagacaacgagacaagcatcgggaacagtcccctcttacatgaaaaaagaggcgatgggtcaaattatgcgaatggtgtcaatttgttttttatcaggtactcactcggcttcttttcaaaagatcctttttccttttggaacaggcgccgctgggaaaaatttgaaattttttactatttttagcagattcaccaaaaattaatcaaattttgcgattttgagccaattttttttaatagaaataagaattttaaggccggcgctgccaacaggcgccggccgctaggaaaatttttcagtttttaaaaacaaaaaatttataataacaataactacagcagattataaatacaagaaatgcggttacatgaatttatgtttttttttggattttatcaaaaaatttctccaacttttcatttttaaaaatcatttctccccgcaggacgtgttccacttacagcggacgcacatgttggcccggcatgccaaggaacaggagcacgtgcgccgcatcaaccagtccaaggaggaacagctgttgcgcgcgctcaccgccgaccgcaaggcgttgcccaaagtgttgcgcaacgaggcgaagacgcggacgatgatgttccgcaagagtttggaggtggatttgcccgtaagtgattggtgcacagttccatcagatctcaacacaatttttcataataattcagatttaaaattaatattttatgcacatacgaaaaatattaattttgagtgcattttaacagagagtggtgtcatatttttttgagagaattaaaaatttccttactccgggatttaacattttatcgcaaacacctaaactcaataaatttccccgccgggttcctccatttgtcaaacaaacaaaaaaatgggaaaaaatcgaaaaaaaattttaattcggcatttgattggcaagacgaggacttcaatgcaatatttttcagggcgaaagtgacacatggacagcaaaagtgcgcatgtttgaggagcgggagaagcaacggatgcgcctgaaaatggaggagtacgaccagaagtgcaagcggaaattggcacagctggtggagcgaaaccaagaagtgatgcgcgagttggaggaaatccatgttggaaaagcatttaaaaatgccacaaaaaattgccaatgtttcctttttgtcgtacagaacgagaagcggaacatgctgttggagaacgagcggaccaaactggccgagtatgagcaggaataccagcagttgttggccgagtggaaggcgtcgctacccgcacgaaaagcggtgagggacaggccaattttgcctttatttaggccgatcgtacgaaaatgcgcacccccccccccctcacttttttaataagaaaataccaagaaaaaattgaaagtttttagctattttttccaggcaccaaacattcatcatatattcaatgattga

SEQ ID NO: 46388 - DNA, 1442 bp, Heterodera glycines
  Genomic contig location: Contig_ID=SeqID_7195; Location=829..2270; Strand=+
  SCN-specific regions: Sequence locations=1-262,284-325,356-495,517 -652,674-1442
  Gene Ontology: Mol. function=protein kinase activity; Cellular component=cytoplasm; Biological process=protein amino acid phosphorylation
atgaatgcaggcagcatcgacaatgatcatgatcattaccataattccatcaaaaattcttccccgaaattatcatatgactccgtgaattgttggagtatggaaagcgaagggagctctgtcaacaacgatgagaatgtgagattcatcttactttaagtttaaaaaagaacaggaattacaattgtccttttcaaaatcactcgaattcaaggactgataaggacaaaaacaataattgtctaatttgatgatccattggacaaaaaaccaatgcattttcttaattgcacttaatttagccgaatccggaaatggatgatgaaatgatggaagaagaggcagcgcatcatgaggacgatcaggttgcgaatattttggatctcaaaacgactataatttcctttaatcccatcgcagctggtgttaggcagtgatgaggacgaacaggaggtacggatttgttgacactttaccaatgtaatatttcctattaaggaccccaaggactacagaaaaggtggctaccaccctgtgcagatcggcgatgtgttcaaaaatggccgataccacgtcatccgcaaattgggatggggtcatttctccaccgtttggcttaggtttgttttgcttgggttttataatttttgatatttttctaatctgattttatgtaattgagaatctagaaccctaccattttatttcagtgtgtaaaaacaagtcgctaatttgctagcgttccttcaaacattttcttatattttagttgggacatcgaaataaagcgattcgtggcaatgaaaatagtcaaatcggctgagcattacacagaagcggcattggacgaaataaaagtgctctaatttgatctttcatttttttattcattttcagctgctcgaatgtgtgcgggactcggacccaaccgacgaatcacttcaggtttcgacttgcaaataataaaatggcattccatacacttaccagagagtggtccaacttctcgacagttttaccatcagtggggtcaatggagtccatgtatgtatggtttttgaggtaattatttatttgcatttcgcgacttgcattcgtttctttaggttctcggatgtaatctgttgaagcttatcattcgaagcagttacgctggtttgccgataatgctggtcaaaaggatcgtaaaacaggtcactcttatccatctgttttaacccatcataaattggttttaggttctcgaaggccttcgttatttgcacgataaatgccatataattcacacagacattaagccgtattttcttttctgttaacaattttcattttgaaattttagcgaaaatgttttgattacgatgagccacgaagaaatcaaaaaattggccgaagatgcaattttagcagggaagacgggacgggacatgtccggctcagcg

SEQ ID NO: 46389 - DNA, 2058 bp, Heterodera glycines
  Genomic contig location: Contig_ID=SeqID_7211; Location=1392..3449; Strand=+
  SCN-specific regions: Sequence locations=1-483,505-542,567-653,675 -897,942-1018,1040-1170,1193-1414,1437-1698,1720-2058
  Gene Ontology: Mol. function=ATP-binding cassette (ABC) transporter activity; Cellular component=membrane; Biological process=transport
tatctaatttaggtaatggaaggtcacggattcctctattcgctggaaatcgaaaattttaaatccttcaaaggcaagcattacatcgggccttttaaacgattttccgctattatcggaccgaatgggtcgggtatgtccaatgcataacatttaaaatcgctacatacataataatggattaaggaaaatcaaatttgatggatgccatttcttttgtgcttggtgaaagaacgaatcatctgcgagtgagaaaacttggggtgagtcaactgttttcacattcccctttttaaacaactaattatcgcttaggatttggtccatggcgcgtccatttcgatgccggcgagtaagacttgttgtgttcggatgatttatcgaaaccctgatgggactgaacggacttttcaacgaacgacttcggaattacgtgttgatgataatgtggtgaatctttcacaatatcacaaagcattggaagaaatcaacattttcagcaaggttttgcactctttgtcaacattatttcttaattgccactgtaatttcaggccagaaatttcctcgtttatcaaggcgctgtcgaacaaatcgcaatgcaaaaccccaaagaaatgacacagctttttgaagaattatcgaagttaggaaattttttaataagaaaaattaatctttgactttgacaacatcacatgttgtaagatctgcagaattcaaggacgaatatgaaaaactgaaggaggaaatgcaccaagcagaagcacgtgctcaaaaaaacctaaataaaaagagagacattacgaaagagttgcgcgaggttatgatggagaagaacgaggcacggcgtttccaaacactaaaggaggaattggtcacacaaatggatggggtggcaaattaaaacaattttaaaaatgattcaggtcatccaaaatcggacgctctttttggttcaattattctttgcggagaaaagcaaacaatttgttgaggagggactcgagcagttgcgcttggatttggaaaagaaaaagagcgaccgaagcgaatttgaaagtgatttgcatgagaagcaacgggcagcgaaggacgtgcaccgggagaagcagcgaattgaaattcgattgcagagagaagtggacacttttgatggtttaatcggtcaaaaatgaattaacaacactcaaaggaacgaaaagtgctgaacagacgaccgaatgttaccaaaagcaaacaacagttggaccactgctgcctcaaattggactcagtgcgaaaagcgtacgaaacggcgaagagagcgatggattctcaggagaagacggtgaaagaggccgaagaacggattaagtcggtcatgggatggactttatcagtaaacacagcctcatttcatcaaggaaaacgcaaaaggaaaaggccgttttggaggaagaactcaacaaggagtcgcaggcactgcaacttaacctaagcaaggaacaagtgagccgatttttgccgcaacgaattcacacggccaatgctttttggtggtcgccggaggtgttgccgccaacgaacactttcggacgcgcgtcaaagaaatcgctgcccaacgaaattttgccgaagtgattgtgttgccgcgggaattgtgcccggacaacggagtgatggtggcatggacaggcgcagaaatattggcaccccgaagggaaaagggagaagaaatcgactttttgagttgggcccccccccccccgaaacgaaggtcctggctacgcccttggggtggaatgttctcgaagggtgaaaatggacccgtactctcacgtccctaaatgccactgaagacgtacctcgtctttcgttgcagcgtcgttctgctcactgcccattccctccgcctccccttcttcgataaattcgatattttccggatcgaattcgtcctcctcgtcaaaaaccttgaaagaaatgctgtattatttacaaattttccattaccattgctggcacattcggctccccatcttcgtccgggaattcaaaaaagatggaatttggctc

SEQ ID NO: 46390 - DNA, 1111 bp, Heterodera glycines
  misc_feature (557)..(557): n is a, c, g, or t
  Genomic contig location: Contig_ID=SeqID_34453; Location=11..1121; Strand=+
  SCN-specific regions: Sequence locations=1-186,208-1111
atgacccatcctcaatcggtcgctgcgcatggcattcgagagcacggcgacgaagcatcgtgtgaagatttgctgtacaacttcgaggacgagctcaagcaaatgtccaaggcgtgctttgaaaaggagcgtttattcgaaaaggaaatacgccgacgcaatcgcttagttcgtaatcattaagtatttttatatatctttttaaaacgagggatacatctcatttgttttggattaacaaaattttaaggaacgttttgcgcgatgttcgactgaaaattcctcggcgggccgtgccgaggacgacgacaattcccagcacggaaacaacgagtccaaactgtcacagcaaattgttcgccgccgttctcaacagcatatcatgaatctgagagtctcgttgaagtctgaaaatgttgatcgcgactggacgcccaaagagccggtgaggaaacgacgaagcgggggccgtcgtttcttcggatcgaggtgagcattgggcgtgggatatttgcttatcgtaggtcattatgggatcgctcggcttcaccttattncaggggtaggaagccaatgtcgcgtaaggcgcgggatgtgatgatcaaactgcgcgaggtcagcatgcgacttggcggtgctcagtatttcaagaagcgcagcaacgaagccatttcttgtgaggtaaaatgtggtggtaattgctgggcaatacgaaatgatttactgatcggaggctgtcttttaccccatttatcatatgacagctaaaatatacaataaaaatcactatgctcccttgtcgcctttcctcattgtttttcgtatttatttcccctttttcagaaatgtggcaaactcgtcatcaatcgtctgtctgatcacgcttactctcacttggaggggtgcgacctgttcaagtgccaacagtgcaacttggtattgtggaattcacttggtctcccactgtgttcacatttatgttgtcttttagggtcacttttcgcgtgagacgattgttcgtcatttgaaggactttcacaattcgcacgaggctccgatggacaatcgccttcgttttgcacaagtgaccatcgttttgacttggttttaa

SEQ ID NO: 46391 - DNA, 1044 bp, Heterodera glycines
  Genomic contig location: Contig_ID=SeqID_7253; Location=1225..2268; Strand=-
  SCN-specific regions: Sequence locations=1-277,299-959,1039-1044
  Gene Ontology: Mol. function=casein kinase I activity; Cellular component=bud neck; Biological process=endocytosis
atgtcgctgatcggacgtggcctgtttgatctgctgagcgcggcgggcgacgtgttcagccctgggacggcaattggcgtttcgcttcaactgctcgatgcgctagaggctcttcacaaaattgactaccttcatctggatgtcaaactggagaatgccgcgatcggacgcgcggagaccaatgagagccgacgcatttttttgatcgactttggacttgcgcgccgttacatcagccaatccgtgagcagagattatccgcccattcctctcgcataattaattttttccaatttttcacagggtcgagcacgaaaacaaagatcaaagacgcacttccgcggaacgccaatgtacgcatcgatctcagcacacgcgcgagccgactactgccgagcggacgacatcgagtcttggttctacacactggtggacatgtacaccggcaagctgccatggacccatgtgacgagcgaacgccgcgtgagttttgtgggtcggaggggatttggcgcgggatttcaaatatccatttcccccttcattttcagacaggcaaaatgaaacgactccgtctaagccacaagcctaaggaagtgcaacaacgggccctgcatgcactgttgaagaaatgcccgccaatattctacgacatcttgttacacattgtgcgttttatgcgacattttgtgccgctttaattatactaattaccccccccccctcttcccacaggacgacctggagttttaccagcggcccaaatacgaatggatagacagggttctgcgcgactacctcaacacgaatggcatccacgagttcccttacgactgggagaaagaagcgaatcgacgaacaaggagtgcaacctgattgattgattgtcgtgccccgcgtgtttcattcataattccgtgttgttcggacctatattcattattccgtgttgtcagccctatgtatatattatatgtatgtatattctatattgtatattatgtgtacttgttcgacctatactatgtatttgtgtataataaa

SEQ ID NO: 46392 - DNA, 452 bp, Heterodera glycines
  Genomic contig location: Contig_ID=SeqID_7257; Location=19..470; Strand=-
  SCN-specific regions: Sequence locations=1-31,55-192,228-326,348 -404,428-452
  Gene Ontology: Mol. function=protein serine/threonine phosphatase activity; Cellular component=cytoplasm; Biological process=cell cycle
atggcaagagaggagtactgcttcgatgcaacggcggcggcagcggcggagcagtctcggccttcggcaacgacttcaacacttgtgcaaggagatggcctgtcaagcagcttcgtggacgcgatcatcaggaaggtcaggcagtcgcctgtccaacgcttcacggatgaggtgggatttttttgacatgacatttcaacaattaaaaaatttcattttttccacagatcaccgacgaggagctcaaacaactctgcaaggcggccacggacatcttcagaatgcagccgacgctcgtcaggattcagccgccggtcgtcgtcgtgggcgacatccatggacaattcacggacctgcagaggatcttccacacgcacggcaaccctccagagcagcagtacgtcttcctgggcgactacgtcgaccgaggcccccagtcactggaaaccatt

SEQ ID NO: 46393 - DNA, 829 bp, Heterodera glycines
  misc_feature (41)..(41): n is a, c, g, or t
  Genomic contig location: Contig_ID=SeqID_34541; Location=20..848; Strand=+
  SCN-specific regions: Sequence locations=1-304,326-533,555-616,638-829
  Gene Ontology: Mol. function=poly(A) binding; Cellular component =cytoplasm; Biological process=regulation of protein activity, epigenetic
actgaggaagcagcgaacagtgcaaatgcaaaagtgaacgngatgcttttggatgggaagaaagtgtaagatgatttcatcaatttgtttttgtggtatcatttaactactatccgtttttttaggtttgttggaaaatttttgccacgttccgctcgtgacaagcaaattggtgatccgtccagtcgtttcaccaatgtttatgtgaagaattttggtgatgcaatgaattcggagaagctgagcgaagtgttttcacagtttggcgaaatcatcagtgcaaaggtgatggaggatgacagcggcaagtccaaggggttcggcttcgtcgcctacaaggaccatgaaagtgctgcgagggcggtggagaagatgaacgaggtttcggtgcccggcagtgagaaggtcgagcaaaagtttacggtgtgccgtgcgcagaagaagagcgagcgccaggctgagctgaagcgtcgttacgagcagtacaaagctgagcgcatccagcgttatcagggagtcaatctgtacggattttgtttggttggggggaatttttctcaaattttaggattttgttggtttgggggggagtttttctcaaattttccatggataacttttgtttattatattaatgtgccattttttgtgtaaaactgttcggaaagctctccactaattaaaaaaataatgcaatccataaaggcatactacgaaattgtttactgaactggagattttaaggtacgtcaagaacctgcacgataccatcaatgatgagacacttcgaagcaattttgaatcctacggaaacatcacaagtgcaaag

SEQ ID NO: 46394 - DNA, 354 bp, Heterodera glycines
  Genomic contig location: Contig_ID=SeqID_34562; Location=862..1215; Strand=-
  SCN-specific regions: Sequence locations=1-354
  Gene Ontology: Mol. function=structural constituent of cuticle; Cellular component=collagen type IX; Biological process=cuticle biosynthesis (sensu Nematoda)
caagtgatccccggagagaatggaccaccgggtgagcaaatgcctttctgagtttggcacgtcgaaagtttaggcgagcccggcccggtcggaccgcccgggccaccagggaaagtcggacagccgggcaaagacggggccatcggaccaaaaggtggcaaagaacaaataagaattccggaacgtaaaatgacattctcaggccgtaacggacccgaaggcatccctggacccaacggattctcaggcccgccggggccaaatggcccccccgggaagtccggcgagaaaggcatttgcccaaaatattgtgccatggatggcggagtgttttttgaggatggaacgcgcaga

SEQ ID NO: 46395 - DNA, 1130 bp, Heterodera glycines
  Genomic contig location: Contig_ID=SeqID_34586; Location=86..1215; Strand=+
  SCN-specific regions: Sequence locations=1-48,70-178,200-1130
  Gene Ontology: Mol. function=cytoskeletal anchoring activity; Cellular component=cell-cell adherens junction; Biological process =locomotory behavior
atggcaaaagaagaagcaatcgtttgtggcgcactcgaggcgcttgttcctctccttgctcctcaaactgcaattccccaatcgggaccaaacccaaaacttcaagcaatggttaagtcaagtactcattcatcctataaatgtgttgtttgaggttgctgattcactttattttctgctgctggacaatcttcaatgcaaactcacattcctatccctccaaggtccacgatatctcgtcgaaatcctcaaatcgaatcccggatatgtaaagttgttttacgccgttgtccgttgtattcgttcaataagcacttgcgccgaaaacaaagcttcactaattgccataggtataattttgattttttttttgttgctgagtcgtaatttgtttaggtggccttgaacttttgcatcgggctttcaattttatagatgatgacaaacgaaaattgacgacattaagtgcgattagaaatttgtctgacgtggccactaatcttgaaacgcttgcgccacttgtggctgagttggtttctttgattgccgaccacaatgacgaggaattggtcagttgcgcctgcggaatcttgtcaaatttgacttgcaacaacattctcaacaaaactacagtttagtttcaaaaatcatattttagtttggttttgctaatgttaggtttgcactaatggcggagtctccatcctcgcacgggctctctcaaaattctccaacattgaggatgtcacagaacccgctctgtgtacgcttagacattgcactgttcgtcatccgcttgcgtaccaagcacaaaacgaacttcgttttgcctatgcaactattttggttattttgcatttattaagatcgaccaaatgtttttttagtcccttttatccacgcaacgaccgcccattgtaaaagctgcgttgggccttgtgaggaattgttcgctttctaacgagaatttgaagctaattctctcggttagtggctaaatctttaaatattggaaatccactcattgtttcaaggaaaaaaatgccgacggcgaaactgtactatcactgtcagtcgcattgcttgaacagtcgggcaaacagttggcccacgaattggagcggtctctg

SEQ ID NO: 46396 - DNA, 595 bp, Heterodera glycines
  Genomic contig location: Contig_ID=SeqID_34600; Location=127..721; Strand=+
  SCN-specific regions: Sequence locations=1-18,42-79,116-234,271 -477,499-539,567-595
atgtccggatgtggaaaaggaggaaagggactgggaaagggcggcgcaaaacgccatcgtaaagtgagtacaaatagaataatttacaaaaaatagaaaataaaagcgggaaaatacatccctaagaaatgacccgaaaaatttcagaaatacaacgctgagacttgaaaaatttttctcaaaaattgatcgccaaaatttgatctttttgcttcataaaaattttcttattcgaaaaaatctataaattattttattaatcatttaaatgcccaaaagtgaattttttgattactttttacgtcttttcataaaacttaaatgcctttttttatgtcttcttagggatttttgtgccttttaatgccgttcttcaatttttggtgtctattatagtgttttttgcgatttttttggtgctttttcgagacccctaatacttatgataaataaattatgtaattaaatgtgaaatgatgttttcggttttgtttttctcagaataactgctacctattcctattttcaggggactcgttacaacatccaaggcatcaccaaaccggtcatccgccgattggcacgttgcggaggg

SEQ ID NO: 46397 - DNA, 682 bp, Heterodera glycines
  Genomic contig location: Contig_ID=SeqID_34604; Location=269..950; Strand=+
  SCN-specific regions: Sequence locations=1-242,264-591,614-682
atggcactcattcatttgatggcattgaacagaaaattgaaattgctggagaacactgatggcaatttgtgccgcgcaacggacgaacggacgtacaaattgacgacgaaactttgcccaccgccggaggaccccaacttcacactgtgctcgacattcaccaaaagtgtgtggcaaaaggactattggcagaagcaaggcgcaattgacgtgtggatgaaggtgaagcggaagaagcaaaaagacggggaaaagcgggggaaatgcttcgaattgcttcaacattttgccaaaaaaaatttcagttttttgaacgggcgcccaaccgagcggagatggaaaaagagttcttctcgcagttggacaatcctttgctgggcaaagccttcaaattggccatcatcggcgaatggttggccgccaacagtttggacgtgcgtaaaatgggaaagttgcgtaaaatgccgcagttgtgctgcattttcagcagggaagttacacgccgaccaactcggaattgttggagttttgggtgtcgaagagagcgcctgaccgattgttggcctgcgagcacggcgtggtcgactacgaaattgagggctccaaagtgaaaacgaatgttttgttcgaagcggcaacgaccgcgggaaatgtaaaaggacaaaacgacggaagcaactga

SEQ ID NO: 46398 - DNA, 1449 bp, Heterodera glycines
  Genomic contig location: Contig_ID=SeqID_7300; Location=1..1449; Strand=+
  SCN-specific regions: Sequence locations=1-263,285-359,381-587,609 -666,689-815,837-1036,1058-1288,1312-1449
  Gene Ontology: Mol. function=transmembrane receptor protein tyrosine phosphatase activity; Cellular component=integral to plasma membrane; Biological process=embryogenesis and morphogenesis
taaggatgagacgcgcgtcgttcttcgtttcccttcctttggcgacgacccttccgcagattcattcatccacgccaattacgttcgttcgccggtgctcttcaacgatttcatcgtcacccaagcaccgatgagcaatacaatcagcgatttttggcgggtaataaaggctaaaaaagggaaaaaatagctatttaatatggagaggcgaaaattcattgaagacagactgaattgaatttcttcaacaaccgtaaactgtacaaaatatactttaatttcacagatggtttggcaagaaaaagtgtgttatattttcatgttgatcagtcgcaaagaatcaaaacgttgtgccccttattggccaaaaaagtttgcttaaattttgggcatataagatatttgtttatttttgtctcttgtaagtctcagttcaaaaccgttggcattgcatggactgaccattcaaaatgagggcatcgaaacgtcttctcgtgacccttttttccgagtcacaaaaattcgtatcatcggaccagacaacaccgaagtatatgttgtgaatgcttatcaccgctaataagaaaaacatctcaattactctttcagcttcgcttggaacattggcaggcggacatgaataactcggagaatgtcgaggcgccccttcgtctgctgcgcctgtcgcgcagttgcacagcgcccactatcattcacgaccatttagggatcagtcgcgcggcatgtctcgtcgcagccgaaatttgcatttgccagttgattcgcggcgggccaatgtgcaaagtcagtcctaattatcttattttgtattttccatttttacatataacatttaattctaaatgaagagcatcacaattgcccgaaaatattgtgtgaacagaacataaaagatatataatttgttttcagtatatcgttcaaaatgccgttcattatttgcgttctttccgcccattttccgttgaaacgccaatgcaatacattgttagtcttatttaatctaccaatgtggttggtcaaatgatttttaattttcttcaatttatgcaccttttcgtttaatttaaattttttttgagtttattcaccgtgtcgttcaacatttcattcgccctttcgttggcattccatctggttttgaacaagattacattcgatggctcgacgaacgttctcaacgtcttttcgtcgatgatttcgacagggaagtgagtaattatcttttttcctttgttcccgtttaaatattttgtttcggatccccgctttccgcctgctttctcctcgcgttgatcccgacatgctaccgctggtacgtcgccgtgaaaggcccgaactccgccgagaaatgcatgcgcccgtgggggaactgcccctcccggctgagatggaatgcgcaccctcaggcggtatgccatacaatca

SEQ ID NO: 46399 - DNA, 908 bp, Heterodera glycines
  misc_feature (845)..(845): n is a, c, g, or t
  Genomic contig location: Contig_ID=SeqID_7305; Location=39..946; Strand=+
  SCN-specific regions: Sequence locations=1-442,465-908
ttaagagggatgtgatggaaattgttcctcagaatgggtgtttttcattcttcggctcactttctaactaaattcagacgaagcgtcgattttatctgtcgggtgaaatatggaaatactttgccggatttgccttttgaaccgaagtttctgcaaagtccgttcatctcgttaaacaggttgttattattattgttggttatttttattatatatagtgcgtttgtttaggttcattggctataagccgtccagtctcgagaagtgtttcaaatacgagttgttgacggaacccgatctaaatgtgaagattgatctgatcgatccgatgacatattattgcgaacctgacgaaaaaactacgctcgatcccattgatgaacagcttcttgaggatgaaaacacctcccaattaaacacgcgacggtatttctgatcagattttgctgtttggaattttctttagttctattcaacatcgaaaggtcgttccatggatgagaaaaacggagtacatcagcacggagttcagtcgttacggaattgggcaaaccggagctgagcggccggacaccaaaatcggatatggaatgaaaaatcgcatcaaggacgaggtaaatgatacgcaaatacaaaaagagaatatttgaaagtctcttccactaagtcattcgaatataaagaccgggattcacaaattgcggcaatccaacgaactttctctgaagtccaaaagccggtccgtcaccattacagcaaaaaaggagtcacggcggtcgaggaaatgccgatatttcctgactttgaggcgagtactttatacaattacagcaataattgaattnttgcatttagttatggagatacccattcgctccagtcatttttgatgctgacccgctgccata

SEQ ID NO: 46400 - DNA, 928 bp, Heterodera glycines
  Genomic contig location: Contig_ID=SeqID_7306; Location=17..944; Strand=+
  SCN-specific regions: Sequence locations=1-353,377-594,616-879,902-928
  Gene Ontology: Mol. function=DNA-directed RNA polymerase activity; Cellular component=DNA-directed RNA polymerase I complex; Biological process=embryogenesis and morphogenesis
atggcggacgacgacgctgaaacattcaaactttggcgcgtacgtaagactgttatgcaggtagttaatgtgaaggatcttggtaaagtgtttgacttacgtgtctttctgaccaaagaggcgattcgtttgttacataaatttgtctgcagatgtgccacgaccgagggtatttggttacgcaagacgagttggaccaaacgctggaccaattcaaggaccaattcggcgatagacccagcgaacggaggcccggcaggggcgagctgaccattttggtggcacataatgacgaccctaccggtgaatcctacagagaaggagctttactaaaatgccgttttctagaccaaatgtacgtgttcttcccagatgacccgaaaataggcatcaaaactatcaaacagatctgtcaacaaatgcaagaacagaacatcactcgagcgatcattgtggttcaaagtgggatgacaccgagcgcaaaacaggtggagaaatttgattgggagaagtgttggctgatgaaccactcatttatcatttaatttgtaaggcgattgtggacatggcgcccaaatacattctcgagcactttttggaggcggaactgatgataaacatcactgaacatgagcttgttccggaacacgtggtgatgagcagcgaagaaaaagcggaactgttagcgcgatagtcagtcccttttgctgggccgactcattttcaactttttaatctgatttagcaagctcagagataatcaactgccgcgcattcaagtcagtgacccagttgctcgttacttcgggttgaaacgcggccaagtggtcaaaatcattcgtccatcagaaacggcgggccgttacattacttaccgactttgcaattgatgtttaattcagaggatttgttgcaaattgtcacttga

SEQ ID NO: 46401 - DNA, 1020 bp, Heterodera glycines
  Genomic contig location: Contig_ID=SeqID_34696; Location=1..1020; Strand=-
  SCN-specific regions: Sequence locations=1-227,252-270,293-674,725 -1020
tcgaaagctttacatgtttagaagcttccaagctattgcttagcgattagacaattaccaaaaaagttataacatgaaaattgcaaaaaagacgaaatttttgagttttttcttaataacttttttataagctaatttttttttgtttttttgtaaggctaatagagcttgtgaagggctttcggatgataccaagattgttagatttggtcaacaatgaaaactagtaattaattaatttttttataattgtgctgaaaatggttcatcttatgaaaatttaaaaattttggcaaatgttggcaatggcatttttaatggtaaatcaaatgcaaatattccaacaaaaaaaaaactctctgcacttgttcttaatttcaatgccctaattaccccttgcggtaaaatcaggcattgtccattgactccgctcgcggcgtatctatcaacgcgcacaacgccagcggacagaacaccgccagcctgaacctgcaggcggacgggcgtgccaatgtgatgtgcgaacggtttgaagttgtcgaccggcaaatgaacgtgctgttctcggtggactcacaagaaatcggattgaacctggaaaacttgcgcattttgggtagagacgacttttcatttgggatcagttcatttccccactttttttcaacgatttctaaaaatttttctaaattataatttttttcggggaaacattccacgggggaaaacgtgatgtcatcccttttattgtgattttttgattaaaagaaaaaatctcaaaaagtttggctatagagaaacttaaaaaaagaaatagtagcgggaaactaaaatctgaattttcagtttttaaagacataaattaatataaaatggaattatctaaatcactttctaccgtatatatttatatttcttaaacactgttttttcagatgatggaggtagcatttttgaaggtgccattcaaacatcaattgttcgtccggaaccggacagtccattaaggtgggggggggg

SEQ ID NO: 46402 - DNA, 373 bp, Heterodera glycines
  Genomic contig location: Contig_ID=SeqID_7319; Location=1360..1732; Strand=+
  SCN-specific regions: Sequence locations=1-373
agtcacagaacaatgcttttgcaaacgatgggctttcagtctgaagaaaagcatggaaagcgagaatgtaagttcgcctcagttgtttggccaattgtttgtttccctattcaaaaaatcattttttcagttcgaaaggcatttccgtttggccgttcaatcggtcactgcggaagactatgaaaagatgcgtcagtatcggcaccgggaggactctctcgcgactttggccggtcgtctcttcctccgtaaggctgtccaatgcctttgcggcgtccgttgggccgacattgaaatttcacgaacggaacggggaaagcctttcattgttcgacccgagaacatttccataggactgaacgtttctcaccaa

SEQ ID NO: 46403 - DNA, 770 bp, Heterodera glycines
  Genomic contig location: Contig_ID=SeqID_7319; Location=1..770; Strand=+
  SCN-specific regions: Sequence locations=1-91,113-255,280-540,562 -588,610-720,743-770
  Gene Ontology: Mol. function=signal sequence binding; Cellular component=integral to membrane; Biological process=cotranslational membrane targeting
gcattttcaattacacttcgccatgggtcacttattatgtgaccgaagatgccaaacaagcgacgttcgggtacagcacagcgccaggcgaaggtcatcagagacattcaaaactaacaaaaaaaacttgtttcattttgcattttagggaacatttaccggctaaaggattatgagcgccgattcagttccaaaatcggtatttggctcgtctttttgctgttagctttacccacgaccttgttgcctttcttcctctggtcagttttagttctttctaaagcaatttttccatttctcgcattcattcatggttttatagcctattgtaaaacaggcaaaacatagaataagaaaatggcaaccaatgagtgcgtaaaagcacggagtcatttggtgatataaaggtaccaagtgttaacttcgaatattttaaaagaggacgtaaaactcgaaaatattaatacaaccgcagctaaaaatctttttcgtatccatagtagctcattaaaaatgaatatagtctaaaaatcaaggccctaaataatttaaaaattttaaggtacaaattccaacagaaatatgcgacaaaaagcgggacatccggtcaacaaaattctaaaaaggctcaatgaaaactaaaggcaattatggagtgcgcaaatccatgccacctttatatttattaccattttgtttccatgcaaacttgtatttgttgtgttaaaccatttcattccttatgctgttgacgtaaacgtgtggaaaac

SEQ ID NO: 46404 - DNA, 565 bp, Heterodera glycines
  Genomic contig location: Contig_ID=SeqID_34758; Location=71..635; Strand=-
  SCN-specific regions: Sequence locations=1-178,213-235,257-289,318 -322,376-482,514-565
atggacggccccgagccgtacagcacccggtccgacgtgtactccttcggcatatgcgtgtacgaactgctcacctccagattgccatacgaggaaatcaagaatcgggaccaggtgtgccaaaaaaacaaatattttttcgaaaatttcatttttttaatttttcagtgaattaattttcaggcctttgaattttccctttaaagaaattatttttttctttgaaattcgattcaaaaattgcatttatttgtttcataaaatgattttgcctttaataacaagttgcttaaataattttttaatattgtttttttgggtgtaaaaaaataatttcaaaatttaaaaaaaattgttttttttttttgaatttttctcggaaaattctctctaaatttcaattgggaaatatattggattaattttatgactgaaattggaaatttcatgccacttcgtttatacaatggaatttgtacaagttaattttatataatttttttttattattttccaattttctaacaaaaaaaaattcacttgaaatttcaaaaaaaaaaataaa

SEQ ID NO: 46405 - DNA, 847 bp, Heterodera glycines
  Genomic contig location: Contig_ID=SeqID_34899; Location=171..1017; Strand=-
  SCN-specific regions: Sequence locations=1-325,347-382,405-569,591 -698,721-775,797-847
  Gene Ontology: Mol. function=chaperone activity; Cellular component =cytoplasm; Biological process=nucleosome assembly
tgttcgcttatccattttaatacgttttccacatttcccatttaggggttttctctgttcttccattttgccgagaatccgtacttcaccaacgcggtgttgaccaaacattacgaggttaacctcgacgtggacccgcaaaaaccgtaaattgttttttccttcatttacagcttttatcaaacctttaaggttctcttacgacgggccgacaatcgtgaagagtcaggggtaatgacactgaaatggcgataaaacttttttcatcaaactttagctgcgatatcgattggaaggatggaaaaaatgtgacgcaaaagattgtgaagaaaaaacagaagaaaggggcgcaggcgggcaaatacgtcaccaaaacggtgaaattttaaaaagggaaaattttattgataaattttgtctcatcaataggtgaccaacgaaagcttcttcaactttttcgatcctaaagtgacgaccatcacagaggaaatggtaagtggaaaaaaatgacaaattgggagggattggcgaaaagccataattaaattagcatttggttgttctcaaaaatgctgatttgtgaatgctatttttaatcacttaggacgacatcgaggaacagaaaaccaatgatgacttcgaggttggacagatcattcgtgaacaggtaattttcattatttttgcgctttgtctcgattttccattggttttttagctgattccccgtgcggtgcttttcttcactggtgaggcggctgaggaagacgaatatgacgagttcgatgacgaggaggaaatgggggacgaacagtcggaagaggaggacaatgccatgcactgaagg

SEQ ID NO: 46406 - DNA, 1161 bp, Heterodera glycines
  Genomic contig location: Contig_ID=SeqID_941; Location=4366..5526; Strand=+
  SCN-specific regions: Sequence locations=1-16,38-240,262-273,295 -696,718-1037,1060-1161
atgccaccggcacgaggaagccgcaccgttaccgtccaggtacagtaacactgcactcatcatctgctgaccccaaatgctcactaatcccatctctccccatatttaggcaccgttgcccgtcgcgagattcgccgttaccagagcaccactgaacttctgctgcgcaagttgccgttccagcgtttggtgcgcgaaattgcacaggacaacaacttggagatgcgctttcaggcggtggcctttgcagctctgcaggcaagcaaaagcttgttgtttaatcattttactaatttggcatccatttcaggaggcttccgaagcttatttggttcgacttttggagaacaccaatttggctgccgcgaacgcaaaccgtgtgaccatcatgccgtccgacattcaaatgtcccgtcacatccgcggagagaccctctgaagagccgaagcgagaaaacggagatgcgcaagaactattgggaaatcgaatgtgatcatgatcatatcctataattattgaatgtttgtaaatatacatataatcattcgtatgtgaatttattgtatgattaaagaatgtgctattattttgagtctatggcaattcaaacaaagtttacagacccgggattttgttattccttggttttactggattcctacaaaagaaaaaaaggcaagaagggggttgagcggttttttggagtttttgagggcgctgatcacgaatatatgacactaattcaatcaatttcgagcccctaattcgaacaattaacattgactgttgctggagggtgttggccatttgaatgctacatcatcgacccaatcacccacagaagattctgaccacccgatctccattttttaaattagctttttttcaattcgcggtcactgaccagcgcctccgaaagcacaaagatcacaaaccctccccttttttgcctcttttgtcggactaaaatcgatgattaccaatttttgactttcacaggggagtgagtagccttccgattagcaaaaagtggtccatccccaatttctttccctggtggaatgaccatgtacagcagcagaagtgaactgcctccagcagacatttattaatcgcgagcatcagaatggacaattacaatacaataacataggccaaca

SEQ ID NO: 46407 - DNA, 1189 bp, Heterodera glycines
  Genomic contig location: Contig_ID=SeqID_941; Location=38..1226; Strand=-
  SCN-specific regions: Sequence locations=1-241,263-293,333-412,435 -518,555-614,639-815,857-1057,1080-1189
atggcgttcagcatcaaacagttgttcagcttcaaccgaaccgacgtgctggacgacgacccgctgaaggacaaagtgaagcgggcgatgctgcaccgaaagtacggcgaatgggcggcggctgttcaggtggccaaaaaagggggaggaggaaaggggacgtataaattaaaagggaatgggaggaaagggatgtataaatttatgggtaaaaatctactaaatccagggagggtcccgatggaaagggggagggacgagtttcatttcgggggccctacgaattctctttgaaaaatttttaacaataaatttaaattttttttaaatttccgggggagacgggcaatggagggggggggggggaaccggcagggggaaacgagctgctcccttcatgtcatccatcttctaaactttttaaatgaaaagtgggatttcaggtttgttgcatgacgtaaaataatctaaatgcttcataattttcaaagagcaacctctacctggttacttttttgaattttaaaattcaattttttatttttactttatttcaaaacaaaattccaaggcgtcgtccgccaaccgacagaaacattcattaaagcaaacagtttttttaaatttaattttaaaaagcttttaggtgctcaacgaggcgttgaacgaggcggtcgagttgggcaatgaaattttcgtgtcacggatgtattacgaattggccaccaccttttgggagtcgggccaattggagaacgcggagcatttactgaaactgctgcacggaaggtgaaagaagagaaacattcctatcgaaaatttaaaatttttatcaaaaaaaaatttttatttttaactgacgaaatgaattatacgatttgaacagtaaattaattggtccttccctctccagatacctcactttgcaccgttcgtccggcctttccccggaagttatcgaaaattcgttgcgtttggccgacgtttacacgcgaatgggcaaattggtcggttttaagtatttgtttcatagtaaaaattgaattttcggactccgttttatttaatttttattgtttaggacgttgccgaagatgcgtacaaatattgtttgaccacccaaatggaagtgatggagaagcatttggcggaataccatgtggccaggggcgccatggtggaaatcgat

SEQ ID NO: 46408 - DNA, 6902 bp, Heterodera glycines; identical to SEQ ID NO: 7362
  misc_feature (67)..(67): n is a, c, g, or t
  Genomic contig location: Contig_ID=SeqID_7362; Location=1..6902; Strand=+
  SCN-specific regions: Sequence locations=1-727,793-925,979-993,1015 -1133,1170-1505,1528-1678,1700-2093,2116-2164,2194-2218,2241 -2318,2395-2625,2649-2831,2853-2889,2911-3021,3043-3139,3161 -4174,4196-4279,4301-4509,...
  SCN-specific regions: Sequence locations=...4531-4644,4666-4822,4984 -5451,5473-5544,5580-5754,5787-5827,5870-5910,5948-5951,5973 -6305,6342-6548,6584-6733,6755-6902
  Gene Ontology: Mol. function=calcium ion binding; Cellular component =lysosome; Biological process=receptor mediated endocytosis

SEQ ID NO: 46409 - DNA, 1276 bp, Heterodera glycines
  Genomic contig location: Contig_ID=SeqID_7377; Location=1220..2495; Strand=+
  SCN-specific regions: Sequence locations=1-499,524-736,758-867,889 -924,946-959,981-1276
  Gene Ontology: Biological process=growth
atgacccatcgcaaaatgacgatgaacatggcggagaagacgaacaaagcgcagaaggtcaaagtgttggcgcaagttggcgacaaccccgaggcagaacgaagggtgggccaaatatggaaacattggcatttttcaatgccaaaactcaccaaagtttgcatattatgtctaggaactcatccggacggaggaggaaaagctgcgggccgcggcgcgtcgcgaggcgcagcagcgacggatcagagaacggccgcgcatggccggactgacgccgggcttcctggagggatacgagtcgggtaaacagtttgggaagagacatttgttagtggacaatcattgattattctgctttttctatggttgataattgtgtgaaaattgtcagtgacaaatgaggcaaaaactaattgccttttttaaaaagcgcccaccattatgcctatgagtttattaagtcgcaaagttttgaactttggattttgtagtttcgctatgattggttttgttttgttttcccaccccctccttttagacgagggcggcgagtcgttggcggccataaaacggcgttaccaacacgcgccgtacagtgcggggggtgcccacgacggcggtgccgccggccgtcgttcgtcgatggcgggcggccgcggcggctcctcggacgaatcagcggaagaagaggagcgcgatcgacgggcgcgcaaggcgataaacgaggcgaagatttacagcgacgacgaggaggaggtgggcggcgcgagcggcacagggccgataaatggcgacggcgcgggcgacgactcggacgcggtgagcagagttgacagacatggcccccaatgggcaaaaacactcccatttattttttccaaaaaattgccgaaaagaatcaaatatttgtaaaaaaataggagccaacacacaacacaaacagcagcagacatcagcctcaacagaagaagaaaattgtcatcgatgaggacgacgaatgacaatggcacagaacagcgaagggagtgacaatcggcgatttccccaaatgggggagggttttttggcagaagtcgaaaaaatgtcaaaatatggttttttgtgctcaaaactttatgattaaaaaacgcggccagactgtatgttcaaattgccttctcagttccaaaaaatcctgaacaacgccccatttttagtgcattttgtctttggttcaaagggtttgactgatttgacaacgacaggttcggaagcagtacctccgatcaccgtataa

SEQ ID NO: 46410 - DNA, 1402 bp, Heterodera glycines
  misc_feature (1316)..(1316): n is a, c, g, or t
  misc_feature (1337)..(1337): n is a, c, g, or t
  Genomic contig location: Contig_ID=SeqID_7384; Location=1106..2507; Strand=+
  SCN-specific regions: Sequence locations=1-79,102-904,931-1402
atgacatttcacaaaattgacgcgagtagcatcgattcgattaccaacgccgtggacttttttagtatacctccgacaaatgtcaccgtgtcatcttcaaaggttttcgagattttgctgagtaatccactcaccgacacaccttaccattttaaaatacactcgagccaaaattacattgatctgtcaaaatgttacattttgaccgaatttcgaatgcgaaaattgacatcaccaaatggtgaatggggatatttggatgctactgatcaggttgtaccgatacaactgatcggacacacgttcatacgagacatgaaaattgcaataaatggtcgtgaaattttcaactctaattcactgatggcatacaaaacttatctttctcatgagctttcgcaatcacttgaagctaaagtttcgcatttaactgctgctggatatgaccgtgaagatgctaacaatttacaaaacgcaaattccgaagggttcaaaagtagaagacaacggtatttgggaggtcgaacagcacaatacattgcaaaaatcgatgccgatctgttcaatgtgccccaatatttgattaatcattgcgaaattgacataacgatacaaccccatgacgacaattttttgttaattgacacattagaccccccgggtcaaccatatagcattgagcttgttggattgaaactctactgcaaaaaagtcagtcttatggatggcttggctcttgagttggcgaaaaaattggaaatgaaaccagcacggtatgctgtacgaaaaacaatgatgaaagcactgttcataagcccagggcgctatgaatttaatgcaaacttgttcatggaccaagttccacgccgcgtaacaatgggtcttgtggcaaactcagattatgtggggaacatcaaaaggagtccattcaactttcagcactttaatgtacgtgagttgagtgttgtggccaatggtcgctcctatccccaggccccgtatgacattgactatgaaaattggaaatttgtccgcccctacaatgacacgcaagaggcgcttggttttgccaactctacatatggaaatggaattgattatttttcttttttgcacactcattgtatttatgtgtttaacatgactaatagtggagatgatcatggcggtttgttcgacctgatcaaaaagggatgtacagcagtgaacataaaattcaaaaagccagtgcccgatgggggaattacactgatagttatgggagaagcagactccatctactttttagataaaaacagaacgattgcaactgatancaccatttgatttcaaaaaanatgtttcatttattctttattgtcttgttttttcaccaattgtttgtttgattgttgaagaagga

SEQ ID NO: 46411 - DNA, 869 bp, Heterodera glycines
  Genomic contig location: Contig_ID=SeqID_7406; Location=1008..1876; Strand=-
  SCN-specific regions: Sequence locations=1-402,425-869
atggatggccgtaaccataaccatgcccatcatcacgaatcccacgttcaaatttcgaccacttcactgccgccggccaacccaatcgacggaattgtaaattctcttccggatttgaatggtaaaatttgtcttgcgatagtcatgaaaaagatataagcgctttgcactatgttttttgctcttttgtggtacattaaagtcataatcactctacttgaattcgtattgttttaatttacagcgttcatttcagtccattctcatggccatcaccaccacgaccatggccacgccatgaaaatgtttttccacggaggctttcgggaagtgattcttttcgacttttggagaaccgaaacattttatggtatgcttaagggggaaataaatattgccaccttctattggtacatttatttttccttttagggctgtttttctcgctgattttggtgtttatgatggccgttctgtacgaaggtgccaaatggttccgcgtttatttccaactttgggtatctttcgactccatttgtctcccttttctttatccattaaaatcatttaagacttctgttagtcaaaaatcgtccggttgcatatcaatggacgccgttcgtggcaaattccggcggagtcagcatggcgtggaagcggcactcattgaaaaggcgacggccgccgtcacaaattcgtccgccagcggttgcaacgcgtgcgatggcactgccgacgattcactgaaaaacacaattggcagtcagcagcaagtttatgcgccaactgttgtccgaccggcgccgatcagtcccaacatgacgatcaaccgttggacgtaccgcacacttttgcttatttgttcgtaa

SEQ ID NO: 46412 - DNA, 731 bp, Heterodera glycines
  Genomic contig location: Contig_ID=SeqID_35094; Location=1..731; Strand=+
  SCN-specific regions: Sequence locations=1-22,52-71,95-119,303 -347,387-447,474-544,566-731
ggagggcattcccgctaatgaccagcgtttgatctttgccggcaaacagctcgaggacggacgaacgttagccgactacggcgtgcagaaggaggcaaaaattcatttggtcagaaaacataattaaaatatttaactaatttttacaagaatttttatattatttatttacaaaaaataaaaataatttttttttctaagtaaataattaatctttaaaatatgtttctttttttctcaaatattttacgcaaaattaaaaaaaaattaattctagaaaaagaaatatatattatttttttcgctccttcaaagctttaacttttaactcctctaccgggtgtttgatataaaataataattctttttattattgtatttaaattgtattgcctaattccactcaacaatttttcatcgaataaaattcacctaaaataaggggggttttaaattttttttttttaaaatttgaataggtcctccgtcttcggggcggaatgcaaattttcatcaaaactttgaccggcaaagtcatcacgctggaggtggacagcatggacagtgtcgagaatgtgaagcggaagatcactgacaaggagggcattcccgctgatcatcagcgattggtttttgccggcaaacagctcgaggacggccgaacgttggctgactacggtgtgcagaaggaggccactgtacaccttgtgctgcgcctacggggcggcgga

SEQ ID NO: 46413 - DNA, 510 bp, Heterodera glycines
  Genomic contig location: Contig_ID=SeqID_35108; Location=799..1308; Strand=+
  SCN-specific regions: Sequence locations=1-151,176-510
  Gene Ontology: Mol. function=snoRNA binding; Cellular component=small nuclear ribonucleoprotein complex; Biological process=35S primary transcript processing
atgaaagtcaaagtgatctccagacatccggatgaataccaacgcgagacaaaacatgacatattcaagggttaggagctttatgaagatatttttggtgatttttcgcatccgaaattagtgcctcggaattacgccgccccgcccgacccatttcagcagcaggtggagtacacgcgagcactgaacgcggcaaagttggagcgcatgttcgcgaagccatttctggctgcctttgatgggcacaatgaggcggtcagttggtgttggcatttcattttttattggcatttcgtatccccatttacctacatttcttcgtatattttcaaattgtttaatccatacgttcgcaggtcaatttgttggtcaaacatcccactcgtctgtccaccgttctgtccggtgcgcgtgatggccaagtccgagtgtggcatttggccactcgccgctgtttgcacgtcctccaggcacattccggccccatcaacggtctctctgttgatgcat

SEQ ID NO: 46414 - DNA, 1079 bp, Heterodera glycines
  Genomic contig location: Contig_ID=SeqID_35127; Location=1..1079; Strand=-
  SCN-specific regions: Sequence locations=1-350,391-400,422-851,873 -1079
  Gene Ontology: Mol. function=CDP-diacylglycerol-serine O -phosphatidyltransferase activity; Cellular component=intracellular; Biological process=positive regulation of body size
tgtacagatgtacgcgtgaattgctcggatgtgatttggagcgtctttggggtacatggacatttttgcggtcggacatttcctcggctgggcaatgaaagcactgctcattcggcacagcatcatctgtgaacatttgcacatattttgctttcagttaatcattgtttaaggttggtacattagcatttggtgggaattgactgaggttggtttttgcattgccatcaaatgaaacggagtccctcagattgtcttctcccatttgttgcccaatttccaagaatgttggtgggatgccatcattttggatgttttgctgtgcaacggattgggtatttgttgcggtctttggatttgtcgttgtttggagatgcagcagtttcattgggagagcatcaagtgccttttgaatttctttgcattctaacaaaaatccattaaattgtgcactcactttttagaaatattcgaactttgcgtggcaaattgaagcgggtcgttcttcaattcacacccgaatcttggataaccgtcaattggctgcagggcagcgatttgatggtagacaagccaaacaccgaccacaaaaacggtccggggaaggcgcatatggtaacaaactgactcgttgaaattggcggcaaaattcatttcagacactcgtgggccttaagaggtgcattgccatttacgccttcataatggtctggttggccaccgagctgaacgtgtttttcctgaaacacgttttagccatcgacacttcccatcctatcgtcttttggcacattattttcatcggactgatcgctgcccccacaattcggtaatttaattatatttgacttttagtttatttgttgttgaatcttttagacaatattatttgtacgtgactgatccgaaaattaagcgaatgggaatgcaatgttggtcagtcaattcactttagttttgggctttcaataaattgtcatttggttttcaaggctttacttggcaatttgcgctctcgaagcatctatttgtgtaaagttcggccgtgagcaacttccagcaattaaactttggctgat

SEQ ID NO: 46415 - DNA, 1621 bp, Heterodera glycines
  misc_feature (7)..(7): n is a, c, g, or t
  misc_feature (9)..(9): n is a, c, g, or t
  Genomic contig location: Contig_ID=SeqID_7422; Location=691..2311; Strand=-
  SCN-specific regions: Sequence locations=1-27,49-349,371-742,764 -1270,1302-1378,1453-1561
atgcgtntnaaggcatatatgatgactgaatggggatttcagaaagatgtcaaaaagggtctttgtgaagcgtcctgctattatgtcgacgatgtcgaccaggatgattacacaaatagcggcttaaaaacagagcgtcacgttttgctgatgggcccaatgtgagaccatggtgaaacttaattttaatctcggccgttagcccaatcttttgcttaataactctgatgtaatttttagcatacatcgtaataccgatgattttctaattattgcaccgtcatatgtttccggaaatgcagtcatagcgaacccgcacacatatcatattaacatacacgatattagaatttatataaaaacagtagatgttacccaagcattaaataacgtaataagcaatcagctacaaaccaccccggccaaatatccgatgagaaaaattgagatcagaagtcttttcatcccacggggcacttctgatctctcgcacaatgtttttacaagcattgttccgagacgtttaatcgccgggtttgtttcaaccggtgcgtataccggaaatcctaaagagtcacccttcgtctttgaacatgcaaaaatacgctctatcagtgtcgaagcgaatggaaacatattccccgggtcaccctattctcttaattttgatcgaaacaaatacattcgagcatttgttgacatgtatacgggactcgggatggacgacggttaatgaacaatgtcgatcaatatacaaaaatttgtaaacggttggtgcttattttatcccgatgacctctactctagaggacacccccggttttgaattgattcgaaacggaacgaccagcatcaaggtgcaatttaatgagcctataaaggatggcgggtatgagataatcgttctgggggaatttgattcgattttatctattaatgctaatcgtgtgctcagtagcgacggaagcatatgatgaattctcatgagattgaaatatttctatccaaacatccgacaacccgaaaatattttatcggcgtttttgcttccgacaagatgcctaaatagaaggaacaggcattttccatactgttttgtggcgaataccgaccgggcgggcacgatacttgaacactggattgctgttttgccgacagaaattgaatattttgattcattgggcgattatcccaatgaagatttaagttcataccttaacttattttaacgaattctcattaacgatcgtattgttcaacatcaattctcattaattattttttatttataagaattaatagctaataggaatcacatattaatagctcaatagggcaaatcgcatattaaattgattttgtattttcattaaatctcttatttttaattaattataattaaatttaagattaaagattgttaaaaattataagttaaaaaaaattaattttctcaaagtgcaattgaatagtgcttaattctattaacttaattttgtcgagtgatataatcgactagacttttaattgttaaagctttcattttatttgctataatcagaaatttattagtttatttatcttaaattattcatttcatttttaagttatttttaataaa

SEQ ID NO: 46416 - DNA, 1353 bp, Heterodera glycines
  Genomic contig location: Contig_ID=SeqID_7423; Location=292..1644; Strand=-
  SCN-specific regions: Sequence locations=1-730,752-1039,1061 -1119,1141-1353
atgacaactctcaagaaaatcgacacggcgagtgaggacggtctcgaggggggcctttcacttttcgatatccccccgacgaacgttgcaattaataaatccagtattcgggaattgctgccactttcagcaataaatcaatctggaccgtatatatttagacttttttcagataatcagttttgtgacctcaataaaacttttctctatttgtcaacttcaatagagagaaaagacaaaagcaattggattccaattaccaaggacagtgaagctgaccaacacgtcggtgtcattcaaaattttgggcacagctttgtcaaaacattaaaggtgtcaatttccggtgtcgaatcttatgattccggtatttactatgcgtttagggcatatatgatgactgaattgggattttcagaagatgtcaaaaagggtctatgtgaagcgtcctgctattatgtcgatgatgtcgaccagaatgattacacaaacagtggctttaaaaacagagcgtcacgttttgctgatggggccaaatgtgagaccatggtgaaacttaattttgatctcggccgtcagcccaatcttttgcttaataactctgacgtgatttttagcatacatcgtaataccgatgattttctaattatggcaccgccatatgtttccggaaatgcagtcatagcgaacccgcacacatatcgtattaacatacatgatattagaatttatgtaaaaacagtagatgttacccagtcattaaataatgtaataagcaatcagctacaaaccacctcggccaaatatcctatgagaaaaattgagatcaggagtcttttcatcccgcgtggcacttctgatctttcacacaatgtttttaccagcattgttccgagacgtttaatcgtcgggtttgtttcaaccggtgcgtataccggaaatcctaaagagtcacccttcgtctttgaacatgccaaaatacgctctatcagtgtcgaagcgaatggaaacatattccccgggtcaccctattctcttaattttgatagaaacaaatacattcgcgcttttgtggacatgtatacgggactcgggatggacgacggtgaaagaacaatgtcgatcaatatacaaaaatttgtaaacggttggtgtttcttcgtcatcccgatgacctctactctagaggacacccccggttttgaattgattcgaaacggaacgaccagcatcaaggtgcagtttaatgagcctataaaggacggcgggtatgagatgatagttctgggggaatttgattcgattttatctattaatgctaatcgggtgctcagtagcgacggaagcatatga

SEQ ID NO: 46417 - DNA, 646 bp, Heterodera glycines
  Genomic contig location: Contig_ID=SeqID_7424; Location=78..723; Strand=-
  SCN-specific regions: Sequence locations=1-22,51-416,438-443,481 -530,554-646
atgagcagcagcgatttgttggcccacaacagcagcaccagtggctccagcagtggcgcaaccgacaaattggcggtgttcggcggctgcgagggccccgacgcgtgctatgtgatgctggtgagcagtgacggacatgaatttgtcatccgcaaagtgagtgggaccgccaccggagttgagtacgtacaatggaaagtgttggtggggcggaggctcatggcatttcgagatttagaaatacctaaaaaaccaaaaaatttaaagaaatttgaaaaaatttgaaaaaaatccaacgaaaattacttttgtgtttattttaaagtatctttaaaaaaatgccatcagataagctcaaattgcttcaaaaaaaattgaattttctcagagatttttgacatcagcggacggacattctttacaaatttttcctaatattgcgcaaaaaatcaaaaattttattgtaaaaatatttttaatgcaaatttatggtcgctgctcagtgaatataaaacaataaaatgacaccaatccattcattcattcattcattgtcctccttttgcaggagcatgccctgatttcgaagaccatccgagcaatgctttccggccccggccaatacgcggagagcgaaaccaacgaa

SEQ ID NO: 46418 - DNA, 2746 bp, Heterodera glycines
  Genomic contig location: Contig_ID=SeqID_7426; Location=266..3011; Strand=-
  SCN-specific regions: Sequence locations=1-110,132-855,877-1253,1275 -2609,2632-2746
  Gene Ontology: Mol. function=carnitine O-octanoyltransferase activity; Cellular component=endoplasmic reticulum; Biological process=acyl-CoA metabolism
atgatgattaattcgtttgtagagctgttcaatacatcgccgcctccaccacaaactctcccttctctgccggtccctccattggcacagacaacagaaaaatttctcaaatttgctgaacccctcctatccgaagcggagtttagcacaaccgtcaatgtgagcaagaccaaagccaaataaccaattaaatgaaaataattgcgtattgtacataaagtagggctgtgaaatttgattttccggaatcctggaaaaaattatagaaaagttgtcttacaattagaccggacaatccgtaaaaaacccttcccttttaagcttgtcaattgttttctggagagcaaagaagccaatgaattgcaacgcttacttgaacaaagagggcgcaaattggttaattgggtgagtttatttacaatttgattaaatacctctgttttaacatttttaacaaattcgaggttattagtcgcaattatcgctatcggcgttgttcccgatgggattccagtcccattttaattcaaattagggtaaaaatttgtccttttttggtgaaaggcggttacgatttcctgtttttgctctccggcgtcgacagttttaaaattacacgggagaaaaaattttggctcaaagagcaaaaaaaattgtccctcccgaaattttttttggttacgggcctggggggtactcatgcagtttactggatacttttaatatacattttcagatgccaataaacgtgttttagagattaatgaaaataagttttaaggggtttttgaggtcgctgatcacgaatacagcacccatttttgccaatttcgaacccctgttccgaactcgaacaaaaataaaattaaaaaatttgtatggataatatcctcattggcatcttgcccatgaggatattattggtacaggaaaaataaattcgaaaattgtacggatgatatcctcattgcatgagtaccgcctggggttccagcaaacatcttaatacagtctatgtgtccatattctgtgacttgtcagttcgtttagctcactccgtggtggctgaacgttgcttatttggcggcacggactccgctgccaattgtgaccagtccgggcatcacttttcccaaattcgacttcgccgtgcccggcactgaggcgcaattgcaatgcgcggccaaaatggtccaagcggcgctcaaataccaccacaaaatcatcaagtttgattatacttttctcacagattatgtaaaatggagcaaatgtcttgctttttctgcgattttataaattctcaaaatattcggtggcattttaacttttaattttttgcttttaaattttttcattcgttcagcgatcagttaccggtggacaaaggcccgggcggcgtgcccttcgacatgagtcagtacagactaatgttcggcaccactcggatcccgggccatggcacggacacaattcggtatggcaaggaccggccgagttgggcacggcacattttggtcacccgagacggacgtgtgagtgggcgggcggaggacgaaaaatccatggggtggcggggtctcacgggcactttatgggtccgataaatgactaattttcaatttaattggccatagtttttttcttgagcaatgtctacattcatgttcatggtatcaaatgaaaacttaaaagtcatagaattatacttggtttttttcaaaaattttatgggttttatattacaataaaacaaaaagtcgacctttctaattggttttggtgatggtgttatggtactactagtaatatagtttaggtccaaaatgtttctttttttcacatttttattgttaaaattactttcataaataccattgaatcgacctgacgtacggtcacaaattgcctgaattatatccaataaacacataataaggtgttttgccttgaagcaatattaacaatgaaaaatttaaaaaaaaatttgttttccaaccaaaaaaggacctatcggtaaactatcccacaaatggtataatttccattgtaattttgcttccttttttctcatagactttccatgtgccggtgtacgacggggctggcaatccgttgaccattggccaattggtggcacagttgggccatgtgatggcactcgctgaccaacagcaggggaagaaggcacgggccatcaacattgtgtcaagcgatggccgggaaatgtgggccacggtttatgcacgaattcgtggaaagttttttgtttattgggacggtccccgggattgagggctttttatttttgctgaaaattttcgattttctttgttggtaccacctccaagatctacctcactaaaattttcctaaaaatttgtataaatttttccgaaaatccttcaaaattatccggcacggcaccattcagagagggatccgacggaacttggcctggtggaggacgcgctgttcgtcatgtcgttggaccgtcactttgagcatgccgaggacggtggttctgcctcggcgtcgttgcagttcgaccccgacgaccggaacatggcccaggcgttgcacggcggcggcacgcgacagaatgccaacaaccgctggtttgacaagacgttgcagttccatttgaacgagtgtggctacggtggcataacgtatgagcacacgccggcggagggcccaccgctggccatgctgttggacttcatctgcgagcagttgtgaggaa

SEQ ID NO: 46419 - DNA, 489 bp, Heterodera glycines
  Genomic contig location: Contig_ID=SeqID_35189; Location=310..798; Strand=+
  SCN-specific regions: Sequence locations=1-197,223-281,322-489
  Gene Ontology: Mol. function=glutathione synthase activity; Biological process=neurogenesis
gatgcgattaaaaacccagacaattatgtgctgaaaccgagcgaagaaggcggtggaaacaatttttggggcaaaaaaatcacggaaaaactgcaaacctttacaaagcaacaactttcggcatatattttaatgcaacgattgaagccgcttaaaatcaaggtcaacacattgcaattattgcttatacaaattgcaaaaatattaaataaaattaaaaaagccaccgaacaaagacaaaaatgataaaatcgatttatcgattatgcgaatatattgtcattattattttgtatttttcttaaattattttttttatttcagaattatttggtccgtccgcataagcggccggttaagctggtggaagcagtgagtgagctgagcacatttggctaccttattgcagatggtgatactgtatataaaaatgtctccgatgggcatatggtaaacgacggaggaatatttaaaaaagttcaatattga

SEQ ID NO: 46420 - DNA, 1450 bp, Heterodera glycines
  Genomic contig location: Contig_ID=SeqID_7440; Location=1..1450; Strand=-
  SCN-specific regions: Sequence locations=1-122,150-774,817-939,977 -1126,1149-1422,1444-1450
tttgcagatgatgtgaaactatatgtttcatacaaaaaaagaaatgagcgcattaagctaaacacagctttacaaaacattgaaaattgggccagtttaaatggtttaaaaatctcacccgataaaacatttattatattttttggcaaaaacaactctaaacaacaatacaaattatgcaacaaaattatcaatgaggttgaatcgattaatgatttgggtgttttaattgataataagttaaagttttctgatcactatcttaaaattactaaggctgcttatttaaggatcagatatatagccaagtttctaaaatcccgctcaattcgggtatggactactgtttacaagacgtacattcgccccctccttgaatacgcacctgaaatttggaatcctaagttaaaaaaggatatcattaaaattgaaagatgtcaaaaatattttacaaaaattgctctcttcaaatgtagattaattaccttatattccctaccaacaacgtctcagttttttcaagatacaatctttagaggaaagaagaaaagttatagacctagtccaagcatttaaaatagggttgagcggtaccggtaccggtaccggtactggccggtaattaccggtttttttggtaccggtaccggtaccggtaccggttttttcaaaaatgaaattaccgttaccggtttgtctagtaccggtaccgccggtaaaaatttgcactggtaagaatgggggtctggtcgagaaaagagtaggaaattggtgaagaaggagaaatttttgagaaaaaattaaattttatttcatttagtcatgggattacacacatgcacatgtggtgtagtggttaaactttctacctttcataatttttcgcctgggttcaatttcccccacttggatggaaatatccctcccgttttctttaccattattttaattaaaaattttaattttaaaaaatattccaactttttttctttcgatgttaagcaccctaaaaacccaaaacttaatcgaattggtcattttttttacaaattctgttaacaaatcgcgttaaaaattacaaaatttttcccggcggcgcctatcggcaccgccggccctccttgtcccccaaaagtcttggaaaaaacgtgccgcgtaaaaagcggtgttgaaagcgaaaaaaggtcgttgatttacgattaatttacgtggccggagaccccttcacgaaattggaaaattggctgctgaccccttgttttgcgataatctgaattttgaggtctacgtctgaattttagtgttctttatcctgaatttgaaaaaaaaacttggtcaccctcaatatacgtatacttctgaacaattctaatctaaaaaacaggtactcgcgcgaaaactgaataaaaattttgtatttggaaaatttttcctaaaaatttttatgact

SEQ ID NO: 46421 - DNA, 1252 bp, Heterodera glycines
  Genomic contig location: Contig_ID=SeqID_7441; Location=1062..2313; Strand=+
  SCN-specific regions: Sequence locations=1-371,393-1167,1189-1252
  Gene Ontology: Mol. function=microtubule binding; Cellular component =spindle pole; Biological process=meiotic spindle assembly
atgacgcaaatatcttttgtcgccgcaagtgccaccaaatgtgtgatgcttttcgccaagggattgggtgccaaatttactcctcacgtgtcgtttgttgtcccggtgatcttcgacaagttcaaagggaagaaacagttgctcagagatgctctcgtcgagtgcatcgatgtcatcgcagcaaatacagtaaaaatgcataaacaaaattgaatattttacgactttttttagagtttcggtaaactcagcaaggccttactcaatgctctgacatcaaaacagaatctgagtcagaaatcacagacggatttgttcatctaccgcctgttccgttctcttccggccaaagacgttcccaagggtttgctgaaggatttggtggccattctgagcaaagtaacattttatttgattttctacctaattttcagccctttagcatggctttgatgccgcttccgaagtgagggactcttcttttgctgcgttgggtgccattatgaaatgcattggggaaagggacttgtgctgtttcatttcgctcgaattggccaaagatgcgaacaaaatggccaagattgctgaaaaacgtgacactgcttaggtattttttttatttgtttagaaattttcccatatttttgttaaattttagaccatttattttctattttttttacccctttttccatgtatttgataaatgagacactcttcggattcggtatttttggtcatgatgtgttccactttagtgttcacaatatacctatatgttaatattttggtccacggacgctaattgaccattggtgtaacggtaaatcggttccattctcacgggataattccccaattgcttgcaaattatttgcagaatggcactcacactttccatgtgctaatgtgaaaatttacaaactctcccaattcaaagccatcgcagccgctgaacttcaaaagtccactcccgtgcaaaattcgccggctgatttatgggcacctttccagtcattaaataatttcgctgaccatctttttaatttggttttcagctttttgatgcccggttatctgtccactcgtgccgttttccaatgcggcacattttggcatgtcgaaatgcacgcgccacggagcagcagtgcaaagtgacgaactgaacaaattgggggaagggaatttgtttatttgcaggatggagaacaaacacttcaactgctccatcgccaatgccttccctttgtga

SEQ ID NO: 46422 - DNA, 781 bp, Heterodera glycines
  Genomic contig location: Contig_ID=SeqID_35274; Location=488..1268; Strand=+
  SCN-specific regions: Sequence locations=1-173,195-354,376-463,485 -502,535-535,571-580,602-610,634-781
  Gene Ontology: Mol. function=proteasome endopeptidase activity; Cellular component=proteasome regulatory particle (sensu Eukarya); Biological process=ubiquitin-dependent protein catabolism
atggagcgtttattgcgattgggaggccttagtggtttgggagcaggttcattgaacgcaacaccacacgattcgaaccaagttgacacttcggaaactgtttacatcagttcattggctttattaaaaatgctaaaacatggacgagctggcgtcccgatggaggtaactaaaaactaatattttttatatttacacaccaaaaaaagtattaatcaaatccgctgaccgcaaatatcagagacacacacgtgtacgaatttgaaatggttaaatgaatgatattagtgatcagcggatgatttatgtcaaatttaaatgttccttttaggttatgggtttaatgctaggtgaatttgttgatgattatacggttaacgtgattgatgtctttgcaatgccgcagtctgggacggttaatttgtttttttttgtctgctttatttgccgataataattgaattttaagggagtttctgttgaggccgtcgatccagtctttcaggctaaaatgttggatatgcttaaacaaactggaaggcctgagatggttgttggttggtaccattctcacccgggatttggttgttggctttctggggtcgatataaacactcagcagagttttgaggcgttgtctgacagagcagttgctgttgtagttgacccaattcaatctgtgaagggaaaggttgcctttcttattagtttaccggtcaaattacattttaggttgtcatcgatgcttttcgcactattaacccacaggcaattgcactaa

SEQ ID NO: 46423 - DNA, 645 bp, Heterodera glycines
  Genomic contig location: Contig_ID=SeqID_35283; Location=66..710; Strand=+
  SCN-specific regions: Sequence locations=1-233,260-279,302-377,400 -471,495-535,560-645
  Gene Ontology: Mol. function=translation initiation factor activity; Biological process=gametogenesis
tcgttgttcaccccaaacgctccgagttcttccttaacagtcacgtggcgatcaagggcactgcttgtacgccacattacactgttctgcgggacgagaacaatatgtcgatggacacacttcaaacaatggtccattacctctgctttgggcatcaaattgtcacgaagccgacctcattgccctcgccggtgtacatcgccaatgaatatgtgagtcaattcgaataacaataaaaaactacataaataattgaaatcatttaggcgaaacgtggtcgagacatctactcatactacgccaagaacggtattgacaatttggagctcttcgcaaagaggaaaggggtggaatggccgctgcgcactcatgatgacatgaccaaagtcctttctttcctcaacaccaaagacctgagggagctgcgcatcaacgcctgataagttagtgatggatggattatgatgctggtttttgctttccatttgattgttcaactcccctcacctttgcctcttcaattcgtgcatttgctttcgtttcttttggtctttctttgtgcattctcttcttttttggaatgattttttccttctccgtttcattgtaccaatccttttgttgtttattatattctgagcttta

SEQ ID NO: 46424 - DNA, 595 bp, Heterodera glycines
  misc_feature (589)..(589): n is a, c, g, or t
  Genomic contig location: Contig_ID=SeqID_35306; Location=468..1062; Strand=+
  SCN-specific regions: Sequence locations=1-318,340-595
  Gene Ontology: Mol. function=mannose-1-phosphate guanylyltransferase activity; Cellular component=cytoplasm; Biological process=protein modification
atgaaagccttgattttggttggaggttatggcactcggcttagaccgctaaccatcacacaacccaaaccgcttgttgagttcgccaacaaaccgatggtaaatgtagcgcagaaaacaattgctgaatgattttaaccatttgtctttttcgggtggtccaccaaatcgaggcattggccgccgtcggcgtggacaccgtcgttttggcagtcaccgctcgcattgaggaccttttggccggagaaatgcgaaaggaggagcaacgcattggcatcagggtgaaaaactgatttcaaaatttcattttgcaatttatgtttaattttagattgttttttctgtagaggatgagccgatgggcaccgccggtcctttggctttggccagcgatttgttgggcgatacggagcccttttttgtgcttaactcggacgtcatctgcacatttccgttcgccgaaatgatgcactatcacagaaaacatgggcgacagggcacaattgcagtcacaaaagttagttatttctacgtttgtgggggatgcaaaaagttgaaatttttggatttgcataaattaactcactgngactaa

SEQ ID NO: 46425 - DNA, 614 bp, Heterodera glycines
  Genomic contig location: Contig_ID=SeqID_35377; Location=5..618; Strand=-
  SCN-specific regions: Sequence locations=1-614
  Gene Ontology: Mol. function=protein binding; Cellular component =endosome membrane; Biological process=signal transduction
tgtccatgagaaaaatgtgacgtcggtgggcttccaagtggacggtgcgtggatgtacacgggaggggaggattgcatggccaaagttggacacaaaatccgcaaaatttaaattcggcaatgttttttcagatttgggatatgcgcaacaatcagctgaattgccagaggatattccaagtaagatgttgactaaatttgggtgacgagcagtagatgtacgaactttttgaccactatctcaccaaaaaaaaaattcctaaaaaatttcaaacagaaatctttcaagaaaaaaatctgaaactttttcaagtgaaaatttcctgacaataagtttgaattttttttttaaatttttcgcggggaaaatgaaatgcacacaaatttttgtgctttgcatgtttggacccgtttttttgttactatgcgagacaaaattttgctgcgcaatttgctgtcttctgtttcaggtgaacacgccggtgcactccgttgtgctgcatcccaaccaagtggagctgatcgttgccgactccaccggcgccatttatttgtgggatttgcgctccgatcgggacgattcgctgatcaccgaagtggacatgtccgaattt

SEQ ID NO: 46426 - DNA, 2754 bp, Heterodera glycines
  Genomic contig location: Contig_ID=SeqID_7478; Location=3042..5795; Strand=+
  SCN-specific regions: Sequence locations=1-274,297-520,542-608,630 -876,898-1047,1070-1245,1279-1492,1514-1718,1741-2175,2197-2315,2337 -2520,2545-2587,2609-2633,2655-2754
  Gene Ontology: Mol. function=translation initiation factor activity; Cellular component=cytosolic small ribosomal subunit (sensu Eukarya); Biological process=protein biosynthesis
atgcggtataaagtctcctacggaagtgattagcgaaaatctgtaattttttttgaatttactaaaaatgcattttttttcagtgatcccaaagatagttcttgtcgctgtttcacatttagcaataacggcgtctacttcgcttattgtaattcgaataggtaatttacgctgttaaatttccttgttgagtgtatttttttttgttaagcactacaatcgtcgaatcatccactggccgaaaatgtttttccgcagatttgggcaaaactcaatgcattattttttctcctaaagacagttttatggtcacttatgaaccgtaagtcatggctgttaataggttaccctatttgaataaaggtacgtgatctacgggtctcgtaagaattccgatgggtccctcaaaactccgaaccccaacctccgtttctggtcagtgccaaatggcgagctgttggccacagttgttgcagacaaacaggtgcagtttgaaaatactgaattccaatttcaagacaaaaacttaaatttattaaggcagtttggaagccttacttttccgctgatgagtccttaatgttgcgggtgcttggttcggaagttcatttcttcaaaaatggaaattttggttcgttgaatatcaattattaaatcggtcgtggtttagcaaaggctgcacacaaagttgtggtcaaagacatcgcttccttttcgattagcccgggcacggcaatgccgcacttcgcctgtttcattccatcaaaggtagcgcaactgttgcaaatacttttggttacttttggaatatcaaaggattgtcatttggtccatcaattctgtctgtggttattgtgtgaaaaaaaagttaaagggaacccaaaaaactacatttttgttgtactttgaaacttggggaaaagcatatagagatagcaaacgatacgaagaatctcgtattttattccaaaaaaagtcattaaatttgttttatccttacttttcatggttctgtaaatttttttaggatagggtaaatgcaatggagcatggttttcagtgattttctcgcatcgtccccattgtatgcactgttttccatttcttagaatcaaccggcgatgattcagcttcgaagtctttccgactcgttggaggttctcttctccaaggcgtcgttcacttgcgaccgttgcattatgaattggaactcgaagggtctgtggtcattctgtcactgcttcaattccttcccttttaagggaatgctctgctggtgaccgcttctgttgacgtggacaaatccaacaaagtttccaatgtcttttttacctcattttcaattctttctgtcaagtcgtattacggggtcagccatttgtactgtcttcttaccaaatcgtatggcgattgtttcaatgtactgtgactttggtgtagtgccaatcaaacgaaattaatttaggtcactttgaataagcaagggccggtgcattgtgttcaatgggccccaaattcaaaagagttttgtgtttgctatggttttatgccttcaaaggtttgcaaatatcgacaaactttgtttcctcctacgctttttaggtttcaattttcaacacccgtggcgacaccgtttgggagctcagcgaagggcaccgcaacgaagtgtacttcaacccacagagcacaattctggtcacttgtggcttcggaaacattgcttctggcaagatggagttttggaatttggaaacccgaagcgaaatctgtgcattttgtgctcctcacacgactcactttgaatgggcaccggacggacagcacatttggtgattttttggttttgtccgtttcgcgtttattttttcttaatatttatatcctgatacagtaattagtgttaatgaaatacgtaaaatcgactagaatcttttttttctgataagcctttataattaaatcgttttttttgaagcacgtcgaccacagcgccaagactcaggacagacaacggatttaaactttggacatatcggggcgattttgtttatgaacaaaaatacgatcgagaggaactttgggaggttcgctttatgtccaaaaaaaagaaaatgaaatcgcatgttcatttaatagcccccccccccccaccaccgaaaactaaaagattaaagtttaaatgaaattttgttatttggaaacgatgaggtccaaactcatctttttcaagaacctgaataccattcaacctccaatcacagttaaaagcattacccattttgttcgctttcagatcaaatggcgaccgtgcgcagcgtataacaaattcaaaattgaggagcccaacagagagcaaagtacatcaaattccagccgaataaacgacggaaatgccaaaacgcccttcgacaatttgccgaagggatcgctgacgcaaacggcgcgttacgtcccaccgcatctgagaggtgtctcgagaaaagtgaaacggtggaaatttacaaattcaggaaaaccgcagaaaaaggaagaaaaagggaagaacgagacaaattcggaagagacggacgtggggaagaaaattcggacattgcagaagaaattggacgatatttcgaagctgaagacgaaaagggccgcgggccatcagttggagttgaaccaaatggacaaaatacgcaacgaagaacgattgctggaggaaatggaacgactgacggccacggccaactgctgaaagaattagcatttaat

SEQ ID NO: 46427 - DNA, 1027 bp, Heterodera glycines
  misc_feature (113)..(113): n is a, c, g, or t
  misc_feature (131)..(131): n is a, c, g, or t
  Genomic contig location: Contig_ID=SeqID_35392; Location=1..1027; Strand=-
  SCN-specific regions: Sequence locations=1-12,49-131,154-374,396 -641,663-669,691-1027
aaggaatcagttattttccctcttttcaaaaaaggggattaaatttaatcctaaaaattataggcctatttctataccctgctcactttgcagggtatgaaagaaaattctangcaggaatattacaaatnttctactaaaaaacaacaaaatttcggaatatcaattggtttttgttaggaataggtctacaacgagtcaactaataacagttgtggaagattgtacgatgcaattattaatggaaaaaatgttgactgtatttacattgattttcagaaagcttttgactcagtgccccataatttactgttatacaaattggaaaaaattggtatacggggcaaacttttaatgtggcaaacttttaatgtggataaaaagctttttgagtaataggacttttcgtgttaaaattggggattctttatcctcaagtaaaaaagttggctctggcgtcccccagggctctgtccttggacctttattatttttgatttatattaacgatcttcctgatgccttaccatcaggagtgaatattaaattatatgctgatgatgttaaaatgtatatatcctataaagcaagatccgacttataaattatgcacaaagcattgcataatttattcgaatggaaataaatggcaaataaaagtttcagttcaaaaaacttttttattatatttgggttcaaaaacatataaatttgatgggaatacaataaatgctgtggatacaattagggatttatgagtaaacattgattacaaattacaattttccgatcatattaaccaaataacaaggaatgcgtatttacgtatgcgttccttgtttcgaataattaaatccaaatcgtctaaaatttggattacgttatataaaacttatattaggcctttattggaatacgctcaggaggtttggaatccgtctcttcaaaaaaacattaaaaaaattgaaaagtgtcaaaaatatttcaccaaaagggtattttaaatgcaaccttccaccaattccat

SEQ ID NO: 46428 - DNA, 713 bp, Heterodera glycines
  Genomic contig location: Contig_ID=SeqID_35398; Location=393..1105; Strand=-
  SCN-specific regions: Sequence locations=1-68,90-451,473-713
  Gene Ontology: Mol. function=glutathione synthase activity; Biological process=MAPKKK cascade
atggttgaacgatttttcccaaaccctgaagaagcgccattaattaaagccatccgagatacgtttgcaaaaatgtggagaattgaagggaatgagaacaatcaggcattttctgagcttattgaagtaaaagaataaattaaaatgcattataaatgtgattaaagtttcattaattgttttcattttagagagtcaaaaaacagccaaataattttgtaatgaaattaactgaatatgcattatcggacgcattgaataacaatgaagtgaagaaaatttattttggcgaagaaattctcgaagctttggcaagtttcgatgctgacaaacgctcggcatacattttgatggaaaaattacggccgatgtctgtgaaggtaaagtcgggaaaatgcatcaattgtgagcttaattttaaaagtcagtttcaattttcaaattcttaaaataattttataaattcatttatgcaaattcagaatcacattatttgggcagaggacggagaagaaagcagcggagaagactttttagaagacgtgaccccggaattgggaatttttggcactttgctcggcaacattgtcaacggtgaagtattgtacaatgcgcaatttggccatcagctgaagaccaaattggccagcgaaaatgcgcgtggcataacaactggaaattgtgcttttgatacggcatatttggtggactga

SEQ ID NO: 46429 - DNA, 977 bp, Heterodera glycines
  Genomic contig location: Contig_ID=SeqID_35405; Location=379..1355; Strand=+
  SCN-specific regions: Sequence locations=1-253,275-699,721-798,820-977
  Gene Ontology: Mol. function=casein kinase I activity; Cellular component=bud neck; Biological process=signal transduction
atgaccaagctgaacacccttcgagacggagacgagaagcacttctgccgctgcttggacctcgggcgcgatgagcaaaaggaccaacaatcgggacaaatgaagaagttcaactacatcgtcatgtcactcgtcggtcgtggcctggacggagtcgtcaaggatgccggtggccgcctcagccttggaagcgcagtcggcgtctcgatccagatgctcgccgctctcagaggactccacaccgtcggctacctccaccgcgacatcaagccgggcaactcgaccatcggacgtccggaatcaaacgaaatccgcctgctctacctgatcgacttcggaatggcgcgcaaatacaccaaggacgacgtgagtttgagtgaagcgctttgaaaaaaacaaaattaatttccctttaccctttttcagggcgcccaccgccgcccgcgcgctgcaaccatcttccgtggaagcccccgctatgcatcgattgccgctcatctcggactcgaatacagccgcaaggacgacatcgaatcgtggttctactgcatgatcgagctcttcaaaggcgcacttccatgggccaacgtgggggaaacgaaagaggtgagcgaatgggggggagggataatcagaattctgatttcattgtttttttcagatcggcgaggcaaagatcaaacgccagaagaaacaaccggaagccgttcgacaccaggcaatcgccgacttgctctccggatgcccgaacgagttcggccaggtcctcaaatacatcgtgagttcgttcgttttttcaaaattaaaaactaacaaattaaattttgcaggacatgaagtacaacgacaagcccgactacgactggatcatcgcgacattgcgcaacagcctcagcaacgccggcgtccaggaattcccctacgactgggagacgacggacaaaaccacgccgcaggtttcgagttacttcacctga

SEQ ID NO: 46430 - DNA, 841 bp, Heterodera glycines
  misc_feature (804)..(804): n is a, c, g, or t
  Genomic contig location: Contig_ID=SeqID_35417; Location=5..845; Strand=+
  SCN-specific regions: Sequence locations=1-143,166-166,188-444,466 -500,537-565,587-841
  Gene Ontology: Mol. function=proteasome endopeptidase activity; Cellular component=proteasome regulatory particle (sensu Eukarya); Biological process=protein deubiquitination
accaacgaagcaggaaattggtgtttgattgaaagtgaccctggccttttcacagaattggtaatgttatcagacacgcttttctgaaactatttttttcaattctcgagaatttaactttcggttaataccaaaaatgcaggcatttttccggaaaaaaggtttaaattttccattttccccttttagataagtgggttgggtgtcaaaggaacacaagttgaggagctgtactccattgacgatgagcagcatctgtccagcttaaggtcagtctccctccctttttcccgccatttttcttttatttatctttttcatttttagacccatttacggtctcattttcctcttcaaatggcgtcccggcgaagaattggagggcactccgatgcccgacgcccccgtgtactttgcccagcaggtgggcgctttttcaaagcattttttccaatttaaaacaaatgtatcagaaaagaattttggagaaaccaattcacataaaaaattatttaaataatttatactaaaatattcggtgttttcccgttttggagcgcacgccaaaaatttaaaaaaaaattaacaaaaatgcgtgccaattttcgtgcctttctgtggttttttttgtgtgtgaaccccaaaacaggaaaattgtgtaccaaccattctactatgcatttcttatacatacttcctgggaccacaattaatttttattaattcctccatttttccccaattccatcgtcgcattgttttcttcaggtgatcacaaatgcgtgtgcctcccaagcactgatncaccttttgctgaacattttcgtcgtccgatgttcaa

SEQ ID NO: 46431 - DNA, 1637 bp, Heterodera glycines
  Genomic contig location: Contig_ID=SeqID_7489; Location=2043..3679; Strand=-
  SCN-specific regions: Sequence locations=1-688,710-1103,1125 -1505,1530-1555,1577-1637
atggccttccacaaaatcgacaatgattcagtgaattcaatcaccaatgctttggactttttccgtattccgcccacaaatgtgagcgtctcgtcatccaaagtgtttgaactgctccctagcaaccctctgaccgacacaccgtatcacttcaaacttcactccagccaaaattatattgatctttcaaaatgctatttgctcaccgagttcagaatccggaaggaaaacgttaatggccagctcattgacatgaaagctgacgacctacacattgcaccgatccaaatgataggccaaactttcattcgtaatattaaaatgagcatcaatgggcgtgaaatttttaattcaaatgctcttatggcctataagacatatttctcgcacgaactctcctattccactacggcaaaggactcccatctgaatgctgcgggctattatcgggacacaggtgatgcacttgagacaggagacgggtgcatcgcgcggcgtaatttgtttgctaacagcaacgtggctcaattcattgccaaaattgacaccgacttatttaaccaaccgttgtatctgattaatttttgtgaattggacattgaaattttgcctcatgacaacgactttgtgctaattgctccgacagcgggtgcaccccgctatcattttgaggttttgggtttgaaaatgtatgtgaagaaagtttctctaatggatggcttagcattggacattgcgcgaaagcttgaactgaagcctgcccgttatgcagtgaggaaaacaatgatgaaatcaatgttcatcagtccgggtcgatatgagtttacagccaatttgttcatggaccaaattccccgtcgtgtaacaatgggattggtggctaatactgactatgtcggtacaattagacgcagcccattcaattttcaacctttcaatgtgcgcgaaatttccattgttgccagcggacgctcttatccacaagcgccctacgacctggactacccaaacggaaagtatattcgccctttcaatgacatgaatgaagcagtggggtttgcaaactcatccgagagcaacggtataacttttgcccaatacggtaaaacacactgcatttacgtgttcaatttgaccaacagcggagacgatcaagcgacattgtttgattttgatcaagaatgggactaccgctgtgagcataaaatttaaccagccagtgccagaaggtggaataatgctggtggtgatgggagaatgtgattcacttgtgatgttagacaaaaatagatcaataagcacagacactactatttaaacggtttgtcatttcatttgtgcacaaataaaaatgttttcaaaaaaagtgagttttattttgttcattctccgagtttctcttcccgttgtctgtttatatccagagcagccgccgcaaaaacaacctgacttttattatgcagagtacctaaaaagtttatcattatcaagactttctactactgcaacaacaacaacaaatccaagaatattcgctcgatcaactaaaccatcagctgtcaccaccacctccatcacaacctttaccccaactacctttagctcttccacaacgactccaaaaagtgaaaaattaa

SEQ ID NO: 46432 - DNA, 589 bp, Heterodera glycines
  Genomic contig location: Contig_ID=SeqID_7507; Location=700..1288; Strand=+
  SCN-specific regions: Sequence locations=1-36,58-63,86-237,259-589
  Gene Ontology: Mol. function=DNA primase activity; Cellular component= alpha DNA polymerase:primase complex; Biological process =embryogenesis and morphogenesis
atgaaatttgcttatccgcaactcgacgcaaaagtcactgctgggtgagtcagttaaagacaaattaaaatggaaaaaatttaaaagcatcttcggagcattccgaatcccgaacctgaattcgaacaaagagttgaaattttcgatcttttctttaatgatggcggttgatgcaattctaatacatttagtttgaattcgaaagtaaatcttttctaacaataagcataaatttaaatttacaaatttgaattatccattgtatttagttcaaatccagtttaggggttcgtaattgcacgaaaagaatgcccattcgagatgagagacccttaaaaaaatttttcaaaaaaattccaggctcaaccatttgctgaaatcgcccttctctgttcatccagaaaatggaaatgttgccgttccgttgagtgccaaagaaatccgtgcctttgatccgaatgtggtgccacgaattgataaattgttggcacaacttgcctcattgcaatccagccaagaaaacaaggagaatcagcgttcaattggtaaaaagttttaccggcaaataaccagagattgcttttattag

SEQ ID NO: 46433 - DNA, 757 bp, Heterodera glycines
  Genomic contig location: Contig_ID=SeqID_35549; Location=102..858; Strand=+
  SCN-specific regions: Sequence locations=1-129,307-378,400-441,618 -630,652-757
  Gene Ontology: Mol. function=helicase activity; Cellular component =cell wall (sensu Fungi)
atgttttatcaaacggtgtgccttcttttgctgttgagcgcatcgaatgatgttgcggtttttggacaggaagaaacaaccacaacatcgactagtagtacaagtacgagcacaactagttcaaccagtacatcgaccacaccaactacaacatcttcaaccagtacatcaactacaccgagcacaacaacttcttcaaccagcacatctacatcaactacgccaactacaacttcgtcgactagtacatcaactaccccgacaacaacttcttcaaccagtacatcgacgactcccactacaacatcttcaaccagtacatcaactacaccgagcacaacaacttcttcaaccagcacatctacatcaactacgccaactacaacttcgtcgactagtacatcaactaccccgacaacaacttcttcaaccagtacatcgaccactcccactacaacttcttcaaccagtacttcaaccacacccactacaacttcttcaactagtacatcgaccacgcccactactacttcttcaaccagtacatcgaccactcccactactacttcatcaaccagtacatcgaccactcccactactacttcttcaaccagtacatcaaccacacccactacaacttcgtcgactagtacttcaactacatcgagtacgacttcgtcaaccagtacatcgtctacatccagtacaacttcatctaccagtacatcaactactccgagtacaacttcttcagcaa

SEQ ID NO: 46434 - DNA, 1112 bp, Heterodera glycines
  Genomic contig location: Contig_ID=SeqID_7519; Location=2749..3860; Strand=+
  SCN-specific regions: Sequence locations=1-736,759-780,802-1112
atggacgagctgggcgaacaatgtgccaccttttccgacccaatgcccgccgatccgcccaaactttgggtggcgtggctttacaccgatttttacgggtcgggacgaaagatcaggtgaacggacacggaaaaattcatttaattatttagcttttgggttaatacttaagatggtgcgggttcccttttgaaaaaatccagttttgtgataaaacattcgttcccttttttgaaaaatatccagttttttttcgtgataagacattctaagttttcggggttgaataaccgaatccagcatctatttcgtatcgaaccctgattattcggataaaaaattgaattcaagtttttcgagtttcaatttaaatcatatttgactacacggaaacgaactgaaattcttcaaaaagataatttaaactttcaaaatagttgaattttcatgttttgttcgagtccgggtccggtgttcaatataggccgaaatagaacagatgtcgggttcggattatctgacccagaaaactcttattatgtttttatcactaaaaatcaaaaaagggatccccaccatctaaagttttaccattttttgttttagggaccaggtgacaaagcttttcggcaaagacgcgaaaccgggcgaaatgcaagtgttcaaaaacacactgtcgaccaacaaacagttatggaagataaagcatctgctcgaaatacggccggtaacatttccaaacggagagccggggcaggaagatgcgacacatttggaggtgaaaagcaaattggaaagcgaaattggcaaatgtcttttaagaaattttagcaacaaataatggcaactgtaaacaatgtaaatgtttagataatggcagatggacgctgtgtaatcagccggcaaagtttgcctaatgtcgacgactttcaactgattgactacagcaagcagttcaggttgaattacgacaactgattcgtacggcttttacgccaacccacaaatttagcccgcgttatttggcttctcgactgatgtcaaaggacgtgaccaagcaggacgtgtacgaggacaccgtctacaacccagaaaatatcagcattggatga

SEQ ID NO: 46435 - DNA, 320 bp, Heterodera glycines
  Genomic contig location: Contig_ID=SeqID_35598; Location=167..486; Strand=-
  SCN-specific regions: Sequence locations=1-289,311-320
tttcagcaatttttttcctaattggtactcaactgagagtaaattaaatggttcacgaaaacatccattggtcccggccacgcaaatttgggcctggctcgcgctcgtgtcgcgtatgtttcagtcatcatggactcattcgaaaatattcactgaacatttgccgtcgctgcttccgcgaatacgcctccgacattggattcaagaaactcgattgaattgatggagaaagcccgagtatttttcattgttttcccggaagcattgttatcaatcacaaattattgttgaattttttgttttgataaatcaaaaagtta

SEQ ID NO: 46436 - DNA, 1357 bp, Heterodera glycines
  Genomic contig location: Contig_ID=SeqID_7529; Location=1..1357; Strand=-
  SCN-specific regions: Sequence locations=1-14,36-94,116-178,203 -350,372-665,688-731,783-923,960-1199,1221-1357
  Gene Ontology: Mol. function=ATP binding; Cellular component=integral to plasma membrane; Biological process=N signaling pathway
gctctacggaagtttgtctgaatgggttttgcatgaacgaccagaacggcagtcattgccaatgccaaacggggtggaaaggacaaaggtgccaagaggacattgacgagtgccaactgagcgaaaaattgtgccaaaatggcgggaaatgcgtgaacaccgtaatcacccattatcattattttgtttttataattttaaacccaacagattggcggcttttactgcgagtgtccatcggactttgtcggctatctctgtgaagtgccgcaccgtcccactgacccatgcctggccaaccattttccctgcttaaatggtgcccaatgccacgagaacattgtggccacaactgcagtttgggcattggacgcgcattttgactggcgctgggaatgcgaatgtttgcccggctttgagggtactttgaaaattgaaaaatttaattcaaaattaatattttgccattatggattctcaccttttaaattgccattcaggcaaacattgtgagcgtgccgttgacgagtgcgacatgggcatgatgacatgtttgaacggcggcaaatgtgcacacgcgtgggccgaagacgtgcgcgatgggaatggcattgtggtggagaggaattggcacgcgtcgcagtgcaaatgcatgcacggctttgaaggtgggtgaggaagggcatgggggagggggacagataaaattggggggggggggtaattagggcaaaatttatattataaaaaataattataatttaaagaaattgaattttattgcaggtgatttttgtgagcaggacatcaacgaatgtgaacggtttggcgccactttgtgcaaaaacgggggcacttgtgtgaatcggcacggctcctacatgtgcatttgcgttggcggattcgttggtgaatttgcactgattttaaattttattgtgttttttttaatttaatttcaggcaaattttgtgagatcaacattgacgactgtgtggataatttgtgttacgccggctcaacatgcgtggatggcattgctcggtacgattgccgttgtgcgccggaccgaattggtacaaaatgccagaaatttacaaaagcaattaactaccaaacaattaggtgctttgtgcgaatttcaaaacatttgcaatatccacgaaaatctgtgcgaacatggccattgttttacgaatccgttcaacggaagctacacatgcttatgcgatgagggatggaaggtggaaaaacagaaaattatgatttcaaattgcaatttcaaatgaatttttaagggccaaaattgcacggatgacgtggacgaatgttcggatgagatgacgcgttgtttcaa

SEQ ID NO: 46437 - DNA, 569 bp, Heterodera glycines
  Genomic contig location: Contig_ID=SeqID_35618; Location=1..569; Strand=-
  SCN-specific regions: Sequence locations=1-125,151-569
  Gene Ontology: Mol. function=long-chain-fatty-acid-CoA-ligase activity; Cellular component=lipid particle; Biological process =gametogenesis
aaactcttggaaaagatggggtcgaaaaggataaactctgaatgaggcccatttccttaataaaaagcaaataagtgcttttgataagccaaaaaaaaaaatctcagtcatagcgaaggaccaaatttctctttgttttctctttttctgcactgacaatccactgaacagctttaactttttaattacagcaaaactcgagcgaaatgtggaaccggacgacttggctatgatcatgtacacgagtggcagcaccggaaagccgaaaggagtgctcttgtcgcaccgcaacatcatcacggcggcatcgggacagagcgctgtcatttcagtcaggtgaataagcaggaaacaattagtccagactgcagacaattcagtaccagcgacacaattatcggctatttgccgttggcacatattcttgaagtgtgtgccgaaatcgtttgcctgtccaaagggtgccgagtcggttactcatcgcccagcactttgcacgaccgtgccgtgaagattaagaggggaaccactggcgattgcgtcgaactgaagccgactttgattgcttg

SEQ ID NO: 46438 - DNA, 596 bp, Heterodera glycines
  Genomic contig location: Contig_ID=SeqID_35637; Location=243..838; Strand=-
  SCN-specific regions: Sequence locations=1-332,354-596
  Gene Ontology: Biological process=embryogenesis and morphogenesis
aataacatggacccccagcgatgtaagtcggctatcgcctcttcatttgatcggcggaggattaagtcggatttgaccatcccttcccatttcatatgacatgtttgccgtttcgcctgccaacaaattctcgaggttcacaaattgtcgctgtttcttttgtcagttcgttcttttcgtttcagttacggcgttcgctacgacttctccagcgttatgcattacgacagcaaaattgcggcacgtcaatttgggatgaaaacgatgacggcaaaagtgaacccggaagagaacgacgcaaagatgggacagcgcgagggactgtccccgtcggacgcggaggcactgagcaaaatgtactgcaggccgaagggtgcgttgcttaatcagccaatcaatgcggaaacaatggatgaatcgatcggattcatcgattgataaaaatacaaatcaaatgattgatcagtcaatgcctttgagaatgtgtcgacgccaacgtttactgcgggacatgggcgactcagaacagatgctaccaaaacggaagtgcgaatgtttggatggcgaataattgtcaaaaatcgtgtgctttctgc

SEQ ID NO: 46439 - DNA, 4323 bp, Heterodera glycines
  Genomic contig location: Contig_ID=SeqID_7538; Location=1..4323; Strand=+
  SCN-specific regions: Sequence locations=1-186,208-686,717-930,958 -1216,1238-1249,1272-1415,1437-1496,1520-1749,1780-1780,1807 -1898,1930-1989,2020-2296,2318-2374,2400-2414,2436-2509,2532 -2713,2736-4134,4164-4323
  Gene Ontology: Mol. function=chitin synthase activity; Cellular component=contractile ring (sensu Saccharomyces); Biological process= reproduction
ggaattcttcttgttccagctgtttcgagacttgtttcctttgggttagcaagcccaaagcattcgtgtggcttcgcgattcttgttctcgaacgccctatgttgggaaatgctttttcaatgtcagcaaggatgtcttttttccatgcgtctgaaccgaaggagaatgccgatcaggtctttcaaaagtagcgggcctgtgtgcaggcattcgttgagtgtggggggggggggggagaaggaataaacaaaaggaccttggtttggagagagggaccacttacattgacaacaatgacactttttctcacaagcaatttaattttcttcctatttttttgaatgatccgacagtaggccgatatgccggatttttttttgaatatttaggtaaatagagttaatcctgaagtaaaacatgcatttggagttagatggtgcagaagaacaaacacgttacagtatattttcgtactcgttcaaatgctcaattttgtttctttctgtgctgcgttctttagacgcgcaacagaaaatgagaactgagggggggggggggaagagatgggaagagggcgatagaagaaagtgagtgaagcagtcaatgaaaatgagcaaagtaaattatttaaatggaatcaatcaaaatcttatgcattttagcgtggatttaccaaacaaacaaaaagagaggggaaaaggaggaaaaggggggaccacccacacaaaaaaacaagggaaaagtgaatgcatttgagggcgttaaatttgtgtgtgcaaagggtacggtcgaggcgagggagggaggcccgcccaaaaaacacgacggacgcttcattcatttgcaaagggtgccaacattcaaaatgcgattggttggcttattttcactcctactaaaacacattttccggaaattattgaattttgttgtgatttgttaaatatttcacaaatttttggttaagaaattggcaaattctttcgttcccccttccctcatttataatcgtctcttcttccttctccgctgttgatgatggcacgcaatgtttaaaagcagcagcaacagcagtgtgccaaaatgcggtcaacttttactcagatgacccgaaagcggcgatggcaatcgaaaaatggatgaaacatctgctgtcgttgctgctgcgccgttcgttgcattgaggggattgttaattgtaagtttacaaaaatattcttctcctcatcaacagatgcctccaggcccccggggattttaaaggaaaggaaagaatttttattaattttaaatgggtgacgattggatgactaacgatttaacttaaacaacgttgaataagggacataaggcgttaatataagcagccaccgtgacattagtgacaaacaaccaatcaatcgttaatacgaatgtgatgtggtgtggtggggttccttccattcggagcaagccaatgattccaacgcctccaacttttccaccacctctcgctttatcaataataaaaattaaattgtcctctgtgacattgttaatttcggattatccgtatataaattgtacgccatgaacaattggatgtcatagaattgctttagattggcaaaaatgagtctcaaaagcttggtgggataactcaaagcaccaaaccggccggaacaaaccgaagcaaaaacacttaagtgccaccctcactcattcagtttccaatacacaaaactccccccccccccaacacaaagccccttaatttggtaaaatggatagaagggggattgtccaaacaaacaaacaaaaattattccccttttcagttgacataagaaaatgcaaagacacctaccgtcatcctcatcagcatcctgctgcactaccacctgctgttgaacatcgacaacagcttcagcagcagcaacaacatcatccgaaccaccatcgccaccaccgttgtccatgtccaccatcggttgctgttgttggtcgcccatttccacctcctcttcctcctccaccgcttcgtccgcattgtccatgtgcggcggcgatgtgcgcggctcgtcacaaccgccggtggtgaccagttcgtccaagtcgcgctcatcaaaagcaagcggcgacacactctccgaacttttgacacgctccactgctgcgcgacgatcagcactcaatggcggcggcgtttgctggccatcggctgcagatgcaacgggagaagaagcggcacccggaacagcaacggtagcaacaccatcatcaccagaagtagagggatcttccggcggttgttgttgctcctcttcctcctgctccccaactccgtgcatttgaaccgtttccggtgtcagctgacggtgaccatgcgcaagtcgttgttgttgttgatgttccttcttcgtttccatggcacttaaaatggcaaaatttagttgtgagtggaaaaacgcgcacaaattgtgtgcctcaatgtatacagtaaaccccgggacagtagtaagtttgccatttgccaatgaaaaatatgttttctatgcggtgcgatgaatcacaccgaccgagaaagggaggataacaaaaaactttttgcttcactggacctaacgtgggaaaaacattaccattactatcacccaccacccatccgttccccctgccctcacgacgcatttatgtcatcatgccaactaaaggtggatgttcacaggtgagaaggaaatgacgctgaaacagtaactcagtcgatccctctagcagacatatttgcgtatgggagtggtcaagccgcccaccccccctcgaaccgcacatgcacagccgtattcttctgaacactccgtacggaggtcgacttgtgctggcgcttgaatgtagggctcacttctttttgtgcatctcaaagacaaacgtttgatccgacacaaaaagcgttggtcgcaagtgatgtacatgtactttttgctcgggcatcgaattatggactcacatttgagcgtataagacaaacaattgcaggtcttttgagcctaaattttgccctcgtggaatctgtgcaataattcaatgttcgcaccgatgcttaggctgacaacacatatattctcgccattgatggcgattccaaattcgaaccagcggcagtgattcgtcttttacatctgatgaacttgaaaagcgacgttggctgtgcgtgcggaagaatccatccgattggagaaggtgtgctatccttcccattaatggtgaatttcttaccattccccaggggtcatggtttggtaccaaaagttcgagtacgcaatcgcccattggttccaaaaggctgctgagcatgtgttcggctgtgttttgtgtgcccccggttgcttctctctgtttcgtgcttctgctctcatggatgacaatgtgatgcacaaatacaccaaaactgcctccgaaccacgacattttgttcaatacgaccaaggggaagaccgttggctttccactttgcttcttaagcaggtccaattgcctttcttttttcggaataataaccattttaagggttatcgggttgaatacgccgctgcttctgacgccgagacttatgcgcctgaagggtttgaggaatttttcaaccagagacggaggtggacgccttcttccatcgcaaatacgctcgatcttttagcggattacaaagttttggatgccattgactttttcatcattatttttagcttgcatcaagcaacaatgccagcatctctcggctgtacattctctatcaaatggtcgtcatcgttttctctttgcttggacctgccatcattttcactatgcttgtctatgcacaggttattatatgacaaattctatttaattgctacaaattaatgctcgagcgtatgaccggtggtttttcaggtggcggcctttgccgttgattcgacgagagtgctcttctacaatgcagttccggtgtgcggcttcatcttctgctgcttcaccatggattcgtccgtacagcttacctacgccaaaattgcttccgtcatttacgccttcataatgctggccgtccttatcgccaccacaaaccaaatcgtattggagacagtcttttcgcccacctccatgttcgtgttgggcatggtgctgatcttctcctttgcctcctgcatccacccgaaggaattcgccaacattatttatggttcgatcttcttcctgatgatcccttccacttatgtcttcctctcgctgtactcattgatcaatttgaacgtgattaattggggcactcgtgaagccgtagcaaaagcgacagggcaggcgac

SEQ ID NO: 46440 - DNA, 1728 bp, Heterodera glycines
  Genomic contig location: Contig_ID=SeqID_7545; Location=65..1792; Strand=-
  SCN-specific regions: Sequence locations=1-68,106-257,509-785,830 -915,937-955,996-1145,1169-1425,1465-1619,1693-1728
  Gene Ontology: Mol. function=ammonium transporter activity; Cellular component=integral to plasma membrane; Biological process=transport
atgccatgccgtccgcaattccccttggcaatgtggccgcagcggaggcacagcgaaaatacacaggcaaaaataataaataaataatatttaaattaaaaaatagagttgaaagcgtagtttttcagatttccaagatgtgcacggcactttgatcatcggatttgggtttttggtcgcttttttgcgccgctacggcttcgcatcgttcaccatctcaatgatgctgacttcgttcacattggaattatcggtagaataaataaacattaaaaaaattattattttgttttaaaagaaaaacaatattttaattaaaaatttgatttttacatataaactaaaaaatttaattaaaacattttaattaaaatttattataatatttattattaaacacattcactaaaatatttaaaattaaaatagattattatacaacttgtttcaaatcaaaaattttaataagtgtattttataattttaaaaaagtttaaattaataaattctctagaattaaaacctttttacagctccttgtccgcggcttcctcaccgacgaatttgccaccaatggcaaattttacgtcaatttgcagaagtaattaatattatttcccatccaaataattgaattgcttttaattgaaaaacactcaatttacagtatgataaatgctgattatacggctgcggttgtgctgatttcatacggtgccctgtgcggcaaattgtcgccaatgcaatatttgttgatggcactgattgaagcgccattttcggtgaattttaaataataaaaatgataatttgaaaatatcattaaaatcgaattaagattttcaacgagtacatccttgtgaagatgttgggagtccaggacattggagggtatttaaaattaatttgttggaaaattttaaataatttcaaaaatctcacttttttgaaattgtatttttaaataatttacttttatatttttaattattaaagctcaatggtgattcatgtgttcggtgctgttttcggccttgttgctggacgcattctgtacaacaagaattggcgtgaaagtgaacattttggcagtgtttaccactctgacattttgacatttattggtgagttgagttagctaatcaacaagttaattaaggggcaattagcacattttattataagccggtttcagtaccaagaatgtcagactcgacctcttatactagttgaattagcacacattatcggttgtttgatttagcaaccggctttttgtgggtgttttggccatcattcaatgccacaaatgcctttggcgtggatgcgcgaaaccgtgccattgtcaacacttacaccgcactgatcggaagcacaattactgccttcattctctcctcatttttcagtaaaaatgaggtgtggttttaaataaataaattgaattattgtataaatatttttgtttgtttttatctcatggacaatgggcaatcactttatttatcaaacaattgccaaatgattcgacaaattttgaaatgatcgatatcgaaaaaaccgaaaaagggaaattactcgatcgattttttttgacaaaatgtcaattgtgccgtctcttatttttaaaataaaattatgcacttaattaaaacaaaaatttaatagtaaaaaaaatttcttaaaaatattcattttcagaaattcaacattcgtcatcttaccaac

SEQ ID NO: 46441 - DNA, 1186 bp, Heterodera glycines
  Genomic contig location: Contig_ID=SeqID_972; Location=3738..4923; Strand=+
  SCN-specific regions: Sequence locations=1-969,991-1070,1092-1186
  Gene Ontology: Cellular component=nucleolus; Biological process=RNA processing
atgggagaaagtgaagatggcaaagccgacgacgaacagagcattttgagcgcaggggaggaatcggaaatggacgcggggaacgatgacgacgacggcacggacgaagcggcacgcgaacgcttccgtcagcaacgagaaaatttgcaatggccggacgaggtggagacaccgcgggatatctccgcgagggagcgattccaacgctaccgaggcctgaaaagttttaggcaagttacaacaccaacagcaaaaaggaactaattgtaggatttttcaaccatcaggacgagtccttgggaccccaaggaaaatttgccgcatgactatgctcgcatttacaaatttgtcgatttcaaacggacccgaaaattagcttttgccgaggctcaagaagcatttaaaacaaacacaacgggtgaatttgcacatcctggcacatacgttacgctgcacattgcaaatatgccgcgacgaattctcggtgaactttcaattgattcttgttggttttaagccttttctgcagattttatgggtccctcgtcgcctccgctggtcatctacggtttgctcaggcatgagcatcgcatgaccgttctaaacgtcgtcctccaaaagcaccaattcggctcaaacgcggtcatcaaaagcaaagaccgactcattttccaagtcggctgtcgtcgctttgccgcctcacctttattttcacagaacacaaacggccaaaaattcaaggttctcgttttaagaagcgattggcacttgcaaattaacatttccattctttttcagttggaacgctttatgccttcccagggcgctttttgtgccactctttttgcccccgtcacttacccaccgacgaatgtcaccgttttccttgctcacaattcacaacccgcggaactcgtggcgtatggaattttactcaatgtcaaccccgaccgcatagttctgaaacggactgttttgtctgggcacccgtacaaagtgaacaagaggacagctgtggtacggtatatgttctacaacagaggtcggtgatggtcatttatccctttaaatgctttccttttcagaagacatcgaatggttcaaaccagtggagctttacacgcacgaaggcaggcgaggccgaatcaaacaggcaaattggacgacatgccaaccattggtttaa

SEQ ID NO: 46442 - DNA, 256 bp, Heterodera glycines
  Genomic contig location: Contig_ID=SeqID_35765; Location=482..737; Strand=-
  SCN-specific regions: Sequence locations=1-256
ttccgggcggtgatcctgcacaatgatcaaacaccgaccgcggttgcgcaacccattgccattgcggtggattctgatcggggcctgctgttttggcttgaccaaggcaagggcggtgtggccacaaaggtggcacgtgccgacatggacggcggcaacccattggtgttggtgaacatcgacctggccgagctggaccacctggcgctggacacggtcaaccaccgggtgtacttcacggaggccaaagctggaa

SEQ ID NO: 46443 - DNA, 714 bp, Heterodera glycines
  Genomic contig location: Contig_ID=SeqID_7566; Location=46..759; Strand=-
  SCN-specific regions: Sequence locations=1-240,275-714
  Gene Ontology: Mol. function=structural constituent of cytoskeleton; Cellular component=Arp2/3 protein complex; Biological process=cell motility
atgcatagtcgtggtgaatatgtaaaaggaacgacatttcagtaccataaaacgaaacttgctgcaactgcagttgggctcatcggtcgcgaaaaagcatatacattgtgagccggtatgtatggtggagcgttcgagcacagtttatatgaacgggtttttgttcgagttcgagtccggcgttcggaatttaccaaaatgggtaccgtgcatataatagaccagcgacttgacttttatgaacaaaaatatttttaaaaatgggggaggggaactttgacaagacattttttaattccctacagctgcagctacaattattttttaaccactgaactaatgagataaatttactaacatgctttaagatatttattctaatataaactgaaagtaatgattattcttgagcaaaacaatagggtaattgcggaacttttggaaatgaaatttaccaatgcccgaacaaagtaaagttgctaatctgtggttcaaaaataatagataaattccagcagtaaatttgataccgtcgatgttgtgttcgccgattttgatggcattttataccatgcatcaaatccggatggaggcgacaaatcaaagcttatggtaaattaattatacattaagacgtaaatttctcaaattattttacagctgagcatttcattgaaattttacaaagagcttcaagaacatggtgcagatgaa

SEQ ID NO: 46444 - DNA, 1117 bp, Heterodera glycines
  Genomic contig location: Contig_ID=SeqID_35772; Location=33..1149; Strand=+
  SCN-specific regions: Sequence locations=1-144,173-234,256-838,861 -1117
  Gene Ontology: Mol. function=glutathione synthase activity; Cellular component=intracellular; Biological process=MAPKKK cascade
atgaaagcggacaaagtgactgcaattcacaaaacattcaccggattgtatggcttagatgacccggataatgagaacaccaagcgtgtgattcaggtaattatcataagcatcatgatggttttcaaattcagaacaaatgtctgaaattaaatttttatttgaaaaattttgggacgttttttaatatttttacccaaaaattgggtaatattgttgatgcttgggcctgacttttaacagaatttccatttgatttcttaatagattttgaatcaaaataagaaatgtataggcggaattttagaaaattaaaggaatttttggattggacagaatgttcatttaattgctgtgaaatttattatttttcaatgacttacctcctttaaaaacttgggagtctggattaggaatgtgaaagtctcgaaaactaggcaaaatccaacaaaaacccgaaaatcctaaatacgggatctaattttctttaggatgccattgctcatcctgataattacgtgatgaagccaagccgtgagggcggtggaaacaatttttggggcgatgaaattccaaaaaagttgcgcgaaatgagccgtgccgagctcagtggccatattctaatgcaaaaagttcacgcattctctgctccggtaatttttggcataaatcaattggcatgttcaggaattacattttaattgttcgagttttggataggaatacatggatctggagagtaaaaaatcggatccgggtgttgccgggcccagaaaagccgagtccagatacaagtttttaaaccaagccagagtctgggaccacaatggtcatataatgaggagaaaatttaagtaatagctaacaaaaattagaggtgttgctaaaaataacaatttttcctcagaattacatggtccggccaaatgagcgcgtgcagcacggaaatgtcgtcaccgagctgagcactttcggcactctgctgggccatgtgaagacaaaggcggtgctgcacaacgcgcagcagggacattacgcacgctcaaaaccggaaggggcaacggagggcggcgtttacgggggcggaggcgttgtcgactcgccattcttattttag

SEQ ID NO: 46445 - DNA, 665 bp, Heterodera glycines
  Genomic contig location: Contig_ID=SeqID_35793; Location=324..988; Strand=+
  SCN-specific regions: Sequence locations=1-665
  Gene Ontology: Mol. function=structural constituent of ribosome; Cellular component=cytosolic ribosome (sensu Eukarya); Biological process=protein biosynthesis
atgactgaagccaaaaaattgccggaagtgccggagacgctgctgaagcgacgcaaaatcagagccgcacaacgggctgccagggcgaagaacagcttgaacaccatcaaagtatttcttacacaatcaaatattggttttccatggtttactgacttcaaaaataagacctcagttaatgattcgataaattagaaaacaaaatgcaaagtcacaaaacgcacattattattttggatacaaatgcgcataatttggtaacatcatcaaattgatttgctcgagaaaatgagttgtgtcgattttcgcaatttttgttaattttaaaaatggtgtttgactcaaaaacagaaaagtaccaataattgtcttgtctagtaatttggttgatctccgttgcacacgcaaatttttgtgtcgaattggtacttgcacatggacaatatcattaactgaaattcaaatctcaaatcatttctcaattgcagaaagcgaaggccaaaaagacggaaatcttcaaacgggcggaacattacttggttgagtaccgccagaagcagcgccaattggtcgcgttgaaacgggaagcgaagaaagtgggcaattactacgtgccggatgagcccaaactcgcatttgttgtccggatcaagggaatcaacaag

SEQ ID NO: 46446 - DNA, 1263 bp, Heterodera glycines
  misc_feature (600)..(600): n is a, c, g, or t
  Genomic contig location: Contig_ID=SeqID_7571; Location=713..1975; Strand=-
  SCN-specific regions: Sequence locations=1-719,747-1198,1232-1263
  Gene Ontology: Mol. function=signal transducer activity; Cellular component=plasma membrane; Biological process=agglutination during conjugation with cellular fusion
ttcaaccagtatttcaacaccaagctcaagttcaactggtactgaatcaagcacgagttcgagcagtacttcaacaccaagctcaactatttctactagtactgaatcaagcacaagttcgaccagtatttcaacaccaagttcaagttcaactataacgagttcgaccagtagttcaacaccaagttcaagttcgaccagtacttcgacacttagctttagttcgaccacaagtgcttcaactactaatactgagtcaagcgcaagttcaacgggttcgacacctagctctagttcgactataagtgcttcctctcccagtaccgaatcaagcacaatttcgaccagtacctcgacaccaagttcaagttcaactcccagtacagaatcaagcacaagttcggtgacatcaagttcaccgacatgcatcgaatcaacaagtacaatattcacgtcagcagagagttcaactacacgtgcatcatcaccgattacagaatcaagcacagtttcaagcagtagctattcaacaccaagtactgcttcaacttcttcaatggcgcaacacgatcaaagccattatatgatacaagaatactntaaattagtagaaagttaccaaaagctggtgacaaaaacaataacaactatgcaaatgtatgaaacgaagacaaatgaatacaacgaagtgaagaaacagaacgaacaattggaagagtcgaacaagcaaatgaatgaacaaaatagtcaaatgaaggaagaaaaaaagcaaatggaacagaaacaaatagagatggaaaaaagcatgtcagagacggaacagatcaaagcggaaacggagaaaagctatagccaattgcaatcggactacgaacagatgcaatcgcagtgcaccaaaaaggaagacggacaagtagtggtgccgaagccgaacttcccgacacgtatccatgcctttttcttttggtgtactgattgccattttcagcatgttcggacaatctgatgaacggaaactgtaccgatcccagctacatgaaaacgtgtcttgacccggtcagcaagcagtacactaactcattagcaatcataagtttccatcgcagaattacaacgccctgtccatgtccaaatgctgcatcacttgcacaaaagtgcgcaccgcagtcactgccagcctcaacatttccatctcgttcagtagcagcaacaccagcagtagcagcagcagttcgcaaactcagaatggaaagtgattgctga

SEQ ID NO: 46447 - DNA, 510 bp, Heterodera glycines
  Genomic contig location: Contig_ID=SeqID_93; Location=1..510; Strand= -
  SCN-specific regions: Sequence locations=1-510
aaaaaaataggtataaggggcaaacttttgatgtggataaaggacattttgagtaataggacttttcgtgttaaaattggggatgatttatcatccagtaaaaaagttggctctggcgtcccccagggctctgtccttggacctttattatttttgatttatattaacgatcttcctgatgctttgccatcaggagtaagaattaaattatatgctgatgatgttaaattgtatatttgttataaagcaagaaccgaaacagaaattatgcataaagcattgcataatttatcagaatgggcaaataaatggcagatcagaatctcaattaaaaaaaattttgtacttcatttggggaataaaaaccccaaagaaatatataaaattgatggaaatataataaatgttgtggatacaattagggatttaggcataaatattgataataaattgcaattttccaatcatgtcacacaaataataaagaatgcatatttacgtatgcgttct

SEQ ID NO: 46448 - DNA, 847 bp, Heterodera glycines
  Genomic contig location: Contig_ID=SeqID_93; Location=6328..7174; Strand=-
  SCN-specific regions: Sequence locations=1-632,654-665,687-736,759 -786,846-847
tgatgctttgccatcaggagtaagaattaaattatatgctgatgatgttaaattgtatatttgttataaagcaagaaccgaaacagaaattatgcataaagcattgcataatttatcagaatgggcaaataaatggcagatcagaatctcaattaaaaaaaattttgtacttcatttggggaataaaaaccccaaagaaatatataaaattgatggaaatataataaatgttgtggatacaattagggatttaggcataaatattgataataaattgcaattttccaatcatgtcacacaaataataaagaatgcatatttacgtatgcgttctttatttcgggttattaaatcaaagtcttctaggatttggattattttgtacaaaacttatgttagaccgttattggaatatgctcctgaggtttggaatccatctcttctaaaaaacattaaaaaaattgaaaaaatgtcaaaaatatttcaccaaaagagttcttttcaaatgcagccttccacccattccataccaacaaagattagaataccttcaattgccgacacttgaaagcaggcgaaagctgtctgatctgttcatggctcataaaataatttatggccgaacagatctgaatccctttgaaatacttaaaccttctgaacgctttaacattcccttttatagacttaactcgaaatataaattaggcaaaaaatttatacttttgcggggcgggtaacaaaaatttggaaccaactcgataaaaagcttattgaaataaactcattaaatcaatttaaaaataaaattaaaactatttcattttccttaaatttattttattca

SEQ ID NO: 46449 - DNA, 706 bp, Heterodera glycines
  Genomic contig location: Contig_ID=SeqID_35872; Location=19..724; Strand=+
  SCN-specific regions: Sequence locations=1-575,597-706
  Gene Ontology: Mol. function=structural molecule activity; Cellular component=nucleoplasm; Biological process=protein-nucleus import, docking
atgctgcgatcgattgcatccttctacgagaaaaatgttaaatccctcgacatttcagtggtatacgaaagcgttcaacaggtattttcggttgtttaatattgctaacttttctttgccctttcagtcgagattaaacgaaatcgatgactcacatttgtcaagtgatattcaaaatcccccctcgcgactcgagtttcagcgtacccccgaaaagtcgacgcgtagcgaaccttcggcgacttcggcagaaattagcactcacaatcagagccctttatccgaaattgtgccaactcaacagatggtacgataatttgtttactcattatctttccattgacttcagcaaccccaacctcatccaccctcgaaggaataccgtgtcaaattaatccgccccgaatattattgtaaaccatcggccgaagagttggaggagtgtttccgtgaggatggaagccttcgaattgagtgtggcctcacagttgggcgtgtggggtatggaagtgtgttttggaagggcccaattcaattggatggaccgatcgactttgatgagattgttcatttccgcaacaaagaagtggtggtttaccccgacgagaccaaacggcctgaagtcggcacgggtctgaacacagcagcggaagtgagcctggagcgagtttggcctatcgacccgaaaacaaagcagccgatcaaa

SEQ ID NO: 46450 - DNA, 553 bp, Heterodera glycines
  Genomic contig location: Contig_ID=SeqID_35877; Location=59..611; Strand=+
  SCN-specific regions: Sequence locations=1-146,189-230,252-260,282 -434,456-553
  Gene Ontology: Biological process=growth
cataccagcgagcgcgatctcaaacagttgtttggccgttggggtgaggtggaatctgtgcagattgtttatgatcgctattcgggccgttcccgtgggtttggcttcgtctacttcaccaacaccaaggaggccgcacgtgtaagaaaatttaaatatcaaaatttatttaatacaaatttatttatccctctaattgagcccccccccccctccttttcaaatgaattacgttaatttttcaaaaagtagggaaggacctttatttacatatttccggattttcttcatattttggtccggaagccgctctgcgatttctattttttgaccttccccaaattttccgttttatattaggccaaaaattcaaaaaaatttattttttcccgaattaggaataaatattttaaaacaaatttgttcctcgagttatttgaaaatgaacaatttgatcatcaattttccaggccaaagataacatggccgatgtggtgattgatggaatgaaggtccgtatagattattcggtcacgcgaggcggcggcccata

SEQ ID NO: 46451 - DNA, 903 bp, Heterodera glycines
  Genomic contig location: Contig_ID=SeqID_7593; Location=454..1356; Strand=-
  SCN-specific regions: Sequence locations=1-52,84-389,411-475,499-903
ttcgacttttccctcttcgacgactccgactttgccaaccgttcgtgggtcgacatcattgacgaggaggagagggagcggagcaagagcacggcactgtccaccactccgtccgttgtctcatcgtccgcgcccaacaaacgccgtcatattttgccaactccacaaaaaggatgggcggagccgaacaaggtcagtttggcgcttcttttaccatagacaaaccccgaaagagaaacaaaatcaaattttcggcacttttccagggttggtgcacggacgaagcgacgttggaacggcgggacaaggaactgcagaagatgaaggagaagccgacctacaagcgttacttgtcccaaattcccaaatttgcgcgcaaaaaaggccctcacccgcgcacacccaacaaatacatcaaccacacgcgtcgttcgtgggacaaacaggtgggcgagaggggaacgggtgctgttgcccatcttttcccagggagggggaccgagttagttctttatgaatatttatgggattgttttggatcccgcattttttaaatgttgaactgtgccttttttgacgtttcccacaggtccgtctgtggaagttggccatttacgagtgggcgggcgagacgcccacctcgagcgtgtgcggctcgcgctgtccgtcggagtgcagcgaaagcggcggcgacgagtcaccagcgccgttgcagaaaaaagcacgcacattgagcatcggaagcggcggaaacaacaacgaagcggacaacgtggcctcaattatgggtcagttaaatgcagcgaaaggggacagggaattgaaatgaatctccgaatttttgactccggtgccaaaagtgatcagatttggacactgacagttcggtatgcttccttgtaa

SEQ ID NO: 46452 - DNA, 171 bp, Heterodera glycines
  Genomic contig location: Contig_ID=SeqID_7596; Location=2037..2207; Strand=+
  SCN-specific regions: Sequence locations=1-171
atgggcgcctataaatacatgcaggaattgtggcgcaagaagcagtcggaggtgatgcgctatttgctgcgcatccgctgctggcaatacgccaaatggaggccatccatcgctgcacgcggcccacgcggccggagaaggcgcgccgcttgggctacaaggcgaagcaag

SEQ ID NO: 46453 - DNA, 1472 bp, Heterodera glycines
  Genomic contig location: Contig_ID=SeqID_7597; Location=1869..3340; Strand=+
  SCN-specific regions: Sequence locations=1-129,161-284,307-650,672 -699,721-748,770-964,987-1207,1229-1254,1296-1472
  Gene Ontology: Mol. function=structural constituent of ribosome; Cellular component=cytosolic large ribosomal subunit (sensu Eukarya); Biological process=protein biosynthesis
attggacaatatgtgtatatgaattttggtgaaaattatttttcgcttttgttcgatttcgggtccgggatttgaaatgggtggaaaaatgaatgtcatattcgtgatcagcgcccatgaaaaccccagaaaaaaacaaaaaaaattattatttttttatgtggcgtaaagtgaaaaagtacctagttttgcgtgaaaaatggcgacatggaaattttatgaaaattgagtgaatttatttccaaaaatgtaactgcatttgagcttcccgtcctaaaataaaaccctttgggctctcctctttatttttatagaacaaaccagtcatttaaactataagcatggctggacagtattttttttaaagtcaattttggtagtgactgaatgtttcggaaaaaggggggaaccgccaattcgtcgcggccaactcgccgcaaccattgcggcgagaaactcacgccgagatgacggcgttgaattggccgctacgaaatggtcctttttcttcgaaaaatcgtggcgcaaagtttcgatttttttttacaatttgccatttttaaggctttctcatttaccgcgtgcgcattcgccgcgggggtcgaaagcgccaagtgaccaaagggcaaacgtacggaaagccgaaaacgcacggcgtcaaccagctgaagaacacgcgcagtttgcaagccgttgcggaagtttgtttttaatttgatgggcctaaggaaatggtgtgtgttttacatttaaaaagttgggaattttaggcgaaatgcgctgagaaccaatcaaaatttatatagattcttcgaatttaggatttgttaggacgaagcgcaattcattaaccgaaaatagtatgaaaggatgccactttccagcccgcaccattaaatttgtttataaatttcagtttcttttttttccaattttatcccgccgggtcggttattatgagcccattaattttttaaaatattttagactaaagactaaaataaatcttgagtttttttttggtaatatgccgatgttccccccctccccccctttgtcgaaaattcaaaattcttacttctgttcctaattttgaattttcgactttttgtcgagttcgggtccgggattccaatttgaccaaaatgaatcttagattcgtgatcagcgacctcgaaaacccatgaaacttgtttttatgacattaaaattttagatttttttccaaaacggggggggcatcggcagtatgacctttttatttatgtttaaaattattgttgttcttttttattacaaaattttacgagttttccaactcattttcccttttcccataggcccgtgccggccgccgtttgggcgaacttcgtgtgctcaattcgtactgggtgggccaggactcgacctacaaattctttgaggtcatcctcgtcgacccgtcgcacaaagtgcgttttgtttcttgtttg

SEQ ID NO: 46454 - DNA, 411 bp, Heterodera glycines
  Genomic contig location: Contig_ID=SeqID_35948; Location=1282..1692; Strand=+
  SCN-specific regions: Sequence locations=1-411
atggaaggcgaagagaacggcgaagtccgagtcatccgagaagactcattttacgtcggagatgtgagaaaagggggaaacccattaacaaaatcactagtcatgtcataagaaacactttaggctgctggtcgccttaaatcatcggtttttcgtttttttcatttttccgaaaaattcgccgttttattttctcagatccgtcccaaaaacgaccattcgtgcgccgaccgactcttcgccctcaatctttcgctgacctttcaaacgcccgaacagtttttctccaaagtctctgccgaagagccgttccgtctgcccgagttcaatccgtcccaattccttcgcgaacattccgcccaatccgtcccaagtcccttcccccgccccccaatttccaactctaattag

SEQ ID NO: 46455 - DNA, 1364 bp, Heterodera glycines
  Genomic contig location: Contig_ID=SeqID_36108; Location=1..1364; Strand=-
  SCN-specific regions: Sequence locations=1-29,62-283,305-454,491 -639,682-745,792-889,913-1364
  Gene Ontology: Mol. function=ubiquitin conjugating enzyme activity; Cellular component=endoplasmic reticulum; Biological process =locomotor rhythm
ttttattaaaaacgtctctaatctatgggtttattcagccaaaaaatgagccaaggtagccaaattatgctgtaaattctatttaaacctctaactttaaaaattcccccctcagatttggtcccggcccagcctcggctgtgtgcaaacattgagcgggcacaccggctccgtgctgtgcctgcagtacgacaaccagatgatcgccagtggcagcagtgacgcgacagtcaggtggaggatgaaactcaattttcaatggcatgccaaaatgggaccaaaagggaagccgaggggccatgtgattccaaagaaaggatttttctaggaaaatctgaccgcgaaaatccgagttttgggagcaaatgcatttaccgaacacagtttttacgccattaattaacaaatttcgcccaaaatgctaaattttgggggctggcgaaaaaacgctttgtttattttaaaaaaaaccaaatattatttttattttccaatttttccagaatatgggacgtgaacacgggtgagcaactgaagacgctggtccaccattgtgaagctgttctccacctgagatttcaggacggcatgctggtcacatggtgccgccatttcacatatttatttattttccatcacaaatttaaaaaatatattttcaaacttaaaaattaaaattttcaagttttttcttgtaattttctcgtaaaatttttagctgaagggtacgtacccccgttctcacaaattaaatttgaaataatttttgtctttttaaaataaatttattactggcgaatttagctccaaggaccggtccatcgcggtttgggacatggcatcgcctcgtgacattgaagtgcgtcgggtgctcgttggccaccgggcggcggtcaacgtggtggactttgatcacaaatacattgtgtcggccagcggtgatcggacaataaaggtgaccgaccggtcgaatgtttgtcaatcattttaaacagggctcccgagtgtccttttttctaagattgtcctttattttaggcttccccaaactttttaaattttttgtgcttaatgatttatttcgctgatataaatgctaacaaaactcccaatttcaaaattttttctttttcttggcggcgcctatcggcaccaccagagctccattttctttaaaaaagggtctttgggtcgggtatcgtttgtcctttttttgaaaaaaaacttaggagccctgattttaaatggtttttttttttgctttttaaaccacttttttcgcggatactttttccaaaaaatgatttggcgaaacgtttgggaactatgggttatggatgttttggagtggtgtgccgacaaga

SEQ ID NO: 46456 - DNA, 512 bp, Heterodera glycines
  Genomic contig location: Contig_ID=SeqID_993; Location=466..977; Strand=+
  SCN-specific regions: Sequence locations=1-105,127-512
  Gene Ontology: Biological process=reproduction
atgcctgagttacttttcaagaccatcacgcagcaatcgttcacaattgaagttgaggaaactgcaacggtgagatgtttagacatccttttcttgtgcctaaatacctaacgatccattccttttcagatcggcgaagtcaaacgaaagatccaacaggtcaaaggcgcagaatacccagcggagaaccaaaagctgatcttcaacgggagagtgctcgaggatgccatgttggtctctgagctgaactttgcggcgccgaaattcattgtcatcatggtcatgcgagtgcgtttttgcccttcgtccgagtcaaattcggtacctaaattgcgtttgggtccacatttttggtcaaaatttttatcaatattttttttgaattaaaaactcctgaaaacaagtagtatgatataaactctccctttcagatattaaaatcattatttttggtaattttcaaacttaatgagatgcgctttctcccgacgccttcggtacagtcagtataa

SEQ ID NO: 46457 - DNA, 785 bp, Heterodera glycines
  Genomic contig location: Contig_ID=SeqID_36232; Location=412..1196; Strand=+
  SCN-specific regions: Sequence locations=1-165,187-458,481-721,745-785
  Gene Ontology: Mol. function=chaperone activity; Cellular component =cytoskeleton; Biological process=cell organization and biogenesis
atgtccccttctctttccgttgccaactcaaatgtctctcgaccgcttggccaaccaaaagtagcgggcttcaaagataaggataagccggaaagtgttcgtactagcaacattgtggcagcaaaggctgttgcggatgcggtgcggacgagtcttgggcctcggggaatggacaaaatgatccaatcgggcaacggagaagtgacaattaccaacgatggggcgactattctcaaccaaatgtcggttgtgcatcccaccgcaaaaatggcaagatttgtgttgtttgcttttatcaattgcactgttcagttggtcgagctgtccaaggcgcaggacattgaggcgggcgatggtaccaccactgttgtggtgttggccgggtctttgttggacgctgcagaaaaacttcttgccaaaggttgattaagctcgcttatacgccaaattttagcacttttgtttttaaaggaattcatccgaccaccatttccgactcattccaacgggcggccacattttctgaaaaagttctcgaggaaatggccacacccattgacattaacgatgacgacgagttggtgaagctcgccatgacgagtttgaactcgaaggtcctcagttcactttctgcactttctttcgtttgcccattgtttccttcgattttccttttttcaggtcgtcccgcaatattcccatctcttggcaccaatggcggtgcaggcagtgaagaaactgatgagttcaccggaggactcaagtgtcaatctgaagttgattaa

SEQ ID NO: 46458 - DNA, 522 bp, Heterodera glycines
  Genomic contig location: Contig_ID=SeqID_36236; Location=82..603; Strand=+
  SCN-specific regions: Sequence locations=1-184,206-522
atgcgggtgcgtttggcgtggtgcacgtggcatgtggaataacccccccccccctttttcaggtgatcaaccctgggacgaagcgcatcggctacgccttcaagaccaccaaaccgaagcgcatcaacatgaacccgccgaacggagtgctcggcccaaaggagtccgtcaacgtggccgtctcctgcgacgccttcgaccccggcagcgaggacaccaagggcgaccgtgtgaccgtggagtggaccaacacgccggacccagccgccaccgcgttcaagctcgagtggttccagggagacgggatggtgcgccgcaagaacttgccgatcgagtacaacgtctgatggaaggatgcttcgtcacctcaacatggacatgataggatcccaccgtcccaaaattgtcattttgtcccccatcatgtaaattgttgtatctgtatgtaaatttctgtgatcatcacttcaaatgaatgtatatttaattgttgcctatgtaattgtatagttgttgtgctta

SEQ ID NO: 46459 - DNA, 386 bp, Heterodera glycines
  Genomic contig location: Contig_ID=SeqID_36273; Location=443..828; Strand=+
  SCN-specific regions: Sequence locations=1-386
  Gene Ontology: Mol. function=GDP-mannose 46-dehydratase activity; Biological process=carbohydrate metabolism
ttaagtggactcctcaaacggttggaagaggattgtattgggtcagccccagcagtaatggacaaggacgacgccaaacaatttgaagaatatcgggcgaggaaagtcgcaatgataactggcatttctggtcaggtaattgaccgtaaatgaattaataccaagtacaagatacatacctattttttctccctaggatgggtcgtaccttgccgaatttctcctcgccaaggggtaccaagtgcacggggtcatccgtcgttcctcctccttcaacactggtcgaattgagcatttgtactccaatccgatgacacacgctgtcggttccagcttcaacttgcactacggcgacatgaccgactcgtcctgtttgatcaaactga

SEQ ID NO: 46460 - DNA, 3815 bp, Heterodera glycines
  Genomic contig location: Contig_ID=SeqID_7690; Location=209..4023; Strand=+
  SCN-specific regions: Sequence locations=1-1068,1093-1217,1240 -1574,1597-1854,1876-2406,2429-2913,2935-3192,3214-3501,3523 -3581,3603-3815
atgcaaaatgggattcaaaaaattttaaatgaggccaaaaagattgacccggaaattacgaccgatgacgttaataaattcctagaaaagcagagaacatacacgattcacaagcccatcaggaaaaaattcccgagactaaagacggtaccgagcggcttccataccgattggcagtgcgatttgtgcatatttgaccagttgaaaaagcataacgacggttacaaatatctgttggtatgcatcgacgtgctgagtcgaatgatcttcagtgcaccggccaagtcaaagaagagtgaggacatggttgaggcttttgatcgggtgttcgaaaagtcgaaaattatcccgatgaaaatatatagtgacagcggactcgagtttcaggctggaaaaatgaaaaaatattttgaggaaaaatttattatcaaaaatgtgatgtatagtcctgacctttgggggccaagccagtatccgttacttttgaaaatgcccgttcgctctgggaaaaattatataaggagaaggaattcaaaatttcgaaaaagaaaaaatttaaaatcggtgatatcgttcgtattaccaaggaaaagggaaaattttcaaaggaataccgcccaaactttaccgaagaattgtttaaaatcgttgttgccaattcgacgacacccgattcatacaggattgaagatttggaaggaaatttaataaaaggcatattttataaccaagaattagtgaaaacggatggatgatttttacattgtactaccctcgaacacaccggggcaggagaacactacgtcaaaattcacagtacgtctccccgagactttggaattgggcacaaattggtcagtagctctctcatcaattatttacccctactcattcaccgctctcggtataaatggtcaagagtttattaaagtatgggaaaatgacagcagtgtccccattcaagtttatttaccggacatgaattttaaaaccgccgggggattaggaaataaaattaacgaggcattcacacatcattacaaaatcaaaaaacaacgtgggaagagagaagccaaggctgaagaaaccaaagactcaaaaattgatgtcgcaaagagggctgcagaacgcgccgggagagacgtagtaagacattttaatcagatcaacaatatctcgaattccatccaaacccaactaaacacactacgagaaacaaatcctcaaattttagaagagcctgatataaaaatttggtttgacaaaatggttgagatgggaaccgaaattcaaacatcccgaaatgaacttaaatcttttcaagaagaagtagataaagccaaaaacacaacattagagcatgtggaaaagaatgacatgaaagaagcaaagaaatcagccgacgtcgcaaagggaatcgccagacaggcaaagaccaaatatacatcaactctcgagggatataatgataaatcggaaaagggttttaacgggatggtggttagacttaacgaggcgctcggtgagcattttaaacgtaaggaaattgaaaataaagaagttttagaagctgaaaaagggccgcaaaaaagagagagattagccaatgaggatgttcaatttaactacgacagtattgatcaaaaatttattgtctatctttcctctgccgtcacccacatagatttgtcaaaacacctcgcatatgttctggggtttaagaacacaaggctatttcacgcggaagaggcgacttatatgccagatttgacgggaggcgtaaggcagctatacatttatgcaccaaatttaatcgaaaacacaattatcggcaaccagatggccccactcttaagaatagttaacgtcgtcgatgacccaggatcaattagtgaagttatatatagcaccgagtattttcatcgtctacagtcgaaaagaatttcagaaattacaattgaaattcacacaccgtttggcgaattcgttaaatttcactggggaagttgtattctcacattacattttaagaaaagtatattttaaaaatgacacacgtatttttcgatcccgagtcggtcgattggtcatcttttatcactcctcaacatgggaggggacagaaacaatattttgtcggaagcaagtatcaacggggattcggtttcctcggtaatgtggcacgtttcttgacccctattgcgaggaatattgcctcgagtgcaggacatgaggggcttgccgctgggcagagagttctgagtgacatcgcccagggtcgtgatttaagggatgccgtcagggaacattcaagacaggggttgactaaccttactgataagttacaacaatgtgggaaaggaaaaaggtctctgatcactaataagaaccggaaacaagtatatgatcagttaagtttcatctaaaggtataaatggaataaataatacaaatagttaaaaatgacaactctcaagaaaatcgacacggcgagtgaggacggtctcgaggggggcctttcacttttcgacatccctccgacgaacgttgcaattaataaatccagtattcgggaattgctgccactttcagcaataaatcaatctggaccgtatatctttagacttttttcagataatcagttttgtgacctcaataaaacttttctctatttgtcaacttcaatagagagaaaagacaaaagcaattggattccaattaccaaggacagtgaagctgatcaacacgtcggtgtcattcaaaattttgggcacagctttgtcaaaacattaaaggtgtcaatttcaggtgtcgaatcttatgattccggtatttactatgcggttagggcatatatgatgactgaattgggattttcagaagatgtcaaaaagggtctatgtgaagcgtcctgctattacgtagatgatgtcgaccagaatgattatacaaacagtggctttaaaaacagagcgtcacgttttgctgatggggccaaatgtgaaacaatggtgaaacttaattttgatctcggccgtcagcccaatcttttgcttaataactctgacgtgatttttagcatacatcgtaataccgatgattttctaattatggcaccgccatatgtttccggaaatgcagtcatagcgaacccgcacacatatcgtattaacatacacgatattagaatttatgtaaaaacagtagatgttacccagtcattaaataacgtaataagcaatcagctacaaaccaccccggccaaatatcctatgagaaaaattgagatcaggagtcttttcatcccgcgtggcacttctgacctttcacacaatgtttttacaagcattgttccgagacgtttaatcgtcgggtttgtttcaaccggtgcgtataccggaaatcctaaagagtcacccttcgtctttgaacatgcaaaaatacgctctatcggtgtcgaagcgaatggaaacatattccccgggtcaccctattctcttaattttgatagaaacaaatacattcgagcatttgttgacatgtatacgggactcgggatggacgatggtgaaagaacaatgtcgatcaatatacaaaaatttgtaaacggttggtgcttctttgttatcccgatgacctctactctagaggacacccccggttttgaattgattcgaaacggaacgaccagcatcaaggtgcaatttaatgagcctataaaggacggcgggtatgagatgatcgttctgggggaatttgattcgattttatctattaatgctaatcgtgtgctcagtagcgacggaagcatatga

SEQ ID NO: 46461 - DNA, 1250 bp, Heterodera glycines
  Genomic contig location: Contig_ID=SeqID_7694; Location=107..1356; Strand=-
  SCN-specific regions: Sequence locations=1-101,123-356,378-659,693 -800,823-885,924-1250
  Gene Ontology: Mol. function=structural constituent of ribosome; Cellular component=cytosolic ribosome (sensu Eukarya); Biological process=protein biosynthesis
agtttggttcttatatttacaatgagcgtagagacaagtatagtttcgttttcttttatgcccattttcattgtttttagaacacacatgagacggcgcgtgccatcaaacatatgccgttgaagcgtgccatccgctttctggagaatgtacgggagaagaaggagattgtgccgttccgccacttcaacggcggcgtgggacgcaaagcgcaggcgcaagcgtggggtaaaccgtaggggggggggggtgtattgcgcgttaggcgtccgatcaatgactatccttaggccataacttctttctaactagggtcaaactttacattctcggtaccggtagaatatgtgaaatcagtatttgctgtttttctttgtgtttgtaaattcccgagactaagcttttgtttgataccaagaatgtatgctttgaccaattaagaaaaaattatagtcaatgaaactgaggatggtcattgattggacgcctaaagtggtaaaaatccgggatgggatgggttttgacatagctctttagactaatgatgttcctttacacttttgtttattgttaggcacaacacagggacgttggccgaaaaagtccgccgagttccttctccaacttctcaggtaaaaggccgttctgtttgggaccctaaaaacattttatttggaattccattttggtttccgtatatcctagcctacccacaagaaaattcataataaacaaacttgaccaaatgttaagtgtttgcattttgtatcgtcatttttgcacagaaatgcggagagtaatgccgaggtgaagggcctggacgtcgaccatttggtcattgaccacatcgtcgtgcaagcggccgccaaaatgcgtcggcgcacttaccgcgcgcacgggcgcatcaatccgtacatgagttcggtgcgttttcttcagagttggaaacattttttcacaatttagcggattttccaaacccatcatccatgtccaaattgtcttggattactttaacttttgcggcttgaaatttcaaaattcgccaaattttgttcaaagcattcctaatttctgactgattgtgcactatcccattaccattaacattcccattcatttagccgtgtcacatcgaagtgattctgaccgagaaaaaggacgtcgttgcgaagccggccggcgcattggtcaaagtgaagaaagagtcgaagaagaagcagcgacggcaattggcacgtggcgaattc

SEQ ID NO: 46462 - DNA, 5573 bp, Heterodera glycines
  misc_feature (3947)..(3947): n is a, c, g, or t
  Genomic contig location: Contig_ID=SeqID_7697; Location=319..5891; Strand=-
  SCN-specific regions: Sequence locations=1-202,224-273,303-670,701 -878,900-979,1002-1031,1053-1177,1199-1296,1319-2144,2169-2332,2373 -2384,2406-2425,2447-2696,2718-3345,3527-3585,3608-3614,3650 -3651,3681-4365,4387-4714,...
  SCN-specific regions: Sequence locations=...4736-4828,4852-5280,5334 -5500,5525-5573
  Gene Ontology: Mol. function=DNA-directed RNA polymerase activity; Cellular component=DNA-directed RNA polymerase III complex; Biological process=growth
aatcgcaaattgacaatttttcccgtcctgtccttaacacatttacaaaaccgagttttaaaaattttgcccataagtgttacggactttttgaaaaatggcgtggtcaaattcgcagcgggattatacctcgccggaaaaccaaaaattttttcaatttctaacgagtttttttaacaatttgtaaatattttcatgagtttcttattttctaaagaaaaaggattttttaaaattttttccaacgacttaaaacgattctgcaaaaactctttaaaaattaaaaatttctttgtttcaattatcactcacaatcaggacacctttgtgatcatccgaaataatcagttgctgtgcggttcgcttgacaaagcattgctcggctctgaaagcaaatgttcaattttctaccgtttgttgtgcgattggggcgagggccatgccatcgaggcgatgtggcggttggcacgcatttccgccgtctatttttccaaccggggcttctcaatcggtcagttttcagcttgagcctgacttccatccccacccttccagacataaattttacaaaaaaaaacttagaatacttttttgaaaatgtcgttaaaaaaaagcgtagtgagacatttgcggaccgactttttcggccgctattctcagttgaactgtgtaataaagaaaaaaaaattaaaaaaaaattgctttggttagcctagagcttaaatttttatcaggcatgacaaacaattaaatttaaaaaaaaactcaaaatagttctaccttttccctaacattgtccgtaatttgctgttataaaactatgaatccgaaattaagaacgagcaactatatactatatttatcaatggaaacttaacttcttaaaaataaaattgttttattactttcgatgtttattgcttaaggtgatcagtagggatgtcaaaaatatgcttataaaatcgcaaaatatgggcataaatgccaaaatatatgaaataaatcgcgaaaatggataaatatggatatagaaatccatcctagaagcttgaaaccaagctataaacattttttatacgtttcaggcctccaacactccaggaaaaaaatatatggattttcatataaatgacagccctattgatcagaacatctttaagcgcgatgttcaagttggaaaaatcaaaattaaaaataattaggtaacgcaatttttggaaataattattttttgtttttttagacagttcaaccctgaaatagtggtccgcaaaagtcggctaaccaaaaaaagatgttgaaaattgatacttttgctggcctaaattacgccgggacaaaattttaccgccaaaattttgaaaaaaaaattggaattttttaacgattttttttaatttacaggggaaattttggagtgcacccaaaaattcttattttgccacgacgcctgccatactcccagaataattttgtttttttttctccatcttcaggcattggcgatgtgaagcccaatgtcaacctgttgcaagagaaaagtgtgctgctgaacaccggctacaaaatttgtgaccatctgaacaaaagcatgcgcttggagcgccagaaggacaagccggacttgggcctggtggaggagttggagtccaaaattttgaaggagctgtccagcatccgtgaccaggcgggcaaggcgtgcaagcagtacctgaggtgggtgtgccgtaaaaaacaggcccaaggacccaattaatcgaggcccaattattgtaaaatcatataaaacttccgaaaaaggccgtctaaaactgcccaaattttacgcaattttttagtcgaaagaaggcgccgttgacgatggcccagtgcggttccaagggatccttcatcaacattgcgcagatgatcgccctggtcggccaacagtccatctccggcaaacggccttctgacggatttgaggtcggttggtttttggtagttccgttgtattggatcaaaaattaaatcgtctccttccatcttaattaaaaacagacgacatcaaccatgcccaaattttgccattttggggtctaattttcaaaaaataatggtacaatacagttcggcgttgccaatggcgccgctgggaaattttttcttggaaatttttaatttttgattcgcagaaccgctccctgccgcactttgagcgcaaaaatttctgcccctgggttgagcggatttttttattgcttgaaagtactgtattttttactactccatttgttttatggcttttttggaggggataataaatttcgggggaattaaaaatttgtttagcaatttttgattaatttaaaaattgatataatttttttttacaaaggccttcaacccttgaattttaaaccaaaatttttttccccaaaaaattattttctaacattaaaaatgatttacaattagcctatcgtattattatttctactcgcttcaattgtgccaggatttggctgtcaactatggcaacacggtgcgcacctccaccaacgaggtggtccagttcacgtttggcgacgacggcctcgacccggcgtacatggaggcgaaggacggccgcccgttggacttccaacacatgttggcccaagtgcggaacaccaacaacaccaggtgggcggcgaaagggtgatgtactgcctcgcaaaaaaaaaattattttttttcatgaaaaattcggtacattttggcactgtcaattttcaagtgtcataaatttttttttaatgaatcaattaaaaaaaagagcctacgtaaacaatttaaatttgcagtcattaaaacagtttatacatcaaacataaaaaaagagttctctgtaaaataattgaattttgggtcattggttcttgaaaaactcaattcatccatttttatgcttgaacattttcttctctaaaatgtttcttccattcgaaaatgttctttcgattaattttcaatatttttgcaatttttccatcactcattttggattttcatttttcatttgccaataaatttttattttttctatcttttcttttccgttatttttcctttcattccaaattgtttcttccatttgttaattcttctttcgttaattccaattttcttataaatttctgcaaatttttcttccattctttttttgaatattttcttcctttttgtttatactcatttttcattgaattaaatttttgaataatttcaattttttgttcatccgtttttgatttgtggcatttatatttttgaagatttaattctttgatccatttgtaaatgtattggcgatttgtccccaattttttccctattttctgttcaattttattccattcttttctggtatatattttttcgttttgtttaattttttctttaattttgtaaaatttctcaataatttctcgttttttctgatcattttcattttggttattttcttcttctaaattttcttcttctttttcttcccatttttctccaaatatttcttcaaatgattgttccaattttttcttttctgctccaatttcaattagcacaattaaaaatgcaattaaaacggataaaaataagcataatttcatttttgacaattttattgtgttaaattataaaataattatttaaatattctcaaaaagcgcttagattttggcaaaagaggcattcattcaaaaattatcatcaatttgtatatataatttctctctactgattctcaaatcttttcaattatacagaaagataaaaccattttatgaaattttaattccaattctactgatcataaaaacagatattgaccaatgaaaatttatttgcttgaatcgaatcaatcagaaatggtccggtttttgattagacagatttttcgacccgtccggtccccgatttctaanaaaaaaataaaatttggattacatttttatcaaaaaacgctttctttttgccatttttccctaattttttaaaggttttacagaaatttgtaatgcattttagtaattttaaacattttttagtctttcaaaagatttttttgattagttattgatttccactgttaaaatttgtcaaaaggccttccgaattttttaataggcccatggatcccaccggcaccgccgatggcgtcgtgtacgacctgcttggcaccaccagtgacgccactgcatccgccgccaaccttgcggaggccatccgtgccgaaattgtgcaacgcatggacgttgtggtcatcgagcgggagggcatcggcacggaatggtcggcggcacggaaaaagtggcaacaaagtgtcggagagggcgaaggagtacaacagcaacaacaacggaatgagcacactggtggtgttgcggcggacaatgagcagagaaaaccgcggcaaaaacaactgcaacatctcccacggatcacggcccaattcggagacgaattgttgaagtgggaacatatataaaaagtattaaactgtataaatgggtatgaaaatatagcgctatgacatcggacaaacgtgtcaatgttcggccgatattttttcgaacaaaaatggggcctaaaaaccggttttcgggcgccgaatggaagcgaaagtcattgtccttgaaagacttgcaaataattcaattcacccgcctctccgtctgtttttctgtccgaaaatattttgttttttacaattgtaaagctttataaaactgtttaattaacaataagactcgaactgtttgcgtttttgtttggtatacaaaaaattatttcgaatttttctttgtttaattaaatcttaaaaaatttgagattttcagtgccattccatttaaatttaaatctcctgaatgacttaaatttttctattccaattttccttcacagattcttcgctgatctgttcaaagccaatttgcgtcttctgcactctgtgccgggccaatgccaacggcacattggcattgggtcaccgacgtgagcaaaaaaacagaaacaactttaatttattaattttgcattttggtgacagaactcgttccagaggcggccattccacgcgttgccgcgactgcgagccgatcgccgcccggcgaagggcccttttgaatgccacggggttcaggtggtgttggtggtgccattttgttaggggtgaatttcatttgccctctccccgcattttttttaaatcccagaaactgaaaaattggtttaattttttttttgaaatcagacatttaaaaatttttttttgaattacatataaaaatttttttatttcaaaaaaacgaaaaatacgtttttaaatttcagtcttggccaaatgcgccaatttttggacatttgtgcaatgcgaatatgtcgagcaacggcggagccgggtaaacaaaaaacaaaaaataaataaattgctgtttatataattaaaaacaatttgtgactcatttgataataataatttttgttttccttttctctaaggcactgctgtcggtgcaattgcagccacgtcaattggtaattacaat

SEQ ID NO: 46463 - DNA, 1585 bp, Heterodera glycines
  Genomic contig location: Contig_ID=SeqID_999; Location=450..2034; Strand=-
  SCN-specific regions: Sequence locations=1-164,190-235,257-1585
  Gene Ontology: Mol. function=mRNA guanylyltransferase activity; Cellular component=nucleus; Biological process=mRNA capping
atgtccctttttcctgaaggtttcaatcggaccggctttctcatctcggcctatctgtacgaaaagtgcgacatgagtatcgaaatggcagtcagagaatttgcggagtgtcgtccgaatggcatttacaagcagtactacttggacgaccttcgcaagagatacggcgatgaggacgaagacgagatgacagtttgaatatacaatagatcggcaaaacactgtgatttccttttagttccccggaaggcctttgtgggagaacggaccgatcagtgacgacgaattcaccaacaacggagcatttgtcatggaggcgacttccaacaattctgacgttggcattgcttcgaatgggccttcgtcttcctcgaacaacggcacacaaatggcaaaaaacagtttggaaaagactcaattgggaaaatctgccaatcattaagtaacaaaactgtcgggaaaaggcgcgccaaagtttatggacggaaaagttgtgaatgtaagttacgtggaagaaccgaataagcgacgacaagtgcaggacaaagtgattaacaaggtaattgcctaattaacagcaatcgctttttagacaaggcttttttgtggttacggctccaaagtttttccgggaagtcagccggtttcattggaaggaccgcaggggaacaataacattgagtttctggcccaagagccttatatggtctcgtggaaagccgacggtgtcaggtggcgaatttgcgaggagaagagcatttcgaacgaactatttagatatttggtgttgattgacgggaaataccaagtgtacgcatttgacagggacaacaaccccttcttgatacggagcatggcctttattcgacacccaagacaaaaaccgctagaagacgatgattttgtccacgacacgcttgttgatgctgaaatggttatcgaccagaatgaaggccaacagatacctcgtctcctaatttacgacctcgtccgatttcaagtggaagatcgactcacaaaaattggaaaaataattaattgttataagggagaagatttacgtcaaaagcctttcaatgtgcggtttgagatgatcgaaaatgagctgattcgaccacgaacggaggccttcaaagctggacttttaaaacgggaggaagagccaatcggagtgcggaggaaaggcttttggaacattgagtccacgcggagactcctcgaaccgggctttttgagttgtcacgaagttgacggattagtttttcagccagtgaacggagttcgtaattagcaaataactaatccttgaacaacaaattccagggttatgtgtctgggagatgtgacaaattattgaaatggaaaccgccagaattatcatcgattgacttccgacttgacataaaaaaggtggactttttcttttgtttctatttgttttgtttttcaggtaatacgccccggggaattgcccgaattcgtcggaaatttgcatgttctccacgcggataaacctttcgctacaatcaaagcgacaagacagcttttaccatacaacaacaaaattattgaatgcaaattctcg

SEQ ID NO: 46464 - DNA, 2348 bp, Heterodera glycines
  Genomic contig location: Contig_ID=SeqID_7700; Location=1023..3370; Strand=-
  SCN-specific regions: Sequence locations=1-71,93-206,228-906,958 -1026,1048-1312,1334-1412,1434-1727,1749-1778,1801-1884,1906 -1940,1965-2348
  Gene Ontology: Mol. function=RNA binding; Cellular component =nucleoplasm; Biological process=mRNA-nucleus export
atggacatcgatgcggacggtgttgaaatgaagaaaaagcgaatgccggccggcgaagacataggaccaaaattggtgaacatgatcaaaaagttggacgaccaattgcacggtgcgtccattgagtcggcaattgaatcgttggccaacgttttggaggacaatttggacccgtacgagggacagatcatccacattctctacgaatggtcagtgtttgttgcatttgcatcagtcgaggcaccgaaaaacgctcggaagtcgattttatttagaaatcgagtctatgtctattgtatgattcattcaactgaatgtcagactaactgtgtgacatggttgaattccgtttgaaaaaaacgaaaatgccgatgtaaatgaaaattgacgaatttagaaaattagatgggtgctttggtttgtaaaatttttagccataaaagacgagaaaatctgctctaatgggttttcgggggttacgctgatcgcatactgacaccaatttttaccaactaagaattcccaacttaaacttatatactatagaagccgaaatatcgacttaaattatcctaaaaaatgtctccgtcacgctttgattttaatatattttttttcaaaactggcctaaaagataactaactgactcttattgcaactttccacaaaaaaactataccctccgaaattagattacctatatcagtatgtgaagaaattttttttgtaaattttttttcaaatttagtgccgcttatttgcccgagaagatcacaattttctccacactcgtcggtcttctgaatgttcggtccgccgattttggtgagcgattgttgaagaaattcatggacgaatttcatcacacattcaccagcggagaatacgacatttcaattcgaatcgtaattattttttgaaaatttacaataaattatttcatttttactaatttaaggccaccttcctttgcgatctttgcaatgcgcgagttgtgacgccggaatccattgtttcattcatggagaattttgttgacttggccacggaagaaaatgtagtatttttggtcttgaaaaatttcaacaaaaaaattggaagaaaaaaaacctaactttaacacccaatagcattatttttcttctagaatcatttttccgttttcagattaagtccaacttcttcgtgtacctcgtcctgcacacattgccatgggttggcactgaactgtacgccaaattgcccgccaaattgaatgacatcatggcgcgcatttcactctacattggcaagcggacgaagccacactttgatgtgagaattgaaatttcaaaatttttcatgccatttttttggtcgtaaaaattcaaaattggctaattttcgatgcttttggcattttcagatgttgaaaatttggtctgccactgactatcccaagcaggaagactacctggacagtctgtggtcccagctccaaaatttgtgccaaaacgattggatggagcggcacattttgcgtacttatgccttttttgaggacgttctcgtcgcctcgggggcccatcaattgcccgagtaaaaaatggcccatcatttgaaggtaaatttttgaaaaaaaaaattcaggttagaccaacacgttttgatgacaagcaaaaagcatccaatgccgcacattgttttccgtctcttcggcaaagatgacgtcatggaaagcgtaagaacattttttatttggagaaaaagcttcggaattgagtatttaaagctaataaattcactttttaaatctcatttttcgaaaaaaaatttcccttgttcgcttttcatcacaatgtttgaaaaactttcatatgaatagccaaattccagaaaatttttgttattgaatttaaaattttaggatacttcgaaaatttcctttttttcggtttttctttaaaaaaaaaatttttttttttgaggttttaaaaaaaagtttttcaaattaggcgttggagagtgcgctctcggcaacaatgcgtatttgatttttggggcttttacggggtttccacgcccttttgctttgaattttcattttttttaaattttacgattttttaaaattgcccccttcccaccgctttcctgttcaggacgttgtgttgccaattccaaacgccattgaacgctttctggttgaggaggacctgcactggatcatcgacaacaattatttggactggaaattgtgtgcccattcgctgctgcaataccaccgcaaggacactgtgccgttgaattatgtgatcatcgagacggtgttcaaccaactgttccgacttcctgccgcctcgcaccac

SEQ ID NO: 46465 - DNA, 239 bp, Heterodera glycines
  Genomic contig location: Contig_ID=SeqID_36357; Location=1..239; Strand=+
  SCN-specific regions: Sequence locations=1-239
  Gene Ontology: Cellular component=eukaryotic 48S initiation complex; Biological process=protein biosynthesis
ataaaacatgaacaaattttcactttattgagtccgctaacttccaacaaaatccaaacaattcaataacaaaagatcggtaaacaacaatttccgatgatcgcaaaaagaatcatttgagtgggatgaaacgcgaactgtgcgttgcgccgattccgggacgaccgtgtttgacaggcttgtacgtaatagaaaattcgcccaagtaatatccaatcatctcagctcgaatttcaacc

SEQ ID NO: 46466 - DNA, 690 bp, Heterodera glycines
  Genomic contig location: Contig_ID=SeqID_36367; Location=38..727; Strand=+
  SCN-specific regions: Sequence locations=1-104,137-459,565-690
atggctgagatttgtttggcggttaatcgttgcatggaaattgcttctcctaaaatggcacgttttctattcgaaggaaaacgcattttcatttggatggttagtttaaatattatttatcattttaattaatttagaaaggaaacgggcgatgcgattgccaaaatgcaaaaaaacgggcacatgaattcaaaaatggacagttttttaaaggcttggcaaaatgcacggttttaagggccttctcgcaaagctggaagaaaccgggatttgcttacctataccagttttttctaacactgaccgcatatcgctacttacctaaagattaaattctaaaattaaatcttacgactaatgcctgcacatttttttgcccgatggaaaataaattgctgaaatgtaaatttaataaaagcttttgctcaaaactataaataaaaatcatgaagaaaagacttaaaaaattgaaaatatattgaaaataaaatattttatttatattttatggaatttgaaaatatattgaaaataataatatttaatttccttatttttatttttcagttgtttcctgctgcgtatggcctgtatttgtccatcttcaccaagtcgccatgtttcagtagcatttacatcgcttggttctcgaacccgcacattggttatatcagtggttccgaggaaaac

SEQ ID NO: 46467 - DNA, 2165 bp, Heterodera glycines
  Genomic contig location: Contig_ID=SeqID_7736; Location=1472..3636; Strand=+
  SCN-specific regions: Sequence locations=1-246,268-1469,1491 -1508,1540-2099,2121-2165
atggctttccacaaaattgacaatgacagtgtgaactccatcaccaatgccttggactttttccgcatcccaccaactaacgtcagcgtctcatcctccaaagtgtttgaactgctcccaagtaaccctctgacggacaccccctatcacttcaagcttcactccagtcaaaattatattgatctctccaaatgctatttgttatccgagtttcgaattcgcaaagaaaatgcaaatggtcaactggttgaccttgcagctgatgaggttgctccgattcaactgattggacacacattcatccgtaacatcaaaatgagcatcaatggccgtgaagtgttcaacgcaaattctctgatggcctacaaatcgtatttttcacacgaactctcctattcaacagcggccaaggactcgcatttgaatgctgccggttactaccgtgacactggtggtgtgcttgaggtgggagacggatgcactgcacgacgcaacctgtttgtaggcagcagaacagcacaattcatggccaaaattgacgccgatttgtttaaccagcctctctacttgatcaacttttgtgagttggacattgaaattttgcccaacgacaacgactttgtcctaatcacaccacccggtgttgctgcagccactcgctaccatttcgaagttgtcggtctgaaaatgtatgtgaagaaggtgtccctgatggacggattggcgttggacattgcacgaaaacttgagttgaaaccggcacgatatgcagtgaggaaaacgctgatgaagtcgctgttcatcagtcatgggcgttttgaatttacgtctaatttgttcatggatcaaattccccggcgtatcacaatgggattggtggccaatgctgactatgttggcaccgtttcacgcagccccttcaactttcagccatttaatgtgcgtgaaatttccataattgccaatgggcgctcctaccctcaagcagcctacgacttggactacccaaacggaaagtatgtgcgccccttcaacgacatgaacgaagcggtgggattcgccaactcatcggaaagcaacgggattacactagcacaattcggcactacgcattgcatttacgtgttcaacttgacgagcagtggagacgaccaagcggcgctttttgatctgataaggaacgggaccacagcagtgagcatcaaatttaatcaggcggtgcccgctggaggaataatgttggtggtgatgggcgagtgcgactcgctggtgatgttggataagaatcgatcgatcagcactgacatcactatttaaggcacacttattttcattttttccataacgataaacatgtattccaaaaaagttggcgtcattttattccttcttcggatttctcttcccgtagtgtcatgccgagaggaaattcctgagtattctgaatatataagaagaaaggcaatgcttacatccacaaccacaacaacgattccgtctacaacaagcacatcaacaaccaccacctcctctcccccaaaaagtgacaagttaattgaagagcaagtgtcagctggtctcacgccactcatccaattgtgcaaagaccgaccagaagaggggaatttattccaacaagtcgtttgctgggcggtgtttgcattgtatttgatgcttattgtcagcctggttctccatcaactttgctctattttttggctgaagaatggacagcgtgcaaatcacatcaatcttgaacgaaaaccgggggaccgcgcgagtctttcggggctgcttcgccagtgatcaattaccgcctccggtcactctacagtatcccgcagcgctaattgttaaccgggacccacattacaagggagggtctcattggtgcgccatatatgcgaagggaatggaagaaccagtgatttattatgacagtctagcccaaaaaattccatctgtcattgtgtcatcattcctgaataagtttccgatgggcctaagaaaaaatattcgttcctatcaatcccaattagtgtcaacttgtgccccacactgtatagtttttgtgtatcatatgtcacaaggtcattcatttgaaaattttattgagaaattggaaaaatcgacaaattctgatctgtatgtaataataatgatga

SEQ ID NO: 46468 - DNA, 3063 bp, Heterodera glycines
  Genomic contig location: Contig_ID=SeqID_7746; Location=88..3150; Strand=+
  SCN-specific regions: Sequence locations=1-1028,1056-1199,1222 -1756,1778-2282,2311-2571,2599-2604,2626-2690,2729-3000,3022-3063
  Gene Ontology: Mol. function=protein binding; Cellular component=SCF ubiquitin ligase complex; Biological process=apoptosis
gaatgccagcgtctgtccggtgaccagctgctggactactacaccgagcagtggaccaaattccagttctcctccactgtggtgaatggcattttttcctacttgaaccgacattggatcagacggaacatcgacgaggcggtgcgtcccggaattttggaagtgtacaatgtgagtggtttgacggtcatacatgaattggggatgggtttcatttttaaattctcgaatttcagttggctgtttccatctggaagtcggtgatctttgacgaactgcaccacaacatcacgtccgctgcgctggcgctggtggagaaggaccgcaacggggaacgcatcaccacgcgactgatcagcggcgtggtcgcctcatacagttaagcttttacaaatttggaccccgaggcggggctggggagtcagggaatgggtctttcgttcggcgaccagattctgccgccactctttcgttcgaacacccgctaatttgcattccttgtttccagtcgaacttggcatcaacgagcacgacccggcggcggacgtcggaggaccagcaacagctgcggtcgcccaacaacagcagcagaattcggtggtgcatcgtccgagtgtcaaataccaagtgtaccgcaactactttgagcagcgctttcttgaggtacgcttggatgggttttgtgcattttgaaatttttacattttattttttcactccacgcaaacaggacactcgcaacttctacacaacggagtcgaacaagtttctgcagtcgaacagtgccaatgtgccggactatatgaaaaaggtgggtggtgaacaggggggagtctcgtttacgagcgcaactttcgtcatgtttttctctttttttcaggttgaacaacggcttagcgaagagcgggaccggtgccaaatttacctggacaacacaacaatggactcgctgatggaggcatgtgacacggcgttgatcaagcatcacctcgagctcttccacgacaaatttgaggtagcagaaagagaattgtccattttattatattacacttttttcagtcattgctcactcgtcaacagaatgaccatcttggacggatggtgagatttgcagaatgtcaccacttttctcacaatttttgcataatcgtttttttcagtacacactttgttcgcgtgtgcccaacgggttggccaagctcaaggagatcctgaaggcgtacatcgaacaggagggcaaggcggccattcagcaaattgcgcgtgaagcgtccaacaatccgaagcagtacatcgactgtatcctcaaaaagtgagtagcgggtgggtttttggaaatactgaaccattttaaaggcacaaactctacaatcgcttggtggtggactccttcaaaactgaccatggctttgtgcaatcaatggactgcgccttccgcaagttcatcaacaacaacgcagttacggagatggctcggaatgcgtccaaatcgtcgcagctgttggtcctctactgtgatcagcttttgcgcaaaagtgcacgcaacaaggaggacgagaagatggatgagtacctggaccaagtggtgggtttgtttggttctttaaagtttgaaattttccatagtttctgttttcttaaaaatgctaatataatattcgcattgtcacagatgaccgttttcaaatacatcgacgacaaggacatgttccacgcgtttttccacaagtttttgtgcaagcgcctcgtctacgacacgtcggccagcgaggagcaggagcggtgcatgatcgcaaagctgaagcacatgtgcgggttcgagtacacctcaaagttggagcgtctgctgactgatgtcgcgctgagcagggaccattccgagcagtacaagcaggtggctaacgaaatttaaattttcattgagacagttttaccccatttttagcagccgagaacatccaacgttgacttctccgtcattgtcgtcatgtcgaacgtgtggccactggggcagccggtccaattcgacatcccgcgtcctctcctcgactgcattgactgtacgtttggggaagacgggtggtggagagaggtacaccctgggaaagtgtcattacttttcagcatacacccagtactacaccaaccgcttcaatgggcgtaagctgacttgggcgttgcaaatgtgccgcggtgaattggtctcgacgagcaacactttcaaggacaaatactcatttttggtaagcaattccgacattaaaaattgggtttcctcgtaaaaataaataaatgtttttcttttccagtgcaacacgcaacaaattgccatcctcatgcagtacaacgaacgcaacacgtacacacttgacgagctgcacgtcgctcttggcaccgactttcccgctgatcagctgtgcgccgttgttcaatccttggtcaagacgaatctgctgaagctcaccagcgccgatgggacagctttgaccgagacgaaactcgatgacaaggagcagaaattcacctttaactcggaattcaagaggtgaatttgaaaatgaacgggggtaattaaattttaaaaaatttaaaaatgaatgtaaaataccgttaattctaattatttttcaatttcccgtcttttcagccgcaagctcaaagtcgacttggtccgtgccatgtcatccgccagggagacaaagaaggagagtgaggacgtgcagaagacggtggacgaggacaggaagttggtcatccaggtgagacaaattgacaaatcaattttaatgacccctttcttctccctcattaaggctgccattgtccgtattatgaaaatgcgcaaatcgttgaagcatcagctgttggtggccgaggtgctcaaccaattgacaacgcgtttccagccaaaggtgggggagaatgattttgggtgcaaatgaatgcctttcctttccttttaaggtgccgatcatcaagaagtgcatcgactcgctgattgagaaagaatatttgaagcgctcggaggaggatagcgatttgtatgaatatttggcatga

SEQ ID NO: 46469 - DNA, 575 bp, Heterodera glycines
  Genomic contig location: Contig_ID=SeqID_36545; Location=47..621; Strand=-
  SCN-specific regions: Sequence locations=1-23,45-77,100-289,313 -425,477-535,557-575
  Gene Ontology: Mol. function=zinc ion binding; Cellular component =nucleus; Biological process=regulation of transcription, DNA -dependent
tttttactttaaaaacagtgtgctgaatgtgggaaaacatttgcgcattgtcaaactctgcacaatcatcgccgtacgcacaccggtgaaaagccatacggggtgagtgatttgggatttgattttcaaattcttttttatggattttggatgtttgaattttaaattattttcctttttcaaaaaacagtgtgagttttgtgacaaggcctttgctcaacagaatcatcttgactgtcatcggcgtattcatacgggcgaccggccctatgaggtgagttgaaaattgaaattttgaatttaaaatttggttgtgcttcgaccttaaaaatttaggcaatttttgggtgtatatggattagcatttggttgtaaaaggtggaacttttttccgtctttccccttattttcaatcattttcattcattttatttttattttaaaattaatttttatttcatttatttaaaaaaaaacagtgcgacttttgtggacagcgatttgcgcattcgaacactttggtcaatcatcggcgtgtgcacactggggaaaagccgtatgaggtgaattaccgg

SEQ ID NO: 46470 - DNA, 1358 bp, Heterodera glycines
  misc_feature (115)..(115): n is a, c, g, or t
  Genomic contig location: Contig_ID=SeqID_36567; Location=1..1358; Strand=-
  SCN-specific regions: Sequence locations=1-6,33-1305,1327-1358
tcagaatccaaacaacaaatcgctcgctgatctctctgtttgctaagggatttcatgagcagcgcgactgtttcgccgaactcggtgggctcgagaatgtcactctcgagattgnggaggcacagtgcgggatgagcagtgccgagtctgtgcgtaaatttgccaagatcagtcaaacatttctcccaattgttgtcagatttcccctacgggcctcaatctttcggtggttctcatcttcgccgcacgtcgttcgctggtcagtctttgctttatccgctttttccaccgctttatcccccggcattttttttgctaattaagccgttgatcccacactttcagcggctgtctcccatcgagcattccttcctcctccaatgctttctcccctcttccccgcgctctttcgtcctcaacaccgatttggacacaaatgttcctcctcagcccatttcccacacaatttcattggaaatggcacctccaaaatgtaattactctttgcgcaggtcaaactccatgttatttattggcattttgtccaaatttgtagggattcgcccaatgggccaatggtggacaaagcgcacatcggacagacaatttaccaccgctgggaatgccaagggggcaaaggttgtccgaccttgttgtttatgccattgatcacggtatttcgtccatttggttgataatattacagagatcagtgaagtgttcggcatgcgtatttcggactgttcggtggccaatcattcgatacccaattcggccaattcaactgatcagcttccgatcgcttccggtactcaaatggccatcgtcgacagtgacgggtgggcgcattgccttcttttgcattcttttcccatttgaatgtctgtcttcctcagttgtactgctgactctgatctgctctctgacctacagtacgccgatgaccgtttgctggccgttgcccgtgctaccgtattctccctgcgagagtccgattctctgcgtttctcttgcaaattgacactttgcgttcgccgggaagcccattgtgaagggatcattgtccgttcgcaattagcttaatgggtctgtttaattgcttgtctgtcgccaattcaccctcctcgctgttctgccgctgctccgcactttttctcgcggcgactccaaaatgaatttgacgcttctgccatggaagcactgagcacggaagttcgtaatttgttggcacagtcgagggtctcgagtccatcaatgataagtgggccctctctctttacaggtgttgtcttcaaaggtcacccgttcttcctccgttcttcccccaatcaccggccccttaaccatcgctcttcttc

SEQ ID NO: 46471 - DNA, 1313 bp, Heterodera glycines; identical to SEQ ID NO: 36639
  Genomic contig location: Contig_ID=SeqID_36639; Location=1..1313; Strand=+
  SCN-specific regions: Sequence locations=1-824,848-915,938-1037,1060 -1157,1193-1313
  Gene Ontology: Mol. function=diacylglycerol O-acyltransferase activity; Cellular component=integral to membrane; Biological process=triacylglycerol biosynthesis

SEQ ID NO: 46472 - DNA, 934 bp, Heterodera glycines
  Genomic contig location: Contig_ID=SeqID_7781; Location=1544..2477; Strand=-
  SCN-specific regions: Sequence locations=1-83,105-214,237-316,340-934
atgcttttcttctcctttttcaagtcgatggtcggcagagaagtgatcgtcgagctgaaaaacgacctcaggtggaattaaaaaacagtgatttcattccaaattcttttcagtatttgtggcactttacattctgtagaccaatatttgaacatgaaaatcaacgacatttcggtgacggacgttgacaggtaaaaagggaccagcaaattgaatattataaaaagtcaatttttgcctcaaactccgaaaacgagttggggctgggaaaacgccattaccccagaatatgtgcagatgattttcaatttttacgtttaacaaattacatttcataaaattcctttttttgtgcaaaatccgttcaaatttacaaatttaaatgaaaagccataagcacttaaaggaattacctatgggaattaaacaacttcccccgcaggcatccccacatgatttcggtgaaaaattgcttcgtccgtggctccgtcattcgctatgttcaccttccgacggatggcattgacacggcactgcttcaggtgggccaataagcgccaaacttggcacctttcccatggtttaattcaattcccattaaaatgattcatactttaagggaggagaaaagaggtccaggcgatggcgaaaaataaaatttggattaaccaattctttgtcgcgacaccctctctctcctcttttagaccccccccccccatcatttagggacatttgcaaatgagtgggggggggtgccttttgtatgaaatgactaattgtgagtaattccctattaattccactctattttaccgcgccaattcaaaaggaaagggcggcgctattttcgctttttcatttcacttttaattaaagttttttctgttgcccataggaagcatcgcggaaagaaattttgcaaagtcggcaa

SEQ ID NO: 46473 - DNA, 152 bp, Heterodera glycines
  Genomic contig location: Contig_ID=SeqID_36780; Location=799..950; Strand=-
  SCN-specific regions: Sequence locations=1-152
ttttccggtcgccaaaatttcgttcattgcccgcgacacttcgacggatgcgcgcgcctttggcttcgttttcggcacggcggacggcaaacacaaattttacggggtgaaaacggcacggacggcggaccacgcggtgctctccattcggg

SEQ ID NO: 46474 - DNA, 398 bp, Heterodera glycines
  Genomic contig location: Contig_ID=SeqID_36805; Location=61..458; Strand=-
  SCN-specific regions: Sequence locations=1-398
  Gene Ontology: Mol. function=transmembrane receptor protein tyrosine kinase activity; Cellular component=integral to plasma membrane; Biological process=signal transduction
atggcgcacagaagaccagtgaagaaaatggagcccaacgcgcgcgtccccgtcaaatggctgtcgcctgaagcgttcgccgagcgctgcttcaccgcgaagagcgacacgtgggcctgcggagtgatgtgctgggagatcttcgccaacggagaagcgccgtacggacaaacgggcggaacagacgtggcggtatcggtgggtaaacacactttttttttgcttgcttttttcaacttttccttccttttcaggtgatcaacggaacgaggctcagcttcccgaaagatgcgccgtcaaaattggtcgagttcatcttgcagcacatttgggatgcggagacgagcggcagatactcaatggcagcggtccacgactggctgaagcgacacacgtaa

SEQ ID NO: 46475 - DNA, 508 bp, Heterodera glycines
  Genomic contig location: Contig_ID=SeqID_7817; Location=620..1127; Strand=+
  SCN-specific regions: Sequence locations=1-232,257-275,297-383,410 -434,456-508
  Gene Ontology: Mol. function=protein phosphatase inhibitor activity; Cellular component=soluble fraction
atgcggcagtcgaccaaccaaacgccggtcactcgcacaacgacgacgacaatcactgaacaacagagggaaggcggaggagaccaagtgattgttttatcaatttttcaaatacagccgataagtccgatcctttttctaatttagcagaccaattctgaacaatttgtgcttaggctggaagcaccgcccgacacgcggccgaggttagccaattccaagcaaaaaaaaggactttgttttgtttttaaagggtccaatggagcaccggaacagtggacaatgaaaacatgggcaaaaagaagtcgaaatgttgttgtatttacaagaaaaagcgcagttgggacgacccaaacgcatcgagcgaagacgacgacggagttggtttaattaattaattaattggcaaaagtaaataattaaacagcaaacagacccagattctcttgacttatacgatgtttttttctcttggaccaatctcgacgaatatggtaccaatcgatag

SEQ ID NO: 46476 - DNA, 1544 bp, Heterodera glycines
  Genomic contig location: Contig_ID=SeqID_7817; Location=1566..3109; Strand=-
  SCN-specific regions: Sequence locations=1-1383,1405-1544
  Gene Ontology: Cellular component=integral to plasma membrane; Biological process=cation transport
tttgctccgttcagattccctctctgttgctgcttcggctgaccgttccctgtgcttctcagcattggtcaaagcccatctccgcactccatgccttcatggcaccgctccttttctgtgccgcgttccaatgtgtgccattcattctgctccctgagagagtgataatttgtcgaaatgccaagttcaggtctcaaaactccgctcccatttgtgccgccttttgtcctcggtgagttggcactgctcctttccgtccttctcgcactgtttgttctctgcttcaccaaactccaaaaagagcccagctgttacagggtgaggccatttcaatgggttcaaaaatggacaaacaatggcctatctgatcaaatgcccacactttctaaatgctcactgatcacagatggagtctcctctctgatcagatgattagaattaattaccttttttgctaatgtgagggaccttctgctgatgatcattcacatttattgctaaaacactgcatctgttttattccgaactcatcagcagagtgagcttccgccggcacttccggtctgaccaaattgccatttctggtcgaattctccgaaatattgggctgccggaccatttaattgaaatattataaacaatgtagcaccaagtctcttttttaataatgacgtaataatgcatatattttttttgcagagatgcgccgcttactttggctttgccatttccatcgcttggatttatgccacagcttcggaagtccgtccattttttgcttttttcccccgttctttccccctttgtctgttttctcttttgaggtgatgaatgttgttctgatgttcggcacaatatccggcatccctcaccaaattttgggccttacggccattgcgtggtaagcaaaaaaagggagggggagaggagaaagcgtaaagacaaaaggaggaaaaacaatcaaaagcagactccgatcacttttgagaccccacttaagccacaatggccaaaacgtatgaaagtgtgagacatttccaaaatcaagggccaattcgatcggtgatctgattgcggacgtgaccgttgctcgccagggcacgccgcggatggcattttcggcggccattggcgcgccgttattcagttggttttggcactgtacgaaagtcagtgagcaattctcagtttgattacagatttgatggttggctttggcaccacttttttgattgcggaattgcaggggaaagtgatcattgtgagtgattttgggcgagtggcaattaattttccgcgagggaggggactccctcgtaaatttatgaaatcacaatgaaaatgccattctggctgagtttccggcacagtattccaagtacagtaggcttctttttgaagttttacttcgtttttcaaatgtttgtcaataattgatccaaaatgtcccctccccgtgccgtcgtcagattgagcccgaccccgtggccctggtgatgttcgtgttcctggccctgtctctgctgtgcactttgctgctcctc

SEQ ID NO: 46477 - DNA, 1491 bp, Heterodera glycines
  Genomic contig location: Contig_ID=SeqID_7825; Location=1365..2855; Strand=+
  SCN-specific regions: Sequence locations=1-3,25-717,739-761,783 -1344,1367-1491
atggattttggttttttaaatgactcgactaacaaatgggggaaaaaccaacgcaattattatgggacatcatatgttgacaaggactttggtggagttaatgattcggaggaggaagagatgcttcaattggaagaagaggacgcgatttcccggcagaagaaaattgagacgggaaattcgttggtcgattttgattgtctaattgcaaattcaacgataaagaacaaaggaaggagcaaactcttcgaagtccttcacatttcagttgcaaaagaaacgcctgaaaaggaaactgcgcaaggaaaaccgctagaaaatgtaattcaaatttactttaccagtaataatgttgcgcagattggcagaacttttgaacaaaacgtgtgcgatctgcagtcagaaacatcaaccgatggagggaatttcgacgatggaggaccgtgcgtttcaaaagaaatgcggcgaaaaataaattacgaggtgccaattttaatttttacagtgctataattggccgcttattatgacgaggacttttcagattcggaagaacaaaggcattcgaaaggacaaagggcgaaggaaagctaaacagcggcattcgcgggtgatgaagcgaacgcaatacgaaaaagcactgatcaagcgcaaatcgcaggtatttgttgggagcagtaaaaattttgttgtggtatttacctttaaagccataaattacttttctcaggtcccaaacatgcgtcgggaaatggagagatatgatggtgaaaagcgtggaattcgtatttctacaatccgttccacaaaattttaatttttgattaaattctttcttgcttttttgcgcacaatgccacagttaaatacaataaaattatcgtttttacttccatcaactaattatttgtagaaggttaatgacttcgcgaattttaagactttggcaggtaaaaatgaatttcattgattaatctgcttggagttttcagcccggagctccccgtcctagggtatttttgcctgatttctggataaaattggttgagcaaccgagcaagggttacaaccgtcttccaaaaaatgccgctgcgtttgagatcgacctcaaaatgtcgcgaatggatgtccgcgaatatttggaaaaaatttacaaatatccggttcgggatgtgcggattcgtgtcactatgggggatatcacatgggaccaccccaaagaccgggacaagagaagagcactttggaaggaagaggaccgaaagattgctatcgtcttttttaaagtatgcgaatactaatgacgcactggaatatccatgttcatttcagaagggtttcattgctgaagtcccggatctgttccccggccgtggcaccgatgctgaaattgatcagatgaagaagttccaagagcaggacgcaaatactttcaacagtcgctttgtcaataggggaagggcagggataggagaaatgctacctatttaa

SEQ ID NO: 46478 - DNA, 4003 bp, Heterodera glycines
  Genomic contig location: Contig_ID=SeqID_7830; Location=843..4845; Strand=+
  SCN-specific regions: Sequence locations=1-10,32-514,536-691,713 -913,936-965,1006-1833,1855-2347,2370-2659,2681-3629,3652-3848,3874 -4003
  Gene Ontology: Biological process=embryogenesis and morphogenesis
aaattttcttgccttggccgagaagctgctgacaatcgcaaaagacgagaatttgcactggcggcagatcgactttgccgaaacgcttctctcattgctgcttcggaaggactgcgacttgccggagggtaaaattagtgaaataccagtagaagcgaaggaggaattaaacccaatttacgtgcggttttatcatgcacccaataaatgtcatcattagaccaacaaattggcctgtatgtgttttttaattgttggtagagcctcccaacttatagttcgtcgttctgttgaacgctcatcattcctcttattactgtttcaggtgttgtgctgcacttcttcaagctgctcacttctgacatcataaacactcgcaaaattgcgtccgtttgtcccattcacattgtcaaacaattaatttattgttgctatttagcattggcttctgtagttcatggttgaaaatacacaggcaaaaggcggttaaggaggacgtcgttattccggtcggttggtgggaaagtttccttctttacgacgcagcaaatgcaccctccgatgccgacaaatgggacagtgccaaattccactcgaatgtccacccgggcttttacacttggccaagcaaattccgtgtgtatgcgccaccgagtgaacaaaaatgggtgagttttcgttaatcagccaatttttatgattttctaaatttactcccttttcaggcaaatcgcaacttttccgaactaacgccaattgtaaataaaaatccaattaaatttatttatatgaacaaattttaaggagcaagcgattgttacgatgttcaaagacaacaaattcatggaaagatttttgacctttttctctctggaggaaaaagtgagtggactttttccaattcaaagtgtttatccctttttcttttccctttacagaaaggaagcgaaaaagtgagtaataatggagaaattggaatgttttaattgttaattttatttatttttgcagttcgatcctgtcaacatgtcattgttttatgtgagtatgatgagtgattaattgctctctaaattaaaagcttttccttatctagcgcattttccgcagcttcaatgacattctcctcccggaattcctcgaaatgctcgacaaattgctggacatcggacacgtaaatagcaaaattgtttatttagaaatattttctgattaatttaatttgcattaatttgtattgtataaaaggaatcgcatcaccgtttggcttccgaattggtcaccggaatggtcagcgggtcgaagctgtggcagtacgcaaaagtcaagaaggtgcaggagcggctggagcaacgattgaccgacacttttttgggccttacggaagaagtcgaaaagaattggggcacggcgttggccaccattgttcgtcatcattttgtcagtttaatcattagtaattatttcatcgtttagttcggtgcgtgtgagccgcgcgtcactaattggcttatccaaatgcttttcggactcgcaaagcgacccacagaaataagcacccaaataaaaacgtaatttgtttgctttcctcacaaattcgttcctttttttaatatttatttaccgtttaggcgtttatatttgctacaatcgggccttaaccaggtgcggtaaaagacgacattctttcattttttaatgccatttgtcttacattgtttagtatgaatggcgaattccgaacgaatggcgccgattgtttgaactttgcatggatcatgtcaacggattgggctgttcctatcaaaatgtccgcttgcgtatcggaaggtgaacaaaatgatcaatgaaatttgggataaatggtgggcccataaaaatagaatgggaaatcggtggctctttttttcggcaatttgcggacaacggagtaccaaattcattctactaaataattaatcaattactcttaaacaaatcaatcataattaaattttaaaaaacgtaatttggcattccattgaccgaaaatggacccttaagaaactgaccacaaatttccgattttcagcaggccgcaaatttcatataacagtttaatttcctttcttcagctgtcttgccaccatttcatcgtccgatttcaagaaagcacttgtcgaggcgaatggaggagaagcgaacgccgacgacgacagccaattgaaacatgtcaccgttgaggaagtgatctcgcgcataaatgccatggtaacgtttgttgattgaatttggtggcgagaataccgcgtgggaaattattcaaattttatcattatccaatcagtgtgattctttttcaacatttttggggggattaattggttttcctataaatgatgcttttcgcttttctagcttactccactgtggagtgaagcactccgttcgtccgttggtgtgtccgccgatgttcctcacaccgaatcggcactttccttggatggcattgtcgtcactcccgccgatgaacacaaacgagaaaagctggcgctaattacactgcttaactacttcagcagtttgagcacgcattgggcacagttactgcgcccatttgcaacgtccatcttccaactgatcccattgttttcacactattccaatgaaaatacgtaagttttcctttttgtgccatatgaagggttgcacagggtgcttcacctccccctccgggtgcaccccaaaatctcgccgccgaaatcaaatcttagaaacttttttaagaaaatttcaagaacaaaccttattagttaaccgaaaaaattggtccaaaaattgtcctgttctcaaatggctaaaagacaattctcctgcgggtacttccccctcccccccccctcccctttcgagaattctaaatcattgatcgcctctatttttacggttaatgctatctctatgtacacttttaatttctggaatttgtttaagtcaattaattaaccactgtttcagtgatgaagaattgagagggtgttgtaatgcgcaattggtgcgttacatgggcctttcaactgtggcctcggcagcggacttggaagaactgttcgccacttgcacaacattgcgcgagcgggcgtcttggtggaagagcaaagtgtggtaaggaaatgatctctttaaaataacaattaagccgaaaaataactacatatttaccattaagccagataatcatggccccaaattggggtcctccaagaaatggttttgtattttggtgtttattttttggctgctttttctttaaccatcgtgttccaagtttacttttttgtaattttagcctgttgcgctttctccaagtgttcgcgttcaccaatcagttcttcatcagtgcccatccaaatggcttttcggcactcgagcaactgatcatcgactttttgtgtgacccccgctttgatgttcgcgtagcggcagcagaaacactcgggggactcatccgagccgccatcattgcagtggaccaacaattcctggccaaggcacgagacatggcgaattcgactgatccaatcacacgtcactcgggcgtcctcgcactttccgtatgtttcacatggaggggaacattttatgccagttaattaatattttattctttcaggccatcgttcgtgctttcccatactcagtgcccgactttttgcccgacgtattgatggcattggcgaggcattcgaaggaaccgcatccaatttatgtgggttccgatcaattgatttactgaaatgttggcaagagtcatgatttttccagggaaagggataaaattttagggagatttgataaaagctaatctcctttattattttatcattttaaggacactgtgaagcgcgccctcaacgaattcaagcggacgcatcaagacgaatggcacacgcataagcttacattcactgaagatcagctgctggtccttacaaatgtgatgatttcgccttcatattatgtt

SEQ ID NO: 46479 - DNA, 2003 bp, Heterodera glycines
  Genomic contig location: Contig_ID=SeqID_7833; Location=288..2290; Strand=+
  SCN-specific regions: Sequence locations=1-2003
tcttcggcaaatgctccccaaaatttgccaacgttgaaaaagcattcaggtggaagagggaaagggccgaccaacggcactggagggagaagggcactgatcggacactttaacattgccattgcctcccctcaggcgacactttgcggacggatgggagcgggagggggcgtcgttggccatttactggaagggccaattggtggtggatttgtgcgggggatacgccgacaaagcgtcgctgaagcggtggggcgaggagacgcggacggttctgttctcagtgacgaaggtgaaacgcgcatcggatttcaattcgtcatttgttttggcccaggcagtcgctgccctcgcggttcaaatgctcatcgaccgtggccacatcgcttattccgacaaaatcagcgtgttctggcccgagttcgcccgcaacggcaaggagaacatcacgctggaggacgtccttctgcaccgggctgggctcgccgctttggatgagacggtgacgatgaaagcggcacgggaccacgtccgaatggcacaaatccttgaagcgcaaacgccaaattggccactcggtgcagaaaatggcgagacaaaggcacaaactaagggtgtttaaggcacaactcggagtgggtaccatgccgtcacttttggctggctgatcgatcagatcatccgtcgggtggacccgcagaagcgcggcattagtcaatttgtgcgcgaagaaatcactgacaaacacagtgggcttaagcgccttccgttgatcggatggattaagcattgcttctcccctctcagacattgactttcacctcggcctccctctgtccctctctcacaccgtttctcgtctcacatttccttccttttggtaccaattgcgtgaatttgtttatgatccacgagtgatcgtcgttcaaggagttcttcatttgcgcacgagaaattctttacgaacgcgaattgcagagaatgcaacatggattcggatagacggagtgggactttgataaaattcaaacgaaataataaaattagatattcagaacaccaacactttcaacaatccgcaattatttgaactcgaacaagcggccgccctcggcgttagtcgtgcgaaagacgtcgccaaaatcttctctctgatgctttccggcgaactgatctcacgcaaatcgctgattcggctgtccaaacctcaaatcataaaccaaattgattacgtgatgaaggtgccattcagcaaagggcacggctttatgtttgaaaagcaccctaggaaagaagtgagaaaattgcaaccaattttctttgtgaattatctatcatatggttaagtttattgtgacaatgagaaacaacaattccaaaaactcgaaaacaggttgcgatatcgaaggcccaaaaaaaggggggcgcgagctaaaaaacaacaatttttcgcattttttgggtggatttgcagtacgtattcgataggtattgttgataaagctccaaatgctaaactattatagcaataagacgaagacaagtcaaacgaatggaaactttggcaaatactactgaaatttaagataacatttatgtttgatatgtacctaaatgatttttataccttttgctcactcaatgggtttcccttcccactcattgccaatataaaccgcggcatttctcacacgtattaaaccgtgttctgttcgtttagggaaaatggctgttcggacacccggggttcggcggatcatcggtgatgatggacccggaggaggaattggtcattgcttatgtgtccaatgggatgaagtccggtaaaaaagagcatccgctgattttgacattttcgagttcgataagcttcgcttaaggcatgggtgagctgacacgaacattcagacgattgaaattggcggcatttgactctatcaaagcaatttccgatggacgaactgatggcaaaaatcagacgcaatataataaatttaacagca

SEQ ID NO: 46480 - DNA, 1466 bp, Heterodera glycines
  Genomic contig location: Contig_ID=SeqID_7834; Location=76..1541; Strand=-
  SCN-specific regions: Sequence locations=1-901,923-1299,1321-1466
atgattggaaaccccacggcaatgtctgtggccctttttctgtttgccctcagtctgtccaacattgccaatggcattgtccattttgtccaggtcttttaacattactatgcccttctgctggtccattccctcacatttgaccttgttcagttcgacatgggccacgaacggtccctgcgctttccgcgccagcactccgccggtgcgtccgccgcgccttcgtccgatgccgcaaaatcggcaccgctctttcagccgataagcaatgacttgccaactcaggtgaagtgaggaaaaaacagctgactgagcatggtgattgttcagcttcaactcaccgacaaggacaaagaaaacgtggagaaggccacttcgttcaccaattctctgctggaacggctcggattggccggacagaacgacgctcagcagcaaaagggcgacatccgccggcagccgcccgtctcctcctatcagacggacgaactcgccgcgttgggtgcggatttggcagcgaatcgaatcgacttgcatgtgaggcagtcacagacggaatgccaccatttttgttctgttcaggggttggccagtggtcagattcccgggttggcacccattccggttcccggcttcgctgggccacaggacgcaccgacggtgccgggcgtgaacactatccccggcctcagcaacttcaattacatcgttggtcaacttgtgccccaaatgatccctcccaccaacactttgctcggctcgtccatttcgcggcttttgccaaaagatgcgaccaaaaatttggcaaaaaatgtgttccgcgctgttcaccccgcagcagagaatgttgacgttgcgcgaatgatgggcagatggtttcaggtgaagggttttctatctttgccattcctttctctttttaacctcttttggtattcttttccgcttttcctcctccgttggcactttttcctccctttttggcactctttggcactttttcctcccgttttggcactctccgcttttcaggtgatcaacagtccgcatgtcatccgtgaggcgtgcaccgtttcccatttcggcgctctgaccaacaacacttactcggccactttcaccattctgaagttttaccgtgagggcaattcgaatggtccgcctcgcttttcgcttggctacggcttcaaagcgggcgacacgggccaatttctgctgcactcgagcaattcaccagacgcagagccattttgggtgatcaaactgggcccactgaacgaatacaatcaggtgaaatggatgaaatgccaaatgatggtcttaaaaagccaaaattttgctaactcttacagtacgattacgcggtggtgtccaactgggtacggtaccccgtgttcgtcatcgcgcgggacccggaacggttccatcggcagcacatgaaaaaggttggcccaaaaggcgattga

SEQ ID NO: 46481 - DNA, 1048 bp, Heterodera glycines
  misc_feature (398)..(398): n is a, c, g, or t
  misc_feature (403)..(403): n is a, c, g, or t
  Genomic contig location: Contig_ID=SeqID_7836; Location=1479..2526; Strand=+
  SCN-specific regions: Sequence locations=1-22,49-483,505-816,838-1048
  Gene Ontology: Mol. function=DNA binding; Cellular component=nucleus; Biological process=nucleosome assembly
atgtcatctgccccttcgattgcttctccaactttgcaggctcctgcttcgtctcaacaaactccgaaaaaatctctgacgcctacgaaagcttcaaaatcgaaatcgctgaagacggccaagccgaaggcaatgaaggcctctaagccaaagttgccaaaagcttccaagcccaagtctccgaaggtttccaaatcgaaagctccgaaggtcaaaactgctaaggctccgtcaaaccacccgtcttacagctcagtaagagatgattccgataagaaataggcaaatattggtcaccttttcagatgatcaagaaagcgatcgctgagttgaaagagaagaaaggcagcagtcgtacagcgatgtaaagcatcattcgatatttaaaaaccaatctnaattntagtctgaaatatctcatgtcccactaccaattgggcgaaaatgcgacgaaggtggttttgcttgagaaaacgtaaattatttttgcttcgttactttttagatcaattccagcctcaaattgggccttaagcgcggcgttgtttcgggtgaattgaagcaagtcaaaggcattggtgcttctggttctttccgtctcggcggaagtggcacgccaaaaacatcggatgtgaaaaagagcccaaagaaaagaattgctgcgaagaagccatcggtgatgaaagcgacgccgaagaaagccaaaaaggccgtcccgaagaagtcgccggctgcgaagaaggcgaagcccaccgctgctgcaaaacccgaagttcctctgcccgtttcgccggcagtgacaaagtctaagaccgcgaaggcactgaagaaagacgtcccgaaaaagtctaagatggccaagagatctcctaaggtacttttttctctgttttattgcacatttataactttgcttctttcgcagatcgctaagaagtcgaagactccgaaaaaggcgacggggggtgcgaaaacttcgcggaaggtcaagaatgtggtggcgtcaaaatctgccaagaaggatgtcggtgttgatgctgcttcgtga

SEQ ID NO: 46482 - DNA, 249 bp, Heterodera glycines
  Genomic contig location: Contig_ID=SeqID_36938; Location=86..334; Strand=+
  SCN-specific regions: Sequence locations=1-62,84-207,229-249
gcgtaccgcttgctgcacagcttacaccgtcccgagtccgccttgcgccgcgctttcgccaacaaatcggcagtgacgagcccacggaccatgaccaaatgccgttccaaacctaataatgtgtagatgatgtacaattgtaatcaagggagtaggacatgatggacaattatagatttaaatcgcggagcaagtcgtttaccgccctatttttttaaatttttaaaacagaaaattgaaagaaaagga

SEQ ID NO: 46483 - DNA, 907 bp, Heterodera glycines
  misc_feature (52)..(52): n is a, c, g, or t
  misc_feature (98)..(98): n is a, c, g, or t
  misc_feature (134)..(135): n is a, c, g, or t
  misc_feature (211)..(211): n is a, c, g, or t
  misc_feature (250)..(250): n is a, c, g, or t
  Genomic contig location: Contig_ID=SeqID_36938; Location=1..907; Strand=-
  SCN-specific regions: Sequence locations=1-250,275-512,542-594,616 -739,761-907
  Gene Ontology: Biological process=regulation of protein activity, epigenetic
tttgcatccaaataaaaaaggaaaaaaaaagttgcggattcgtatcacatcncagactcatatcctaccaacactgaattacgggcccattcgatatnttatgttatttgtatgctatgcatgtcaaccccaannttacaattatttctgaatgtaattaatgccattaaaaaattgtaattcattttagctaaaggcaacatccgccgcncgccgccgctgcgcactcggccgccaccgccgttggtgngtggtggtggtgctgctgctccgaccagccacccgcaccaacaccattatgtgtgcgaaatttgcgacttggcacagttgaccgaccgcgagcagtaccgggtgcatttgcaggccgcacatcgtcaactgttggggaagaacaacgcggaaatggccagcggtgcaccgttggcgtgctcacgctgcagagaccgtttctggacatacgaaggtgctgctgctgaaggatgaacttctttttctccctgtcgtttctccccaaaaattaaaaaataataaaaaattttatcgttttagaatatgctggaaattttaaaaaaatccttttctttcaattttctgttttaaaaatttaaaaaaatagggcggtaaacgacttgctccgcgatttaaatctataattgtccatcatgtcctactcccttgattacaattgtacatcatctacacattattaggtttggaacggcatttggtcatggtccgtgggctcgtcactgccgatttgttggcgaaagcgcggcgcaaggcggactcgggacggtgtaagctgtgcagcaagcggtacgccttcaacattttgcaacgtttggtctccgatcaccggattaaagtatgctaattacatgtttataattgcaaataatttaattta

SEQ ID NO: 46484 - DNA, 547 bp, Heterodera glycines
  Genomic contig location: Contig_ID=SeqID_36987; Location=341..887; Strand=+
  SCN-specific regions: Sequence locations=1-291,314-327,349-485,507-547
  Gene Ontology: Mol. function=RNA binding; Biological process =neuromuscular junction development
atgagttcagaatcggacgaacagagtgccgatgttaacggactctgttcgcaatcgcttcgatcagatgaaaaagtgtgtcccgacccggacacaattaaaatgtttattggccaaattccgaaggtccgacgaaatttatgaaatgtttaaataataaatgcgttcttttgaggcgtgggacgagttgcaactgaaggaatactttgaggagttcggtccgatttatcagctgagtgtgctgcgggacaaagagacggcctccagccgtggtgactcacccccccccccttaattaattaattataataatcaccccaattaattcattttggagccaatttccaatttaggctgttgcttcgtcacttattatcaccggaaggatgcgatcagtgcccaaaatgagcttcacaatgtgcgcactttccccggactcagtcacccgattcaaatgaaaccggcggatgtcgaaaacaaaaacggtaaggaaaaggcaaacttcacgaaattagtgacaattaatttaccagtgacagttccgtaa

SEQ ID NO: 46485 - DNA, 1082 bp, Heterodera glycines
  misc_feature (1047)..(1047): n is a, c, g, or t
  misc_feature (1056)..(1057): n is a, c, g, or t
  Genomic contig location: Contig_ID=SeqID_36999; Location=1..1082; Strand=-
  SCN-specific regions: Sequence locations=1-280,304-822,845-1082
  Gene Ontology: Mol. function=dynein ATPase activity; Cellular component=cytoplasmic dynein complex; Biological process=oocyte cell fate determination (sensu Insecta)
tgaacgagtccaagggtaaaatactggacgatgactccgtgatcgcgacgctgggaaaactgagaaatgaagcacagaagtagcaagaaatctgcgaaaactgaccaagtcatgaaagaggtatagacgttttttaatgatcgtttcgaatcgattcttctaaattctaccgccaatttcccataggtcgaaattgtctcacaaaaatactacaagttggctaatgcgtgttcactcatctatctcatgttgcatcgtttggacgagattcatttgctctacaattattctctggactttttgctggacattttcacaactgttctcaagtcaccacaacttgggaatgtgaaagactacgatgctcgcctgtcaatcattcttcaaaatctcttttcggtctttttttactttactgctacaatagttcctcttgcttaaggtgatgtactctcgtgtttccataggaatgcttcacaatgatcaaattctgctcgcttctcttttgctccggatctattctcgctgttgcggtgcagagaatgcctacgaacaggaattggagcagctcacagcccttcctcctgagcaggtgctttcctcggcacacatgcttatgacgaaggcgtttggttcggaattcatgcaacaggacaaagtggttaacctccgtgaaataattttgaatgaggtcagacaaaatgtaagataccacttgcttataaaacatctcttattaaaggttcaatgcaaagtgcccgttttgttgtgttcagcgacaggctatgacgtctctaatcgcgtggaggaccttgcatttgagctgaaaatggacattttgtcaattgcacttgggtcagccgaaggatttgaacaagcggacaaagcgttgcaatcgacaagccgatcaggaagatggattctgctgaaaaatgtgcatttggcaaccgaatggttgactcaacttgagaagaaatttcgccttcacaatccacacccacattttcgtctgattttgacagctgaaattggctccgctctgccaanttctatganntcagtgtataaattaaaaatttact

SEQ ID NO: 46486 - DNA, 1208 bp, Heterodera glycines
  Genomic contig location: Contig_ID=SeqID_37020; Location=82..1289; Strand=+
  SCN-specific regions: Sequence locations=1-202,430-431,538-1062,1084 -1103,1207-1208
  Gene Ontology: Mol. function=cytoskeletal protein binding; Cellular component=cell-cell adherens junction; Biological process=N-linked glycosylation
atttgccgagaggagacttatgttcgggtgcaagactcaggggatggccgaacggaagaagcgacacgtccgctgacaggacagagcaaaccgcgcacagattttgctaagaaagcggtggtacaaccgatgcgccaagagaagctaagcgtgacagaacagaagacccttttggcaccggacgaacaaaagattcgtgaagaggaagaaaggaagagaaaagtggaggaagaaacgaagaggaaggaggaagaaaggaagagaaaagaggaggaagaaaggaagagaaaagtggaggaagaaacgaagaggaaggaggaagaaaagaagaggaaagaggaggaagaaaggaagagaaaagaggaggatgaaaagaagaggaaggaggaagaaaggaagagaaaagaggaggaagaaaggaagagaaaagtggaagaggaagagcgtaagcaaaaattgaagcaagacgaggaggagagaaaggcaaaaaagaaagcagaggaggaggagcggaagaggaagctgaaagaggaagagcaacggaaaaaggcactttcggaagacaaatcggcacagcgcaaatcaacgctgaacatgcgagaagaggagcgtatcaaagccgaacaagcggagaaggtgagtcttcccgggatattaagcactttttcgccgcttttcaggagtcagctcggcaaaaagcgcgcgcgacgggagcagtcgaagagaagagcaagcagtacacgacgacaaaaacggaagattcattcgcttacaaacgatcaaaagcattggaaccgaaaacggtggacgaacagaaaaagcgcacttttcaaccaattcaaaaacctgatccaaaggctgaagaagcattcgaaaaacaggtgaagaaagaatggcaatggcagaatgccgtacctaaacccattcagatggccgaacttcgtgaacagatgcggcagggatcgcgcaaattacagagcgaattccgagacgtaagccaaggactgaagtcggcatcggatgaggcaaaactgaagacgaaggaggaacggcaccgaactgtcatggacaaagcatcatcagcatttggaaaagcggagcaggagagacgcagacagcgagagcagcaagagagtgaggcggagagagcgaagcgagaaaaggaggaaagagagagcaaagaacgtgaaaagagggagaaagaaaag

SEQ ID NO: 46487 - DNA, 865 bp, Heterodera glycines
  Genomic contig location: Contig_ID=SeqID_37028; Location=488..1352; Strand=-
  SCN-specific regions: Sequence locations=1-118,140-246,268-272,294 -564,586-682,705-865
ttttcaggagtgccccagggaagtgtcttagggccatcactctttttaattttttataaatgatctgccgtcctttattacaaatgaagcggcatcagttggcataaaaatgtatgcctatgatgttatattatattatgcccatgaaaatgatgaccattcgaatcagttggataaagcaattgaggctttggaaaaatggtcaaaaataaataggttagaaatttcaactgaaaaatgttttgttttatattaagggaaaaataatatgaaaaaagaatattttattaactcacaaaggatttcagaatcggataatgttcgtgacttgggaattataattgacacgaaactgaatttttcagaacatattagaaaaattgtacgaaatgcatatcttagaattttccaaatttcgagagtgttgaaaagcagggaaataaaaactctaacagcagcctataaaacttttgtacgacctcaattagaatatgctactgaagtttggaaccctaatcttaaaaaagacatagataaaattgaacgtgttcaaaaattttttacaagaaaagcacttagaaaatgtggttttgtgtacaaaaaatatggggaaagactaaaaatcacgagtttacataaattggaagaaagaagaaaaattaatgatttaacaacagcttttaaaataatcaaagggttcaccagcctcgatgctgggaaaagtttctttttctcagaaaggctcaggaggcctttacttttacgggtaaagcgccacacggccaaaactcaaaataattttttccataggatagtaagaaactggaataaccttccagttttagcggtgcaaattaataaggca

SEQ ID NO: 46488 - DNA, 1047 bp, Heterodera glycines; identical to SEQ ID NO: 37050
  misc_feature (599)..(599): n is a, c, g, or t
  Genomic contig location: Contig_ID=SeqID_37050; Location=1..1047; Strand=+
  SCN-specific regions: Sequence locations=1-87,112-113,135-626,648 -652,700-707,731-760,789-835,857-908,931-1047
  Gene Ontology: Mol. function=acyltransferase activity; Cellular component=integral to membrane; Biological process=cholesterol metabolism

SEQ ID NO: 46489 - DNA, 454 bp, Heterodera glycines
  Genomic contig location: Contig_ID=SeqID_7871; Location=2962..3415; Strand=-
  SCN-specific regions: Sequence locations=1-62,84-300,322-454
gccatgctctatcgatgcgctcgtcttcggctgtttggctccgctgctgcgcacccctctgcccaatgatcggcttcagcttcacctctcggccaccccaaacctcgtccgattcgtcgattccattttgagtattgtaagtttaggtaattttgtaatagcatttgttttgccatttcagtatttgccactgcccgaaaaagtgatcaaggaacaggcgatggcgagaaaaaagtggcaaaagctgaaaatggacgcccaacagacaatggaagagggccgaattgagagggaactgcgcaaggcggagaagaaggagcgcaactccatgcaccacattctgttcttcgccatcagttcaattaccatctcacttctgttcgcccttcacacgggcattatcgtagtggacacagtggaccacaaagggaagaaaaaggcgaaggggggatga

SEQ ID NO: 46490 - DNA, 3446 bp, Heterodera glycines
  misc_feature (40)..(40): n is a, c, g, or t
  misc_feature (43)..(43): n is a, c, g, or t
  misc_feature (59)..(59): n is a, c, g, or t
  misc_feature (74)..(74): n is a, c, g, or t
  misc_feature (209)..(209): n is a, c, g, or t
  misc_feature (218)..(218): n is a, c, g, or t
  misc_feature (224)..(224): n is a, c, g, or t
  Genomic contig location: Contig_ID=SeqID_7874; Location=26..3471; Strand=-
  SCN-specific regions: Sequence locations=1-15,37-267,290-909,931 -1114,1153-2096,2121-2442,2464-2849,2871-3446
  Gene Ontology: Mol. function=serine esterase activity; Cellular component=endoplasmic reticulum; Biological process=embryogenesis and morphogenesis
ccgttcacttcccccgttttgcttcttcttccccgttttnggntcacacaaaattacgngctctcttcgcggtnttgtccattctctgcgcgactccgccgaattttgtcgatgtttttttgggcgttccttacgccgagccgcccgtcggtgcgcttcgttttgaagtgacatgcgcagattaagcaaatgggggggggggggaaagnacggcaacnttgccnggcattaggaaggggtttgggacctttagtggcccagaacgccttaatttaaaatatttaatattgaagaagccgattccgcctcaaaagtgggacggtgtgcgctccgcggtccgttccgcttccgcttgtgtgccccacgcgcggccctccgaaagggaagcgaacgacgacgcccaactgagcttttccgaggattgcctttatttgaatgtgattactccacacaaggcaaccagaaaacgaagcccatattccctttttgcttatcaattgttaaatttgggtttaggaagcgaacgcttcaaaattgagccaaattttggtgataatccatggcggaggctttgaaattggctcggcacatcggtacgacttctcggacatcggcgagaagttcgtccggcgcggcattatgtcggtggttgtgcagcaccgccttggcattctcggctttgcctccagcggagacaagacaatgccgggtgggttaaatgctggtgacattcgctcaatatttgaaagcacttctcgttttaggtaatctcggcttgtgggatcttttggcaatgctccgatgggtccgttccgaggcaaaagcatttgggggcgacccgcgacggatcactttgctggggttcagtgccggctcagccgcagtttcggcactcggaatgtgcccattcgcaagaggcaaatgggcagcgaatggacaattgccaaacatggcacttggtgtttagacctttttcaccaggcaattcaaattagtggcacaattttggcacaaacaaaaacaggagcaccggtcgctaatgagacgaaagtgttggcacagcagctgaactgcccgaccggtaaagagacgaaccaattttaatttaatgagcaaaaatttaattaaaaagtatttaattaaataattttagacgattcgttggaattaaaagaatgtctccgagagaaaagcgtcgaagaattgcacaatgcgatcgaaaaaatagtctcttctgctgctgaaaagaattgaatttgtttttcaatttttcgtttcacagggaccgactcgatcggacgtgaacttttgcaaatttggcccccgtttcgatggccatttcttcccccgcgacttccccgaactcatccacgaatccccgcccaaacggactctcctcggcttttcccaattggaatcgctcatttacagtaagcaaattggcaaagtattcaaatgccaatttctttgttttttcagcacttattcagcgccaaaatgattctttgactcaatatgtcgtgcccagtgaaaagattggcacttatggggccaccgattttgaggcattcgtccgcgaagttgtggccaaagagcaatactttggacagaacgccaaacaagtccaagcgaaaattgtcaaattttttggcgatgaatacgaaatgccaaaagaaaaagacaatgcattttggttggaacggtacagtatggtaatttagcgaagttttggagttggcctcgaaaatgtgaacaattccaaaggtgctcaccgatttgcactacataatgccatgtgtttgggagtcgcggctcaaaatcaatttgggatggccaatttggctgtacgaaaatgcctattttgagccttcacacattgcggagcaaatcccagtgaaaagcaagcgaaaagccatcaaattaaagcgaacattggcatttcataagcattttaggggccttccacggctcagatcacaatttgatgttcacaaaaccggcacagaaacacgcgaatattacggagaaaagcaaacggacggtggaaatgctcgtcgacgcatacgcaaatttcattttgaaagggtaaaaataggcaaaatgaattaataaaattcaaaaatggacaaaggcagccccaaagtgagctgatgatggccaattggagaatggccaaccaagaagaaccgatgagacatttgctggtggacggaccgaagccgaaaatgaaagaacgggcggacattcggagactgaagttttggcacgcactgaccgagacgtacggcgaatacaatctaatcagaggcacatttggacacccaaaggcggaggaacacgaggaattgtgaaaaacggaggaaaacccgaaatgaaactttcaaaattgattgatatttaatgatatgattaaacaaatgccattaattgacaattaaaatcaattaaaattggcaattaaaatcaattaaaattggctttgtgtgacttccctcccatccaatcggagttttaatgctgcgatggtccgcttggctgtggcaattaaacccaatgaatcggacggagtttctctcatccgtctgttcagcggcgaacactccgaacgaacaattgttccgccgcttttcccagctgctgatcaatcgatttgcaatgggaaacgaaccgaaacttttgactcttttcgccatttccacgaaaattaaaaagttaaactgatcaatttatttatttattgtgtatttcttttgaatgtttgttttctaacagttatttttgatcgtttttaccactgatctgtgcttttggtcggcgatggacggaataaatcggtcagttgagctgaaccgctccttccgcctcacccggtcgcagtccctctgcggcattcgttccacttcggccggcaattaccccgtcatcccggtccgattggcactcactcattcgccaattttggcattctttcactccgtgccatcccattcagcgcacttattccatctgcgacttcgatgactaccggcgcgaagtgatcgcccatccgatcacttggccccgtgtgcccgtctttcggcccattcgctccgcttatgtgtgccgcccccattggacttaccgctcctattggccatacaacgcgtcccgctttgagagccctccaattaaatagtaattaaatcaaatggaagaaaattaattatcggaaattaaatagggcaattattcagcgaatacggcgccgaccctttccattggtcgtatcccttcacagtttggacaaaatatcggaccgattggtaccaaccaaacgatcaatgcaatttaaacgcactttttaaatttttaggtacaaattcgacaacaaattgaatcatccgatttcgcttgcatggaaccacgggaatgtgctgaaacggggcattgtcagctgagcaaaagca

SEQ ID NO: 46491 - DNA, 522 bp, Heterodera glycines
  Genomic contig location: Contig_ID=SeqID_7879; Location=387..908; Strand=+
  SCN-specific regions: Sequence locations=1-72,94-363,387-396,420-522
  Gene Ontology: Mol. function=DNA binding; Cellular component =nucleosome; Biological process=embryogenesis and morphogenesis
atggctcgtacgaaacaaacggcacgcaagtcgactggtgggaaggcgccgcgtaaacaattggcaacgaaagcggcgcgcaagtcggccccgtccacggggggcgtgaagaaaccgcaccgataccgtccaggttgtcaccaggaacattttgaattactcggtcctatagaagcgggctttacttggcaacaatccaattttggccattttgacccaaacttgaaaatagagatttatggacattataaaaacggcatatgattatgttacaaaccaatacaattgcatgaaacccttttctttgtagggaccgtcgcactgcgtgaaatccgccgctaccaaaaaagcaccgaactgctcatccgcaaattgcccttccaacgattggtgcgcgaaattgcccaggacttcaaaacggacttgcgctttcaatcggctgccatcggcgctttgcaggtgaaacagtttatagctaaagaatcacgccaaaatgagtcaattccagtccaatacttttga

SEQ ID NO: 46492 - DNA, 324 bp, Heterodera glycines
  Genomic contig location: Contig_ID=SeqID_37107; Location=233..556; Strand=+
  SCN-specific regions: Sequence locations=1-185,211-324
gaccatcttgatcgtgaatattctcgtactgatttttcgctggacgatggtgaacagatgttgcgacagcttgactctgtccgtgaatacatccaacaattgcatgcgcgactcctttcactgaccgacaggtgagcaaaagcctaacattttttggcactttttttgccatggcatgtcattccaatttttttttaattaattttttttcaaggtgtgcccaaatttcaccgctttggcaacgtggcgaacgcatttcaaaaccgctgccggtgatggcactttgcgagtacaagagcaaggacaaaattcacatcagacaag

SEQ ID NO: 46493 - DNA, 336 bp, Heterodera glycines
  Genomic contig location: Contig_ID=SeqID_7882; Location=8..343; Strand=-
  SCN-specific regions: Sequence locations=1-336
atgccaacgccgaacctccaggcgggcatgggcaatggcacgcaccaccaggcggagaagggcgagcaccaggcggagaagggcgagcaccaggcggagaagggcgagcgcaacgaggatatgaagaagtcggaggcgaccattccctcccaggccggctggaacgagggcgactcgcagaagctgatgatgaccaactttggcacgccgcgtgacgtgaagggcaaacatttgaagcgcatttgggagttggagttcccggaggaggcggccgactctcagcaaccgacggcaccggtcaatgcggcgccacagcaacagcaacaggcgacacag

SEQ ID NO: 46494 - DNA, 4418 bp, Heterodera glycines
  misc_feature (2500)..(2500): n is a, c, g, or t
  Genomic contig location: Contig_ID=SeqID_7884; Location=1427..5844; Strand=-
  SCN-specific regions: Sequence locations=1-111,138-270,292-1927,1949 -2301,2325-3061,3085-4243,4267-4418
atgccaccagtgaaaaccaaagtggaggaactgtcgctgaaggaggaggagcagtcgaccagccaaaccatcatgaccatgacgcggactcggcgcaagcagaagcaggagatggtgcgcaaggccatccgacgggcggaggagagacagcgcgagttgcgcgagcagtacccactccgagcgacggcggtggtgcaacaggtgatcataggagcgggcaaacagcaactgctacctgggaatgatcaattagcgggagggcattgcccgggggagggaagtggcggtgaaacagccgcatgaaagtgtgactcgatacccttactttttacgattccccgagacagagactctcgatatgcctaccggttaacccccggcactatctgtccgttaaacattaattcttgcatttttgcaggtggcctatgaaccggcgttgttccagcaccaattgaccgctgccgactcttcccaagctgatgaccccgcactgcttgagcccgttcaccaggcgcgacaagttgtgcctgtcgcgcagccattgttcccttctgcgattctcagcgttgtgccgaccatcgtcgaactgctagacgatgcgcaagtggacggaagcggagtctcaggtaattttgcccggagcaaagaaaggcatttgtaccccgggacttatgcatttttaaaaatagttggcgaaacgtgccgacgtgtgatttggagttgctttgtggaggacacggcactttttcttcggcatttcttcgaaaaactcaccaaccgagcaaaacaggtgaagcaaaactggaactgcatttaaattttcaatccgttttccctttggcatttcattccccgtccctttttctctccgttttcaatctttgcccccccccgtcttcaaggagtatctgttggctctgctccgtcgccttgtgctttccttccaccctttgccctctcaaactgcgcacacgcttttgaacgcgttgttcggcttggccatgttttacgtgcgaacccccggcgaaggcagcgaccgttcgttggcattggcactgagtttgtgttggttggtggtgccgttcgtccacggactgtacttcaaggacctaaagcagacgctgaagaaggagcagtgcgaccaggccattatggtcactgccaatgtgccaagcgcaaagaaagtgagatgactcagggaatgcttaaaaagaaaggcagcatcggcaaattgtgctgctttcaggtgattgtgcatggacccgactcgcaacagggcggcatcccgacccaattcccggtgttggaggacacccaattccaacatttgctcgcggattccatcgaattctacaacatacaggcacacgaggcgcaccatttctttctgtacgatccgaagacgtttgtactgcacaacccaagcgcttttgttcggtccgtccctcccaatgacaaatgaatgcttttatgtgcccttcttttccagcgacttttacttcttccaccgctccttttatccccaattgcaattggtccgtttggacattggccaagcgcagcagcgcatccgcgagcatgccctccagcagaagctgatcgaaacgggcaaagtgctgctgacgcacaacgccctgcgccactcgcccgaggcggtcattccgcagcgcattttcttcctccacgacgaattcacgcatttgccctccttcccacgccgcgcggtggagacgtgtttcggcatgtaccaaaacacgagcggagcggaactgcaaacgacggacgcactgcacaaattcgcatggagcaagctgatcgcgaacatgttcgagaagatggagaatgcgttcatgttcggcgacttgcatctgttcatcaacgtgatcaatggcattatggtcggttagccttcgtttggggtgccaatgccaatgccaacgaatgtcagatcattcactgcgaggatgtgctgatcctacgccgatgcatggccgcctatttgggcatgagcatccatttcaactcgctgttcgcctcccagggattttccctgattatgcccaccattctccgctgctacagccagcgacagcccaaccgaatgttcactcaggtgccctccgtgggggggggggggggtacgccatgtacgactccctcccccaattcatgagaaaaatactaagccgaaaagagccggttaatttttacatcatggaattttattgcataatctagggacagcagcagatagaccggcttataaaaagtgccacccttttggttcattcctaaatcctggtcctgtttttcaaaattaaccttccccgcccctctttgttaggtggtggagttcgtctgcaagcagttctacgtgttgcatcggaagccttttctgctgcaaatgttcggctcttgcgcggaccttttggaccaaagcgacagcattttcgaggctaatccgatgcgggtgaaggcccaagtatttattcgcttngctgttggccatggagcgaatgaacgaaccgttggaccaattggacattttggccatgttgccccacccaaagccgctacaggcgctcgacttgtgctaccgcgacgagccgaacactttcaacattctgaccgatgccatggccagctgcgtgtgagtgagccgaatctggggttcccaaccgaaacaggcattcgaattcaatcatttgaaatgggtattgcctctgccgttctttccgttccccggcatttttttttgctcgttagggccattaaacatttaagccgaattgaatttgttgcagcacaatttgtgcgtttgcgcccgaaagtcggcgtgcccatcagatgcttttgtgcatgcaatcgatgcttccccatttggtccggcatatggaagaggagacaaatcagcgacaacagcaggcggccaacgcgctcgctgcgcttaaattggagctgtccgcttatgccacgctgagcgtggaacttcgtgctttggtcaacagttgcgacgtgctcgcgcgtgggccgacccggtcctttgatttggccgcgagcggcggaggcggtggaacggccggtggcgcttcgctggcgccatcctccgcaaatcgtccgcacgcgactgacccgcgtcgcggtcgttcgcttggcggtggtggggccgactctccgcaattctttgatccgccgacaattgtggaggacgaagtgagtcgccagcagcagtcgaccgcctcagcgaagactgagaagaaactgaccgtttccggatccgctgacggaacaacgacagccgcgacggacaacgaagcgatgaaggaacagttcagagggccgcgagacgggcgagtggcacaaaatgccatcattgtttcagtttgtgtgctttagattgctcacgttgtgttcaatgttcgttcagctcggctccgagcgtctgaaggaactcggtcgactctcggtcggtctcgactacagtcgtggtgtaatgcccgagctgttggaccacaaatgccacatcaaactcagcgaagttgccgttgctctattgaagttggccccgtacgactcgaactcgttgggctgtgctgggctacgccattacttcacgcaagtgatgcccgtggtcgactggtccgtggagacaaaccgatccgccattaacatcattctccgtcggttggacaaaaccatcgccaaaatcgccaaaaggccgtccacgcgacgccgtgccaattggggcgtcatcagtttttggctggtcggactgcaccaaacgctgctcaactcgccgtacattgcacatttgcactctctgaaggtaattagggttaaaagccaaaattaatgaaaagccgtcacatcggcttgtgcccaagtcaaagggatgggcgatgcatttggcattcattcagaccatcactttgctctgcttgcggctgaccctcggcgacccctttggcattttggacgaccaaaccgtgccgcctttcactctgtccgcccagcacagtgccggtgccctggccggcgcttacctgtcttctgtccacgccccacagactgtgctcagtgcccactctccgccagcttcgttttgtaacgtcgtgctccgattgacctcttttctgatgaccaatttgggacaggtaaaatctcaaagcaattaattgagtttaaaattgggttttttcaattattttcagctcgttttttcgctcgagatgatttgcggtgtggaaaacattggcccattggcggaacgtcccgaggcaattctgtgccaatttcttatcccaatgtttttgcgtgccgcaattcccggcaaaggtggtggcagtgttttaacatcattaacaaattcacaaacccaaattaagaagcgccacagttccggcccaaagacttga

SEQ ID NO: 46495 - DNA, 519 bp, Heterodera glycines
  Genomic contig location: Contig_ID=SeqID_7890; Location=2266..2784; Strand=+
  SCN-specific regions: Sequence locations=1-308,330-495,517-519
  Gene Ontology: Mol. function=protein translocase activity; Cellular component=mitochondrial outer membrane translocase complex; Biological process=mitochondrial translocation
atgagcggaggagttgattttcccgacccaagtgatccacaggcgaatgagatcttcttcttcagtcagatcactcttggagaggagaaaatgcagactggtttttatttatcgccagtccaataattacgttatattaaaggccacattgaggaggggattacgcatctgtcgaatgcaattgtgacttgctcgaagcctgacgaattgctcagaattttccaacagaccatcccaccggagtgtttcagtttgcttgtgcaggcaattcctggcgccaaaatggtaaattatcacgatttatggaagatgaaaatgaaaccattttttagcgtcggaatgcctcttcatcgtatcgccatgggcgagagccgattgatttagactgtgcaaagattgacgatattggtgacaatgcggtcgacaagaaaatgtttgttttgcaagatgacgagcttgaatgaaatggaatacgacaggaaagcaggccactccaaattatattttgttttgtttcga

SEQ ID NO: 46496 - DNA, 679 bp, Heterodera glycines
  Genomic contig location: Contig_ID=SeqID_7890; Location=2900..3578; Strand=+
  SCN-specific regions: Sequence locations=1-20,42-209,233-534,556 -634,662-679
  Gene Ontology: Mol. function=structural constituent of ribosome; Cellular component=cytosolic small ribosomal subunit (sensu Eukarya); Biological process=protein biosynthesis
atggcttcacgaaaaggaaaggtcaaggaagagcagccggctgtttctctgggtcctcaggttcaagaaggtaagaatcaagcacctatttattttaacaaaatgtacttttccctaatgatggcttccacatacgttttacattatttttttcatatattctccgtttaggcgaaaatgtctttggtgtggcgcacatttttgcgtctttcaatgacacttttgttcatgtgaccgatttgtctggacgtgaaaccattgtcaaaatcaccggtggaatgcgtgttaaggccgaccgagacgaggcaagtccgtacgctgctatgctcgccgcgcaggatgttgcggaacgttgtaagcaggtccgcattttttatttagtttttctatttaagcctatcaaaacagtcccattgtgtttaaggttggcattaatgctcttcatgtcaaattgcgtgcaaccggtgggaccaaaaccaaaacgccggggcctggtgctcaggcagcgctgcgtgccctcgctcgttcgggtatgaagattggtcgaattgaagatgtcacgcctattccttccgactcgactcgccaaaaaggaggccgtcgtggacgtcgtctttgagttgattcaaatgcgtcccgatttttgttgttgtttgagttctctatcgcttttcttcaa

SEQ ID NO: 46497 - DNA, 907 bp, Heterodera glycines
  Genomic contig location: Contig_ID=SeqID_7895; Location=1114..2020; Strand=+
  SCN-specific regions: Sequence locations=1-274,296-907
gtggaggatttgttcgatttgaactcgccactacccgccattggccaattggagcccgagtgttctgaccccgccttggaccccgtacttcgcgaacttgacagtctccccgcttttcagtacagacatcagctgaccaaattctacaaaccggagaaggccctgagaaatgtttcgaatttgtcgttgttttgccatttacaattctcagactctccgatcactcggctcctccggcaaagtcgaacagattgaacacgtggtggcccgtctttattttgccatgaaatgtgtgcattctcacaatcagtgtgtgttttgatcgctttccgtttagctgacgaagtgcactgggctctgagcactctttcggcgttgtattggcgggtgaagggcgacccggtgaatgtccgtcttttgtttttggctttctttggccaaatggaaagagtcaaattcaggccattaaatgccttcggcactctctgcacaaatcgccaaatatattcaaagtgccatttccaaattttgttcgcaccattttgccttatctaaggacgtccctttgatttcgctggccaacatttaccatcaagctggcttccttcacagtgccctaatcgtcggacgaaaaggtgccgaaacatttcctttggcgatggctctctctctttgacagcattggaagcgggcgtcgacgtggtcgctttgcacttcactttggccaacatttacgcctctttggtcgtccctttgcctctgcgttaatccctccgtccctttagtccgattttccccacgccctccaattttaccactccacactcgcacttcagtccaattttgagccggccaatttgaggattttggtctgtccttttgcatttgtttgcccctattccaccga

SEQ ID NO: 46498 - DNA, 2702 bp, Heterodera glycines
  misc_feature (2098)..(2098): n is a, c, g, or t
  misc_feature (2150)..(2150): n is a, c, g, or t
  Genomic contig location: Contig_ID=SeqID_7896; Location=254..2955; Strand=-
  SCN-specific regions: Sequence locations=1-358,381-627,649-745,767 -1552,1575-2192,2215-2549,2622-2631,2653-2702
  Gene Ontology: Mol. function=fatty acid (omega-1)-hydroxylase activity; Cellular component=extracellular space; Biological process= prostaglandin metabolism
atgggctttttggttgtttttctgatcgcttctctgttcgcttggctttccgcttggatcagtcggaagttcttgcgcatctctcagttggtcaatcgaatcccgggcccttccactttgcctttggtcggaaatctccatcaaatccggcttaagcccgatggttagtcagattagggccccgttctgtgtggactgtttgttcagaattcttcgagcaagtccagggcctcgcttatatgttcggggagaagaacggacgcatcgcgcgggcgtggctcggccccattccgcttgcgatcatttttggcgccgaggaagtggagccggtgctgggcagcaaaaaactgctgacgaaggtcctcccacacccctccctctgcttctaattgcgggtccccccttcccatggctaacacttaaaaaaagtaaataagccggtgattcccactgtggcactgccattgccaaacccctgcttgtcaagatgttccactactcctttctgtccgcttggatcggcgacggccttttgctcagtaagccgaacaaatggcgcccccgtcgcaagttgctcacccccaccgttggttatttattccgtccgattgcttccgcttactcactctttttgctcagtttcactacgacattctgaaggactttgtgccggtctgtccgtcgcctcccaaaaaattctcttttcacccctcaaaaaggtgtataatcggcatggcaccacattagtgcaaaagatggagaaaattgcggaaagtggagaatttgtggacattttccacaccatcactctgtgcactttggacatcatttgcgaggcggcactcggcgtgaacattgacgcgcaacggaccattcactcggactatttggacgcggtgttcgccatcaaaaatatcattttccaacggatagtcaaaccgcaggtaaaagaacaaccgacggaggggacgacgattaatgggcgaactgttggatgggtagccagttaattaacagttggcatggaattgcttaattgcctattaaggttaattggtgttttcagttttatcccgaatttctgttcaacatttttggggctggcaaagagcagaagcgatgtgtccaaattctacacgattttactaataaggtgaaggccctgcagaatcatttgtcattcaagccataagccaaattaaggcgattttggcacgtaaaaaagcgatggaagaagcgggaggcattgagaaattagtggcgaagaaagtgacggagggaggcaaaggggtgaggtaatcggagaagaaagggcccaagggaaggcaatggcatataaaaatggacaaaagggacaaaggcaaatgcaattttagacaatataaattgccagtagaaaatgcctaaatccgttccgcaaatctcgaaactaagcagagattctttttggagtgttgaaacccgtataaaatacatcttcttcttccgattggcattgttggatttgatgttggacatggagcagcacggccagttggacttggccggcattcaggaggaagtggacaccttcacttttgaggtgtttttctgattgggaaccaatgcccccccccgcccaatttcccgtagggccacgatacgacttcgacagcattgaattggtttttgcatttgatgggtgccaatcccgaggtgacaacggcattcgcgcaattggaatttctcatgcacaaatcgcagatccaatcgcgcgttcagcgtgaaattgaccaattgctggggcccgaccctgaggccgaacttcgctacgagcaattgggcgagttgcgctacttggaagcgtgtctgaaggaaaccctccggtctttcgctgcatgccaattgctttatccgtccccttatctgctttagcctttacccaagtgtaccactcatcgctcgacaggtccaaccgaatcttatctaaagattttcttatcacttaattggtcctttcctttttaaaggtaactgaggacacgcaaatcagtgagtggtgggaagtgtttggctgagatttgcttctcatttcagaggattttttgctgcctgcggngaccggcattatcattgtggcgtcgatgatccaccgcgaccgcaattattgngaaaaccccgagggttcgtttcgtcttctttctgccgatttgcttcttttgttctgcccctttcagtttttgatcccgagcgctttttgaaggtcgactatctgaagcatccctactgctatatccctttcagtgcgggctctcgcaattgcatcggttggcattttgaggggggggggggggaagaaagtgccgacggttatggcaaatgctcaaatcccccaaggccaacgatttgctcttatggaagagaagtgcctaatcacaaagatacttcgttcttttcgagtcacttcaaaattacgcactgatgaggtgagaagggaaagaatcgtttattggacacaacatcttcagatgcgtgtttccgctgaactgatcattcggccaatgtttggtgagtgagagagagacacacacatagagagagagagagaaatggacagagagggaggggggggagagagagagtacaaagaaaactcccctccccaaggcaattggatacgactgcaaaaacgcgaaattggggaactaaaaaaagaacgccaa

SEQ ID NO: 46499 - DNA, 3715 bp, Heterodera glycines
  misc_feature (2212)..(2212): n is a, c, g, or t
  Genomic contig location: Contig_ID=SeqID_7902; Location=11..3725; Strand=-
  SCN-specific regions: Sequence locations=1-17,50-154,176-539,561 -1672,1695-2345,2382-2761,2890-2919,2956-3159,3182-3319,3350-3715
  Gene Ontology: Mol. function=chromatin binding; Cellular component =nucleus; Biological process=establishment and/or maintenance of chromatin architecture
atgggaggattcgtaagtcccttttcccttcaaaataaatttcaattttccctctcagaatgaaggctttcttaaattatcacgccagaatgtgcaattcaagaataaaggcactgggaaagtgttgacaattactgaatcggacattgaccatttgggatggcaaaaactggggaataagcccggcctgaaagtggtgaccaattcaggggtgcaccatcgttttggcggtctcaaagaaaacgtttgtaattattttaagcgtttgaatacattgaatttaggactatgaaagggtttccgcttttacgaatgcgaaatggcaaaagactctaaagaagaacgaattgtctctgaaaggatggaattacggtgacgcggaatttgaaggttatttttttcattatctaatcggtgatatttggcagtttattcccaattgatgtgctaatttaatacaaacacttaacaaaggtcactcgcatttgattaaggtcaaaatctggttttcaatgtggctgaaaaagtggcgtttgaaattcctctttcaaatgtcatgcgctgtcaaaccgcaaaatcggaagcgatcgtcgaatttcatcctaacgaggaatgccctgtccaattgactgaaatgcgctttcacattccttacgatcctgagaatgaggaccaagatgtagttgaggtaaaaaaaagctatgaaagatgagaggaaatcggaggggaatgaatcggagacgggagatgcgtataccctaattcctcccctcactcaagcataaattcaaggataaaaaagcttttaactttttcaaatattttatacctaatcctggctgaattttcttaacgccgccaaatccgcttaattctaaatatttctaactcaacaaaatcactttttatgtggtaaaaattctgttacttgtaagctacaccttatgcgccgggctttttctttagctccaaaacccatcgtctcccgggaatggttttcccaagccgagttcctgaaatgattggtgtttttttcgtttaggagtttcgcaaagaagtgctgcgttttgcagaggtggaaagcgaagccggccaagcgattgccactttgtctgacattcttctcgccactccccgcggtcgttacgaaatcaaagtgtttcagaaccatttatcctttcacggaaagtcttacgattacaaagtgccgcttaaaacgataacacgaatgtttttgctaccgcacaaagacggacgccacatgtattttgtattgcacgtaagtggagcaaaatcatggaggaaaaaaaggaaaaaaccacaaaaataaaccctttttatggcataagggcacaatccttgtgcagaaacaaatggtttgaactttaggagactttaatacctgtttagagactcgatataaatattcatttgtttatgaagtttgtcgttatttcgtctttgtttcaggtgaacccagcggtacggcagggccaaactcgatacccttttcttgtgctcgagtgctcaaaagaggactacattgagctcgaattaggctgcactgagtgagtgacagattgtgaacacaattataattataactagggaaccactcgaaaataagtcggttaaagtgggaatcaatttgatactattggcagagcatggtctatcactttttaaatatttaatattacgcccctaaagcaataaatcaaaaaaatatgaggcccaaaaaatcatttatttgctggaaggaaatcacagcctaaatttcgacttttgaggcctcataactttttgatttcttgataagggcttattaaaagttacaaagaaatcgaccaaactttatcaaatggtataaagtttataccattttccgtcttacatttcggatgattcccttgtaagttttacaatggttttcgccagggaacaactcgctcagcaatacaacaacaaattggacatgcacatgaagggttatctgtttgaaataatggctaaaatattccgtgtgattgttaattcgcgcattatcgtccctggcaacttcacggggtcggcttttcagtcattcctttgtgtaattgtgtgcctttttagtgcctcgggcactcccgccaatttcgtgcgccgttcgccagtcgatgggttttctttatccgctggagaagggctttgtgtacgtacacaaaccggcgcntttacatgcgttttgaagaagttgacaatgttcacttcgcgcggtcggacgtttctttgcgctctttcgactttgaaattgtgcagaagagtggacagtcgatcatattcagtaacatcggaaagtaagcgcaaaaagaaaggggaagttttaaaatgcaattttagggaagagtataacagtctcttcgactacgtacagacaaagggactgaaaatacgaaatgcgcagagattgggcgagaaagcgtacaaagaggcggacaaatttgctggcagcagtgacgaagagttggacccgtacaaagagaagcttaaggtaatgttttcgaaatttgaattgggctaatttgttaattgaccaaaggacgacgcacgagagagagcggccgggtcggaaagcgactcggaggacgaggacttcaacgtggagaaagagatgaagaagcgcaaggcggacaaggactcgtcggaggggtcgggctcagaaccggacgaggaatattcggacgatgggacggatgtatccgacgatttgatggggacagataagggaaaggaaaaagagaaagaaggagccaaaaagaggaagaaggacagggaggagggaaaggaagagaagggaaaaaaggaaaagaggaaggaaaaggagggaaagaagggcgagaagaagaaggacccgaacgcaccgaaacgaaatcaggtgggaacagagaagagaaggagagaaagggagaaaacggaactcaaaaacgggtcggagtcgtacccaagtttgttagaattgctccgcaaagtaaaaattatacaggaggggggtaacgaccgacttaggagaaaatcgccggatgagtttttggaccataacatcaaattaaacattaaagccatcaaacaaaaccaagaatatgcttattgttagatgagagaagcaataataaccttagaaccaattaaaaaccattcaattcagtccgcctttttcatctggcaaatcgaaaccgaccgcagatcaaaagccgggggacagtgtgacggaaacggcggcaagggccgggcaaatgtggaaggctttgagcgctgaggagaaacaggtgggcaaccgtactttttaaaatggaaacagagtcttgggaattttaacacgtttccataaataaattgtgaaagtgatgtccgttattagctgactaattaattactcctttctttttagccttacgagcaaaaggcgaaggaggacaaagagcgatacgaacgggagatgagcgaataccaaagcaagaaaaaggaagcaggcgaagggccatcgtccgcgggacagaccagttcccaaaatcagccgaagaagagccaaagcagccccagcaaaaagcccatctcgaaggaatttgtggacagcagcaattcatccgattccgattaattatttttgcattttatttatttacattttcattattattttgtgaatgtattaacccgaaaaaggatgacaaataaa

SEQ ID NO: 46500 - DNA, 1308 bp, Heterodera glycines
  Genomic contig location: Contig_ID=SeqID_7906; Location=866..2173; Strand=-
  SCN-specific regions: Sequence locations=1-121,145-256,278-279,303 -391,429-1308
  Gene Ontology: Mol. function=DNA binding; Cellular component =nucleosome; Biological process=nucleosome assembly
atgtccggacgaggaaagggcggaaaagcgaagacggaggacggaaagaacaaatcgcgctcatcccgggctggacttcaattccccgtcggacgtctccaccggttgctgcgcaaaggtgcattttttggatatttgaattttcgactatttgttcgaaatcgggtccgggcttcggaatttatcgaaatggatgccctgattcgtgatcagtttttaattgggttcgaatttgcatttttcaaaatcacaggtcactacgcggagcgcgtgggtgtcggcgcgcctgtctatctggcagcggtgttggagtatctgacggcggaagtgctcgagttggccggcaacgcatcgcgggacaacagaaagacgcggatcaacccacgccatttgcagttggctgtgcgcaacgacgaggagttgaacaaggtcggacagcagccgatttttgttttttggatcgggcttgtttcgttgtgattaattgaacatgtccatctcgaccagggatggcaaggattccgacatttctgggcctcgaaattccgattccatccctaatctcgacgcatgtttcacacctcaattagtccgccgcaccttgcgagttggcccgcgttgagatggccaagacgaattgggcgctggttctattgcacactttacgagtccaatgccattttatgaattcaatacaattatcgatcctgtttttttgggccttatggtttgaggtcccaaaatcaaaattgctcttgtgactttaaaccgatatttaccacaaaaatataggatttggtacaaaaaaaatgattattaatttaattgattgatttctaaaaaaaagccattggacacataaactgtgtaatagaagccttgggcggttcactatttttgaaatctgtgatttttcagcttctctcgggcgtcaccatctcggagggcggtgtgttgccgaacatcaacccggttcttctgcccaaaaagtcgcagcacagcgaagtcagtgaatgagcggagatggacgagggacaatagacgaaagaaaaaccatcccaaacggtgtcctttttagggccacaatgactcaacctttattgaatttgactaatgcgtttttttgtattttaatgacataaatttttattccatattctaattgaatttatgtatgcaatatggcgctacttgcaaagagcactattttgaaaattttttcaccttttttttggtcaaaatttttttttgtttttttacacataatgatggatattaagtattaacagcacaattatggtgaataaa

SEQ ID NO: 46501 - DNA, 2413 bp, Heterodera glycines
  Genomic contig location: Contig_ID=SeqID_7909; Location=2769..5181; Strand=-
  SCN-specific regions: Sequence locations=1-567,589-663,685-685,707 -707,755-792,840-1028,1078-1085,1117-1172,1194-1272,1296-1395,1419 -1490,1512-1578,1601-2273,2295-2413
atggacttgccaacccgggaatgccgcgtggaacaagcctgcgaatttatgaccaatctcctacaggacatcagaaaatcagaagagaaagtaagtaaatataattaagatcttttctaggtcaaacccaaatccattccacacttggtttcaagacattaaatcccaaatccataactgttgtttcagtctggttttcccactccctattttaacgactatatggagctattaaaatatttattttagcttcattgaccttgtttacctacctatattcgcaattttagatggtccgtgatattgtttctgacttggaaatccgccgaaaagcagtgaccattctgagggattttttggggttgccttccttcgacgagtcgcttctcccgcccaaatcgatcgcattggtacctcaaattttttctaacattttcactgatttttttaagctgaaagtccttgattcggaaaaaaaccgattggaagcgaaaagggaggaaattgtggggagccaagcgaggctgacgggaaaatacaaagcattgtgcgatagggtgggaacaacggcgcgacaaatcgaaggagtgcacgacagagtgagagagcgattggggagacaacactaaaatgatttgttacagattatgtccgaagatgagttggacaaactcaaaggcgaggtggacgcgctgcagacttttgtaaacaaacggctcgagaaggcacttcagctccaagcggagagcaaacggtgcttggcatattttattaatttcaaatttcgtttcagaatctttgagaccattcgcccgtccatcaatagtttcaatgaagacgacctccattttttgcgtgttgacttgtacaaccaatccaccgtgttatcgtctgactttctgaagaagatggaaaaattcaatgaaagagtgagttcaaagaagggcgatcgaacgaagggcttaacgatctctgtttgcttatgcccctacaaatttagctgaaagaccatcacgacttgtgggctgaacaggtcgtcttccgctatgacgagctgctcgttaaattagacgagttatccgcaaaatgtttccaaccttctacggagtttccagcaaagccaaatttgagtaagtgacaattgtcaaagtaaaagtcattgaaatccttgtaaatttcaaaacgcttatttgcgtgattaatcttatatgtaatctttcagaaaatctgagcgagaaggaactgctaaatttggaggaggaagttcgaatccgtcagcaaatgtacgagcgagcgaagcccgtatttgacaaactgaacgaatggatggccagttggaagcagaaattggacaccgaacggcgtgtgtgtcgtgcgtctttctacaagaacagggctgggagtctgaacacaaaactgaaggtcctttttgtgtagaatggggaaatagggataaaagaaacggagatggagttcggcggtttgaaaacaaccaaaaattgtttttcctctgctaatgggagagtatgtcccttttgttaatcggattcataattttgagcaaatgaaacttttagcaaagaaaaatcgtggaacaaaaagtcccgaaattgctgaacgagctttgtgagttatgcaacgactacgtcaaaaatttccaattaaacgacattattgtcgagggattgcgagctgacaaatacgccgaatctgtgatgcaaagttatcaccaagaccgagaagtgcaaaaggctcagaaggttcttcgttaccatacatccattgattgtttttgaacctctaattacagcagttttcgactcctttgaaaccgtcaacgccgaatcgtcccgcgacttcgtccgcttctcgacgcaatgtattcgtaaccacaaattcgtgtggtcgtactgctcctcgcgcactgaatccaatcggaggaaagcagccgacgccttcccgcaaagatggcgaaatgaagcgcgccactcgtaaacgatccttttcgtgcagtcaattgtccgccatttaccctcttgcacagatggtcagttcgcttttgctagtttacagtcacatctttcatgtaatattcttttattattaagatggaaccgcgcacttcttccccaaaacccgaggaaaatttctaaagaagaaattgggctataaacgataattttattagtggtcgttgtattgtttattctgccgacttgttctttaactcatgtttaaaaatgacacgtacaaatgtatttttttgaatcgcataaattaaagtaaaaataagccgtagatatcaatgacgtgtcatattcgtgattaatagggcttccttttttagggacaaaaaattgcgaaatagttgtaaatgaaattgttaaatagtttaaagttttttccaaataaa

SEQ ID NO: 46502 - DNA, 1165 bp, Heterodera glycines; identical to SEQ ID NO: 37247
  Genomic contig location: Contig_ID=SeqID_37247; Location=1..1165; Strand=+
  SCN-specific regions: Sequence locations=1-214,254-287,309-410,434 -577,646-821,866-1018,1078-1165
  Gene Ontology: Mol. function=GABA-A receptor activity; Cellular component=integral to membrane; Biological process=signal transduction

SEQ ID NO: 46503 - DNA, 825 bp, Heterodera glycines; identical to SEQ ID NO: 37250
  Genomic contig location: Contig_ID=SeqID_37250; Location=1..825; Strand=+
  SCN-specific regions: Sequence locations=1-31,59-635,658-825
  Gene Ontology: Mol. function=methyltransferase activity; Cellular component=mitochondrial inner membrane; Biological process=larval development (sensu Nematoda)

SEQ ID NO: 46504 - DNA, 2234 bp, Heterodera glycines
  Genomic contig location: Contig_ID=SeqID_7928; Location=667..2900; Strand=-
  SCN-specific regions: Sequence locations=1-32,58-135,158-470,492 -508,544-675,739-933,955-1151,1184-1212,1235-1360,1477-1602,1624 -1720,1767-1860,2057-2234
  Gene Ontology: Mol. function=ketoreductase activity; Cellular component=endoplasmic reticulum; Biological process=fatty acid biosynthesis
gaggtaatttacgcaattctacctctttttgggttgctttttcttctttgtttgctattcaaatttcttcgcgcaatttggcgttgtgtttacccctattttattgcacgtccaaaagatttgcgccgtttggtcggtgccaaatgggccgtggtcaccggcgccagcgatggaattggcaaagaatatgcaaaacagttggccaacaagtacaatttttgaatataataattagagttcgacctggacatggatccaggccattcttcggcaatttgaattttcatggctttttccagaaatacgggtgcaggcaaaatatgaaaaaatcctgctccaggtccagcttaggcaaaaaaaaacctggatttctgggtaaactttagaatttttcctgggtttgtccagaaaatgagttcatgaaatcaggaccagatttttttttcaaaatgacgaattctaaaatgttatttaatttttacattttcctataaatttttttcgtttgataatattttattgtttttttacaatttaatttatgcgacatctgctgaattaaaattattagttggtcaaatttcttggtttttacaagtaaaaaagaaatagaaataaatgtaattgaaatttgaccatatattaatcctaataccccaatatcgaataattgacttaaatataaaaaattagatattattaaattttagaaaacaatttattaatttcatttaaattcagaggatttaacttaatgctaatttcgcgctccgctgacaaattaaaagcagtgaaagaagaaattcagccaaaacaatttttgcagcccgaagtcaaatggatttcattcgatttgaccaacgcaaacattgaggactatgaaaaatggcttttccccgagctttcaaaaatggacattggcatgctgggtaattgaaaaatataattgaattagaaaaaaataatgttcgatatggggtcggatctcgggaattttttagcagaaatccggatttttttgatgaatagaccaaaatcggagaattttactttttcagaaaaggtgcctcaaatgtgaaaaatgaaaataataccatgctttttgtctccccaattgtgatgccgccaaattttttttttacaattctctcaaaaaaaacaaaaattaataaaaaaaaaatttcttggctccttacgatcgaaatcatttggaggaaaatttttgggaatttttaaaaaaagcacagcaaaaatttattgttattgttgatatgtttagttaataatgtcggaagttttccgccattaatgcgttttcacgagctccccggtggacatcgaagtattgcgaaagatttggtaaatttaaatgttttttttcaattaattcataaatttccttaatttttgtttatacgaaaaatttatttttatttactttaaaaaaattatatataaagataaaataatttttttgaatacctatatcaaacaaaatatcaaatgccatatcatccaacaactacaaaaaaaaacattgacaaattaaaaacggacaaatttaaatttagcttttgaacacaatgccacacaccattcttaccgcttttgttttaaaacaaatgactgaacgcaataaaggcattattgtcaatattgcttcggtggctgctgttttcccactttttcatacagctctgtattcttcagttaaagtacgaaaataatttaaaatatatttttaaataattttttttaaataaattcagaaatatctcacttggttctcgtcaatcttgcgcaaagattatgctgatactggcattatcattcagagtgtaaagatttaacgtttataccattttttataagaaaataaattaaaaattgaaaaatgttcaatttataataaataaaatcgaatttgtataaaattaataataaattaataattgtttataaattattttgaacaattgaattttaaagtgttcttaataattaaacaaaatttattaaaaagcctttaaattaataatagaaaaacatatattttcagattcttccgggcattgttctcactaaaatgtcacaggaagtcacacacttagaaaaaccgggcttttttagtccgacacccgaaaagtttgtcaattcggcacttcgtacagtaggacatgccgacgaaactaccggatgctttgcccatcaaattcaggcaattttattgtgtc

SEQ ID NO: 46505 - DNA, 1421 bp, Heterodera glycines
  Genomic contig location: Contig_ID=SeqID_1027; Location=887..2307; Strand=-
  SCN-specific regions: Sequence locations=1-145,223-290,332-404,427 -1421
  Gene Ontology: Biological process=cell cycle
atgattgaaataattattctttatgtattattttattcaatcatcatgcggctttgccaccgaataactgcaaagaaaactactttcatccaaatcttcgtcaagactcttgggggaatgacgctgactatttttgcccattccttggacaccatcgagaatgtgaaggcgaagatccaggacaaggaaggcatcccaccggaccaacagcgtctcatcttctctggtaattcttccgtttgttaaacttttcttaaaagaattacggttcaggaaagcaactggagaatggtcgaaccctcgcggactacaacatccagaacgagtcgacgcttcacctgtctctgactttgattggaggagcacgcacacgacgtcagcaatcgcaagaggtggcttaatggggtttttctctttttgctcaccggaaggcgggcgttttgctcgcgggaaggcgggcgttttgctcgccgaaaggcgggcgcattgctcgccggaaggcgggcgttttgctcgccgaaaggcgggcgcattgctcgccggaaggcgggcgttttgctcgccggaaggcgggcgcattgctcgccagaaggcgggcgcatttctcgccgaaaggcgggcgcattgctcgccggaaggcgggcgttttgctcgccggaaggcgggcgcattgctcgccagaaggcgggcgttttcctcgccggaaggcgggcgttttgctcgccgaaaggcgggcgcattgctcgccggaaggcgggcgttttgctcgccgaaaggcgggcgcattgctcgccggaaggcgggcgcatttctcgccgaaaggcgggcgcattgctcgccggaaggcgggcgttttgctcgccggaaggcgggcgttttgctcgccgaaaggcgggcgcatttctcgccggaaggcgggcgttagctcaccggaaggcaggcgttttgctcgccggaaggcgggcgttttgctcgccagaaggcgggcgttagctcgccggaaggcgggcgcattgctcgccagaaggcgggcgttttcctcgccggaaggcgggcgttttgctcgccgaaaggcgggcgctttgctcgccggaaggcgggcgttagctcgccggaaggcgggcgtttgctcgccggaaggcgggcgttttgctcgccgaaaggcgggcgcatttctcgccggaaggcgggcgttagctcgccggaaggcgggcgtttgctcgccggaaggcgggcgttttgctcgccggaaggcgggcgttttgctcttgggaaggcaggcgttttgctcgccggaaggcgggcgttttgctcgccggaaggcggccgtttgctcgccggaaggcgggcgtttgctaaccagaaggcgggcgtttgctcgccggaaggtgggcgtttgctcgcctgaacttcgaaataaa

SEQ ID NO: 46506 - DNA, 689 bp, Heterodera glycines
  Genomic contig location: Contig_ID=SeqID_7932; Location=1917..2605; Strand=-
  SCN-specific regions: Sequence locations=1-531,553-689
tttctctatttgtcaacttcaatagagagaaaagacaaaagcaattgggattccaattaccaaggacagtgaagctgatcaacacgtcggtgtcattcaaaattttgggcacagctttgtcaaaacattaaaggtgtcaatttccggtgtcgaatcttatgattccggtatttactatgcggttagggcatatatgatgactgaattgggattttcagaagatgtcaaaaaagggtctatgtgaagcgtcctgctattagatcgatgatgtcgaccagaatgattatacaaacagcggctttaaaaacagagcgtcacgttttgctgatggggccaaatgtgagaccatggtgaaacttaattttgatctcggccgtcagcccaatcttttgcttaataactctgacgtgatttttagcatacatcgtaataccgatgattttctaattatggcaccgccatatgtttccggaaatgcagtcatagcgaacccgcacacatatcgtattaacatacacgatattagaatttatgtaaaaacagtagatgttacccagtcattaaataatgtaataagcaatcagctacaaaccacaccggccaaatatcctatgagaaaaattgagatcagaagtcttttcatcccgcgtggcacttctgatctttcacacaatgtttttacaagcatt

SEQ ID NO: 46507 - DNA, 1297 bp, Heterodera glycines
  Genomic contig location: Contig_ID=SeqID_7940; Location=1863..3159; Strand=-
  SCN-specific regions: Sequence locations=1-736,757-1297
atggagaaggagcagaagtcggctgacgacattgctgcgttcaagaagaagatccaggcctgggttgtctcattgctggccaaggaccgtttcaagaatctcgcattctttatcggttggccttttgtacactagtatgactttttcgtttcgtaaaacccgtttgttcaggcgaaaacatggccgagggcaagggcgaaggacaggtggccattgttgagtaccgtcaggagaatggtgaggaagtgcccactctgatgctgatcaaggaggcgctcattgtggagaagtgctgacgacgacgacaagcgatatacgagaaatgcgcgcgatattattattataacttttttgttttaatatgatatggtgacacaatgtccagttactattacatattgttgttgttgttttgttggctggccttcgtttgacacggaactctcaattggttgattatattgatggtagataagatcgcggttcgcaactgttatacaaaaacataaaatttatgacattcaaggcgagactatagtcatcgatcacattccgcaaaaaaataatgtaacatttctccttgtacacaaaagactccttccttgtcgtggtggtgtttttatgagctacacagacacagaggacgacggacaaatgatctgctgatgagtcatggttatttttgatgtcggcctcgccccaacgacgatggaatttgcgacgacgaaatttcgtgtgctgctgctgctgctgctgattgtttagtttggtattgtcgtctgtttgcattgggccatcgccaacaacaaacggacggacggaggaaaagtgaggcatgccccccgtcaaaataggggtggggggatgcttatgcaagcgaaaggacaaacaaaacgatcaaattgctttagggggaaggaagggcatttgcttgatgcctcttttttgattgcacaattccctcctcggcgcccgtcggtcaccattttcacttaacatgctttgcttttgcgattagcggctaacacgcgcggcgcattgaagcggagttttgaggcttttttttttacaaataatgaatggaattttcgaaatgttttcccaaaaaattttttttttcgctttcccatttttgtcgaaaaacacgagaaaaaaagcgaattctcatgtttggcgtaagttccaaaatttacttagccggctttcatgtcattgaaaaaaatttttttttttgttttgcatttcttatttttggggtttccttttccgaagttatccaaaaaaaaatgccaataaa

SEQ ID NO: 46508 - DNA, 1380 bp, Heterodera glycines
  Genomic contig location: Contig_ID=SeqID_7941; Location=549..1928; Strand=-
  SCN-specific regions: Sequence locations=1-71,103-116,138-280,309 -372,401-513,546-951,973-985,1009-1380
gccgtcgttgtcagtgcgttggtccttgttggctatttggacgaaaagtctcgagacaccgtaaaaactcgaaaaatttttttacaaattttttttttttttgattttcaggtgtacagtccccaaaatatttcccaaactttcctctgcattttcaacattctctccagcgcctcgcccgtcgatgatgtgctaatgaccactcatattgcagccgatttgctccatcggctggtgatcggtcagccaaaaacggtaataattcaatatgaaatatttgtcttttttaaattaaaaaaccatttcttatttgatactttaattgtttttattttactaattcatctgttcgtttagtttagattgcttctcaaaaaattttaataaaatttaaaatattctctttttactaaaaaatcttcttttttttgaaaattgctttgtttgatttttagagggatggttaactttagtttatttattagtttaacaaattttcagttggatgtctcgataaatttttttttttttttgaatatttttttcccccgatttcagcccaatgatctccctctgttaaatgcgaccgcacggaatttgaccacctacgatttctttgacaaatccgttcaaaaaacggctgctcttctcaacatgttagacccgcggtctgaagaaagtcgcaaggtgtttttctcatttttttcaccttaaattgtaggggaaaatttgaaaattcaacatttaaaatgaaataataggtgattttgatgaaatttactaacatttttgctaataagaattactgattgtgcatgggcctttagtttggcgtcttttgccggctggcgattgtggtgctaaacgagtcatcccgtggtaaattgacacgctgtttataacaaacccttttccaatggccgcaaattggaagtgtaaaaaagcagcaacaatacttttttcccttcacattacctaaatttttattgaaaagggggatttaaaaaatgggcattgacagatttttataacggtgcttattggacaaccctaatttcagacgatgagctcgcctctgactcgttcccgatgaagttggtcgacgacctgatctacgagttcaagggtcgccatgtcgtgcgaaaggagggcgaaattacgatgagcggggcaaatccgtcagcggaggaaattgacgagggcactgaagaggcggtggaacgcggcattgactttgtgctcaaccatcgactacaggagatgaattgttacgaggtttgatgggactattgcttaaattttgcgtgtgacatcagttatatttttaccgtttagaaccaggcaacatttaaaggctacgtcaaggacttcatgaaaaag

SEQ ID NO: 46509 - DNA, 945 bp, Heterodera glycines
  Genomic contig location: Contig_ID=SeqID_37352; Location=338..1282; Strand=+
  SCN-specific regions: Sequence locations=1-183,211-699,722-945
  Gene Ontology: Mol. function=DNA binding; Cellular component=nucleus; Biological process=G2/M transition of mitotic cell cycle
atggtccaagtggatgccaaattggacaaaaatgagcgcacattccttgcacgggcttacaaaaaattgatcgatgttcgtcgggaaacctggcgttttttctgtaacatggacgagaatccgcaggatgccgacacggaggagcaaaagcaggtggaaggcgtgatgtcagcggacaatactttttaatgttttttccccttttacaggccaggaccgatctccgtttgaaaacgcatgagggattgctgcaactttaccgcgaatttttggttagttttggatttttgttggtttctatcactttgtttcatttacaatttgaggatgtcattaatgaaaagctcctgccaaacgccaacgacgaagaggcgagtgtgttctaccacaacatgaagggcgatttctaccgagaccaggtcgatttgttggaggaggatgaacgtgccggtaagggtttttgtttcgtttgtttcccgcaaaaattttcattcactttcagaaagtttgatcatttcggaaaagtcctacgaagaaggctttaccattgccaccacaaagttgaaacggtccaatccggttcgcctgggcttggcgctcaagtacgctgtgttccaatttgaagtgttaaagttggaggaggaggcgcgtcagctgatgcagaaagtcaactttttgttttccttttttttgttggaattaatttgtaaattattgtaaatttaggctcttgaggatgccaatgatgaactttgcgaaaaagaagcggcaggggacacggaagctgctcttctgctgatccagaagcaattgaccgcgtggaagccgaagaatttcgctgaagatgccgctcaatgaaaaacggatgatattttgttgctgtattgtcatcgatcattaattaaatgtagaaatgggagtttaaaattgatgttaacttgttga

SEQ ID NO: 46510 - DNA, 787 bp, Heterodera glycines
  Genomic contig location: Contig_ID=SeqID_7949; Location=303..1089; Strand=+
  SCN-specific regions: Sequence locations=1-100,123-601,624-787
  Gene Ontology: Mol. function=proteasome endopeptidase activity; Cellular component=proteasome regulatory particle (sensu Eukarya); Biological process=proteolysis and peptidolysis
cggaacgaggctaaagttgaggtcgccgttgagccaccaacggcgatagaccaacgggtggacgacataatgcaaacgggcagatttggagacggccgattggtgaagatggaagtggactatagcgctcaagtggacagtcagttgatagtggcagacaatttggccaaggtatttgcaatggccaagcaaattcagtgaggaaacaaagttttttcaggaggggaagactgccgaggcaattgagtccttggaaaagctggaaaaggacagtcgcataaattgcgacatgcgttccaaccagcgcctgttgtgccacatggtcaaattggcatttgacgcgaataattggcaattgctctgcgaaactgcgaagacattgtgcaagaagcgtctgctgatcaagtcgagcatcaagaaaatggtcaagagtcacgcaattctttcatctgaaccgcaatgacaccaaattaaggtccaagaatgctgcgaaatggtgccaaaagcgccagacgcgtcgtccaaatcgacgctcatcgacacactccgcgcagtgactgcgggaaaggttatgaaaaagcaaaacaccacggaaggaaataaggcattttattttcagatttacctagaggtcgaaagagcgcggctgaccaaacaagtggccgaaaagttggaagccgagggaaaattggacgaagcgcgcgaaatgatgatggaactgcaagtggagacgtacggcacgatgcaaagaaaaaaaggtgccattgggcaattcaacgaacaatgg

SEQ ID NO: 46511 - DNA, 1521 bp, Heterodera glycines
  Genomic contig location: Contig_ID=SeqID_7950; Location=269..1789; Strand=+
  SCN-specific regions: Sequence locations=1-39,61-167,189-697,719 -1453,1476-1521
  Gene Ontology: Mol. function=proteasome endopeptidase activity; Cellular component=proteasome regulatory particle (sensu Eukarya); Biological process=proteolysis and peptidolysis
tcaagtgtgtcgtgttttacttgctgctttcggctcatgacaacgaaaaatgggaacttttgcatcgagtgaatgcgatgagagaattggaacaaatacccaaacacaaagtaaagaaatacctaaatatcaagtcacaaaaaggcaacatcatcacgttttaggaactgctggaactgttcatccaccaggaattgatcttttggagcaaaaccattgagtccgaattcgccccaattttattcgctgctcaaccgccggtcgaagtcatttcggattcgtttctcccgtccacccacgttgtttttcgcacatttagcatttattgttagtttttttaggtgtttccgatgaccaaagaggatggtcaaaagcgcagagaacgccttcatgactgtgtgggggaacatgtgagtgattggaaacccaaaaaacggtggcaccgaagcgttgccattaaaaaaagttgtcgagataaaacccgcctgaaaattatctaatagcctataattcttaaattttcgttttaaattttatcggcgacgttttgtcccggcaacatttcgatggcgaatttgcattttattatctttgaggactccccttagcttttgttagaatgtgcgaatggtggccaaatattactcgcggatcactttccaacgaatggccaaacttctcgaattcggaattgaggtatttattttgcattttgtttatcacaaaaattatcattatccaggaaactgagctgttttctttaaatttgttctaaaatgcaaacaaaattttaagaaatcaattagttgtctaattgtaagtacatctagaaatatttaattgacaataataatgctttaaaaccactttaatcatttttttgataacttgaactaaaacatggtcactcagaataacaaattctgaaatgttatccagaaaattcatcttaacttggatttcttggacaaaaagccaggttgccgaaaaatggactggacctggatccaggaaaaatccagcccaagtcgaactctgtttattatatttcagcaaatggaagcctttgtgtgcaaaatgattgtcgacggagtaatccccgaagtgaaaattcaccgcccttcgcaaattatttatttgagcccgaaaaagaacggcgcagaagtgctggacgaagttagaccattttatttactcattttgaaacattttctgtttagtgggtttttaacgttcgcaaattgaccgacacaatgaacaaagtcagtcagctgatcgcaaaggaggaaatggttcacggattgcaaatttctcagcggatttgaccgatgatatcgatacaaagaatcaattgattgttttattattgttttcccaaaaaaataaacgaattttccgtatttcatttttttaaacttttaattttgttagtttaatattgttagttttttttcttcattattttattttttgttcgtttgggtgatgaaaaacgttgacctcaaagattctcccgatgag

SEQ ID NO: 46512 - DNA, 797 bp, Heterodera glycines
  Genomic contig location: Contig_ID=SeqID_37387; Location=67..863; Strand=-
  SCN-specific regions: Sequence locations=1-364,387-738,762-797
  Gene Ontology: Mol. function=transcription co-repressor activity; Cellular component=26S proteasome; Biological process=embryonic cleavage
atggcgcaccctgccggagatgtggtgagcgattggtgcttttcattttctttttctatgtcatttcattttttcaatttttcagaccgacgcccaagtgctggagatgtcttccgaccaaattgacgaacgcgtacgacagctcgacgaagaaattcgcgtcatgagggacgaaatgcgcaaaattgcgtacaacatcaaaacaatgggaacgaagacgaaggagaacaacaaacagatgcagaaagtgagcaaacaaacaaaaggaggaacgacaaatttatgacgaaaagcattttcagtacatgaaaatgccgtggctggtggccaatgtcgtggaaattctggacctcgcggatgaccaagcggaaggagaagaaggctcgagcagcgacttggacgcgcgtcagaagaaaggcgcagtcatcaaaatatcgaagggactcgtcatgtttttgcctcgcattggtctcgtcggcccagacgagctgaagccgggggacctggtcggcatcgacaacgacacttatcacatcatcgcaaaattgccgccccattttgaccgacgcgtcaaggccatggaagtggtggaaagaccgacggagacgtacagcgaaattggcggatgcgagacgcaaatcaaagagttgcaagaggccattgtacgtgtcaaaaaacaattttggatcaaaacttcccattttctcattttcaggtgcttccaatgaccaaaaaggagctgttcataaagattggcattcatccaccgaagggcgtgctcatgtatgggcctccag

SEQ ID NO: 46513 - DNA, 892 bp, Heterodera glycines
  Genomic contig location: Contig_ID=SeqID_37421; Location=1..892; Strand=-
  SCN-specific regions: Sequence locations=1-108,151-336,372-467,492-892
  Gene Ontology: Mol. function=adenylosuccinate synthase activity; Biological process=adenosine biosynthesis
ctattaacagagataaagaaatagtacgccaaaaagcgacccttccgccacttctctttccccgtgcatttgacgggtaaaagctgcgactttagaacaattaattaattgccaaacaaaatttaaatttttctttccctttaaaacattcgcattttatggttaaaagagatgaaaaataagagcatgttttttgtgaaaaacacataaaaggaaaagaaaagttacaatgcaatcatttttcataattttaatgcattctgctgatggttcaatttcctaattctcattttaagatccgaataaaatccgatgtcgccttcgtccatttctattcttttgggggcccagtggggcgacgaaggcaaaggcaaagtgttggattttctcatcggacatcacaaggtcggttacggtgggcttctggaaatccttcgttattgatgttccgaagggctttctgcatatcttttgttgttttgtttgttaaaccctctcactttctcagattgacattgtcgcgcgatgccaaggcggtaacaatgcgggccataccgttctggcaaatggccgcgagtatcatttccaccttttgccttccggattggcctcagaaaaggtgacccaaaaaacaaaacaaaaactaatgttgctgttgcaggtgttgaacattgtcgggaacggagtcgtcgtcaatttggacgcccttttcgaggaattggagagcaacaaaattgaggattcggcagaccgactgttcgtcagtgacagtgcccatttggtgttgcctgtgcacatcgcaacggatatcatgcgggaaaatgcgttgggacaaaactcgtaacaaacggaacattaaacatcgatcaaattatttacatttttcagaaaa

SEQ ID NO: 46514 - DNA, 930 bp, Heterodera glycines
  Genomic contig location: Contig_ID=SeqID_37446; Location=73..1002; Strand=-
  SCN-specific regions: Sequence locations=1-930
atgcaaaagcagcaccagcaaaatgcgttaccgaaggaatttgtcgcggagcattttccgttttccaaattcttcgaaaatcgacgacatcaatccaatttactcccattgaaatttgaagtgagagaaatttactatagagggaaggaaatcgcaaaatctttcacacttttagttacgtgactttgaagaagatttgacgattgcgttggacggatgggagcggataaaagacattttcaagaagttggaagagttcagagcattcgaattgcttcgcaatgggagggaccgcgcgagttatttgcttgtaattgtttggcagggaactcttacaactaacgacttctccgctttaacccattgtcaggtgaaagaagcgaaaatcatcgcgatgacttgtacccacgcggcactgagacggcgcgagttggtcgacctcggatttcgctacgacaatattttgatggaggaggctgcacagattttggaggtggagacattcattcctctgctgctccaggacccccaggacggacggtcgcggctgaagcgatgggttatggtcagtttagagaaacaatgggtttggagatgacaaatgtcttgcagattggcgaccatcatcagcttccccctgtcgttcaaaacgttgcctaccaaaaattcgccaacatggagcagtcccttttcgcccgtctcattcgtttgggcgtgccatccgttcagctcgacgctcaagggcgtgctcgtgctgaattggcctctctttacaattggaattataaaaatttgggcaatttgccacacgtcctcgaacaacgcgaattccaatgtgccaaccccggtttcctgcacaactttcagttcatcgacgtgcccgattttaacggtgtcggggagagcactcccagtgcctatttttaccag

SEQ ID NO: 46515 - DNA, 1583 bp, Heterodera glycines; identical to SEQ ID NO: 7967
  Genomic contig location: Contig_ID=SeqID_7967; Location=1..1583; Strand=+
  SCN-specific regions: Sequence locations=1-301,323-352,429-431,453 -1209,1231-1583
  Gene Ontology: Mol. function=peroxidase activity; Cellular component =integral to plasma membrane; Biological process=thyroid hormone generation

SEQ ID NO: 46516 - DNA, 255 bp, Heterodera glycines
  Genomic contig location: Contig_ID=SeqID_37481; Location=4..258; Strand=-
  SCN-specific regions: Sequence locations=1-97,120-126,148-150,172-218
atgtccggacgcggaaagggaggaaaaggacttggaaagggaggcgcgaagcgccatcgtaaagtgagttcattttttttaacaataaaattcctctaaaattttggaaattctttttcaacaaaaggttaaaagtggttgaattttcccaaaaaatgcaaaaataaatataccaatcattcagttgtttcgaatttctcatttctcaggtgctccgtgacaacatccaaggcatcaccaagccggccatccgcc

SEQ ID NO: 46517 - DNA, 642 bp, Heterodera glycines
  Genomic contig location: Contig_ID=SeqID_37481; Location=641..1282; Strand=+
  SCN-specific regions: Sequence locations=1-232,256-385,407-454,493 -561,588-642
atgcctccaaaaccatccggcaaaggagcgaagaaggcggttaagtcgaccaaggcggtgcgcacgggagacaaaaagcggagaaaggcccgcaaggagtcttactcggtaggtttttctgaattttttagggttttctgttttagttttccaatggcttaacaaaatgaaattataaatttaacccggctttccaggtgtacatctagctgtgctcaagcaggtccaccgggacaccggcatttcctccaaagcgatgtccatcatgaactcgtaaggcccaatttggcgtttttccgtcccaagattctcaattttcccatttttaaggtttgtcaatgacgtgttcgagcgcattgcggcggaagcctcgcgattggcccactacaacaagcggtccaccatctcatcgcgcgaaattcagacggccgtccgaatgattctgcccggcgagttggccaagcatgccgtgtccgaggggaccaaggcggtgacgaagtacacctcgtcaaaatgagcaggagatgatgaaagcggtggtgatcggacggaaaaaactatcccaaacggccctctttagggccacaatcactcaaatggacgcgaatgacactttttttcctgttttgtatttgaacgcaa

SEQ ID NO: 46518 - DNA, 747 bp, Heterodera glycines
  Genomic contig location: Contig_ID=SeqID_7977; Location=900..1646; Strand=-
  SCN-specific regions: Sequence locations=1-492,515-557,579-703,742-747
atggggcaacatccagaagacatcgcaacaattccagcacatgagctgcacctcaacgcgccattcaacatccggaccatctacaacttccgcgtacgtttgtcggtttgggaggctttctctgctaagtgatcaatcattgtgcaatttcagctgatcaacacgggctcaaagcgcattgggttcgccttcaagacgacgaagccgaagcgcatcttcctgaacccgccgtgcggcaccgtgggcgtcggcgacaccgtgaacgtgatcatcaccgtggcaaccttcgacccgaataacgaggacatcaagaacgaccgcgtgatcgtggaatggtgcaacacgcccggcccgtctgacaccgtgttcaagctggagtggttcggcgaggatggaatggtgcgccgcaagaatctgccggtcatctacaacctgtagacgtgtgcttctcacaacggacgagccctgacgacaatgatacattttgtgtgctctgtatatattgtatatttatgcgcctcccccgttttgcacatcgaattgtagctacccaatgttgtgtgtatgtacccatgtgtatatttgtgtcatcaccgttttgcacatcgaattgttgctaccaaatcgttgtatgtatatatatacccttcaccgatgtatatgcttattcactgtgtcttgtattgcatgtgtaattgtagctaaaaatatatgtgcatggtgcattttatgccgttgaccattaaa

SEQ ID NO: 46519 - DNA, 815 bp, Heterodera glycines
  Genomic contig location: Contig_ID=SeqID_37528; Location=205..1019; Strand=-
  SCN-specific regions: Sequence locations=1-174,209-472,502-691,715-815
  Gene Ontology: Mol. function=RNA polymerase II transcription factor activity; Cellular component=cytoplasm; Biological process =regulation of protein activity, epigenetic
gtgactttggtgaggcgattgaactcggaaattctgctgaatcgcattctcaacaatccgaatgcgcgccgtccgctggagaagaccaaacagataattgtccgacgcctcaacggggacgaggatgacgtgcaaatggactcgttgaaaatctcactgatggatccggtgaatagaaaattgaaatataaaaataaaattgctgtttcttttcttctttaattagggcttgggttttagggcatttaacctcctccctcccccaaaaaattttaaaaaaattgaaatcataattttacgcaaattttagttgatgcgcactcgcatcaaaataccatcacgagcagccgagtgcacgcacttgcagtgcttcgacctgaacagctacctgatgatgtcggagaagcgaccaacttggaagtgtccggtgtgtgaccggaatgccatctactccaagctgatcattgacgcgtgcgtatttattaattcatttaccatgaaaatacgcttgcttcttcagctacttcgagcaagtgctgtccgccgtcgcttccggcgatgacgagattgaactgctccgtgacggctcgtggcgcttgccgctgccacccgacacaatgggcgtggactcggacgaccaaaatgttggagtcgctgcggctgcggcggttggtgactatggcggtgctggcactgctgaagccagtgctggtggagatgacgatgatgacatcatggtggtgacaatgcctgtggctaagaagcagcggcctccgggcggtgcgggtggtgccagcgacgctgtgtcttctgac

SEQ ID NO: 46520 - DNA, 1115 bp, Heterodera glycines
  Genomic contig location: Contig_ID=SeqID_37538; Location=22..1136; Strand=-
  SCN-specific regions: Sequence locations=1-508,533-657,681-755,777 -806,828-914,954-1115
atggcccaattgtgcaaaaagctggcggagaaacgcgtgttcggctcccgacttatggccaagacaacgtttgccatgccaaatcactcaagctacagcaatttgccacttccgggcatcatctacatttactgtacattcattttttacaaacatttcattttgattgagacgattaggcatgcaaattcgaaacatggactgttaatttattttgcagatgtatgccaaaaggtgctgtttgaccgggtcgggaaggagaacgagttcaaggagtactttcgcgaggcaatgcgcaaattggcggcgcggtaaatctctgtttgaatttggattttggaaatttttttaaattcagctgccgtcgtgtgcgtcatgctcgcaagttccaccacaagcagccccaaggggtagagttggctccatcggtgggtgtcgtcgtcggtcagtcgcccttccaacagttcgccggccgtcccgtcgttggcccaaatgccattgtcgcgttgggccaccagcagcagcagcaacactccatgaccaccagcggtgccgctgctgggccatcagcggcgatgagcggcagcggcattggtcagtcgcaggacacagcgcagacaatggcggcggtgaacgcggcactcgccgaattggcacaccggcgccagcaacagcagcaaatggcactgcaatcttcgcttggggttgggagttcggagaataaaacgaatgaataagtgaatcacacccatatccagaaagtggcacttttcctcataatcaaaggaagggcaacttttaatttgttgttgattttttaattaattctacaaatatctaattttgcggcaatttgggtcaaaaaaaatgagaaaaacttaggctaattcgggtcaatttgtacaggatgggaaatttaaaatatatgcgtataataatgtttattgtagaaagagctgaacgagttgcccccgtgttcgtccggcagcggcggatcgctgttggcatcgatggtggagaacggaggtggcataagcggcggcggtctgctgaacgtggcggcggcacgcgaagcggtcgaacggatggaggtacagaaaaagcggaaaaataaa

SEQ ID NO: 46521 - DNA, 1316 bp, Heterodera glycines
  Genomic contig location: Contig_ID=SeqID_7990; Location=319..1634; Strand=+
  SCN-specific regions: Sequence locations=1-828,850-898,923-1316
  Gene Ontology: Mol. function=snoRNA binding; Cellular component=small nuclear ribonucleoprotein complex; Biological process=rRNA processing
atggtgcgcacattgaaattccatgagaaaaagttgctgaagaaagtggacttcatcaattggccggccgagttggacaacagtcttcatgagaacaaaatcatgcgccgttaccatgtggagaagcgcgagcactacacactgtacaacaaactgtccagagaggtacgacgaataatgaaatttgaacttgtgggcatggttttcatggtaaaacgacgaaaatatttccaaacttttgaaaattacaactgcttaggctgggcctcccaggcttaaattaacaaaattctgtacgttttgcaattgatgcgttgcttttagcgggttgggcaattcgggttgtccgcaaattcaggctgatggccagggggttgggggtggtagaacccgggaatttcgaaatttgctgacctcggtgcgctgcatgattgaaacccaaaaaagggttgcgattttgatcgaaaaattcgacttttgcagggttttttttgggggggggggaggggaggggtccgtgccggattattgagttttttgacgggtttactgggtttacaaccagagtttttccttcctcataaaaaaaaccttttttttgcagatccgagaaatggccaaacgcatccgcgagttggacgacaaaaacccgaacaagttggtgttggcacggatgctgctcggcaagctgttcgacatgggcgtgattccgaccgcggacacgctcgagcgatgtgacaaagtgacggcatcgtccttttgccgccgtcgcctccctgtcgtttgccacaaaatgcaaatggcaccgacggtaaacgcagaccaaaacaagcaattgcaacatgcattttcatatgcttgctttgagtgatggaaattagggtccatttttatacggaaaaattttcaaaaatgggggaaaagtatttttgtgaaattcaaatcttgttgggtaaaagccttccggtccacaaaattttaaggcaccgcctgaaaatttagggtcaatttgtttgaaaattgagtaaaataaaataaaaaatatccatttttcctggattttatagggtaaaacctttgtacgcctacaatattttctgtttatggacacttttcagttatttcgttttcaggttaggaagtccagccaactggtggagcagggccatgtccgtgttggtgtcgaaatggtcactgatccggcctttttggtcacgcgaaaccaatcggatcacatcacatggacgcgggaatcgaaggtccgaagacatctcagcacttacaacaacgaattggatgactttgaggggtgttga

SEQ ID NO: 46522 - DNA, 111 bp, Heterodera glycines
  Genomic contig location: Contig_ID=SeqID_37576; Location=742..852; Strand=+
  SCN-specific regions: Sequence locations=1-111
atgggcatttcccaagacagatggcacaagcggcgaaagactggggggaagcgaaaccccattcacaaaaaacgaaagttcgaaatgggacggccggcagcaaatactaag

SEQ ID NO: 46523 - DNA, 856 bp, Heterodera glycines
  Genomic contig location: Contig_ID=SeqID_7992; Location=2221..3076; Strand=-
  SCN-specific regions: Sequence locations=1-673,696-856
  Gene Ontology: Mol. function=receptor activity; Cellular component =mitochondrion; Biological process=mitochondrial translocation
agttgggaggagactgcgttcgaacgttttgaggggctcaaggaaatgtttccgacaccggtgcgctctgcgttgtccaccactgtgcaattgacatgggtggtagcgcagaattcggttggattttggggtttttttaatttcagggtaccgatttcgcgaaaaaagagtgaagcttccatcccccaataatttttttttgaaattttcaaattttccatgactgcaaagattcacgcttatttcaatgtatgccataatttattcttgggaacattcaatagcctagcctagctttattctctactatgttagcctttacaatctaaacaaaaaaaaattcatttaaaaatgacaacaacagaatttttcaactcttgaaaatttttttaaatttttactctgtaaatttttggaccgcgcaaatttcaataaatccaaaaaaccgactttttcgatagaatttttttttttgccagttctcttttgcacgcagtgctgcttgggtgttgtcgaccagcgcgctgctcatggtgatgccgtacattgtggacaaggagttgcaagatgtggagaaggcacagttgaaacaacagcaacagttgctgctcggtggacggcccagctgaaatgattgattttgatcaaattggtcgatcagagagcgcaattttcttgatcagcactgattgatttcgatcactttttgttgcttttttccattttttgattgtttcgtttgttgtgttcacaacaattagagcgcctttgccccgtttaccctcaaatcgtcgccattatccgccgtttttctttgtttgaccaatttcttcaagctattgatacataaaatttt

SEQ ID NO: 46524 - DNA, 2022 bp, Heterodera glycines
  Genomic contig location: Contig_ID=SeqID_8000; Location=720..2741; Strand=-
  SCN-specific regions: Sequence locations=1-561,592-600,638-695,717 -722,747-810,836-885,914-1427,1449-1512,1536-1599,1724-1994,2016-2022
  Gene Ontology: Mol. function=glutathione synthase activity; Cellular component=intracellular; Biological process=neurogenesis
atggtggaacgcttctttcccaacgatccgaaacgtgtggcactgatccgcagcacattcaccggactgtggggccttgaggttgaagacgaggcgacccgagaagtgattgaggtagtgaaatgtgccaaaaacaaataaatcttcatttaattttcgtaatttaatttttttgtaccgtacctacgtgttgggtcgtttcgtaaaatccgcaattttagcagccttttttcgacaaaaaatggcatgacaatgcttaaaagcaatctatttgcattcttggtagcgttgatagcccagattttctctgtattagcatacgaaatttgagaaaaatttggtcatcttttgaaataaaaaaattttcattttaaggatgctattcgttcgcatggcaattatgtgctcaaatcgcaaatggaggccggacttggcaacttttttgacgatcagctggccgaaatgctgcaacagatgagcacagaggaccgaggagcatacattcttcaacagagaatcaaaccgttagtggtcaaggtgaacaaaagatataaatttgtgatttttaaattgaaaataattttaaaaaatcggaatctgttaaataattttaagaaaaaaaattaagttaaataaagctattattagtttatctcataattatttgcatcctaaaaaacggtgattatgtcaatctttggttttattatttctttggcaataacttttttaaattttaactatttgagttaaaattagcttcatttgattcaaattcggtattctgcaccgaatgataccaaatacaaataatttgtttttacttttaaaatttggcatactttttataggttgaaaaataattatgaaacgacccattattagtttatttttattttaaagaattatttgatgcgagaagcaaagccggctgagttggaggatgttgtgagcgaaatgggcatttacggctcactgatcggtgaccagtcgaacggccgaattttgcacaacgcattcgatgggcacacaattcgaagcaaagtcagttgaatagagttatattattattagggctccaatttttaggcaaaaggctattttttcctgagctccccgtggcctgaaacgtacgaaaaacatgcttttttgggctgttgttaagctacttttcgagttattagtgcctattttctaggcttttatttttagcgcctaaaaagcctaaaaaattttgaaaaagcctatttttgcctattttggcgttttgccgaaaatttgttaacaaaaatgcaataaaaacaaaaaaatacacccctaagaatcgattttttggaatttaaaaatacacccctaagcagagattcaaaaatttctgaaaataaatcgcctaagcaatgaaaattttctcaaaaatcgtctttaaaaaattttttggacaattttttgaatttaaaaaaaataatgcaacgcaatactgatttgacttatttttttaccatttgaataaatttccattttacacacctaaatttgagactttttagagcctaaacactacctattttagcggtttttagtgcctataaattggagccctaattattatatattataaatcaattcgttaattgtaattataaaaatgaaaaatatttttatataaaaaatttaaaaaattatattaacaaaattaaaaatatcttttaacaaataaattaatgcttctaaaactaatctttaaaaattaagcaacctaactttaaatatgcttaaaacaaaatgcgaactattctttcaattttaagcgttcggatttgaaccttggcggagtgtgctgtggcggtggagcaattgactcgcctttactgttcccaatgtcacaaatgttggaccaaccaaatgggcattgatagttgatgaccgaaaattaatcagatttaaaatgaaatatcccattaaataataccactttttgaccatgaatatctccgattatccaattttgtctttttaaataaa

SEQ ID NO: 46525 - DNA, 767 bp, Heterodera glycines
  Genomic contig location: Contig_ID=SeqID_37683; Location=171..937; Strand=+
  SCN-specific regions: Sequence locations=1-639,661-767
atggcgtctcaacaacagtcacttggcactgatcagcacccatcctcgttggcatttcgccaaggtcaactctttttccgccaaactgcccctggtaatcccttcctcgcttctgctccaatcgcttctgaactacaaatcctccgagtccgacctctctgctcacagagactttcctcccccgaggaattgctcaaatcgacgccgttcagtgcggtgatggccatagacatggccaaggagagtggaaggaggacggagcagccattgcgatttgttattcagtggagacgaaaagtgagagggactcaaacatccgtagaagcagaggaggaagagcaacagacgaaagagtccaaatggatcaccgcatcggtgggtttggccattactttttaggggatgggggagaccaaaagtggcattttatgggcaaagggatcttaaataattatctcccaacctgtatggcatgatcatcatttcagatcgagttcgaccataccttccacgttacgggcatccgtgccggtcacttccaccaattctccgtccaattggtgtcccccttggggcctgtcggcccgaccgttcgctcccattggctcaacttcgacgcgatcattgagcagttcgaaccggatggcccaatgaggcgagattcgctgcagttcttcgctcgctacaacatggacaacggcgtggccgcgttggttcggtggcggagggaccgcgacggacaaagcaaagcgaaggggacaaagtga

SEQ ID NO: 46526 - DNA, 736 bp, Heterodera glycines
  misc_feature (13)..(13): n is a, c, g, or t
  Genomic contig location: Contig_ID=SeqID_37688; Location=975..1710; Strand=-
  SCN-specific regions: Sequence locations=1-429,451-494,517-736
agtcaactaatancagttgtgaagattggtacgaggcattattatgggaaaaatgtggactgtatttatattgattttcagaaagcttttgactcagtgccccataatttacttttatacaaattggaaaaaattggtatcagaggcaaacttttattgtggataaagggctttttgagtaataggacttttcgtattaaaattggggatgctttatcctccagtaaaaaagttggctctggcgtcccccagggttcggtccttggacctttattatttttgatttatattaacgatcttcctgatgctttgccatcaggagtgaaaataaaattatatgctgatgatgttaaattgtatatatgctataaagcaagagccgacaccgaaagtatgcgtaaagcattgcataatttattcgaatgggcaaataaatggcaaataaaagtttcaattcaaaaaacttttatattatatttggtttccaaaaacccaaaagaaacatataaatttgatggaaatacaataaatgctgtggagacaattagggatttaggagtaaacattgataacaaattacaattttccgatcatgttaatcatataacaaggaatgcatatttacgtatgcgttccttgttccgaataattaaatccaaatcatctaagatttggattacgttatataaaacttatattaggcctttattggaatacgctccggaggtttgaaatc

SEQ ID NO: 46527 - DNA, 6201 bp, Heterodera glycines
  misc_feature (3691)..(3691): n is a, c, g, or t
  Genomic contig location: Contig_ID=SeqID_8016; Location=898..7098; Strand=+
  SCN-specific regions: Sequence locations=1-144,177-945,967-977,999 -1190,1212-1807,1831-2551,2573-2690,2715-2902,2925-3453,3475 -3598,3620-3727,3749-4379,4408-4572,4594-4721,4745-4810,4832 -4933,4956-4973,4996-5128,5150-6161,6184-6201
  Gene Ontology: Mol. function=calcium-release channel activity; Cellular component=integral to membrane; Biological process=calcium ion transport
tgttctgtatgctgatcagccgacgactttcgatgttgacttgcccatgatttgctcctatttgacctattggtggcaacatggcctcgagggcccttcgcgctcactcgtcctaattacccaagtgaccgccgagcacattaaccgtttgttctgctccttgctgaccatgatgaaggaccacgtgggccgtgaaaatgccccgtggctgtgccgtgcccatttctcagccgtgccgctgattcaatacgtaacttgcgacccggtcagggaacaaatgctgccggtggcggaacacttacgccaaatggccgagaaggcatttgccgacgaggagcgcatgagaacgcatccggacgaggcggacgacgcaacagttgcggaggtgggtgccatgccaatgaggcgacacacgccgaaagtttaaaagggcggcaaaaaaggagctaaaatggggacaaaagcatcaaaaggggtaaaagaaagaacttttcttaaggacaatgcgcgactcgtccgcgacgtttacgcgttctttccaattttgatgaaattcaccgatttgcaccgcgccaaatggttgaaaatgccctcttgggagagtgacggcatttacgagaatgtggcggtgattttccgcatttggtcgcttagccagcacttcaagcgggaggagttgaattacatggctcagtttgaggacggagagggcactttgagcgcaatgggcgcggaaatgaaaacgggcaaagcggcaattgcggagcggaaaaagcgccgcagggagggacaggtcggaaagatgggcgagtggggagagaggacggggcaattggcaatgtgcagggggcacgggagggaggagacgagacggcggagtgaaaattcgggaattttggagggtcgaatggtccatagtcaaggaagaagtcgggaatggggaagcaccccaggaagaggaagaagtcgggaatggagaagggaggagagagtcgggaatggggaaggggacacgaagaagttgatcaataacctatcccaaatgaacccatctctctctgctgatcacaggtccgacgtgataaacacgcgaatagcattgtgatcgcctgtctgaagcggcttttgcctgtgggactaaacgttttcgggggccgagagttggacattgtccagcaaagcaaagagcgctttttggccaaagagaatgaggaaaaagtgtgcaaattcatccgatcgcggctcaccgtccccgtggtaattaattcatccgctaaacactaaacacccaatcaaaatgactgattaatcttttcggttttcaattagcgcaccgatccgacggataaaaacgcgtggcaattgagtctctaccggaagatcggtaaatcgcaaatgcgaggcaaagaggagatgagtcaggaagcggtggtggacaaaatcgccaacatggccaaagtggtggccattttgcacacggtgagagggcaaaataaaataaaaaagggtgtggggagaagggagggacggacaattggccaatggcacgcgacaattggtcaatcggcggggtttgctttgcttccatttgtggccactttctccgtcgtccgactttttctcttcgttgtttttcccatttgttgctgtgctattttcactcacttttttctcttcccttttcatttaggctttctttatcttttggcattttccaaaaattttttccattttttggcaaagtaattaaattcaaaatttgcctgagggcatttccgctctctgccctccctttgccttgcaattttctgtgtctgtctgtgtttgtctaacactctgtcctttcatttcccttcagaccgaacacccccaggcatataaaccgtctgagtggaaaaagatggtcagcagccaacggaagcgagcagtagtcgcgtgtttccggatgatccccgtgtacagtatccccaggtacgcactgctaatacagtacactcggcacgccatttccgcactaaccaaacacagcacatgcacagtttgaactttgtttctgccgtgtgcttattgacagtaattaacgttatgccaagggaaggatacggtattacagtaggaatagtttttttcgaaaagcgatcgatcggcggtcattccaccgaatgtctgtctttgagcactaatcggccctctcccaaaggtaacaagccgactggagaaggaagaccgatggaagaaagtactaacactgcagcgaaagcgcatggccatttcactgatcaccgcgagtcatttgtacaggctggaaaagtatgtgaggagcacagagtgctgatctgatccgatcatttggtgctgtgcttttccgatttgctgttcaaaatcaacaaaaaacgcaaaaggcttcccatttaaggcatcgtggcatcaactattttttgcccgtgttcagtcaacattggctgaacgatgaagacattgacgaggatcggcttgtctccgacatttgcgtaaatttatttttgagaagcaaaatttggactctcactaaagaacgatgccattggagacgctgttgtggagcaacaaaattcaactcaaattgtccgcgtggtggaggacgaaagtggggggctgaagatcgaagaagggccaaacgcagggcaccaggaaaagtacaattagcaagcacataatgatgatgatcataatgaggatgagcagggtgtcataatggggtagtaaaatgggacaaacccattccatcgaactgtgcgaagagtgaaagggtatgtgtctgtatgggcaaagaaaagccctgttttcagggactaataaaaaaacgctttctaccgaaaataggctgaaaggaattgcttctcagcgtttgttctctcctcaaggccctaaaacccaaacaaaaatactgatcattttattaccattggtctatgattactgtgatctgaccatttctgattgacctttgcctttgacagaattgtgccggacgcacttcgccagctgatcctttgcttccaaagggcggccaccagcgaagagagtggccaatcgaacagcacgacggaggacaagtggggcagggcaaaggccaaaaggggtacaaaagccgctgatcggacagattgttcattcgctacgcggacgtaatgtgccgatcagtgcacattgggcaggacggagacgaaggcggcgcaatggacgacgaaaatgaggtggaccaagcggagaaggaggaaatggcacagacactgcgggcggaacagggcgtattggcaaaccgaggagcagcgataatgtgagaggacaaacggaattttgggaagaggggggggggggtaattagtgggagaaaaaaacagaggaaccgttgcagggtgttgatgtatttgagtgcggcaagcggagagccgaccgaaatggtggcacaaacacttcagctgggcatccatctgctgaacggaggcaacaaaaccattcagaaggtccttgccattcattttggctttttcttccgctgattttcacttttccttttcttagtcaatgctcaattatttgcaactgaaaaaggacgtgcgcttcttcacctccctctccggactgatgaacaaatgcagcgtgctcaacttagaaatgttcgagcgacagatcaaagcggaagggttgngaatgggcgcggcattggcagcggggtaattagcctaatgaatgattaatgaacgaaccttggaaagtgccgagcctttgccaactccgtttttagggagcatcagaatctgaacgacgcgccgttcacctgctcactgttccgctttatgcaattgacttgcgaaggacacaatttggactttcaaaattatttggtcattaaagcaaaatgccattgtcgaaatgccattttagcgtacccaacctggccacaccaccagcgtcaatttgatcaattcaacggtcgattatttgcttcgtttgcaggaatctgtgatggacttttactggcattattcctccaaggaagtgagtggtaaatggcgggaaaaaggcatgagaattgatcgctggaagattttgtgtgattgatcagttagtatgagagattgatcagtaaagaacactggtcaggaaggacttatacaatcaaaaattaattttgtgcaacaactgattaatcagtaaaggcattccattgaataataagttgagttatgtgagactgatcaatgacgaatgattaaaagagactttctcacttggcatttgtcagatgatcgatgagaacggcaaagaatactttctgcgtgccatccaagtgtgcagccaagtgttcaacactttgaccgaaagcatccaggcatttatttgttttttgatttgtttatttcatcactttccctgaagggcccctgcgtcggcaaccaaatgactttggccaattcccgcctttgggatgccatcaacggctttttctttctgtttgctcacatgatggagaagctgtacaagaacagcacgcagttggaactgctcagagagtttctgaaccttcagaaggacatggtggtgctgatgctttcaatgttggaaggtgaccaatggcaccgatgattaagccataatcttggcaaatgttaaggcaatgtgctaaacggaccgatcggaaagcaaatggtggacgcattggtggagagtcagcagtgcgtggagatgatcctcaagttttcggatatgttcctcaaactgaaggtccatccgccgaatgggccactactttcggcacatttaacgtttttggcattcctttgaaggatttgaccacttcgcaagcattccaagactttgacaccaatcgcgacggatggatttcgccgaaggaattccaacgggcgatggaagcgcagaaaatgtactcggtggaggagatcacctacctgatgatgtgcacggacgtgaacaatgacggcaaaatcgactacatggagttcacggaacgatttcacaacccagcgagagacatcggtaggggagggaatggccagggaataggccaacgcggcacttaaaaagggccaatttggcattccattgtcttccagggtttaacttagccgttctgctgaccaacctcaaggagcacatcaccaacgacccccggctcgaaaagatcgtcgagaaggctggctcactgttggactattttgacccctttttgggccgaattgaaataatggggtgagcgatggcgaaaggaataataactctctcggcaaactccgaccaatgaagttttgggacggagttggccggactgagtggggggggggggattcactgctctgatcaatcgcactcattgtcagatcctcgaaaaaggtggagaagatttacttcgagatccaagagagttggttggaacagtggggcaagcagcaaatccgcgactcgaagaacgcttttctgttcaatgtgctgcaggacgacggtggcgaccagggcaagctggaggcgttcatcaatttttgtgaagacacaatttttgaggtattgcaaaatatgctttctgctggcataagcaatgcgataaataatcattggcattttatgccatttttcaaatgccaaatgttcgtcaatcattggcattttatgatgttattccatttcgatcgtccattttgaccatttgtccacctttgcgctttcctctggcagatgcaacacgcggctgagatcagttcgggcgattcgaccagcgagtcgaaagtcgagcgtgcgatgcgccaaagggactatttcctgcagcaaacgtacgccggcgagcaaatctccaaaacgcttcgggcggggtacaaatgcgggatggacgcggcggcggcactgcgcccggaaaacatacaaaaggaactgaaaagggcggcaaagaaattcagcaggtaaagcaaaattggaagcgcaattaattacccataattaattgggtgtgaaaaacaaagcattgaaagtcgacgaatgttttgcctttcgttgggtccgtcccgcgccattccgttaatccgcgtccattcccgcttctcagcatgagttgggctgagctgttcaccgcgttggcattgctttgcttccgcgccggtcgtgccttcttcttcttccacctgtttttgctttcgaccgcttttcgtt

SEQ ID NO: 46528 - DNA, 1099 bp, Heterodera glycines
  Genomic contig location: Contig_ID=SeqID_37717; Location=1..1099; Strand=-
  SCN-specific regions: Sequence locations=1-1099
  Gene Ontology: Mol. function=dynein ATPase activity; Cellular component=cytoplasmic dynein complex; Biological process=oocyte cell fate determination (sensu Insecta)
ccgagagactcgcaaacaaaattgtcctattatttacgtaatattcatttttcaaattaaattccatggttgctttagtctctgcaaggaacagctttcgaaccaatgtcattacgactttggattgcgtgctttgaaatatgtgcttgtttcggccgggaatatcaaacgcgatgcgattcaacgttcttacgatgaaccaagccaaagcggggatggagctggagaacaggcagtggcaagccaaatgtctgaacaacaaatgctcttccaatccgtgtacgacactttgacaccgaagcttgtctctgaggatatctctttttaaatcacctttgcatcaatttttccctgacaacagcccaaaacaagtggaaaggtgcagatttctgggtttttagaaaaaaaaattgtttgttttattttcagcctcaagaacgaagttttgacatctgcaaaaccgaacacttctcatgttcacctatcactggggagaagggaaatctttggctggagaaagttcttcaggtttaccaaatcaccaatcgcaatcatggcctaatgcttgtcggtgcgagtggatcggtcaaaaccactgcgtggaagacacttttgaaggcgttggaaaatcatgagcgcgttgaaggcgtgtctcatgtcattgatgccaaatcgatcagcaaagacactctctacggcactctcgacccgaacacacgcgaatggactgatggattatttacgcatattattcgaaagtcaatttactattaatttttaatatgttgacaatgacacattgtttagaatcattggcaatgttcgtggagagttggataagcggcaatggatcatctttgatggagatgttgatccggaatgggttgaaaatctgaattccgtacttgatgactacaaattgcttactcttccaaacggggaacggctgtctattccaccaaatgtgaggcaatattaatttcaaacttatttttttatattaggttcggatcattttcgaagttgctgatctcaaatttgccacgatggcaacagtttcgcgttgtggcatggtctggttcagcgaggattttgtcac

SEQ ID NO: 46529 - DNA, 618 bp, Heterodera glycines; identical to SEQ ID NO: 37730
  Genomic contig location: Contig_ID=SeqID_37730; Location=1..618; Strand=+
  SCN-specific regions: Sequence locations=1-295,407-446,491-531,553 -593,615-618
  Gene Ontology: Mol. function=structural constituent of cuticle; Cellular component=extracellular; Biological process=cuticle biosynthesis (sensu Nematoda)

SEQ ID NO: 46530 - DNA, 990 bp, Heterodera glycines
  Genomic contig location: Contig_ID=SeqID_8036; Location=2309..3298; Strand=+
  SCN-specific regions: Sequence locations=1-329,351-406,428-510,533 -545,587-667,717-990
atgtacaattgcaatatgtacaatgttgaagacattccattggcggatcgtcaatccatcccacttggcctgatgttcctcacgttgggattgatttgtgaggtaaaaaatacttagcgaaaaattgagactgcgaaattgttgaaaaaccccggattaagatcgaaatttgggattgaacgaagacagaaaaatccatttatcccctgaactttgactgggtacctttttacattatctgatgatacaagtcctatgttaaatttgaggtcggatatacagcaacaataattataatgtttttattcagctcgaggtcattatatgaagaatatttaaagctctgacagggccggaccctgccaggatttttccgggctcctgatcctgatcgggtatattttgaaaaattgggagccctgaaaaacagggttttgaatgcggaatcccggtccgggtcggtcaaattatttaatcctgattccgaatttttcaaagttacgagctcgaaaacacacatacatacaatgtacaaaaaaaattattatatatatatatattttttatatatataatagatatatattacatggttataggttctctacctcccgtgtatgcttgcgattcgcaaacatatggacagcacatgctttaaagtatgtacaaattatttattataatttaatttttgtaaattaattatttataaaaatggtaataaaatttccatatttttttccaagttcatgttttacattgctgtggctgacatgcttgcgctgtttatcagcggtgtactcactggatatttggcattggttggtgctgtctattgctcctacccaaaactcatttacaccatgggcgcatgggcaatttgtatgttaatttttttgttgctcccgtgtaattagggtaattaattgggttaataattgatttaatttttattctcataacaataactgtttgattgcttttaaagca

SEQ ID NO: 46531 - DNA, 798 bp, Heterodera glycines
  misc_feature (45)..(45): n is a, c, g, or t
  Genomic contig location: Contig_ID=SeqID_37789; Location=5..802; Strand=+
  SCN-specific regions: Sequence locations=1-58,80-214,237-354,377 -554,576-798
  Gene Ontology: Mol. function=RNA polymerase III transcription factor activity; Cellular component=transcription factor TFIIIB complex; Biological process=transcription initiation from Pol II promoter
caatttggccgttccgatgacaccgctcccttttgctgagtcggnccaccgcacgccgaagcagcaccaccagccgcactccgccgcggcacagccgcccccgtctaacatgccagcgtttgtgccagcaacgcctttctcaaacgcatccgtggaaatcccatcgccgacgctgcaaaatattgtgtcgactgtcaatttgggtgattttccgtgctgtacaacaacaaaaatgccttctttcactttaggcgttcaattggacctcaaacaaatcgccctcagagcgcgtaatgccgaatacaacccaaagtcggcgtttggcggtgtttaattaccgatcccctttttaaggcgttttgcagctgttattatgcgtattagggaaccaagaacaacggcactgattttctcttctggcaagatggtgtgcaccggggcaaagtaagtgccaaagtttaatttattaacacgtaaattgcttgcttgccgccgcttatcattccgatcaaaattaagatccgaagagacgagtcgactggcggctcggaaatatgcacgaattgtgcaaaaaattggattcaatgccaagttcacggagttcaaagtgcagaacatggtcggctcttgcgatgtaaaatttcccatccaattggaaggtacggattgggcaaagcgacgtttaaattgttttgattgactaattaaatctaaatttcaggcctttgcataacgcatgcccaattcagcacttatgagccggaactgttccccgggttaatctatcggatggtcaag

SEQ ID NO: 46532 - DNA, 1754 bp, Heterodera glycines
  Genomic contig location: Contig_ID=SeqID_8037; Location=500..2253; Strand=-
  SCN-specific regions: Sequence locations=1-1324,1355-1422,1453-1754
atggctttccataaaatcgacaacgactccgtgaactcaatcaccaatgcattggactttttccgtataccccctacaaatgtgagcgtttcatcttcaaaggtattcgagcttctgcccagcaatccgcttacagacacaccttaccatttcaaacttcattccagccaaaattatattgatctgtccaaatgttatttgctcaccgagtttcgaatccgtaaggaaaacgctaatggtcaactcattaacctagacattgatgacataaatattgcaccaattcaaatgatcggacaaaccttcatccgtaacataaaaatgagtatcaatgggcgcaaaatttttaatgccaatgccctaatggcctacaaatcatatttctcacatgaactctcttattcaacgacagcaaaagactctcatttgaatgctgctgggtattatagggacacgggcgatactttggagatgggaggcggatgcacagcgcgacgtgatttgtttgcgggtagtaacgtagctcaattcatcgccaaaattgacaccgacctattcaaccaaccgctatacctgatcaatttctgtgaattggacattgaaattctacccaacgacaatgactttgtgttaattgcgccgaccgggggtcggtaccgtttcgaggttgtgggactgaaaatgtatgtgaaaaaagtgtccctgatggatgggttggcgctagacattgcgcgaaagctggaggtgaaacctgtccgttatgctgtgcggaagacaatgatgaaatcgatgttcatcagtcagggccgatatgagtttactgccaatatgttcatggcccaaattcctcgtcgtgtgacaatgggtctggtggctaatactgactatgttgggacaattttgcgcagtccattcaattttcaaccatttaatgtgcgcgaaatttccattcttgcaaatggacgatcgtatccgcaagcaccctatgatttggtttacccaaacggaaaatatgttcggcccttcaatgacatgaacgaagcggtgggcttcgccaattcatcggagagcaatgggataacttttgcccaatacggtaaaacgcattgcatttacgtgttcaatctgacaaacagcggggatgaccaagcggcactgtttgacctgataaagaatgggaccacagcggtgagtatcaaattcaatcaaccagtacctgtcggaggaataatgctggtggtgatgggagaatgtgactctttggtgatgttagacaaaaatcgatcgattagcagtgacaccactatttaaaccgtttgtcatttcatttttcataaaaataaaagatgttttcaagaaaattgggtcttattttgttctttctccgaatttctcttcccctcgtttcatcaacactgcgagaacaacaacaacaacaacaacaaagacaaccggaaaatacctactctgcttatctaaaaaatctgactttcactcgacaacaatacgagcctgaatattcctacactgaatatttgagaagattgtctttatcgaaacgtactacaaacattccgtttactacaacacctaaagtccctccaaaaagcgacaagttaattgatgagcatgtctcggctgttctcccaccgcttattcaaatgtgcaaggacagaccagaggaaagcagcttttttcatcaagctgtttgctgggccctctttgctctctatttaatgttcatcatcagcctg

SEQ ID NO: 46533 - DNA, 637 bp, Heterodera glycines
  Genomic contig location: Contig_ID=SeqID_8037; Location=921..1557; Strand=+
  SCN-specific regions: Sequence locations=1-637
gaaaaatgaaatgacaaacggtttaaatagtggtgtcactgctaatcgatcgatttttgtctaacatcaccaaagagtcacattctcccatcaccaccagcattattcctccgacaggtactggttgattgaatttgatactcaccgctgtggtcccattctttatcaggtcaaacagtgccgcttggtcatccccgctgtttgtcagattgaacacgtaaatgcaatgcgttttaccgtattgggcaaaagttatcccattgctctccgatgaattggcgaagcccaccgcttcgttcatgtcattgaagggccgaacatattttccgtttgggtaaaccaaatcatagggtgcttgcggatacgatcgtccatttgcaagaatggaaatttcgcgcacattaaatggttgaaaattgaatggactgcgcaaaattgtcccaacatagtcagtattagccaccagacccattgtcacacgacgaggaatttgggccatgaacatattggcagtaaactcatatcggccctgactgatgaacatcgatttcatcattgtcttccgcacagcataacggacaggtttcacctccagctttcgcgcaatgtctagcgccaacccatccatcagggacac

SEQ ID NO: 46534 - DNA, 1665 bp, Heterodera glycines
  Genomic contig location: Contig_ID=SeqID_8044; Location=1..1665; Strand=+
  SCN-specific regions: Sequence locations=1-73,95-329,351-720,757-1665
  Gene Ontology: Mol. function=DNA binding; Cellular component=nucleus; Biological process=regulation of transcription, DNA-dependent
cctccgtcctccagggcatcggtgacttgttcgtggacaccaacgacgagttttgccaattgggtcacattttgcaacggcttcttcattggctggccgtcgacccgtcctcttttgaacaggcctatgttcctctttgtctacccaaactgcttggcccttttgtgcgtcttcaacttgtcgactggcgaccgctgaaggtatttttttatttcataataatattgggttaatctcaaattattgtcgaataaattgaaaaaatctcaatgagtattgctttatcttattttaatagtctcatctgtcctaacaaaatggcaccacaaattttaatgaagaaatgatttggaatgggacttttgctttaaagataaattacgttaggctattagatgactttataaaacctgatgtgagattcctaggcctaaaccaatttaaaatgaaaactttttctcaggccaaactttttgagattttttcgtaattatgagacaactgaatagcagaataagttaatattttctctattagggacacaccaataattagtacgactgtttacttttgccccttttctttgccaggaatcaccaacccaacggcctttgtatcgcatgccctggtaccgtgcgctgctgatggccggcctggacaactcgggactggaggaccttgaacatccgtcgctcgtgtctctgatcccgtccgttgtggaaaagattgtttttccaaaaattgcaagtatacttttaggactatccaattttagacgcccctctttttgtctgttgaccatttcccaaatgtggtcaaaaaaaaccattggaaaacccatgcataaatattatgccaaaaaatcaaaattttcgcaactcatttcttgttcgccatgccattctcaatatttagaaattgtccgcgagcaatgggacccgttgtcgctgcatgagtcttccaacttagctcaattgctgcgttcactggtcgaggaatacccagtaaatttctgtcggcttatttgcaagatcataaccttggaatcgagtcccccgagatgtttccttattacgatttttttggttttagaattttggcttttcaattagtggtctgatggtttcatcaacgacatcgtgcaaaatcttttaatggattaaaaaatcctttttttcaaaggtggccaacgcaagctcgaaacgaatgcaagaactgcttgagggtgtttatgctcggttacgtgacactattgaccgcgacacttttgtgccgttgtacagcaaagagttacatcacattaaaaaccaattttttttatttttaccgatttttaagagccattgaatccactgagacggggtgtggcgcttttttggatcggcaattttggaagtctatcaaagtgagttgaatattttggatcaacttttcataaatcaatggggcggtggagagcgagctgcttcccaaatctgtgctacctttatatggcagttatttgttttagttgatgcgctccatcctctgcttccgctccattctctccgacgcgtgtctggaggaattggtcgtcgaaggactgcttaaccgtttcactgtgttggcactgcaattctcagtgttgggccaccagtcgacgctgaccaaatgtcgggcagtgat

SEQ ID NO: 46535 - DNA, 706 bp, Heterodera glycines
  Genomic contig location: Contig_ID=SeqID_37831; Location=62..767; Strand=-
  SCN-specific regions: Sequence locations=1-706
  Gene Ontology: Cellular component=nucleus; Biological process=N signaling pathway
atggtcaaggcatcgttccatggtcatgttggcgttgtgtccgatgtctgttggcactcaaccgaccagcatttgtttgtttcggccagctttgacaacacagttaaaatgtgggacgtccggtgagtttctggcacaagcgtcgagtaggtatttagcgaatgattaaaacaaatttatatttagaatgtcattattagtactaaatattgtcttcataaatttttgactgtgaagggggggggtgtatttcgaggatttgaattttaagaaattctttttttctgttgctctaatgttttttgtgtccaatttcagcagccccagggcggctctatatgatttgatgggccattcggaccgcgtgctgtgcgttgattggacagtgccgagccgtatttgcagcggttcggtggactcgacggtgaaagtgttctcacatgggaccgaagaaaatatctaattgtttatcgtgatatcattgttgttttgttatagttaaaatttctgtacaaactgagaacaaacaaactatacatggcccaaaaacacttctgattgtaagcctattttaatggaagtttaatgaaattgaaacttttggtagaaagcttttgtttccctttgccagaagggatatattgaatttgaatcaggaaagcaactttttaaatggtgaagtcattaagcatttatagccattaaa

SEQ ID NO: 46536 - DNA, 1694 bp, Heterodera glycines
  misc_feature (1677)..(1677): n is a, c, g, or t
  Genomic contig location: Contig_ID=SeqID_8046; Location=1..1694; Strand=-
  SCN-specific regions: Sequence locations=1-48,70-569,592-840,862-1694
  Gene Ontology: Mol. function=parathyroid hormone receptor activity; Cellular component=integral to plasma membrane; Biological process=G- protein signaling, coupled to cyclic nucleotide second messenger
agtacttcaaatccgtcgctttttggtggatgtttcttgaggtcgtttctccttcctctctttcccatttcattaatacttttcctccccattttcagggcctttacctacataatcttctcgtttttgcctttttcaacaaaacgccaaaactttggccctatctgatcacagcatacggtaggttctttccacagtaactcttaatgtgactcttactcgtttctatgatggacaaatccttctgctgattgtcagcagggcagtaaaatcttccacaaatgttcccacttattctctaattgttctctaaattgtcttttctcggcatgccggctcaattcagtccccgtggaaaagtgtttcagtccattctgaggagagtgtctgttttctgcgcttttcatatgactcggatttcctttttcccaatttatcttgccgagagtttctttgccaatttgctccaattcctttgctttttccgtatttttctccccattcaaattcccttttttggcatttcgtctcatgtgaaaatgtccataaaattgaattggccatcgttctctcttctcgctttgtcttctcacttttggcctttcccttctcctaaggtgttcccttggcccacactttctgttggctaattgtgcttctggtgaagaaacacggacagttggagagatgtcttggctcatattatttggagacggaattttggattttggacggaccccggctgcttcaacttgtggtgggacttacacttactgtgcttatcgttacagtatcacttaaaaaatactgtatactcaaataagaacatacggtactcttcagctgaacgcctttttcattttcaacgttatacgggttctttggctgaaagtgcgcgactcgcaacagtcgagcagcgaaattggccgaatgaagtgagtaatgggcaggacagaattagaagggcttaaatattctttgaatgtgccttttccttagtctttcgctttcattttcaaattttccaatttaattaattttcttcgcttttccattccgccacttaagaaagtccgtgaaggctgctctgatgctgatccctctgctgggcatccccaacattatgcagaccatccctttctcgcccactcaagagaacattacagtacccacccccctcccacactcaccgctaagattactctcttttacagtactttgccatttggacttactgtgcctcgctgtcctacatgtaccagggttttatgatcggtacgaaggctttttgagtttccggatcggatcaccttccttttcagccatcatctactgcttcaccaatcgtgaggtgcagtccgtgctgcacaactgctacactcgccaccgcctctcccactcgcggatggcccaccgaagttcgcgctacgcgccgatggcctcgccgtacactcagatcaaaaacaacagtggatcactaggagcaaacgtagcagtgatcgtcggagagatcaaagtgatcgaagggaatggcactgttgccaatgcgggcgattgtttgttgctgccttcacattcgaacggaacgtcgccatgcataagtgaaatgggagcggagagctgcggcacggaatcgctgagcaacgccaacgacagcggacgaactcttccgggggntagcgaccacggcggga

SEQ ID NO: 46537 - DNA, 1156 bp, Heterodera glycines
  Genomic contig location: Contig_ID=SeqID_37832; Location=108..1263; Strand=-
  SCN-specific regions: Sequence locations=1-104,126-683,705-971,993 -1156
  Gene Ontology: Mol. function=protein carrier activity; Cellular component=nucleus; Biological process=ribosomal large subunit nucleus export
gaaggtcatcgaaattatatcggaacaacttccactttcctttgacattgccacttcctacgcaaatggaactaacgaagaccaaaaatttgtgtcaaatttcgcccaattgcttagcactttcttcaaagaacattctgcattggtcgaaataacctttcctcatccggacgaagaacaaaaagctgtcaagcaagcacatttgatggcgttgaagtatttgttgaagatcagcagcgaagtcgaagacatcgaagtgttcaaagtctcttttctttacggaacccttattacactctctccaattactcagatttgtttggattattggaattggctttgcatggaactgtttcgagaatctccatttgaacaatctgaacattcgatcatcgacgctctgaagcgctataaccggcaagaatcgcccaagcggaagctgtacatcgaagtgctctcagaacttcgcctgctgatgattagcagaatggccaaacccgaagaagtcattgtcgttgtcaacgagaacaatgaggcagtcagggaacttgtgaaggacacggactccgttgtgctctacaaaacgatgcgggaaacacttggtttcttggcgatttatttaggcaaatttcacagtttgtgattttagtgttgctgacccatttggactaccgagacactgagttgaaaatgacggaaaaacttcaaaatcaagttaatggcagtgagtggtcctggaagaatttgaacacggtttgttggagtttcttccctgtctttcaaaagtgatttaagctgtgctgggcaatcggctcaattagcggtgcgatgcatgaagacgacgagaagcgatttttggtcacagtcattcgcggtgagtgaaagggtcgggcaccaaataaatatatatttttttgtagatttgcttggtttgtgtgaacaaaagcgtggcaaagacaacaaagcggtgattgcctccaacataatgtacgtcgtgggccaatacccgcgtttccttcgctgtcattggaagttcctgaaaactgtgatcaacaaactgtttgaattcatgcacgagtcgcacgaaggtgtccaggacatggcctgtgacacattcatcaagattgtcatcaagtgcaaatcgcattttatctcg

SEQ ID NO: 46538 - DNA, 806 bp, Heterodera glycines
  misc_feature (461)..(461): n is a, c, g, or t
  Genomic contig location: Contig_ID=SeqID_37841; Location=281..1086; Strand=+
  SCN-specific regions: Sequence locations=1-806
  Gene Ontology: Biological process=body morphogenesis (sensu Nematoda)
ggaccgttgaggagcttcgcctgaagagcaactccgacctgcacaagctgtggtacgtgctgctgaaggagcgcaacatgctgttgaccatggaccacgcgtacaaagtgcgccttcgcaacatgccgaaccccgagcgaattgaccgggtggccgaggtgtgcggtgtgctgcttgctgatcataggatcatagctgtgcaaagggggtgggggggttgtgaagccgaacgcaaagggtcggcaggcatcgatcacatgagaacggggagggtggtcgagatgaatgaaggagaaagggaaaaaagcgagaaagggagcgtcgagatcaaggagagggtcgcgcattgcgttcgactaacccttaatgagggatttatcgaacgcaaaagaggagggagaaaactcaaattaagacaaattttctcgctttaaactcccgcatttttatgcacacatacncgtattttttgattattacaaaatcgaaaaatacggttggcttttcacacacattttctactgataatgacaattagtaataattgtcaatttgattccattccaagagcatggaacgccttgaggcggtggtgcacgaacggaacgacgcctttttgcagttggagacgggcgacagcgcgtcgcccccgaaaaggacggtcacttccttcatgggattcacctacgagtgagaaaatgttaaaaaacaaattaatattatggcattttttcctcaaaaacctttaaatttgttaaatattatattttggaggtttcctgtttttgaaggcgtgcaactgcatt

SEQ ID NO: 46539 - DNA, 1859 bp, Heterodera glycines
  Genomic contig location: Contig_ID=SeqID_8067; Location=1..1859; Strand=-
  SCN-specific regions: Sequence locations=1-111,134-149,171-273,300 -379,403-759,781-1092,1140-1194,1218-1371,1393-1530,1553-1558,1580 -1616,1639-1703,1726-1859
  Gene Ontology: Mol. function=phosphoric monoester hydrolase activity; Cellular component=cytoplasm; Biological process=inactivation of MAPK
gccggcagatgggcaccattttttgcgcattccaatcaaagactcgtacagtgccaaactgttgccccattttgatgccgcctttgaattcatcggttttggaattttgggaattttattaaaaaaaaaaattctcctattggtattggaatttaaaaaaaattttttttgtttcttactgacttacgaattttgtacttttttgtaacattttcttcagcattcattttatttattgggtaaatggcaatttgtacacaaaaaaaaatgcaatttaaattttcttgtaaaaaatttcctaccggtttaaaatttttagaaacaatttaatttctcatagtaaaaatatacaaaaaaaaaatttcccaggacacctctatctctgcaatttacaaaatttcaagcccccaaaaaaattttttgtgaatttccaccttttacacacaatttttcaatttctcagaggccgctcgcgcctcggggcacaaagtgctggtccattgtttggccggcatttcacgttcgcccaccctggtcattgcttatgtgatgcgcgcaaagcaagtggtcagtgacgaggcgtacaaatttgtcaaggtgagagacggacgacattcgctgacatattttttatgcctggacctctgatgagacatgggtctggaatttctgtggacaaaaaatttccaagaaaaacgaggcctaggaaagtaccgggaaaaccaatggaaattgaggtccaggaaaaactaagtgaaaaaatccaggccaaggaacatcccagggaaatccaggcccagcaaaaaaaaatcagtgaaaacccaagggaaattgaggcccaggaaaaattaagggaaaaatctaagttgccaaaaattgcctctgacctggacccaggaaaaccccaggctgccaggatccaagtccgagtcgaacttttcatctaaattttttttaatttgaatttcacacagaatcttcggccgaccatttcgccgaatttcaattttttgggccaactgatggagtatgagaagctgttgcgtgaccaaaaggtgtggtagtacaataataatatgtagatacaccgcgatttaaattttttttttttttgcatattaaaatttatcattttttaactgccaggtgttacccaaacaacaccaaccattattgtcctctcccattttgatgaccaacaacaaccaccaaaatggtgtggcattttttcaaacaaatttggcattcgtcttcaattcggaatccagcgggattaaagatggaatcattgttggattaattctggggggggggggggggggttccgactccgggatccatcccgagctttttttaaattcattgggggttgatcgggatcggggatttggacggaatcccgattcgagaatccctcccgattttggtgcttattttaggatttttcggaaaattgttatcaacaaaaatgcaataagaaattgaacatttttattcgttccctcagatttaatttttttttttcctcgaaaaaatatttgattttaaaaattttcctccttcaaaaatgagacagtatcgaaaattttttagagccccagcatttacatattgggattttaaattttttttttttttgtgccatcaaacaatgatggtatttggaattggaaacactgacatacatacatagaaaatggtcgtttaaatttttttaaaaattttggaaaaaatttttcttatttgatccagcaaatgccgtcacccaatcgtcgtcgtcgttggttctcgttgaaaagaagccgccgcccatcgctgctgatagttgggccagcgtcgttgttggcactgatgccgag

SEQ ID NO: 46540 - DNA, 3104 bp, Heterodera glycines
  Genomic contig location: Contig_ID=SeqID_1051; Location=1521..4624; Strand=-
  SCN-specific regions: Sequence locations=1-199,226-595,617-859,881 -1390,1412-1456,1478-1965,1989-2148,2170-2301,2323-2402,2424 -2579,2601-3104
  Gene Ontology: Mol. function=transcription factor activity; Cellular component=nucleus; Biological process=organogenesis
tttctttctaactctgctaatcacttttccctcacatcacttttcctgatcactttcctctgatccttttccctctgatctcttttctctctgatcacccctcccccctccctcctttccccttattgtttggcttttcctttagctttggcaccgcctctcttctcgcccccgttcgtgcccttctcccttggccctccctgctcctcctcttcctcctcctccgatttgctttgtgtccgtccaatgccaaacttcgacatgaaaccaaattgcgcttcaccacagacgacgcaacagaacgaagaggacgattgggaggcgatgatggaaataagcaacacggacgaggtgaatgaacgaaaataaattatgcaaatgaatttcaatttcaattcagcaagagaaaattcgcgagttggccggcgaaaacgcattgccaacgacggacccaaatcaatgcgtaagaaggggggggggagagagtgatcggaatggcatttgatcattgcgggattgattagaggacacttttgttagagggggagaggaaatttggtaggaacggcattttgaaggggggaaggtcgactgaaatgacacggaagggatagaggatttatcggaatgtggcattttggtcgattagaaaagggcaaataaattccgttttagattatctgtcggagggtattgagctgcaaaagcgcattgcaaatgcattaccggactcatacaggtcaaaaatcaaacacgagagaatctgtcagccaatgagtttctgcttcaggcgaaagaccgttcaaatgccgaatttgtcagagggcattcaccacaaaggtgccaaaacaaatgatggcacatcaatttaaatgccaaataaatgccgtcaatttgcaattttgcagggcaatttgaaaacgcacatgggcgtgcaccgttccaaagcgccgctgcgtcatcagatgcaccatttgctgaacaacggcatgccgaaggcggaaaatgccggcggaggggtgcccaacgtcgtaaacggcggcgcattgtacgctcatcgcccggggggttcgccctcagcgcctggcactgccgacattccatgcccaatgggctgtggtcacaaaagtggagacccgggccaattgcagcagcacatggcggacattcacggcatgcaaaggttggcagtgacggcatccaaaatagaaattccgctaacttttctcttgggtgtcctttctgtctttgctttagcttatattccttttccaggctccccttctgtatgccaccaaacggtgtgctccccgcggtgcctccgccgcctttcggccgccctttgaacgcctttcatccgtcgccccaggcgccgttccccggggcgatgttcgcccctctccctccccacggaatgcctccggcgccgttccctccgatgattgtcccccctcacccccttttgtttctgcttgcccaacaacagcgaacacaactgcagcagaacacttctccgcgggaacaacattttggagcagtgtcagaagggaatggggaaggacagaggcggggggagacggagacggacaaagttgaccacggcgcggcattggcaaatatgtttatgcctaaggcggatgacggaggaggcgacgagcgacaccggagagaggaaacagcgccggcaccgttggtgggattggcaccgttgccggcatttttcatacaacagctcgcgaccaaaaagtacaaatcatttggcataaatttgctatcaatcaaagccactaattactgtaattaagcgaaagcttaaacgacacagagccaaatgagcccccgttgttggtgaaggaggagacggagatgcaaaggcacgcggagggaacggacggcggagagagtgccgttgaggaaaagtaagtgaagcgggagaagggaaaaagcacaaaaaacattatcccctgacagcagtagcagcagtgaaatgcagcagagaaattgcgtttccaaatcgccgccgcggggcacaaaaaacggcacggcaattgtggcgtcacgcacttccgatttgatcgttgccgacccaacgacggcgcacggcgcagaagaaaacggcgatggggagaacccattggaaaaggtggggaaagagacaattttgaaaaaccatcaacccatcattgatcagtgctgattgatcaaattactgatcggacccatccgtttgggcattttaaatcattttggaagggtcggatcagaccaatctgaaaagcttggtctttccgggggttttcaagtaaaattccgtcaaaacaatgccaaatgaatgtcctcccgttttccgcttgattggccattccttccggcagatccaacgcattttctctgccgccgattcgccgccgcccgccttccccaacgatcccttcggcgcctcgtcctcctccgccgctttctctgttaatggtggccgtgttccgctggccaagcatcagtgtcgctggtgcatgaagccgttcagcagcagttccgcgttggtcattcactcgcgcacgcatactggtgagaaacgggcggggaaaggaggggggaggatgatcaaaactgaccagatcagtgaggagagagggggaagactgatcagaatggaatgactgaaacaattagaataagagaaacgatcagaacagagagcattaatcaaaatgatcagagtcagtgattccttcaattagtatccatttgatccctaattgcttcttctctgtgtccatgctgatcactccttgccaatttgtcaggtgatcgtcccttcaaatgcgaggagtgcgggcgcgcgttcacaacccgaggcaacttaaaagtgcacatgggtgggtcacttgtcccgattaatttctcggccgttcctttcatctcagccatcaaactcaatcattgattatccatcttaattactcgatatcattgtcactctcattagccgttaattgatcattgcccccttctttagggactcattcggcccctcagaacccttcgaggcgtggccgtcgcattttcgacatggaggaggtgttgctgcccgccttccgctc

SEQ ID NO: 46541 - DNA, 1434 bp, Heterodera glycines
  Genomic contig location: Contig_ID=SeqID_8080; Location=205..1638; Strand=+
  SCN-specific regions: Sequence locations=1-97,119-271,293-577,599 -875,903-1046,1068-1400,1433-1434
  Gene Ontology: Biological process=gametogenesis
gcatttgtttcaccaacaacgtcaaaatgccccaggcaacattaaggttggtgatgatgccttgattggcagaagggaaaatttgtctaggtatacgatcatcatcatccttatgaaaccgatttggagtcgggtttgacaagtgactttgatgtgcagcttgaacttgccgatgggtttgctatttctttggttggcattgtggacgaggaaggggaaagtaaaggactgaagcaggaggaattgtgctatggccgattgagcggcatcaaattgaatgttggcaagttcaaagcaacatatcgcatcaattgccatatcgactcaattcaggtggtcatattctaattactaattttttaaattattatgtccctaatttaaattattcgcattattattgtcccgtacaattgcagatggacaaccaaatcattggggccgaccgttggcattttttgttctgtgatcccggtgcattgaaggacgaaccgatggtcggactgccagcattggcattcgaaatgagttacactcccagcgagtttttcgatgtttacgaggcatgcccatgtcctacattatttatatgcagtgaattaaagtgtgatactgtactttcagtgttttcggctcaaactgagcaatgcgtgcattctgttggatgagcaactgttgtggcgcctcgtgcacttttggcggtgtgttttgaaacgttggcaagaccaaagcgaccaacagcagcgagagaatgtaacaacaccaacagcagatgaaacgaaatgcggcacggaatcgccttcctttctgcacaacaactgctactttggcactttgcaattggaattcggcaacatttctttgtctggtagtcactttgttttgtttctgtttgtacttttgtccaaaattttctagttttaactgttgacaaaagtgtgctctgtcgttgtcaattcgtcaactgaaagattctttcagcaagcaactcactttgttcagttttgagaatgcccttgtcacattggcaccgttctgttggctccgttacttttgctcattgagccgtttgcttgaaacgcttggaaatttttatcttagtcagtttgctggcattttgtgaataaaacagagaattctattatttcatagacaaattgaagcgacaaaaattgaacatcatttttgcgatggatgcttttggcaatccaatggcacttggcaatgagctgaaggagggtctccaaggactgatctttgagggcgacttggccggctttgcctttggcattggatatggtgctgcgaacagcttgtcaaaggtggatgatttttggcttctacaaatgctcagcagaacaaaattttgtattttaggtcacgtcttcaatggcacaaggtaaaatttttattattaaacaaaaaattatttga

SEQ ID NO: 46542 - DNA, 1508 bp, Heterodera glycines
  Genomic contig location: Contig_ID=SeqID_8089; Location=2211..3718; Strand=-
  SCN-specific regions: Sequence locations=1-92,114-151,173-178,232 -411,433-731,753-793,818-827,850-1039,1061-1415,1437-1487
  Gene Ontology: Mol. function=ATPase activity; Cellular component =nucleus
atgctcgtaagtcatttataaaagaaagaattagagacagagagtaagaattaattgaaaaggtttaaatttctcaaataattatattgaaatttggccaaaaagaaatccccaaatatggacattatcattatacactgcatattttagccaaaaaatttattttttaccatttgccaattttttaaataaaaagttatttttgaatttttcaaaaacaaaaattttaaagaaccccaagcccgatcttttctattctgctgtcggagtttcagttttttttttatttaaacaaatttttctgttaggcaaaagctgctgcaaaagaatggtctacaaaattgttcagcattccttcctcagtgattatctcaaaaaaggacgaagaatcagttgattttatcaaagtgctttttcaaatggccaaaaatgctcaaccttccatcattttcatcggtttattatagcaaatggattaagcattttaccatttatttgttcagacgaaattgacgcatttttacgcagcgggacggttcaacgcggaaaggcacaatttttggttgaaatggacaaactgtcatcaaactcggcgtatcatgtgttggtaattggggccacagatcagccaaaggaactggacaaagaggcgagcagacgattcgccaagcgaatttttgttgaaaatccaagccaacagacacgagagaaaatgatacggaaaattgtggaagaaaatcaacatgcttttgagttaagagacgaagaaatcaagtgagtggcggcacgtttgactaataataataataatcattagttccttaattactgatttaaaattaacaatgataatttattaattctctcccttaattcttattttaaattaaggcaattagcatcgaggaccgaaaactattgctttgatgatttgttggatctttgtcaaacagtgaaccttggcgttttgcacgatgctagtgagagaaatgagtttggccagtgggagacggttgcccaattgcgtcacatcaaaatgaatgatttggaaaatgccattgaaaaggttggtttcatggcaactcgtacaacgtacagtgttatacacaaaagcaattcatacaatgttgtataaaggcaactcgtacaatcgcttaggttaggcctatgcttaggcttaagcgtaagctttacgctaggcctagccttagtgcttgggccaggcttaggcttaagcctgctttaggctaggccaaggcctagccttagtgcttgggcctaggattaggctttattttgtaaatacgagttggttgcattttgtgcgagttgccattgacccgaaaacgttaagtcacaattgaacaaagaggaaagcgaactgaaaaagcagccgaagtcgaagaataacaaacgcaatggaaaggaggaagaagaatcacaaaatgaatgagatgagatggacacattggcatttcagctgagagcaacaaaacggaaaaaataaa

SEQ ID NO: 46543 - DNA, 1020 bp, Heterodera glycines
  Genomic contig location: Contig_ID=SeqID_37995; Location=243..1262; Strand=+
  SCN-specific regions: Sequence locations=1-100,122-458,482-1020
  Gene Ontology: Mol. function=tRNA binding; Cellular component =mitochondrion; Biological process=tRNA processing
atgggcggtacggggccgtgtgggccttgttctgagattcattatgaccgagtcggtggaagaaatgccgctcatttggtgaacactggcgacccaatggtggtagaaatttggaatttagtctttattcagtactacaggtaaaccgattcttctttttttaaatatcattattatcctattatttagggaagaaaatgcgaagttaaggccactgtccagcaaatacgtcgattgtggaatgggactcgaacgattggtgtcagtggtgcagcaaaaaatatccaactatgacactgatttgtttgttccaatatttgatgtcattcaaaaggttctttaaacaaagatacaaattttgttatgaattaacttattgcatttcccttagatttctttaaaataatataggcaattgacaatttctgggcctaaatttaatgtttattcattgccattgcgaaaaggtaatttataaaatttagttttttggttaagtgtactgctcaaaaacacaaataccaagggcgatttggggactctgacaaagaaagtattgacgttgcttatcgaatcgtttccgatcatatgcgagctgtgaccgttgcattggcagatggaattggttttactaatcaacaacagaaaaagagctcgtgaggaaatcattccaatcagtcagtttttaaattttcaggcgtaaaattaaggaattgtttaaacgcgccacgatttatggttctcaaatgctcggaatggaacggatgagcatgcatttgatggtgccggtcattgttgaacaattggtaatttaaaaatgcagaaactcataaaaaatgtttatagggtgaaacatttcctgaaatggcgcagaacaagcacaaaatcgccgatgctgtcagaatagaagaagaacgactttggaagcagagagacgatggaatgcgtcatttggaagaattgtttcgtaaccatccgccgacgagcaaagtttttccgggtgaactaatcgaaagttaa

SEQ ID NO: 46544 - DNA, 3926 bp, Heterodera glycines
  Genomic contig location: Contig_ID=SeqID_8100; Location=1934..5859; Strand=-
  SCN-specific regions: Sequence locations=1-336,358-371,393-467,489 -656,680-876,924-1005,1103-1228,1260-1543,1565-1633,1673-1677,1700 -1761,1795-2023,2045-2047,2092-2321,2345-2372,2422-2456,2499 -2642,2706-2768,2819-2839,...
  SCN-specific regions: Sequence locations=...2877-2930,2954-3015,3042 -3589,3622-3805,3844-3926
  Gene Ontology: Mol. function=glutathione synthase activity; Biological process=neurogenesis
atgacattccgccaactcgacataaaatgtttaaaatcatttttcattggcctcagtttcttcgccactttcttcgtttccacgaacatcattaagcccctacaaagccttgtatgtatcacaagtccgaacaactgcaaagaatttgtcaatccttcgtccgatccaaatttgacctcgtcaaagatcgcaccaattttttacttgatgatataccgttggcgacttaatgctttactggaggtgttctgctcgtccgatttccagcttgcggtgccttttggcttttgtatttcgcgaacagttggcaattcttattataattttatgtttacaggacattttgaaaaatttatgttatcattttcgggtttttaatgaaaatttctgatccaacaactgtctggggtaatccgttgacataaaagacttgttttctacaagtcacaaaaattatggattccataaaataaaaagttttggccaaattcttgaagccagaaccgagtttggcatttttggcacctgaaattcggattttggtaccaaaaaactgacccggcaattcaacgctggcaatttctgccagcattttccaaccataatctcagctcacagaggacaacactttggttaattccggcaaaaacagaaaatggcaaaatatgactgaaaaatgccaacatgaatttaaacttactcaattttctattcatttccttacggaaatgaaatgaaattgataaaaaaattcacgtgaatttattttgtttttatgtttttcatattataataaagaacggaagttgaattagtctgatgtaatttaaacaaatttctgtatgaattttgcatataaatttgacaaattttctcaaataaattcattaaatattttgatttatatatttttttaatttttagtgtttgaaaaaatgaatttttttctattcattactattatttttacattcgcaaaaagtgggtaaaatccattaaatatgcatttaaattaaataaataattattgatcacaattatttttattaaattattttatttttcatattttaatttgtaaatattaaaataataatatttaggcaacgcggtactaaattatgtggaagaagcatttagtagcagatacgaagttcaaaagttggccaattatgcaattgattgggcttttaacaacggaatgattcttcgttatgacatcagacagtaaaataaataaataattataaaaattaaatggttatttttgccttatttagcaatttcatagcccaattctcacccgtttcgcttcttccgtccccatttccgagagaagcatttgagaaagccatcgctgttcaggaggttaaaaataaacagacaaaacattcgttttataataaaaccatttaattaattaaggtcttaattattatttgctatttattttggcaggccatgcaattgctttacttccgtgtcgcttgcgatttagactttttgttagacgcttacaaagacgtagagaaaacagacaaacacataagacagctggtggacattctgcgggaagtgaaaaaacaaggcataaaacagccaaagacactgatgataatgagatcggcaagcaaataaactaattaatgaattagctaattagtgaattaatgatcattgtatttatgtgtgtgtttttaggattatatgctgaacacggtgaagagcagcaaagaggatggaatggatcgatacgagatcaaacaggtaaaaaataataatgaataagtaaaatttcaaatgattttttagatcgaagcgaacaccggcgccatcaccgggttgcgaattgatcgacggaccaccgaattgcatcagcgacttttaaaacgcattggcagggacccgacaaacgcaccacaaaatgagggcgatacgaatctgatcaactcactgttcatggcatggtaaaaatgaagaaaggatggataaaaacgatttaaaaatcatttttgagggcacatttttgggttttttaattgaataattgggaaaaaccaaagccaaatgatagtttattttcatttttctaaaaaaattattattgctctttgaatattttaagtgatttccaaatttcgcagtttcattttgagaatttaagggaatcctttggcaattccgacgctttgttcgtaattttgtcggcaaaatggaacaaatacaaatacgaattgcgcaacattgaggatgaattggagcgattgtctggtgggaaattgcgcgttgaatatgttccgctgttggaaggatatgagaagtaaaataaattttaaaaaataaacgaatatttttgaggttttaaaatctgcaaaaaatataaaaatcaacattaattaaatatatttattcaatttaaatgctaaattagagaaaaacaaattctagcgctattgattttttataaacaaattttttgtttaacaataatttttttagcttttcattggccgatgataattcgcttttgctaaatggcaaaatcgttggcgttgtgtattcagggctttccgcacttggctatcaagcaaatgaaaaggaaatgcacacgcggaaaatagtggaactgtcgacagcaattgtaaaataaaaaaatataaaattaatcaatcaaaaaatagtcaaaaaaaaaaattatttaaaaagcggcaagagagagattaatgagatttttgtaatatgatttaaataaaaatgcaattagcatgaaaataataataatttaaataattttttgacaaaaattcaaaatttttaacgaaaattgttcttttgtcggaaaaatatcataaatttttttaataaatattaaaaaacattactttgtggatttataagcagaataattttgaagctttatgtttaaacacttttcaaaaatggcttgaatattctttttgacctttttcgtttcctatttttagcacataatcaaatctcttccatggctattcgttttcttttaaaacacaaaaattgtttaatttgcagaaggcgccatcattggcaattggaattagcagctcgaagaaaatccaacaggtggcagcaataaaattgaaattctttgttaattgcataattattattaactgttcagcttctcgcctcgcctggcattttggagagatttttccctgaccccgcagaagcggacaaagtgaaggcaatccgtgaaacttttaccggcttatggggcctcgaaaaggatgacaagcaaaccgaacagctcattgcggtagggatgaacggcaattaacattaattgatgaattatttggttagaatgccatcgaacatccgtcaaattatgtgctgaagccaaacggcgaatgtggcggaaataattattacgacaacaaattgcgtgaaaaactactcaccatgacccgagaagaacgttctgctcacattttaatgcaaaagttacacccaatgacaacaaaggtgagactccaaacggaggcatactgtaagagaatgaatcattagaaaagtaatacggtatcgcaacattgagatacattggttatttttttaaatattttttgttaaaatttagaactattttcttcgtccattctatgcgccaaagtttggcctcgttgtcagtgaattgggcgtgtacggtaccctaatgggagacatgctcacccgtaacgtgtcgtccaatgtgcagcgtgggcatgtgctgcgtacaaagtcggcaggggtaagcaaacgacaaatgcgtaaacaaatccacttttttaaaaatataaaataattttaaatattttttatggttttcgcgtttttctttgcaggtcaacgaaggcggcatcagtgttggcaccgccgtgggcgattccccttaccttttttag

SEQ ID NO: 46545 - DNA, 911 bp, Heterodera glycines
  Genomic contig location: Contig_ID=SeqID_8118; Location=2593..3503; Strand=-
  SCN-specific regions: Sequence locations=1-34,57-563,585-911
  Gene Ontology: Mol. function=pre-mRNA splicing factor activity; Cellular component=small nuclear ribonucleoprotein complex; Biological process=mRNA splicing
aggacaatcaaccaacgatttgctctgctgtttgacataaacaattaattcaacatgcaaaagtgttctccatgtttttttttgaggataaaacatttgtgaagaaattttatgtgccaattttaacacaaaaaatgctctgatggatgatgtgtcatgatattatatctgtcaaaatttatgtaaaatttaaaaaaatagcgttttttgcgcgcgttataaaatgagtgcaccaacgacattggcgaccaacagcagacgacaaacgcccagcgaatttttgaagaaaattgtcggcaaaccggtggtggtgaagctcaattcgggtgccgattatcggggtccgttttggatttcgtgggcatttggaggggactattcatcagagattgtcgaaagagttttgagtttggaatagtcagtgtttttgggtctcgggacgagtcgtcaatattcggtcttgttgctttcatgattcaatatttggtacggcaaaaaaaaatttcacccgtaaaaattgataagttgccaattaattccgagtccctaatccaaaaaaatggaatccaaaaatttaattttaatcccgcaactttgctttttcacgcctttgtcccaattcgaacacttggaatggtattcgactgaagaaaaaaaaaactgagagtgcctcattttgcctcgggccaataaaatatgccttttgatcaattaggcacttctttacctagctgatttttcactcaatgtacaactttgcaggcattctctcctgcctggacggcttcatgaacattgcgctggaacagacggaggagtaccatggcggacagctgaaggccaagtacggggacgcgttcatccggggcaacaacgtgctgtacatcagcacgcagaagcaatgacggatg

SEQ ID NO: 46546 - DNA, 267 bp, Heterodera glycines
  Genomic contig location: Contig_ID=SeqID_1061; Location=5572..5838; Strand=+
  SCN-specific regions: Sequence locations=1-60,82-267
  Gene Ontology: Mol. function=endopeptidase activity; Cellular component=proteasome core complex (sensu Eukarya); Biological process=sporulation (sensu Saccharomyces)
atgtttctgacccgcagcgaatacgacaggggagtgaacactttttccccggagggccgtctgttccaagtggaatatgccatcgaaactgtcaaggtgagttggaagaattcaattcagattcaccataattttcatagcttggttccacaagcatcggaattcacaccaaagaaggcgttcttttggctgcggaaaggcgttcaatgagcaaattggtggtggacgactcaatgagcaaaatttcggaagttgagaagcacattg

SEQ ID NO: 46547 - DNA, 486 bp, Heterodera glycines
  Genomic contig location: Contig_ID=SeqID_1062; Location=286..771; Strand=+
  SCN-specific regions: Sequence locations=1-167,189-486
  Gene Ontology: Mol. function=endopeptidase activity; Cellular component=proteasome core complex (sensu Eukarya); Biological process=proteolysis and peptidolysis
atcagtctcggccgtccgtttggagtttctatgctttttgccggcattgatcacacgggtgcgcatctcttccatttggacccgtccgggacgtacattaaatgtttggccaaggccatcggtgccggctccgatgcagcggaacaaacgctgcaagagcactgtaaaaactgcgacaaagtgaggaaaatgcactcattgcttttcacattttatcattatcattcgcagaaaatggaaatggccgaggcaaaacaagtcgcactgaacacactcaaacagctgatggaagagaaaatcaattccaaaaatgtggaaattgttatgattaagccgcagacggacaaggaaggcaaaacggtagcaattggaagaaaatgcatattttgttatttattcccattttcagttgggcaaaattgtgtggttagaggaatcggagttgcaagaaatcatttcgcgattgtagtcgaaggggacggatga

SEQ ID NO: 46548 - DNA, 3464 bp, Heterodera glycines
  Genomic contig location: Contig_ID=SeqID_8121; Location=16..3479; Strand=+
  SCN-specific regions: Sequence locations=1-638,660-813,841-903,987 -1372,1395-1495,1517-1592,1614-1713,1735-1782,1812-1971,1994 -2279,2301-2459,2495-2829,2968-2981,3008-3464
  Gene Ontology: Mol. function=profilin binding; Cellular component =cytosol; Biological process=hearing
acaaaatgacgtgcacgacttggacagccgcaccaatacgttgccgtcgtcctgcaaaaattccgaccgtgagcacattctgctccagcttttgctaaagctcgttgttggtcagcgaccggaaatacaaaaggtgtggcattttttcaaattaatgactccatttccacggcattacttcttttggtgtagcaaattcccctcccaacatttcagggcaacctatttctccgtcataaacaagtgcgtttcgtccgtggcttttggcgacactgcgcttgaccaggacaccgaaaagcaaaacgttttcaccggcggcgatttgggtgtgtttttatgaattcgtaatcgaagagtttatcgtaaaaatacatccattttagatgacgagtttgacaagatggagcgggacgacggcatcaaacggctgaacaaacgtctcgattccgcggtggaggagaagcaggaagcggtgtcactgcaaatcaaatattacgagaagctcaaggagttgcaacacgagtgttcggaattgcgaaaagttgtgcgttttaattccatcgaaagagagtaattttatagggcaaacattttcatggcttttgtgccatgagatttaagtcaatgtgcccaaaatgtttaaaattttccaatttttattaaacaaaattgcaggcgccctccggacgcgcattgcccccggccaccgttttggacttgcccctgccgaaagaattgggcaaaattgtcaacgggacacaaaagcatggaatagcagcaggcgcagcatttcccacggggccaggctgtcctcctccgccgcctccaccaccgccacctccggcactgcttatgccggaccataaacggaacaaattggtaacggcggctggtggttctgtcccaccgcctcctccgccgccgcctccaccgtcggcgctgaggccgggcgggggcggccctccgatgccaccgccgcctccgcctgggtttggtacgcctccaaccgcatttctgcatgccgcctcgccggagctgcccgactacttgaagaagaagtccggcaaccagccggaggtgccaatgaagaagcttccgtggaatgcggcaattgttgggccaaaatttataaattcatttcgtatttttcgcaaacaaattaattactctttcactgccaacagattcgaccaaacgcgctgaacaagaactcgctgtgggcacagattgacgagaaggaagtggcatcggaggatgtgttcgactttttgaaggccaaattctcagccaccgggtcggttgaatggaagtggatggcattttataattctttttgcagacgaatgaattgccttccaatgaatttggccaaaagaccgccgtcgaaggcaaaaactccgttggtcattcaggacgcgaaaatgttgcaagctttgggttcgttcgttcatatcgcaaaatacaataatttttggaataaaacccgcaatttttggtatattttataaatttctttgacttcccaaaaaacttgtttcagcaattctgcaaggctcttgcaaactgagtttcaaacggtggcgaaatgcaattttggaggtggacgagaaagcgctcaatgccgaacttgtggacaaattgaagagcgcactgcccccgttggaaatgatcaatcggctgaaaaagtgcacggatgacgaaatgcagaggatgccagaaggggaacaggtgaacaaattggacactaaaacagcgatttttttgaaaaaactgtaattcgccaaaaatttcattctaaattttctttcctcgtcgtcagtttgtcgccaccctttcgtccatcagtggtttgccgctgcgtctggaggccatccatctcaaattgtgttggtccgaagcctttggagaacttaaatcgggcataacgacggtgaccgaggcgtgcgaagtcggcacaaatttcatttttatttatccaaaaaattttttaaggaattgctcaaatcccaagggctcaaacacttcatcaacttggtccttttggttggaaatttcatgggacgcacaaaaaactcaaaggacgccttcgcatttgaactaagcgtactcaacaaagtgcggttgttatatgtgtggcactttctcttatttttggatagtttctgttccaatttgagtttttgcttcatatttatccccattttgggtttattttctttcggttttttctaaattttaattccattctttagctggtcgacacgcgtgactgtgacaattccgaaacccttctccacggactcatccgtcttctgcaccggaaattcagcggaaaattcaccacttttgcactggacgactttcaccacgtttccaaggcgtgccgagtggacgtgtccgagttgagcaaaaacaaaattgaccaagtcaggaattccattgagaaggcatgtttttggattttatttattttttctttattttatttcattttctacttttaggtggccacgtatttaagcggctacaaaatgcaggcggaaaacgaccgatttaatgagagaatcggtgcatttgtcaaacaagcgaaggaagatttggtcactgttgacagtctatgggaaaatatgcagcgaaaatggagcgccgtccaagcgtatttgtgctttgacccgaaaaagtacgccatggaccgactgtttgcggacgtacacacattcaaggggcattaccaggtgatttgatgggattgttatgcatttttacattgccgggatccatgcctaatgaatttataaagttttactggaattactaaattagacaaagtttaaaaaattatttttttcgttataacattttgaatttttttattgttattctttatttttgaagttttttaaaataaaatttgatttaaaaaatagaaaagaaattagtttcaaaattttaatatatttattttttgaaaactcagcgacaaattaaaaaaaaattttaaaataaacgagagaaaagacggcttttctgggacatcttagtgcacacgacaaagtcattgaccgtttccacccttttcagaatgccagggcagaagtgttgaaggatcagctgaaaggggcggtcgacggaagagagggggcgaaagcgtcgtcgaggaaaccgttcaaaccgatccaaccgatcgcaagcgaagcggcgaagagagcgcaacagcggaacagcaccagcagccgcagggagttgctgttgtcgaacgaaggcggcggcggtggttcaacagcgacaacgcccgcccgaccacaggcaaccaaaattggtacaacgccaaacacggtgccatttggcgcgaaggatgctgccggcggcggcgacggaggcgtcattgacaaaattgagcagatgttggaggagggcatgtaccgaatcgagtgccaaaagaggcctttccgtgttcggcgaag

SEQ ID NO: 46549 - DNA, 791 bp, Heterodera glycines
  Genomic contig location: Contig_ID=SeqID_38139; Location=442..1232; Strand=+
  SCN-specific regions: Sequence locations=1-602,624-652,682-791
  Gene Ontology: Mol. function=casein kinase I activity; Cellular component=bud neck; Biological process=signal transduction
atggaagaactcgtggcgctctcccctggaatccgcgtcggccgctggacgatcacaaagaagctgggcgccggagcattcggagccgtctacctgtgcgtgaacgaccaaggagagcaggccgcgctgaagacggagccggtcaacacgccacatccgctgctcgtcatggaggtaggcgggggaggaggggcgaaaaattggcaattcaaagtaaaaattttttttcaccacccaggctcacgtgatgaccaagctggacacccttcgagacggagacgggaagcacttctgccgctgcttggacctcgggcgcgatgagcaacaggaccaacaatcgggacaaatgaagaagttcaactacatcgtcatgtcactcgtcggtcgtggcctggacggagtcgtcaaggatgccggtggccgcctcagccttggaagcgcagtcggcgtctcgatccagatgctcgccgctctcagaggactccacaccgtcggctacctccaccgtgacatcaagccgggcaactcgaccatcggacgtccggaatcaaacgagatccgcctgctctatctgatcgacttcggaatggcgcgcaaatacaccagggacgacgtgagtttgagtgaagcgctttgaaaaaaacaaaaataatttgttccctttccccccttttcaggggagccaacaccgcccgcgcgttgccaccaacttccgcggaagcccccgttacgctgcgatcagcgctcatctcggacgcgaatacagccgcaaggacgacatcgaatcttag

SEQ ID NO: 46550 - DNA, 1191 bp, Heterodera glycines
  Genomic contig location: Contig_ID=SeqID_38177; Location=1..1191; Strand=-
  SCN-specific regions: Sequence locations=1-79,101-166,189-610,632 -668,690-734,756-1191
  Gene Ontology: Mol. function=solute:solute antiporter activity; Cellular component=mitochondrial inner membrane; Biological process =solute:solute exchange
gtttccgacggctcaagtccaacccgttcattcagttcagttttccattcacttgcatccggcgcaattgcaggtcctctctttctcacttttttcattaatatgctaataatggtgtgtgtttaggagcatttgctaaaacggcgatcgcccctttggataggacaaaaattaatttccaaggtgggtccaacaacaaatttttccaaaattccacatttctttcaataatgtttcgtctgtgtttcagtgtcgccttctcgtcgttattctttcaaagcggcacttcgatttgtgattttgacctaccgggaacaaggatttgtagccctttttcgcggcaattccgcttctctcgcgcgtgttgtgccgtacgccgccgttcaattcgcggcacatgaggaattcaaacacatgctgaatgtggataaaaataggtgggtgtgcttttttaaatccaattttttttagcagaaatttggctgataattgtacttttttggatactttactgttttgggtcacaatttaaaatataaaaaagccaacaaaaggcccgtgcaaaaataaaaaattttcgacaaattaaaaaagacaattttaatcttggttcatttttggcatttttgcctccaaattattattgtttctgcgcggtcttttgttggtttttttattttttaaattttggtttcccagaacaggaaaccccctttttgtgtccaccaatgttttgccatttccatttttctttgttagttcagcccaactccctaccggcgctttttggctgggactttggccggtgtcactgccgttgtatttacttacccattggacactgccaaagttgtctttcctttttcaatttaatttttttttttgcactttaaaggcgcgtctctccgtgtccaccaaagaagagtaccaaaatttacgtgccgttttcctcaaggagtgccgtgcccatggcttcctcactttttaccgtggcattttccccactctgctcggtgtgatgccttatgctggcctttctttcttcacttacgagtcctgtaaactcttctacacaagtcagactcatttgaagcctgatataactcataatgagaatgcaaaattcctattattttttattcctttttatttttttttagaggaaaccggtaaccccctgaacccgttgtt

SEQ ID NO: 46551 - DNA, 680 bp, Heterodera glycines
  Genomic contig location: Contig_ID=SeqID_38184; Location=153..832; Strand=+
  SCN-specific regions: Sequence locations=1-24,49-680
  Gene Ontology: Mol. function=protein phosphatase type 1 intrinsic catalyst activity; Cellular component=cytoplasm; Biological process =cell cycle
atcaagtacccatcgaacttcatgctgctgcgcgggaaccacgaatgctccaacatcaacaaagcgtaagtattgtttttttttcattttaatcttcaatcttttttcccctttcagttatggcttctacgaggagatcgaccgccgttacccgcgaccgggcgctcgtcgactcttcgacctcttcaatcaagtcttcgcctggatgccattcatcggactgatcggcgagaagatcctctgtaagtttttttcccaccatttttcgataaatcactgatccacttttttcaggcatgcacggcggcatctccgacaagatgcgcagcctggatcaactcagcaccctgcgtcgaccacacacaaggccaccactccgttcgctcgaaattgatctactttgggccgatccagcgcaaggcatacgaggcgtcgtcccgagtaccagaggagcgggcatcctgttcggcgaggacctggtcgcccaaatacgcactcggcttggcatcgactacatcattcgggcgcatcaagtaagtttgtgttttcaatttccttttccataatttcttcactttcagcttgtccttgacggagtggaatatttcgccagtcgccgcctgatcaccgtgttttcggcacagcgctattctgggcggacaacacgggagcaacgctga

SEQ ID NO: 46552 - DNA, 3203 bp, Heterodera glycines
  Genomic contig location: Contig_ID=SeqID_8146; Location=448..3650; Strand=-
  SCN-specific regions: Sequence locations=1-325,347-919,941-1389,1411 -1603,1773-1825,2001-2096,2123-3203
  Gene Ontology: Mol. function=translation initiation factor activity; Cellular component=eukaryotic translation initiation factor 2 complex; Biological process=regulation of translational initiation
atgaatcgttttagaaatcaacactttgtcttcggaaatcgaatgtttgagaagaacagcgttttgcagctgcagggcatcccgctcatttgcaaggagggcatgcagaagaatgtgcgcttcgtcggcgacagtccccagcagagcactgccgtcattcagttggacggtacgctatgcgccattcactcaaaatgtcgttgtttcagccaagaaatcggctttctttccggccattggactcgtcgatttcgtcggttacttcatcaattccgatcctcaccgtctcgaaagtgacgttcagcagaaggctcgcgttgttaacaagcaaatcaaaggtaacatttcgaaaacctcagaattactcaaatttcatcaaactcaggccttgccgtccaaacaatccatttgcctgaaaatcaggtcgtttcttcggactgttccttttgtgttccttttcattgcatccctttcagatgactttctctgcttcgggtttgactgaccgcggagccaacgaaataacttttacgatcgacaaccatcagacgaatttggtgcagtattacgaccaaaagtacaacaggcggctgcgctacccgtgccttgcgtgtgtcatccatcgcaggggcaatcaggaatcgtacttcccgatggaagtgctgaacattgtgtgagtccaactttattcgggtttgccattttagggatacaatatcccgtgggcgattacagaaatccctggacagatttcgtttaacattgtgtatttttgtatttttttttacttcgtttagcgatggacaacgtgtgtcattggacaaacagacgcccaaactcgccgaacaaatgatcaaaaaatgccaggttctgcccgtcgatttgccgcgtggcattgagacacagcgtgacaaagggatgatccaaaatgccaacccattctttcgtgcgcacgaaattcgtgtcgagaccaatatgatgcaagcggaagcgcaactcctttacccgccggcaatttgcttctcggcgccgattgagaaaatcgaaccgaacaatcgtggtggtcagttgcgtctttcgaatttagcattgattttgttcggcttttttttagtgttggacttccgtttggctgaccgtggacagccattgcctcttcgttattctgtcccctgtaaatttccgaaggtttgggcggttgttatcgtgcaaaactccgttcaaagggaccagtgcaggtgggtcaacggagtcagagcgaattcaatggccccattgttgtcagaatgttctgtgagtgtttgattcgatgtgcccatgcgcgcggggttcagatggaaatgccaccacgagtcgacaattttgaggacacatcgatgtgagttggacaaaaaatcagttttggttttatttgggatgggatgaacggacagacaaatagccatcctttaaattcttttagtgagcatgttagtgaacaattcgcctattatgcaaacaatcgctgtaaatttgtgcttttcttcgcgcctgggaaggagtcggctcacgctggtgatattcaccacgtttttaaacttcaggaaattgaacatggcaagcgctctctccctcttctcccctctctctctcccctctccctttccctatctctctctctctcttctcccctctctctctcccctctctctctcccctctctttcctctctctctctcccctctctctttccctatctttccctctcttctcccctctctctctttccctcttgtctatccatctctctctctttccctcttgtccatccatctctctctcccccctctctcttctcccctctctttctcccctctctctttccctatctttccctctcttctcccctctctctctccctatctctctctctttccctcttgtccatccatttctctctcccctctctctttccctctcttctcccctctctctctccctatctctctctctttccctcttgtccatccatctctttcttcttaaggtgttctgactcaacatgtcgcgcctaaaaccgtggacaaggcccttggtcgccagggtgccatcatggtccttgacaacatcatgctgaagacgaacctgaaaatgggcggtgccaattatgaaatttgtgctgcacaggcattcaaagaggctaataggattcgctatgacattctgtaagtgcttggtcgtgagaatttgaaccagtttcattatcagttccgaacaatggttgggtagaaaacggatgtttttcggcttggacatgtcccacgcgccgccacagactttattcgaacgacgtacgggaaaagcgccggccattccgacgattgttggcgtaagtgggcttgacggtcgctgctgcttctgtcccagagtttgattttgccgtttcccagatggcctacacgatctccgagcacttgctgcagatgaatggcacctattggatgcagcagccgcgtgttgccaccgtacaaatggcttctccgatggtcaacgcggtcaaggaggcactgatgactttcaatgccaaaaacgggttcttccctgaacacatcttcgtgttcagagctggtgcttcggaaggcgaatacaaaaaggtgggcgagacggaagagttgcaaaaaggagaccaattgaaggtggcatattgggagggcggggcattcgccactgctttcgctgaactgacgaaggaacgcaaaatgtcgaagaagcctgcgttgacactgattgtgtgtcaacgtaactcaaactatcgcatcattccgaacaacgttcgcccgggcggtcgcgcacctgagcagaattgtcagccgggcactgtgctggacaaaagggtcgaatgcactttcaaattggatgttggacaattatgttgaatttcaggcaatgcattcctcactgacggaatttcttttggtcggccatcggactatccaagtgagtttttattgacaaattgacaccccgctctcactaccttttccattttttacagggaaccgcccagcctttgcgctgcactgtcgttatcgacactgccgaacctcggatcaaactcagcgaattggaacagatcagctacgcgttgtgctaccagcatgggatttgttgcagttcgacagctgttccgggcgttctctattcagccggggacttggcgaagc

SEQ ID NO: 46553 - DNA, 163 bp, Heterodera glycines
  Genomic contig location: Contig_ID=SeqID_38288; Location=607..769; Strand=+
  SCN-specific regions: Sequence locations=1-163
attgtaccacccaacaaaaaatggcgcatttccaatgaatttgtgtcgctgttccattccattttgtccggcatttgggcacttgccattctcacacgctttgatttccaccaaattgacgacctggtcaacaaggattcgctcgacgcgcgttatttggttg

SEQ ID NO: 46554 - DNA, 883 bp, Heterodera glycines
  Genomic contig location: Contig_ID=SeqID_8153; Location=289..1171; Strand=-
  SCN-specific regions: Sequence locations=1-25,61-370,399-429,465 -554,643-883
atggacttctttttctatcatttacaaattaatttaatatttttatttgttattattattccaaaattcagccaatccgaatctgatcgactcagggcagagcagttgctcaatgagcacaaacgtgactttgaccgtcaatatgaggagaacaaggcgcgcttagaggacatcagcaacacggtgcgtataattaatggatatttcattttaaaaacatttttttaatttgccagatttcttccatcgatggtgcgctgcccgcattgaatttggaagtttgcggtgccgactctgctccatgcgatgccgtgtgtggtggacctggtccaacctgttcacgttgtggcggttcatcgtgtccaggcacattaaatttgaaaaatattaaatattaacgcaacaattaaaaattgattttaatttcccattatttaaattgtattttttacattattatattaggctccgtatataaagctgaacaagccaaacattttgcacacgaagctctcgaaaaggtggagacaaagcaaaaagaagctgaagaggtgaattatttttatttatttaaatttttgtttttcattaaatatttaaaatgcgtttattaattaatcaaataataattgtttatataaagcttctgaaaaaagtgcgagatgttctgcccaaaacgcaggaggcacgcaaatcaacagaaaaagcattggaaaactccaaaagagaggcaaaattataacaaaaaaaaaagacgggaaaatgccaaattttaaaatttagtccgaacgtatcaacaaaacgcatgatgcattggtggcacaaattgagcaaatcaaaaatttccttgaatccgaaaggcataggtcaaatttacaataaa

SEQ ID NO: 46555 - DNA, 546 bp, Heterodera glycines
  Genomic contig location: Contig_ID=SeqID_8157; Location=948..1493; Strand=+
  SCN-specific regions: Sequence locations=1-4,26-403,425-546
  Gene Ontology: Mol. function=pre-mRNA splicing factor activity; Cellular component=nucleus; Biological process=embryogenesis and morphogenesis
taccttttaacttaaacccccttttgccaaaacgcaccggtctcgttgctctttgaactgtgggtcaacggtgttgtaacgcacatgctcgtgcagtttgtctgcaggaatgcgttcgtttgtcagcggcgaaattatgtacttctccgtggaggcagccgcagttttggacaccggaccaccacgcgctgaaaacaaataaaacaaagaattaaactcatcggaaatcaaaaatattaacagttaaagttattgagttgacaagtcctcgtaaaattaccagaagtcaagcattaaatattgtaaaatacccacattttttagggtcgtagtcgcggatgattacgctgccggcggtcggcgccgcgggtgccggttgcgtcagcgttgagccggtgtgttgcttctccgccccgatgttcaagcgttggtgcagttcgccagccgcatcctccgccgcttcgattgcggctcgttctttggccgtttcctcgtcacccgactcggcgccgccctcctcgtccgactcgaccttagcgtgggggg

SEQ ID NO: 46556 - DNA, 3081 bp, Heterodera glycines
  Genomic contig location: Contig_ID=SeqID_8157; Location=1..3081; Strand=-
  SCN-specific regions: Sequence locations=1-632,657-1263,1285 -1483,1505-1558,1599-1710,1732-2109,2131-2784,2806-3081
  Gene Ontology: Mol. function=pre-mRNA splicing factor activity; Cellular component=nucleus; Biological process=embryogenesis and morphogenesis
gctgaactacgcgtgtccaatcgggaggaggacgcgcagaacatcgaaccgtcaatgagtggcaaacaaatagtcgggttgatcattccaccgcccgacattcgaagttcgacttttttcattttagtgaatttgccattttcgccttcgcaattgctccatattattgtaactaacgcctttttcttctctttgcagcaattgtggacaaaacggcgcttttcgtggctcgcaacggattggaatttgagatgaaaatcaaagagcgcgaggcttccaacatgcgtttcaactttctcaaccctaccgacccatactttgcctactatcgcaacaaggtttttaagcaaatgtcaatttatatgggtactttctcattttcaggtcaatgaatttgagacgggcgttgcatcggcggacactcagtccaaagtgaagttgccggaggctgtccgtgagcatgtgcagcgggccgaatttattccgcggctgccgcccaaaccgttcgaattctgtgccgatcctttgacgctaaacgcattcgatttgtaagtggcgcattgaactttttacccaagttctctttttttttttgtcttactgtgtgtttaattttccatcgttttgaatcaaaacccctcctttttcagggatctcatccatttgaccgctttgtttgtggcgcggaacggccgtcaatttctcactcagctgatgaaccgtgaggtgcgaaacttccagtttgatttcttaaagcctcaacactccaacttccaatacttcaccaagctggtcgagcagtatacgaaggtttatttatggcaattcaaaaagaatctacattgacttgactgctaagattaataattattgcccgtttaaaatccttatttacaggtgctgatcccgccaaaaacgattgtggatgatttacgtgcttcggtcactcaacacaaaatcttggaggacgtgcgttaccgcgtcggttgggaccgccaccaaaaagcgctgaaggaccgcgaggaccaagcggtggagaaggagcgcattgcgtacaatcaaatcgactggcacgaatttgtcgttgtccaaacggtggactttcagcccagcgaaacacgtgagccttacatttttcgggttgaatttcgattaaattaggtccactcttaagttaaatcaatgattttgcaagatttggtgtagccattatcatctcattttaccctgattcattgcaaagaaatctttaggggtttcttatttcaaatgttgttttcaaactatttgtcagttatttttatggttcggttttttatttttttagtaaatttgccgcccctgtgcacgccaaaggatgtcggggcacgaattctgttgcaacaacgtacggaagcggccaaagcggcggctgagagtgtggcgatggatgtaatgggaacaatgatctagtttttttttaaagatattccggcataggtcatggggtgggaagggggtaaatttcgcacggggattcgaggcaatcgcaaactgtttgtagaaaacaattgaagccttaaaaatatgtttattgtaaaaatccccaccccccacgctaaggtcgagtcggacgaggagggcggcgccgagtcgggtgacgaggaaacggccaaagaacgagccgcaatcgaagcggcggaggatgcggctggcgaactgcaccaacgcttgaacatcggggcggagaagcaacacaccggctcaacgctgacgcaaccggcacccgcggcgccgaccgccggcagcgtaatcatccgcgactacgaccctaaaaaatgtgggtattttacaatatttaatgcttgacttctggtaattttacgaggacttgtcaactcaataactttaactgttaatatttttgatttccgatgagtttaattctttgttttatttgttttcagcgcgtggtggtccggtgtccaaaactgcggctgcctccacggagaagtacataatttcgccgctgacaaacgaacgcattcctgcagacaaactgcacgagcatgtgcgttacaacaccgttgacccacagttcaaagagcaacgagaccggtgcgttttggcaaaagggggtttaagttaaaaggtacttcgcctgaaaaaatggggttaaaagctggagttctttaagaccttttttatttagtgaacaaatggatcgccaggacgaagacttagtgatggcgcccggggcagaaattagtcgaaatattgccaaattggccgaacgtcgaacagacattttcggtattggtgaaaagggagccgaacaaacaatcatcggcaaaaagttgggggaggaggaacggcaaatgccgcgttcggacccgaagaccatttgggacggacaattgtcgacgattgatgctaccactcgcgcagcgcaacagagtgtttcgttagagcagcaaatcagcgaaatccaggttagaggacggaattaaacgaaatataaataggcaaaatggagggggtggaaagatttacacttgaatttcagcgacagcatgggtatttgccgaacccagccgcagaacgaatggtgccgtcgatgccgcccccgacttcgacaccctcacaacaattcggcggtggacaaccgccgacttcacattcaatggctccacctgtaaatagttgtattaatttttcttctcgataatatacaatatcaagatagattttttaaaacgttgcttcgttgataacatggtttttttgttgccaaaattttgtgtttccagcagcgccctccgcctcatcagtccaccggtggcattgcgtccaatgtgcagaaaattgtgccggttccccaacagccgccgcaaatgtctattccaccacagcaccagcaacaacaacaaatgcgtcctccgcagcaaatgccaccgcaatttatgcagccgccgggcggtcgtccgcatatgccacctccgcctcatatgggcatgccaccgcacggcgttatgggcgcaatgccaccgcacatgcaaccgggtaaacaaacacatatatggggatcatacatgaacaagg

SEQ ID NO: 46557 - DNA, 1815 bp, Heterodera glycines
  Genomic contig location: Contig_ID=SeqID_1069; Location=1173..2987; Strand=+
  SCN-specific regions: Sequence locations=1-305,327-1056,1078 -1483,1505-1582,1604-1815
  Gene Ontology: Mol. function=pre-mRNA splicing factor activity; Cellular component=spliceosome complex; Biological process =locomotory behavior
atggatttgttaaaatcttacgacggctcttcatcatcggacaatgaacaagaattggcagatataccttcttcgtccaatcacaacaaattgctcgctttgaaaatcccatccatcaacttaacacccaacgtgattgaacaacgcgccattcaacaggttgcggttgtggatccaaaaaccaaagagttgtatcacaatccgcgcttcgacgaattgtttagaccagaggtagtgccttatgtcttattgtgtagggttagttatatcttttaatatttgtgatccaccggatttcgaacccttaaatgttttccttttgtgatagtgtaataaataaatttttccctcttcagagcggcccacaaaatccgtttaaaagtgaacatcaacgagcagaaaagaacacactgaccggctatgtggagccagcgcatttcaacgccttccattttgagcgttcacttcgctcctacgatacgcttggctatgcggataatccaacggcagacacaaccagcgcaaagttcgttggtgacgttggacaagcgcaagaaaaggccggcgagtcgctttttgaatcagtaaaaactggcggacagaagcgaaagagagtgataaattacgacgcatcaaacgttgacggatatacgggtaaaaacgataggaaatactaattgtaagataataacttcatttgtaaaggaccgtgggcaaggtttgaggacgagaagacaattgctcgaccggacccagaattgcagaaggaaatggacgaaattgtgcggaaacggaaactgaaaagtcgtgctggccgaagagcggccatcgcggaattgcatttggcagaagagagcaccaaattgcacagtgaacatttatcttttttcaattccataataaaacaattagactttggtttcatattgcactttatcacaccaaatttaattgcagtaaaagatgacactgactatttgggccgttcctttatggaaccgccgaaatacacgggcaccaatctgcgcgaggactttgtgcccgaccgctgtttcccgcccacaaaacaagcacacacctacagcagtcacaccaaaccggtgaccgccatccgatggtttcctcgtagtgcgcacatgtttatctcttgttccatggacggaaaagtaagacggatacaccggaattgggaaaataaacgtacggcttcaggtcaaattgtgggaagtgtacggcaaccgtaagttgatccgcacatacactggacacaaagtgcccgtgaaggacatttattttaacaacaccggcactgaatttctaagtgccgcttatgacaattacatcaaattgtgggacactgaaaccggtgaattcttcaatttaatgttcaaatatttattttgtcatctaaaggtcaggtgaaaaaccgctacacaattggaggccatcgggcgtatgtggtcaaattcaacccggacgatgataaacaaaacattttcatggccggaatgtccaacaaaaagatcatccaatgggacacgcgaactggcgaaatcgaacaagtggaaaaataattcaatttttgaactaattaatgtaattttttaaggaatacgaccgtcatttgggtccagtgaactcgatcacctttttcgacaaaaaccgtcgtttcgtttctacttcggacgataaatctcttcgcatttgggaatttggcattcccgtggatacaaaactgattcaacatgctggactacattccattccttcaatgactagggcaccaaatggtgttagaagaatatgcaattttaa

SEQ ID NO: 46558 - DNA, 491 bp, Heterodera glycines
  Genomic contig location: Contig_ID=SeqID_1069; Location=376..866; Strand=-
  SCN-specific regions: Sequence locations=1-91,113-464,489-491
  Gene Ontology: Biological process=gametogenesis
gaaattcttgttctttgatcgtgtccaaatgtatgaacagtaccagcagcagttaccgcattggacctcaatggtggaaaaagccgtaagtgttttaaattattattttggattggtcttaatgtcttatttagtatttatcaaagtcccgtggtcaatccattggagcgtgggccggatttcagttttgtggatggtcgtaggcttcctttcaccactgagtcggaatttaatcggagagtgaagcaagtggaattgggtgtatgttttactaatttactttttgggttagttagacaaaatgggttttttagaggaaagttgtgcaatatttggcagaaatacgccacgcggaggagctttacaaagaaaacaacttacaaagggaaattgtgcaacagaaaattgagcagaacatgccgaaacagaaggggacagaagaattattctgagttgccattagttcattttttaatagaaaatttattttt

SEQ ID NO: 46559 - DNA, 1027 bp, Heterodera glycines
  misc_feature (901)..(901): n is a, c, g, or t
  Genomic contig location: Contig_ID=SeqID_38346; Location=119..1145; Strand=-
  SCN-specific regions: Sequence locations=1-306,345-868,890-895,929 -1027
attgctttcagctggtggtcggccgaatccgcagttgtcccgattggtcgggtggggaggacgaggacgtgctcagtttgggccttttcccgggcacttacctcgaattctccatggacgacaggtggatttttaatcatattaaatagattaggtaattaattacaatttcctttttctttcgcagggttttcttccaatttgaggccgcttgggactcttcgctgcacaattcgccgcttctcaaccgcgtctcgggctacggcgaaaacgtttacatgacaatttcggtaccgaattcaattcaatttaataattcaattaatttattcattttattaattgtttaggcgtatatggaaattgaaaattgtgcgcagtcggcaattatcaccaaagatttgggtctgattgtgtacgcacgggactcgaagatcagtgcggccagcagattttgccggtcactgatcggcggaatctcaaaaagcgcgggtaaatgggcgacaaaaatggcaacaattggcctaccaagcatttgaaatttttgggttttttgacgtgccgtcatcgccccctttttttgtcggactttccaatgccaaaaatgcctatttttaacattttgccttcttctgcttgcaatgcaccgcttttcgatgccttcagaaatgaaccgtgtgcccggtgtttaccttctcaccgtaatggaggacagtgaggcgaacaacagtcccggcacggcacggagaaagcggcgaattttggacacatcgtcaacatgtgggaagacagctaacaaaaaagagccatcggttcattctttcattttccacagatgtgcgaggcgaagagaatcttggcacttggaggttggcggaggaaaagcgaaaatgccaattanaaataataattaaattaaaattatttaggccccgaggggactcaatcattttggagcaccaattggagttggagaagctgagcaaacttcagcaagtggagcgaatgcgactgttccttatggtca

SEQ ID NO: 46560 - DNA, 720 bp, Heterodera glycines
  Genomic contig location: Contig_ID=SeqID_38394; Location=7..726; Strand=-
  SCN-specific regions: Sequence locations=1-55,88-110,138-489,517 -604,626-720
  Gene Ontology: Mol. function=hydrogen-transporting two-sector ATPase activity; Cellular component=integral to membrane; Biological process=proton transport
atggctgtcgctaggcctgacctcgtgatgaaggcgatcattcccggtaagacagaaaattaaaaaaaatttttttttaaattttatgggttttttcaaaatggcatttctttaattttttaaaatttttttttaatgagatgcctgcagcgaaggatggaaatttcatttgacatttttcaaagaaattcaaaaaaaaacatattgaaaattgttttgaacaaaaggggagaccttatcggctgtaaaaaaaattgtttttttgtcatattcttgaaaagtcttcccgggggctttcggtgtcgctgataacgaatctgacacaacccgataaactgactaaatttttgaaaattacaatttgtcaaaaaaaaattttctgtttttttttggccggcggttgggaaatcaattttttttagcgtttttccattctcccttccccccttatacaaaaatccaaattcagtggtcatggccggcattgtggccatctacgggctggtggtggcggtgataatttccggccggctggaggcggccgggcccggctacaccatcgaccgcgggttcagccagttcgctgcaggcctcgtgtgcggtctgtgtgggttgggcgccggctatgccatcggcgtggtgggcgacgcgggcgtgcgcgacctgtcgcagcagccgcgcctgtttgtcggcatgaatctgatgctgatcttctctgag

SEQ ID NO: 46561 - DNA, 1004 bp, Heterodera glycines
  Genomic contig location: Contig_ID=SeqID_8178; Location=1..1004; Strand=-
  SCN-specific regions: Sequence locations=1-10,32-92,114-153,175 -273,311-618,669-924,946-1004
tgtaaccagcactgtctgtagagtttttgaacgaattttgagtagtaaaattttagaatttctgaacagtacaagattctttgataaagaacaatttggattcttaaaaaatagatcgactacaactcaaatattaaaaacgatggacgatatatataattctatacaatagaatcaacaaattgacataatctatattgattttgtcaaggcgtttgattctgttccaattgatttattacttcaaaaaatcaaaaagattggaattgaaggaaaaatttataattttttaactaactttttaaaaaatcggagttttaaggttaaaatcggcgatgaattgtcagaaagtttcaaaatattttcgggagtgccccagggaagtgtcttagggccattactctttttaatttttataaatgatctgccgtcctttatttcaaataaagcatcatcagttggcataaaaatgtatgccgacgatgttaaattatattatgcccatgaaaacgatgaccattcaaatcagttggataaagcgattgaggctttggaaaaatggtcaaaaataaatgggttagaaatttcaactgaaaaatgttttgttctttatttagggaaaaataacaagaaaaaagaatattttattaactcaaaaaagatttcagaatcggaaagtgtacgtgacttgggaattataattgactcgaaacttaatttttcagaacatattagcaaaattatacgaaacgcatatcttagaattttccaaattttgagagtgttgaaaagcagggaaataaaaactctaacagcagcctataaaacttttgtacgacctcaagtagaatatgccaccaaagtttggaaccctaatttaaaaaaagatatagataaaattgagcgtgttcaaaaatttttcacaagaaaagcacttagaaaatgtgggtttgtgtacaagggggtgtggggaaagactaaaaatcacgggtttacataaatta

SEQ ID NO: 46562 - DNA, 787 bp, Heterodera glycines
  Genomic contig location: Contig_ID=SeqID_38419; Location=147..933; Strand=-
  SCN-specific regions: Sequence locations=1-787
  Gene Ontology: Biological process=embryogenesis and morphogenesis
atggacattgccactgactttgacgggttggggccaatagcgacggggaatggcaaatcgacggtcagcgaaagtgacgaaggtgagctgattggtaacaaagtgtcacaaaacaattcaaaaaaagcagaagaggacgaaggggaagaggaatcgaccacttatacgaacattttgggcgaagaaaaggacgtgacgaagggcgtgggagcgatgttgaaattggccggccaaaagggctatttggagtcgggcgagcggaagctggaggaaggcaaactgaagcacctggagagcaaacgcttctccaaagttgagcagggacgatagtaagtgttttaattgatgccagtcatgcttggattacgaatccgttttcttaatttcggaaaaataatattcggcatcagacggggagaggggtctctggccccgtttagaacggattctctcgcgttttctattcgaagaagcgttttattttttggtatgctcctttttggagcaggtcgtttcacccgaacaatttaagagtacttcatgaggaaatttcaaattttgtaattaacggatattttttgaggagctaagaggtggaaaggaaagttaattaggagaaatacgctcgttctttttccctatgctccctttttcaaattcggatattcagcacattttactctttagtgacattgaggacaaaacgatgcgaaagttggaacgtatgggcacaacggggacagggccaactcgtccattccccgagaaagcggagtacgaaccgaag

SEQ ID NO: 46563 - DNA, 1423 bp, Heterodera glycines
  Genomic contig location: Contig_ID=SeqID_8193; Location=20..1442; Strand=-
  SCN-specific regions: Sequence locations=1-226,255-606,646-948,973 -981,1003-1367,1390-1423
  Gene Ontology: Mol. function=microtubule binding; Cellular component =spindle pole; Biological process=meiotic spindle assembly
atggcaaatgatgcaaatatcattgtcgccgcaagtgccaccaaatgcgtgatgtttttcgccaagggattgcgttccaaattcactccttacgtgtcgttggttgtcccggtgatcttcaccaagttcaaggagaagaaacagttgctcagagatgcgctcgtcgagtgcatcgatggcatcgcaacatataccgtaaaaatggataatccaatcgaaatgaatgtttaaaaaataatttgttttttatagagtttcgaccacctatgcaaggccgtgctcgaggctctgtcctccaaacagaatccgagtcagaaatcacagacggatttgttcatttaccgcgttttccgtacccttccggccaacgaaattcccaagggtttgctcaaggatttggtggcaattctgagcaaagtcacattttttcaaactttttagcctaattttcggccttttagcatggctttgatgccgattccgaagtgagggactcatcctttgctgcattgggtgccattatgaaatgcactggagaaaaggccttaggctgtttcatttcgcctgaattggccaaagacacgaacaaaatggccaaggtcgtttaatgtttctttttcaaataattttgttatttgcagattgctgaaaaccgtgagaaggcaatggctgactttccaaatgcaccgaatttattgttttcgccaaaaaagtgtttttcatcgttaaagttttcaaaattctattcaggatcggattgagctccttgccaatgcgaatccctcttcacgactctttgctgactcggcaaaaaagcgagatgagcccaagtctcggcataacctaacattcaactcaactccggatgatccaattgcaacaaaaaaggatgctgatcaaacatcggtaaataaactttgtacgcgtcatttatgattttgtctacaatttaaaaaattgtttttgaaatttatattagttttgttaattctgttctcattatctccaaaatctccggaaatttatatatttttttagaatggccgaagtattggctaaaataagaatattttttgtccaaaaaagcattgtaaatttggtgttttttgccacaagtataatagttatgcaatttgttatcagattcggtcattcggtttcctcctcccccaaaacctccgggatttatttttaatggccggggcattttgattaaataatagtaattttcccataatttcagaattgggccggtgcccatgacactgcttttctgtctggcactttgtcctccaatcagcgaattgagtgcggcactcaacaaatcggttatgaaaaaggtgttcgtactgctctgtccttttctcgtggtaaagcaatgcctccgtcaccgatgcttttctgtgccaggaaaattcgttga

SEQ ID NO: 46564 - DNA, 1491 bp, Heterodera glycines
  misc_feature (5)..(6): n is a, c, g, or t
  misc_feature (39)..(39): n is a, c, g, or t
  Genomic contig location: Contig_ID=SeqID_8202; Location=369..1859; Strand=-
  SCN-specific regions: Sequence locations=1-1048,1071-1259,1282-1491
tctanngagtctgaactgggcttactgaggacatcaaanagggcccggctcatcttttgagctccccccgtactctctcccaacccatccaacaactcattgcgcttggccgcaccgtttacgcggttgaactttatttgcggtgccgaagtgtcgcgctgagggcggctgctcgagagttgaccatcagtgaggagccgttgtcgtacgttcgccaagtgtccggcctttttgtcaacgacattttggaggcattctccgccaccgtcgctttttattttgccgcttctcctcttatttaggtttgccaggagctttctccgcaccgcgaccaactttgccaagtgctgacttggagttcgcgtgagttgagtgtcctcctctcgctcatccgtcgccatgtcatcgaagttgctcccacaatggccgttctcacgtattacccccgcgaccctttgcgacaaatgccatcatttgtcacttcattaggcacacttggcgtattttgatgagcaaatgtgcccaactcgtcccgatcggcctggacttgagcttcgaagtcaatagattggcggcgccctcactcaaaaatgccttggaagctaatttcggcaatattctcgactcaattcgactcagaaattcggtcggagagacatcgaaattaattcacattttgttgtcaaataatgcaggaagaacgttggacgcccttttcactcggaactgatcaaaatctgataagattcctcgaagaaatgtccgacataggtctgcaaattgagtgggtgcgttccaattgttcttttgctattaattaatcacctctgcttattggtagcaccatgtctatttgtcccttatttgctcattggtcctccctttgagccattttccacctttaggccatttgtcgtccctcttccccctcctcgtctgcttcccccctctctcccggtgcctaccgatgcgcgttgaatttggcccaaagtggctgtctttttgcccgcaccgccctccaactcagtgcgtttcgcttcttcttggcactttaaaatgctcactttggacaggccgtgacctcgcccttctgaacacttctccccacctccaccaattgtccgattcgctgatgcattcaatttggacggaacaattggcacatctcactgccggcatgcacaaatcggtggtgcaccactgcacaagtcgattcatcgtttcccaggcactcttttcttttgtgccattctttgctctttcctcactttggccttttctaattatttcttcaccattcgttttgtcttattcttgccgctgcaggtgctgcctttatgcgaaaaagtctacgaactcagcgaaaatggcactggcattttgcaccaactcttaagcacgaaattcccccatttgctgcactttcagcgcaagccaaccaacacttttttgagcagcaaaagtgactcttctgaagaggtggccaatgtg

SEQ ID NO: 46565 - DNA, 658 bp, Heterodera glycines
  Genomic contig location: Contig_ID=SeqID_38505; Location=132..789; Strand=-
  SCN-specific regions: Sequence locations=1-167,189-225,247-658
atgtgctccaaaccgacgaatgttttcctcttcaaacgccttgtcagccccgtccaaatttgctgccgttcaataaaaggcggtggtttggtccatccggtgaccggcaaagagccgccaacgcttgaggaattcgacccgtaaaaacactcaattttaattgctataattgaaagcgatttgttttttcagtttgaaccccggcgagtggcagttgggggtgagttttctcacttaacaattttcgagtgggggaatacaaaaagcactcgtattttacaaaaacaaagcctagcctaaagcttgggccgaagcctctgggccaaacctaagaaatttttacgagttgtcttttaatgagttgccatggcatcatttgacaaaaaaaaaaaaaaaaatttccaccatttcaaaactattctaaacgacaaagccataattagtgaggaataattcatgtttcttgatgtttgagcccttaaaagtctttaacagtgttgtatactgtactgtgtcattaccacaaattttttctaccgtgtttttattttatcattttttctttctacaggcctatggtaaaattttgcctcgtctcccggagggcacgcgttgtggcggtttggtgatgggcaaatacggcctgtacaatccgaag

SEQ ID NO: 46566 - DNA, 1854 bp, Heterodera glycines
  Genomic contig location: Contig_ID=SeqID_1075; Location=1..1854; Strand=-
  SCN-specific regions: Sequence locations=1-712,734-848,870-1126,1148 -1353,1377-1484,1507-1854
  Gene Ontology: Mol. function=endopeptidase Clp activity; Cellular component=mitochondrion; Biological process=misfolded or incompletely synthesized protein catabolism
ttttccaggtcgaccaccgcgccagtgggcattccattcggtgagttcaaaaattggttatatatgtatttacattgtacaacaaataaaacaaattccattttttagtggtggacaatgacgggaaaacaggttgttgtgggaatacaatgctgaaaatgtaaaaatacagaattgagcatttttgattccattactgtgagaatttctatttttttaaccttttctaaatcgaaaattcgccgaaattggacgggattgaattcaatcccaatgagaatttatccgtcaaaattggttctcaaaaagggttcgcttaaactacagacaaaataatatcccgatccattaacaattcgttgtaaatttgattttcgcatatttagaacgcgtctacgacatttattcgcggctgctcaaagatcgcatcgtttgcgtcatgaacccggcaagtcattgtgaaattccattttataaaatgaaaaaaagaagaaattttggcatatttggatgagtgattgaaatttgttcagattgatgacttttttgctgcctctgtgatcgctcagctgctttttctgcaaagcgaaagtggcaaaacggcgattaacatgtgagttggggggggggaacattggacgagcaaagttgccaaggaatttccattttaaggtacatcaattgtccaggtttgtcatgacctggcattggattggatttgtggaattatgaattgtcaatgggacaaatttttacgctgaaaagtgcaattttcaaaagaaagaacaaaaaattttaaattggttcggatgggaaacgacgcggggggtaacgagctgctccgatttttgagtgtggtccgtgggtttggtggccattttcttccttttcaggtggcagtgtgacggctggcctcggcatttacgacacaatgcagcacatttcggcccctgtcgccacttggtgttaggcatttttaatttggagtggtggaattcagaaaaaagggatttatttcaccccaggcattggccaggcgagttcaatgggcagtcttttgttgacggccggtgccaagggaatgcgcacttcgctggtacttttttttagcaatagcacttgctaaagttgtgacacaaaaaggggatacttcaccccccccccccccatagaaatgttttcttttaaaattagcaaaacctataaattttttagaaaaatagacttacaattagccattttagaaactttttttctaacaataagcaaaaaataaatactagtaataagaatgacgaaaaacgaaggaaaattgttctaaaaattcttaaaaatcagcatattcttgaagatctgcgaaatttaccatttaaattttttgctagataaaaaaacgcggaataaattctagggttttccccaaatttcttaggtttcagttaaaagaaatgaaccttcaaaattttattggtctatgacttttggaaatgcacaaaaacttttaaattttgtcccattttgttttcctttaaaccaaatttccttggcacggatttgactcatccgcccattccaactatttttccatgctctaaaatttgcttttgcccttcttttttcagcccaatgctcgcattatggtccatcagccgagcggtggcgcttacggcacggcggcggacattgtgatcagagcggaggagatcaaccgaatgcgaaaacggctcaacgaaatctatgccatgcacacgggccaaacggtggaaactattgaccaggcattggacaggtgggacagatcggacggctcggggaagatttttaacattttattagaaagtttcagaaaattct

SEQ ID NO: 46567 - DNA, 280 bp, Heterodera glycines
  Genomic contig location: Contig_ID=SeqID_38536; Location=502..781; Strand=+
  SCN-specific regions: Sequence locations=1-9,34-87,114-135,181 -208,231-250,274-280
  Gene Ontology: Mol. function=ATP binding; Cellular component=membrane fraction; Biological process=acetyl choline receptor signaling, muscarinic pathway
acttttctggcaatcattttctgtgtggcactctccgagtacgacatggtgttggcggaggatgacgaaatggtagcaaatttttggaaaaattttttttttaatatttttttgtccaaccaagaaacggatgattgaaagcatgaagttgttcgactccatctgtaacaacaaatggtttctgaacacgtccatcattttgtttctgaacaagaaggacctttttgaggagaaaattcgcaggtcagcgccaaaaatggttttaaaaaattatagcccg

SEQ ID NO: 46568 - DNA, 577 bp, Heterodera glycines
  Genomic contig location: Contig_ID=SeqID_38540; Location=468..1044; Strand=+
  SCN-specific regions: Sequence locations=1-395,418-577
tctggccaggctctgaacgacccgtccactcaatacattgagggtcggctggccaaccgacgtgtttggtggtgcccttccggttatggtaaatgtcaattaaaattgaaatataaattcagcaaaattatcgtttatggtcccataaaaaaggcgaaatattactttgggtagttttgcgttgttctcggggttttcgaggtaactcacgaaatctgacacaaattcgaccaattcgaacctatcaattttgtcacttatgcttccaaatatgcataataactacaaagtttggtcaagaaactccacggacacctgctgaccatccattattctaaaataagaaagaacaaattttgtttttttttcctgggtttttcgtaatcagtaattaataattatatatccttaattacccttaaacgattttaacttcaagcgatgccccccccccttttctcaggttacttggcgtactgtccccagcccaccgattgggacaattacaattggtgctgcactttcccttacttcggctcctggaagccctcctgctgcccttttgccattcccacgg

SEQ ID NO: 46569 - DNA, 1612 bp, Heterodera glycines
  Genomic contig location: Contig_ID=SeqID_8213; Location=188..1799; Strand=+
  SCN-specific regions: Sequence locations=49-97,379-498,521-552,574 -679,701-1315,1338-1527,1550-1612
  Gene Ontology: Mol. function=3'-5' exoribonuclease activity; Cellular component=exosome (RNase complex); Biological process=rRNA processing
atggatgttggtgttgaaaatgagtcggtggtactcaaaatcggatttgtaagtgctcattcaccgccacaacttttcatcccttttcttcgattagctcaactttgattccgacaatttgctcgaacggtatttggacgactatgacattgtgcttgttgatgaccaaactatggacgttccattattcattttggaacacatcaaacataaatcagcccattgaatttatcaacaaaacaatagccattttgttgttttcacagtctttggttttgactattagcacggattatttgccaaaatttctgtctatagtgaatgtttcttctgtttatcctttttattgtaaaatataaaatacattttatgtccttttgtctctttgcattttgtgttatttccatttgctaatttactcttaaaaatttttatcaaatttttatcgctcgcttttaatcattttgtgtagtaattatttgtaggcctttgcgatgaaagtcatcaacgagtttggctatcgtcaagatgcccgaacacccagccaaatccgcaacattgtctatcaaatgggagtttactcacacgcggacggctccgcttacattgagcaaggcgagacgaaggtgggcggtcaaagttttttttaagtttgtatgaattttctgtcgattggccattttttaatgttttgctttttccttcattcgctacatttcccctctgctgaaggtcctttgtgcggtttacggtccgcacgaatgtcgcttccgatcacgagccaaagaagacgaggccattgtcatttgccagtacagtcaggcaactttttcggttcctgacagaagaaacaggccgcgtggcgatcgtcgaggcaattccttttcccaccttttggagagggctttcgaatcagtcattttcacacatttatatcctcgaagtcaaattgatatattcttcgaactccttgaggcaataatttgctttttacattttgatgctttattttttaattttaggctgacggtgccaatttggccgcctgtgttaatgtcgccagtttggcactggctgatgccggcattcccctgcggggactgctgtccgccgtcgaatgtggtagtgctgatgggttgccttgtgcggatttgagttctcgtgaacatagtgaattggtaccacgcctcacaatggccaccgttggtgagtaaatcaggagactttataatgagaagttggggggggggggacatggcgaggggagggaaaagaggaaaattaagcgaatgactaattgtaagcactgaaatcatgtcatatgtttaggaggtaaagacgaaattgttcttatggacatgaaaaacctactccacaaaaatcatttgccgtctttgttacaaatgggcgtcaatgcgtgtgcccaagtacacatttgtctggagacagctgtttttagagtaaattataagcacatttgagggttgtttatccattttaattgcagcatgtcgaagcatcgcatcggaaaaacacagaaagtggaaaacaaaattcgcttttgaacagaattgttgaaggtcgctaatcacagatttaatttgttggatta

SEQ ID NO: 46570 - DNA, 1444 bp, Heterodera glycines
  Genomic contig location: Contig_ID=SeqID_8219; Location=183..1626; Strand=+
  SCN-specific regions: Sequence locations=1-211,252-999,1023-1444
  Gene Ontology: Mol. function=proteasome endopeptidase activity; Cellular component=proteasome regulatory particle (sensu Eukarya); Biological process=embryogenesis and morphogenesis
ctgctcaacttgtgcgcgagctgaagaaggtggacgacaaggatttgctggtcgatgtgcaattggaggagagcattgtgcgtttttgtgcccttccgttggttaatccttcgccctgaaatttagacaatcctaaataaaagttccatttccgagtccaccggtgaagcaccacctgagtaaatttttgaaaaaatttcactaattccaatgaatttggtgttaatgtctccaaatttttaatgatttacccaatttcttgtcccaatgccatggggatgactgtgaaatcgctttctttcaaattcatttatttgttggcttttcagggcttttaccatctgtccaactacacaaaggcacgtgccgagttggtcaggtggacaatgcaattcgttttttttttgcatcacaattttcagcgcacggactatcgccaacaccaaatacactccgcccgccatgcaggtactgaactgactgacaaagggcgaacggagtcaaccgcctgtttttttttgctcaaaatcatattcccaatgaacatttaggggtcaaatttttaaaaataatagtggatttatttcttccgttgttgtctattggctacaacttcaaaaaatgccattttctctgcgcttttaaatttttcattctcacagtgcctaaacaggtcaaccgcaatctcttgacacaataatttcaatgagtaatttaattggtaaattttttccaaagattcatttatgttggtcagacgattgaatgttcgagtccgtaaattgcgggacacaaccccccccccccggtcaaaattaatattttggtcccccttttcatttcgctcgttccttgtcctaatgtttgttccacttcattcgtccttccccccccccctccctctcccattttttgttggtcttttaaattacaattccccaaaaggcccgtctcgacctccaatcgggcattttgcacgcggccgacgaccgcgacttcaagacggcctactcctacttcttcgaggcgttccaggcgttcgactcggtcaatgagtcggcgctcgcgcagcaggcgctgaagtacatgttgctgagcaaggcaagcgaaggcggcagcaaagaaatgattcaaaaagaaattcccaaaaagtttaggttttaaattcacaaatcgattttctttaatcgaataaattcgggcgagcggagagcgaattttcaataataatggggaagggtactacttttttttaaactattttgaattgcaggtgatgttggaccagtcggacgaagtgcactccatcatgacgggcaaaacggcacaaaaatatgccaaaacggagacggaggcaatgcacgccatcgcagaggcggccaaaaagcggtcactggccgagttcaacgaagtgtgcaatggggcgggggaaaaggcaatttag

SEQ ID NO: 46571 - DNA, 99 bp, Heterodera glycines
  Genomic contig location: Contig_ID=SeqID_38603; Location=203..301; Strand=-
  SCN-specific regions: Sequence locations=1-99
atggagcattatgatcgtgcaattacgattttttctccggatggcagactttttcaagttgactatgcgcaagaagcagtgaagaagggctcaacagcg

SEQ ID NO: 46572 - DNA, 592 bp, Heterodera glycines
  Genomic contig location: Contig_ID=SeqID_38620; Location=75..666; Strand=+
  SCN-specific regions: Sequence locations=1-406,445-592
atgtcggacgaaagtgaaatttcgtcgctgaacgaagcggacgttaccgatttgagggaacgttacgaaaatgtgtgtttcgtgtggtacgttttaaaatttcatccacactattacagacacaaagacaagaagtacccaaagaagtgatggtacagcgcgaaatgcaaatccgcgagttggagtcaatccttcggttggaggaggccaagctgatgatgttgaagaagttgcagcagagtcagcagaaggctgcgcagaaaacggtgagttaaagccgaacaacgaaaaaattcggcggagtcgggggcatggactaattgcaacaattgtttcaccgacttccgccgcttaatgcgctttttatgaccgagtcattttcattaattaagaaacatttacatttagcagcaacaacagaatcagcagcaacaacaacaacaggaaaatgtgcgaaggttagccccaggcgttgtgcagaattcaacgggacaagcgtataagccgaaagtggccgtggtaaacccatcgcaacatcagacgggaaacaccagcaaaacgaacggcacgacgccgcagcacgggaagaagg

SEQ ID NO: 46573 - DNA, 691 bp, Heterodera glycines
  Genomic contig location: Contig_ID=SeqID_8235; Location=5288..5978; Strand=+
  SCN-specific regions: Sequence locations=1-184,207-535,558-590,612-691
  Gene Ontology: Mol. function=FK506 binding; Cellular component =membrane fraction; Biological process=protein folding
tctgcgagaccaaaggtttttttcgatgttatggttggcggaaaatcgacaggttataaactcggacaacaaatcgccctcattctctgttcaaaataggtttaggtcgaattgtgatggaattgtttagtgacatcgttccgaagactgccgaaaattttagggctctgtgtactggcgagaaagggatgggcaaaagtggtaattaaaaagtcttgaccgtgaccgttatggattttactttaggcaaaccgttgcactacaaagggtcgaagttccaccgcgtcattccgagtttcatgcttcaggtataaagttgtggcacttccgcgaaaaggaatccattaacggactccgttttcacattttagggtggcgattttactcgaggcaatgggaccggcggcgagtcgatctatggcaattgtttccccgacgagaatttcaaagagaagcataccgtcccgggactattggtaacgtttctggcaatttaaggaatggaacactcgtagcccatgggccaaaaaagcgtcatttttcaacttatttttaaattcagtcgatggccaatgtcggacccaacactcacggctcgcagtttttcatcagcacagtgaaaacagaggatgtacgacaggcgtatttagccattttcgagattcatgattaacacaaattaatctagcga

SEQ ID NO: 46574 - DNA, 989 bp, Heterodera glycines
  misc_feature (23)..(23): n is a, c, g, or t
  Genomic contig location: Contig_ID=SeqID_38658; Location=1..989; Strand=-
  SCN-specific regions: Sequence locations=1-730,753-810,832-989
gcaaatcgccaagtgtccgcccncaacggacgcatcacttgcacgcgttgcccagctgacggacgacgtgttggtcaacttctgcttcaacacggccacgcgccgatttgttcgcggaaaggtgattgagcttaataaacgattgtcatattacattgcaaattcgcttgttaatttcgttttggtggctcagttggttatttgctgtccattcgcttattatggcgttggatcgcttcccgccacgtcccgtgtttttaaaaatttaaccggaaatgatgataaatgcagacctgtacggaaatgcaccatgtcgaattaaacctctaagaagttctgatccggttaatcatttttaaattagccattgtttttttaatgttccctgttcagttgaactatcgtaagccgtcccgtggtcgtccgcccgctgttgcggcccagtatgaattcggttccaaatcgttgaactcctccttctccaacttgtcgatgatgtacggcggtttcgttggtgtgccccattttcgtgtggtggccaaattggttggctatcaggtgtttaaaacataaaaactaagaaaataaataaaatattaacgaaggccaatgaatttaacatttagtttattacaatttccagggcatttctgccattctgttcgatttgttgggcctggcccaacggctattgaacgatcagataaagacgcactttcggtcactgctcggacttatgcccaaaatgtgcaaattgcaacgcttcgaatacggcgttgaaggtgaacaagaaggaaattgggtggcactaaattgttattttttccacttgccataatccgcgcattcatttggcattccggtgcgcttgtcggattcccaaattaaattattacttaaaatttgcgtttcaatcttgaaaatcccgttttgaattaggcaatctccaaagatttcatccaccaattgcgcgacttttccgcctacgg

SEQ ID NO: 46575 - DNA, 2918 bp, Heterodera glycines
  Genomic contig location: Contig_ID=SeqID_8240; Location=1236..4153; Strand=-
  SCN-specific regions: Sequence locations=1-260,290-464,486-606,628 -1920,1952-2131,2156-2583,2606-2918
  Gene Ontology: Mol. function=dolichyl-diphospho-oligosaccharide -protein glycosyltransferase activity; Cellular component=membrane; Biological process=protein modification
cgaaaatatcaaaatatgatgtgtttgcccttttcaacattattttttcctttagagcgaaggggccggtcttatcgctgctgctttaattggtcagttgtttcactaccctttgcactgtttggcctttctcttttcagcaattgtccccggttacatttcgcgttctgtcgccggttcatacgacaacgaagttgtttttttttcgggatttaaacattacggcaagttttgtttgattttctattctatttcagggcattgccatcttttgcatgctgctcacctattatttttggatcaaatccgtcaaatcgggctccattttcaattctgtgctttgtgcgctctcttatttttacatggtgtccaggtccaaaccataaaatgactcacaaacaacaaccaatatttttcattttcttactcagttggggtggctacgtctttctgatcaatctgatccctctccatgtgttggtaattgcttttaattatttgatttttcccttttaaccctttctttttttgactttaatttgcaccgggcgcttctctcatcgaatttacgtcgcttattcgacggtataaaaaattaaaaatgttccaaaatgttttttcaatttgcaaggtttactctttgggcacaattttgtccatgcaaattccgtttgtcggctttcaacccgtctcaacttctgaacacatgggggttggtttgggcattcattcttttccatttccatcaaatttgcttggatttgtaggcctttggtgtgtttggactttgccaaatcgtcgcacttgcccaatggatgcgttccaaaatgactgccgaccgttttcagctgctcctccgctccgttctgctcgtttttggcggtgccgcctttttagcactcattttggcgacgtttcttcacagtgaatttccatgtcttttccatgtgctttcatttgtccattcttccagagattgcgccatggacgggccgtttctattcccttttggacccatcctatgccaagaataacattccgatcattgcttccgtctcggagcatcagcccaccgcgtggagttccttttattttgaccttcaatttttggtcttcacttttcctggtacaatattagtacttattttcccagcagtttccattttaattcccttttcagctggcctttatttttgcttcaaaaaactcacagatcaaaatattttcatcattctctatggattgacttccatttattttgctggggttatggtccgtttgatgctcgttctcgctccaatcatgtgagctttaactgtcatgtcggataatttaatactccacaagtttgtcttttttcaggtgtattctcggcggcatcgctgtctcttcaacacttgggaattacgttgtgaatgtcgatttgttcggcgctgaaaagtcaaaggggaagtcggcaggcactgaaaatgcggcggagaaaggaggaaaagcgggcggaggagggaaaagcggcgggagcggggcggcacggtaccatcggggggatgagaattacccctacaaacaggaggtgaagcggagggaacaaagactcagccgatgcttttttttacattagatttcattggcggttacgctggccatgtcaatttgtctgatcagttttgtgtaccacagcacttgggttgcaaatttgcctgtttctgcaatttttgtcccctttttaggtcacttctgaggcgtacagcagtccttccattgtcctttccgcgcgttcgggcgatggcggacgcataattttcgacgatttccgcgaggcttattactggttacgtaaaaacacgcccgatgtaagacaaccaaatatttcttttaccttaaaagcgccaccgtttatttgctcaggatgcgaaagtgatgtcctggtgggattatggctaccaaatttcggcaatggccaaccgaacggtttagtgatgctcatcagctgtttaattgcttgttgttttcacaatcagacaatcgtggacaacaatacgtggaacaacacacacatttcgcgtgtaggacaagcgatggcatcgaatgaatcgcatgcatacgaaataatgcacgaattggacgtcgactatgtgctggtcatttttggaggagtcaccggctattcatctgacggttagtgagcgtacaagtacatattagagatcgacgcgggaacgattccacgcggaatcccgcaaattagtatttgggatttgtttccctgcttttatatataatcacaaatcccccctttttcgacatcaacaaattcctgtggatggtccgaatcggcggttcgacgccggaggggcgacacattcacgaaaatgattactacacaaagaatggagagtttcgcattgacaaggaggggttagccaatgctaaaacttatgaattaaggcgacctttttaatagttcctctacaatgctcaactgtttaatgtacaaattgtgctatcatcgcttcggcactgtgtacactgaacatgtacgttctttacagccttcaataatacttaattaactgagccgtatattttttataactaaaaagtatgctacgaaaaatgcaatatttatagtttttgttttaatttttaggaatatttggggttttttgatttattgacaacttttagtaaagcattagaatttaagcttagtaaagcattagaatttaagcaactaaaaattggttctcttaattacttaaaagggccgtgccaccggttacgatcgcgtccggcatgcagaaattggcaacaaaaacttcaatttgctccatttggaagaggcgtacaccagcgaacattggatcgtccgcatttaccggtcgcaaaaatgggttaaaaaatgtttaaagggcttt

SEQ ID NO: 46576 - DNA, 1062 bp, Heterodera glycines
  misc_feature (1013)..(1013): n is a, c, g, or t
  Genomic contig location: Contig_ID=SeqID_38708; Location=1..1062; Strand=-
  SCN-specific regions: Sequence locations=1-135,171-218,240-240,262 -460,482-1062
  Gene Ontology: Mol. function=ATP dependent RNA helicase activity; Cellular component=nucleus; Biological process=RNA metabolism
ttcgctttattttagtcccaaaatgccttttagggcaacgaacatttggcggatttgtccgcacttcgatttttggttgttgatgaaattgatcggatgttggagcaaggccattttgagaatttcaagaaaaagaaatttaaaatttatttattttaattgttaaaaatcttctcattttattcattattagcgatctgataattatatgcattttgttttggcattttaaaccaattcaatttgattaatttgtttggtctctcttttgaggtgcgtcggattgccctttcgatgtcaatgcgaaagggcgctgcgaatctttcagtgattgatctgacgccaccgcagaaaacgccacagactcggaccgaatgtcgcatgaattgtgccgatttactccaaaaggcacaaaaacatttatatttcccaatctcattacaaaaagttcattttgcttatattttcaggatttgaatttgatgtatttgcttaagcggcacggcgggcgcactttggtatttgccaattcgatttcggccattcgacgaatgcattcgctgctgaaaaaattggcatttccgaacacggcactgctgcacggacggatgaaggaaaaggaacggttgaagagtgtggacaaattcaaaggcaaacaaacacgggacagagggaaagacgaattaaaaaacaaagagacaaaaccatttcgaaactaacaaatcattcagaaaagggcgtcgtatttcctatatatattttcccttaaatttccatgcctttcagcatcggatgattccgttctcctcgccaccgatgtcgccgcccggggcctggacttttatggagtgcaaaatatcgttcattaccaatgcccgaaaacgacggaagtgagaaagagttggatgtgttgttcttccgggttcatttccttttctgttagagttacatccatcgcagcgggcgaacggcgcgagcgtcgagtgccggactgtccgtgctttttgtcgacnccgttggatttgcatcagtatttgaaaatttgccgaaactgaacaaagg

SEQ ID NO: 46577 - DNA, 810 bp, Heterodera glycines
  misc_feature (669)..(669): n is a, c, g, or t
  Genomic contig location: Contig_ID=SeqID_38713; Location=676..1485; Strand=-
  SCN-specific regions: Sequence locations=1-297,319-614,657-810
atggacaaaggacggagcaaaagcccaaatcataacaatgaggcggaggaaactcaaagcgccaaagaggacaagactgatcataaagttgggttaatttcgcttcattttatttaaatgctttttgaataattgcagacaaatgagcaaatgttgctggtgaggaccggactgaaactgaagcgtggcactctcttcaagaagaagcgaaatgttgacccgaaaacaatagatctgaccataaagaaggaacaagagggcccgcggaagacgaaggccgaattggcatttctcaaacggcaggaggagacggcgttcgaccgtttgtcaaagagggcccaaatcagtcaccgggagaaagtggagaagttcaacaagcaaatggaggaactgacggaattcaacgacatcccaaaggttggttggccgaaaaacccattaatttttaatgaggcatatcaatctttaggtgtcttggaccaaatgagaaggaaggaaaaatactactgtatcatatattacatttgcgatcacaatcagaaaaactaaagcaaatgcattcatttttagtaaacgaagttccattcgttttgtatctttccgtttgttttgcattatatttttattttattctcgtttggtaatcaaaaaagaaatgccagctattcnccgcgcggatcgcctgaaaaccatttattcctcagcgaaggcactgaattttgcttttcgactgtcggccacaaatccaatcgcaccagcattcaatggggtgtccgcctaccaaccgcaactgcaacggattacaataaa

SEQ ID NO: 46578 - DNA, 1148 bp, Heterodera glycines
  misc_feature (310)..(310): n is a, c, g, or t
  Genomic contig location: Contig_ID=SeqID_8257; Location=363..1510; Strand=+
  SCN-specific regions: Sequence locations=1-51,74-444,466-506,529 -586,627-937,959-1148
  Gene Ontology: Cellular component=transcription factor complex; Biological process=regulation of transcription, DNA-dependent
cgatggaaaaccggaagaatttggcgaagacgcaaaactttttgtggaattgcgactgcttcagagagatgttaaagttgtgctggaaacaacggcaaatcaggcactcacagggaactgagaatgaaatcaatttgctggctttagaatttcatcggcactgttctgcacccgcggggaaacatcgccgagtttttgcttaaagaggggttggccaagtgcgtcgactggtcaatggccgttgaaggggcggcgccgaaaaactgagagaagccgaacggtcggtgaaattgcttagggattatattcnatacctaaaaagccattataaactttttaagcatcgcaaaagaaaagcgactccgattatggaagtcgttcaccgggtcctcctcaaccgtaaaaaatgcatttactgccaaaggttgtgcaaattcatttctacacattttaaagccgttaaaaccatcagagtctctctcattttcagtggttgaaattggtctggtcgattctctttctgtgcttaaagacaatggagaggagatgaaagtgtacttctcatctttgcgtgcaccgaggtaacaaattatttcaattatttctcaaagttaattcattttaaagacgcgaaggcaccgatggaacttctggcggcgttcagcgccaattcaggcctctctatgacattccgtttatgtttgaagcccgcgagtttcttcgtcgtcgtcttatcggcaaatcggtccaagtgattttcgactacgtacagccaaagcaggaccaattcccggagaaaacgtgctgtacagtgatgttcaacaaccaaaacgtggccgtcatgctcattgagcgaggctttgcacgagcagtgcgtcacggccgtgacgacgacaatcgatcgccacaatacgacgcattgttcgctgcggaggcacaggcagagaaagacaaaaaaggtcagtgtatggatgggccgaagggaaaagcgattattcccaacccaacctctaacaaatggcaaaaacctcaacaaaaatgaatcgagaaaaagccgatcaagatttgtttccctcaatgcttaggttttacttccagccaattagtaaggaccgttttaggaatttgggctgaaaagtgcacagaaa

SEQ ID NO: 46579 - DNA, 1448 bp, Heterodera glycines
  Genomic contig location: Contig_ID=SeqID_8259; Location=177..1624; Strand=+
  SCN-specific regions: Sequence locations=1-95,120-164,186-746,770 -892,925-948,970-1126,1148-1199,1223-1250,1273-1325,1352-1413,1441 -1448
  Gene Ontology: Mol. function=dihydrolipoamide dehydrogenase activity; Cellular component=mitochondrion; Biological process=growth
atggaagtgaacacaaaaaacattctgatcgcatccggctctgaagtcacaccatttcctggcattgacattgacgaggaacaggttcattgatgaattttttttaatatttttattttccacctcaaattgattttgaggtcccaaatttccgggtgcgctaataaattttacaaaaaatgttttcagattgtctcctcaaccggagcattggcgttgaaaaaagtgccacaaaaaatggttgtgatcggcgccggtgtcattgggcttgaactggtaaatggcaacattattttcaaatttggcccctcaaaaagatattaaaaaaagttttcttcgttttagggcagtgtttggcaaaggttgggcgccgaagtgaccgccgtcgagtttatgagtgccatcggtggcgtgggcattgacggcgaagtgtccaaacaattccaacgttcattgaccaagcaggtaaatgcctttttaacggaatttcatccaaagcatattggaattttttggtacatttttgcttgaaaatttaaaaaaatggacaaacatgagatttttaactaattttttacactttgtttagggcatcaaatttttgatgaacaccaaagtgttgggtgcgcagcgaacgtccgatggacaggtcaaagtgcaggtggagacggtgaaggacggcaaaaagcaggaggttgggtggggttttttaatgacattttagggccaatttttctattctctactcttggctaaatgtgtattttttgaccaatacatccggatgtactacttcattctccctctcccaccagaatttttttaaaaaaatattctaacagaattattcaagaaaaaagttcttttaaaaaaattttctgcacttttttggaaaaattaattatttacataaaatttaaaaatcgtaaaattttcctcaatttttttccttgaaattttcctttgaaaaatgggtgaaacgacttgctcagattaaatccattgtctctatacgccattctaacattgcccagttgaactgtgacgtgctgctggtgtccattggacggcgaccgtacaccgatgggcttgggctgaacaatgtgcagctgaacacggacgagaagggccgtgtgccggtcaatgaacgcttccaaaccgcggtgccgtctatctatgccatcggcgatgtgatccaaggcccaatgttggcccacaaggcggaggtgagagaggggggggatgactctttttaaatataaaaaattcactcaattttaaaggacgaaggcattttggcggtggagggcattgcgggtgggccggtgcacattgactacaactgtgtgccgtccgttgtgtacacgcatcccgaggtggcatgggtgggccgagcggaggagcagatcaaacaggaggtgaacaaaatgatgggttggagtcggggg

SEQ ID NO: 46580 - DNA, 874 bp, Heterodera glycines
  Genomic contig location: Contig_ID=SeqID_8268; Location=575..1448; Strand=+
  SCN-specific regions: Sequence locations=1-225,247-336,358-583,605-874
atggaagcgctgaaggaaaagagtgagaagctgtacaacaaagcggtaatttaaagttggatggacaagtggggggggggaggatttctctgattttgaaattcgcttgggaatgaaaatggcgggggggggtgacggaatgatcttcccaacaaaataattggaaaaaggaaacagggaccgatcattggtgatcagtggcccagaaaaggaaggggtggcggattttaaaataaaatggttgttctacccgcacaatttaaggtcgaactgcgcacccttgtcaaggtcagccacaccaacaactcagcttttgactagcgaaaggacaaaaataaattccccaaaacttacagggaaaaattgaccaattggtgcccgacgcgaaggcattcgttatcggggtaagcaatgggcagcggaactgatcagacagaagccgctatttggtcacagaatcggaaacatttaacgctttgctttcagatgatcgaaaaggcaaagggaatgcgcccgaaggccggcgagaagccgaagcttgaggagctgcgcacggcggccaacgagctgatcgagaagtgagtggggaagggaaggacggaaatgacaattagcggtgcctttgaccggtggacaaaatgccgcttttccctcccaggtacaaagcattgaatgacgaagccaaagagtcgctgaagtccaacttccccaagattacgagcgtcatccaaagtcagttgtgtcaattaaattttcaaagtgcatgggctaatcacttttaattactttcccatataactttccctacgtttcagacgagaaattccaaaccttggccaagagtttgctgaaacaggaggcaccggccgcctaa

SEQ ID NO: 46581 - DNA, 961 bp, Heterodera glycines; identical to SEQ ID NO: 38794
  Genomic contig location: Contig_ID=SeqID_38794; Location=1..961; Strand=+
  SCN-specific regions: Sequence locations=1-125,147-197,229-961

SEQ ID NO: 46582 - DNA, 517 bp, Heterodera glycines
  Genomic contig location: Contig_ID=SeqID_8283; Location=28..544; Strand=-
  SCN-specific regions: Sequence locations=1-108,130-261,283-517
atgtcattttgccaggttctgtataaaactctgacctccggctccgtgctgccctcctccgcctctgccaatgcttctgcttctgccgaccccctcaacgccacttcggccctcggccttccctttcctccgtccgtctctttgccgcctgttttggccgctttgttccccgacctgaacacttccaccccaatcactctgaccgccgctcaacaggaggcgatcggggagaatttggagatgatccaaaatttgattgtgcagccgtccagtccgttgtgcagcccaaagcccgtggcggtggccgagttcaatttggacgcatttatgggacaatggtaccaggtcagtagtcagcatggcatgtgccatgaagaagggatttgaatgttgcttatgtttgtttcaggtgatgtacagtcctccgctcgtccaaagtgcgtgcagtgtcgtgtcctatcgcaaattggccgacattaacagcggcggaattggctccatttttgaagtgtttgag

SEQ ID NO: 46583 - DNA, 1265 bp, Heterodera glycines
  Genomic contig location: Contig_ID=SeqID_38950; Location=1..1265; Strand=-
  SCN-specific regions: Sequence locations=1-339,361-1265
  Gene Ontology: Mol. function=transcription regulator activity; Cellular component=late endosome; Biological process=establishment and/or maintenance of cell polarity (sensu Saccharomyces)
acgaggttactacaacagagactcgttgcatggttttttgattatcattttctctttagtgctttaatttaggcagcctattctgaccgctaaaacggtcattccgttggttttcagtataagcattttgttcatcccaattggaattgttcttcttcgcataagtcaatctggtgagacggtactgtgcaattttatgtgcttcttttaagtccaggaatatgtcgttcaatatgtaaacgatgccaacgagtgcaaagactaccatgcgaatggccaatgcgcagtgaacttcactctgaatgaggacttcaaagtcgttttatgattttaattactacagaatttgaatttcagggcgatgtttacttttattatgctctcgagaatttcttccaaaatcatcgtcgttatatgaaaagcagaaatgatcagcaattatcgggcattgattttttagtaatacataatacggtttctctcataatagcctaaattgttctacagaataccaaagattgtactcctttcgagaaagctccggacggtcgtccgatcgccccttgtggcgcaatagcaaattcgttattcaatggttcagttttcattatttatttgatgctaaacaatttaacgcagattcattccaactcaattatcttgggcgtaatggcaatggttatgcaaatatttcatggagtcacgaagggctcgtctggccggtcgatttggagtcgaagttcagaaaccccacttgtgatggccagccatgcaaaacaatcgctgaattgtgtcacaaattttccgtataactttctatttttaactggttattttccgccgaatctttctagacaccaaataaattcaggacgggaatattacatgtttataatcctatcttaaaaagcatacaaaaattgttagaaaacaaatcaattgaactgattgtttgtcaaaccgtttgtagaatttgttctaaaagttcacttttgcgacagttaaccgtccgaccgcccaactggcaaaaggacctctgccttttggacatcacaaatgtgacaaacagcgggtttcaaaatgccgattttgtcatttggatgcgtaccgctgcactgcctgattttcggaagccctgccgaaaattgaccaggactcaaatgttcgctgatggtttgccatccggcacataccaactgttagttcacaacaattacaatgtgaacacatttggaggcaaaaagtcgtttgtcatcagcacgacg

SEQ ID NO: 46584 - DNA, 444 bp, Heterodera glycines
  Genomic contig location: Contig_ID=SeqID_8312; Location=7..450; Strand=-
  SCN-specific regions: Sequence locations=1-85,108-444
  Gene Ontology: Mol. function=actin binding; Cellular component=actin cytoskeleton; Biological process=hearing
atgacatcttcggacgaagaatttaaaaaaggtaatggtaaaataaacgaacaacaatcagtgaatttattcaatttatatacgtgttcctttcagaatgcacttttgcctcacttccgcgcactgtgcgtggaatgcctttggttgtttcgtcgaattcggatggaaccaaattcctttactgcaatggaaatagcgtgttcatcagagacgaggaagtatgtgattcggattggttggcggttcattttcaatgttttaaattccattttccagaatattgccgattgtgatgtgtatacggagcacgcgactttgacaaccgtggcaaaatattccccctctgagttttacattgccagtggagaccaatcgggcaaaatccgtttttgggaaccacacaatcagtccgtttcggttgacattaatttgcatttggcgtaa

SEQ ID NO: 46585 - DNA, 1858 bp, Heterodera glycines
  Genomic contig location: Contig_ID=SeqID_8342; Location=36..1893; Strand=+
  SCN-specific regions: Sequence locations=1-271,293-579,601-760,782 -1311,1355-1492,1515-1858
  Gene Ontology: Mol. function=calcium-transporting ATPase activity; Cellular component=integral to membrane; Biological process=transport
atgagtcccgattccgggcatcgagactctgccggagtgtcgggtgccggtgccttcgatatgacgatagaaggactgcggacattgatggaatttcgtggaggcgaagcattggagaaaataagcaccgactacggaaacactttgggcctttgcgaaagactcgcgacagacccaaacaacggaatagcgaatacgcaggacgaactgaagaggttgcctttgctgaccatagtccgacaaactcttctttctttgacttttccgattattcggccctttgttggcttttaagccccaaagtgccgctgaaaatcctcgtttgattgcccaatcttttaaattttaaggcctctgtgtgaattgacctttgaaattggaatttcaggcggagggatgccttcggtgccaatgaaatccctcccctcccgccaaagtctttctttacgctcgtctgggaggctctccaggtctgtccgatggcatttcttaatgagtctttttgtcggtcaatttaggacgtcactctgatcattttacttattgccgcagtcgtttcacttgccctttcattttataaccccggatcggaactcggaggttcgcttttccatcatttacaagcgtcgtctttcctcaggtggaaaagacgaaactgagcaggaagcgggttggatcgaaggtgcggccattttgatttcggttgttgttgtcgtactcgtcacggctttgaatgattacacaaaagagagacaattcagaggttggccatccccgggaaaggcggacaaaaaatgaatttaatttgaatttgaatttaaggattgcaagcgaagatcgaaacggaacacaaattcgcagtgatccgcggaggaaagcagctgcaagtggtggtcaacgagttggtggtcggagacattgcgcaagtgaaatacggtaatgatttgccggaaaaagcggacgatggcactttgacaagccgaccattggcacttttactcattgacactttcccttgcttcttcaggtgatttgctgcccaccgatggagtgctaatccaaagcaacgatttgaaaatcgacgagtcgtcgctgaccggcgaatcggaccaaatcaaaaagtcggccgagcatgacccaatgcttctctcgggaactcgtggtcagttgtgcccattttgttgttcgcactttccttttagtgatggaaggcagcggtcggatggtaattactgcggtgggagtcaattcgcagatgggaattatcatgaaacttctcggcgcggcaaagtcggcgatggaagacgagcggaaggagaagctgagggaggagaagcggacgaggcgcaggagcaaagcatcaggtcagtgggagcattggccaattgaggagaatggtattcgggtggggcaccgtaaccgattacggtgggactttggcattatttccaccatttccttctttcgtgccgagtcttttcataaattggacaattgggcattcttcaacaaataatttatcataatttatgctcgaaagcaaaaaaattatcatcgatagtaaaagtgttatccattagtctgcaaaaaaaggttaatagaggagaaccaatgggtaggctatcaagctactatcatttgttgtgctttcattgtgtcctttcgcttattggatagtatgtaccaaaaacctaaaaaagaacactttcagacatcaaacttgacggttacaatggcgcaatccctccggggtcggcaggaagggccaaagatgactcggaagttcagccggccaagaaggaacggtcggtgcttcaaaccaagctgactcggcttgccattcagattggttatgccg

SEQ ID NO: 46586 - DNA, 1639 bp, Heterodera glycines
  misc_feature (1436)..(1436): n is a, c, g, or t
  misc_feature (1614)..(1614): n is a, c, g, or t
  Genomic contig location: Contig_ID=SeqID_39112; Location=135..1773; Strand=-
  SCN-specific regions: Sequence locations=1-240,262-271,431-727,757 -914,950-1169,1192-1639
catttgatatttgctaaattggatcgcattttggtcagttgcaacaatttgatgaaagggtccaccggctcatggcgagcccacgaggcgtatttgaatggcattgcagtgttgcgaaatttggtcagcaccaaggatttgctgtccaactttgtgccattgctcaagcaggaagtgctaaccgcggtaattgccaaataaattatttattaattgagtacccaattaaatcgtttttttcaataagaaatacaaaaataattactcgtgcttaaaaaaatttatcattaaaaatgtcttaattaacaaattattttttaattttatttcttcatatctttataaaatttaaagaaatataaatccttttttccaaaaagaaatatttcgactttttttaaatagaatatatatttttttaaataatttacgatatttttttcagcgtgccttaccttgtcgaattgctgctgcccaaacattgttgttgatgatgcgcgagttcgcgacaagtcgcgcccggcaaaccatcgtcgactttttcgtccatgacattggccaccattcgagttgctatcgccggcgccttttgttggacattgtaccgttgcttctacagtacttcagccgtgaattttttatcgacaaatttttgcccgcggtgctcaaactgtccgctgacccaatctcaaacatacggttggtatactgtacatttacagcacacaaataaaaaaaattaaaaaaactaaaaatgttagattctgttagaattaatactataattgattcttttcaaattttatgcttgttcccttttttattagtttaaaaatgcaaattgctaaaaaatattcagtgaaaatcccccccccctccatcattcgtattttgtctttattacaccttttttgtaattttttactaattttaatttcaataattttaaggctccaactgtgccggacactgccgaagatcaagcagtatttgatgttcccgaacaatgacgagtcgttgtccaacttggagcgtgttgtgcgcgaattgctggcatccgaacagaacgcactttcacgacaactcatccaacaggtgggctaaaattgactcttttttttaatcatttcggtgggaaaattcatgataacctccgatccaaaaatgcttatcatattcaattccattttcgtcctatttcagttcgcttgtgaactgtcgaggacagaaatggacaagaaggagtgccgtgcaaaccgtgccaaattggccgaggaaaagcgactgtggaccgagcatgaggactccacggacgaaactgatgaggctgaggcgggccagcagtacagtactgagcatacagtaaccgggagcgatgcgataggctcgcccgaaagcggcatcttcttcgaggaggactgttggcttggcactgnggtcggaaacagtgccagacctaacaaccaccagcagatgggcggtcgcctgtgccgttcggctaccaccacaagcatatcgcaacacatggagacggaggtggacaaaacatttcaataaaaaaatattggcaaaatgataccattaaatttttaaaaaaactgaaaagaagcgaanaaacagacccaaatcaaaaaataaa

SEQ ID NO: 46587 - DNA, 2098 bp, Heterodera glycines
  Genomic contig location: Contig_ID=SeqID_1097; Location=863..2960; Strand=+
  SCN-specific regions: Sequence locations=1-288,310-591,653-799,821 -1309,1332-1499,1521-1584,1608-1624,1667-1677,1699-1898,1923-2098
  Gene Ontology: Mol. function=lipid binding; Cellular component =cytoplasm; Biological process=lipid binding
atgggcgagaaatttgttggcaaatggaatttggagtcgtccgaaaactttgacgacttccttaaagaggtgagcgtgtacttgcgcgcgggcggggcaaggacggcccaggattatgacttggttgggagcggatatattccttcatccacgtttttctcgaaccaagaccgagactcttgagcatgggacaatcattttgggccaacgtcccgcagtccgcggaggactttccctacttgtggccaaatcgggtttagtccatgatcaaagggctaaattttgcacttttttgaaattttctgaagaggggctctgaacttataaccatcgtccatgattagagtgccaaattgccaaaaaaaaacaatttgccatacatttgccggcaatttttcttctttgcccacagattggtgtcagttatttgacgcgaaaggctggcgcatgcatcaagccggtgctcgagtttgaagtgaacgggaacaagtggaagatgacgtccacttccacattcatcaccatctcatgggagttcgagttgggccaggagaaggaggtgaagacggccgacggacgcattgtaaaggtgagggggagagagagaaagagagagagagagagaaggggggggggggagagagaaagtgaggcgcaacacaacgccaagcaaacggagatgcgcaattgggcaccaaggattgtcaaaattccgattcccgattgacatacagtagccacgggtaggctcgagattgggtggcttaattctcgatagccatcggcaacgaaagcaaatcgaggggagagactgaagctctcgagattggatttagttcaaaaattcggtctcgagcattttgaagctcttgcatttggagtaattccttgaaaaatgacaaatatcgcttaaatatgtgccaagttcgaaaaagtgataaaattcttgagttcggtgtcaagactttatggggggaggcatgtttgtcattcattgataagttttggggctctgtgccattaatttggaaaagtttgccgaagtctccatttttgtgcttttcagacaaccttcacctttgtggacggcaaactcattgagaaccagaagaagaccaaggtgaaaaattggaaaattgaaaacaaaattttgtcattttaattgggataattaggcccaaatgtaaaagtatgtctcgcacggaatttttaacggccagaaatttttaaatttcttaccctttttttggttgaagtaattttaattgtttatcattcgagagctcttcacagattgttttttggtttcaaaaatttaaaaatttttttttccaattaaaaggttgaagataaaatttcctaaaattttatggcctttttttaatgttttctgcttgaaatttttaaatttttcaatcgctcaaaacggcttttaattttaaatatgcaaagctttccggtggtaatgctatttacctaattttataattttccaaacaaatttaaaagaaaacattttgataatttctttaattaatcatcaacccaaaaaattgtaaacgaaaaactctggggacaaatttatgacccaaaatttattttgttcaaaaatcaacgaccacttttttaaaacttccttctcccattaaaaccataattggacattgattttgggtttttgatcactttttaaatttccctttcgcgcacgtcaattaaattttgaaatgcaattttgccccttccaaaaaataaaaatggacaaatttgtgcgattttttcgataaaaaaaatttcctcgttaattttttgctctaaattttttttcaggcggaggaaaaggacagttactatgagcgttatgtggacgcggatggaaagctcatgatcgtacgatgaatttaattttttaattgaatttttggccccgataattacccccaaaattattacaatttttaaagaccatggactgcgacggagtgaaggccaaacgagtgtacatcaaggcatgattaaaaactaattgatgaggaggaagaatggacgaaaacggagggactgagagggacacaatgccaaacaaattgcgccaaaa

SEQ ID NO: 46588 - DNA, 1683 bp, Heterodera glycines
  Genomic contig location: Contig_ID=SeqID_8357; Location=1..1683; Strand=-
  SCN-specific regions: Sequence locations=1-86,109-429,458-676,699 -891,913-1016,1046-1683
  Gene Ontology: Mol. function=RNA methyltransferase activity; Cellular component=nucleolus; Biological process=rRNA processing
atgggcaaaataacgaaaatcgggaagcagcggaaggacaagttctacttcttggccaaagaagcgggtccgtttctgtgaaggagtgcatctgtttttgacaaaatttacgtctttttatgcccccgaaaatttaggcttccgctcacgtgccgcttttaaattgctgcagcttaacaaacgcttcgaattccttcagcgctgtcgtgccctcgtcgacttatgcgctgcgcctggcggttggctgcaagtggccgagcagcaaatgccagtctcttccctgaggattggtgggagagagcgaatgttttgtcttaagtcgtttcgtttgcaggagttgatcttgtgcgcatgaatccgatctaaaaattgcatcactttgcagggagtcattatcgaagaaaaggtgggacacgagcagcattcatttcgaatcaaaatgttatcatttttccgccctttttcaaaaattgatttttttaaattccttattttgtgactcggcatgcggtgcgcagaagagttgggcactcgggaggcggattgtgtgttgcacgacggcgcacggaatattggatccaattgggcgcaggatgcattgcagcagaattgtttgtcactttacgcgcttcgtttggccacccaagtcttgcgcaagggcggatttttcgtgagtaaagtaattataattaggaatacttttcgtttcttaattgtttgttttgtattgtttagatttttcgatcagccgactcgcaatgtttgattggtgtctttgaaaaattgttcagaaaagtatttaaatttcgctatttacaaaagtaatttcctttttttaattttgggtccatgtttggaaaccgtccgcttctcggctcgaatctgctgaaatttttgttgtttgtgaacaatactcgaagcctgacaaagttccatcggaattgttggattctaaaaaagtgttctctgaccaaacggatggaggcggtgacgaaagcgaaaagaatttgtaatggataaattattattttttttttgaattattgcatccttttcttattccaaagacaacgactccttttgcatccgggccgtaaagagcgcaaggctaaagcacttggctacggaaacgacgcgttgcttggccaacacagcggactgggcgcaaccgaatttgtaacgtccaaaaatgcgcttcaattgcttagccgggcctcggaattggtcggtggatgctggacaaatcattagaagcgtattgttttacatttcatatttaaaaggtgctcgactcagaaagagtgctgaacagtgaacacacgacgaatgaaatcaaagaatgtttgaaagacattaaagtgagttagtgacagagacaagctggacaatgagaaatatagtgaatactaacagaaaaaaacccgtttaggtttgtggacctgccgaactgagaagcattttaaaatggcgtaagaaattggttgacgaacagaaaaaggaggaaaaagcgtctaaagaaagtgtaaaatcggctgaagaaatggtggagggtgatactggcgaggagttggaggaaatactgaattcaaagagttggaagagatcgacgatctgatcagaacagcaaaagccgaaggaaaagcaacgctgaaaaagtgatgagtcaatttcgaatatcataaa

SEQ ID NO: 46589 - DNA, 1195 bp, Heterodera glycines; identical to SEQ ID NO: 8360
  Genomic contig location: Contig_ID=SeqID_8360; Location=1..1195; Strand=+
  SCN-specific regions: Sequence locations=1-398,424-677,699-999,1021 -1115,1138-1195
  Gene Ontology: Mol. function=fibroblast growth factor receptor activity; Cellular component=integral to membrane; Biological process=oviposition

SEQ ID NO: 46590 - DNA, 591 bp, Heterodera glycines
  Genomic contig location: Contig_ID=SeqID_8369; Location=3651..4241; Strand=-
  SCN-specific regions: Sequence locations=1-88,110-203,225-538,560-591
  Gene Ontology: Mol. function=DNA binding; Cellular component =chromatin; Biological process=DNA replication
attcggtcacaaacacaattcgctactccaaggacaaaacggcggatgacgacgatgacaaagatgtttgtgaatgaagaagcattttgagttgttatttaaatcctttttagcgcgtggacataactgtgaaggagaaggtgaacctcaacttctccatcaagtacctgaccaacttcaccaaggccacttcactttcggtactttgtatttgaatatattaaatagttttgtaagcattatgaagcaagcccatctcgcaaattcaaatcttttggtaactctaacaaattttcaaaaaaaagtcaaaagcatggccaaatgaatgtatttttttctccataaatttaattgtcaaatgctatgacgaattttgtcaaaaaaaaaaccttaggtggctgtcgtccattaacttttaaattgtgaaaattaaaatttcagtgttatttgtgccctttttaggaccgcgtgcgtttgtccatgtgcgacaatgttccgttggtggtcgaatatgacatcgaaggcaatggatttttgcgtttctttttggccccaaaaattgacgaggacaaagagacaatggacgactga

SEQ ID NO: 46591 - DNA, 4017 bp, Heterodera glycines
  Genomic contig location: Contig_ID=SeqID_1105; Location=75..4091; Strand=+
  SCN-specific regions: Sequence locations=1-78,101-124,146-184,206 -408,430-1075,1097-1325,1356-1669,1691-1872,1895-2218,2241-2955,2982 -3123,3145-3249,3278-3519,3541-3722,3758-4017
  Gene Ontology: Mol. function=protein binding; Cellular component =nucleus; Biological process=DNA repair
atggaaaaaacggtcaaaggcgttaaggacgacggggaagaggccaattatatggaacggattaagtaatgaataaatatcagagaagtacttggccaaccccaatttcagagagcatcggtcactccaagaattggccaaattgaagggcgacacttttgacgaccccaatgacttccaaacactgtccaatgactgccgcatttcaaattccgtttggaacagactttacaggtcataaaaggaatgaaagtcgtcaataattgtctcttttgcttaaaagcgatgataaatatttttaagataccaaaaaaggggcgtccgatggctctacgaattgcattttcaatatgtcggagggtaatggatgagcaattgcgtttgcctttcccattggcacttttcagcattttggccgatgaaatgggactcggaaagaccatccaactttgcgtcttccttcgctctctctcggagagtcaaacaatttccaacattttcaggtgtgctttttgcatgcgttttcaatccctgtttttcctgtaggtataaaggccttggtccttctctgatcgtttgtcccgctacacttctccaccaatgggtcaaagagttgaatgcctggtttccgttatgcaaagtcgccgttttgcactcaagcggtgccttttccgggcccaaggccacgcttataaagcgaattggcgaacatcgggggttggtttttgtttgttttacattcgatgcgagcattttttattttggttttaggaatggatcaattctggtcacttcgtattcaacttttatgctgagctacgaacagatttctgcagtcaattggcactattttattctcgacgaaggccataaaattcgcaatcccgaggcaaaggtgttgtctttgtttctgctgcacttttcgatagcgtttctggcactttccagatcactttggcgttgaaagagcttcggacgccgcaccgtctgattttgagtgggtcgccgatgcaaaacaatttccgggagctttggtcgctcatcgacttcatttacccaggccgtctcggctcgctcaaagaattcatggagaagttttctgtgcccatcactcagggagggtacgcaaatgcgagcgctgtccaagtcagaaccgcgttcaaaaccgcgtgtgtgctgcgggacgcgatcagtccgtatttgttgcgacggatgaagaaggatgttcaaatggtgcttcagctgccagacaagtcggagcaggtcagttactcttaaactttttaatgttgttgctcgttttttccggggagagagggtattttaacacgagaaaacaaatgttgtggattaatcaaacattaccttcaattactttccattatggtaaaattcgtctgtgtttcgggtaatttcttttttctcctcccactaaaaaaagtctaccattttggctcctttcgcgatttttcttacaatatttcttgtacagattcttttctgtgacatcacaagtgaacagcgtcaactttatcttcagtacatcgagtccaaggcctgtgatgacattgtcaccggcaagcaaatgccattcgcgggtttaatgtttctgcgcaaattgtgtaaccatcccgacttggtgtccggaggacccaaccgatttggtaccaataataatttaaaaatattagcgattttaaatcgtcatttattcgttttgctttatttagccgactttaatgtcgaagatcggcaggacatggaatttggattttaccagcgcagtggcaaaatggttgttctccgtgagcttttgcgtctatggcgagaacagaatcacaaagtgttactgttttcacagagtcggcaaatgctttcgatcattgaaagttttgttatcattgaagggttggtaaatataacgcccaaaaaacctttaatttatttatattaccgtattattacagttattccttccttcgaatggacggcacaactccaattggcagtcgacaaactcttgtcgaacagttcaacaaagttagttattgctgcttttcctacaatcctcactttaattctaaggatcccgatctttttgtgtttttattgacgacaaaagtcggtggacttggcataaatttgaccggagcgaatcgcgttttgatttttgaccccgattggaacccgtccacagatgctcaggtcgatttggtccatatttttataaattaatttttccttttttttttgttttaggcccgtgagaggtcctggcgaattggacagcatagggcggtcacaatttacagattgtgcgtggcaaaactatcgcctaattaaacagtaattaaggttgacaagcggaacaattgaagagaaaatttaccaacggtgttgtttttcatcggttttcgttaattaatataaatttattcgtttaattattacctttaaggcaaatattcaaacactttttggccaatcgcattttggacaacccaaaacagcaacggttcttcaaaaccaacgaattgcacgaattgtttactttgggctcgtcaaaaagcgaccggaagtatggcacaggtaaaacaatctgtaaaaatctcatcaatttcactcccaaattttagaaacggcggttatttttgccgccaacggaagcgaagtgagcagaaaaaagttgaagaataacatggataaaagaagggatgaaaaggaggcggagaacaaagcgaaagcggcggaacggacggacgacggcggaaaaatgccctcggctgattttaatgacagtgcactttcggacgaggcccgggaaaggcttaaaatggtcgccaaacgattagcggcgtaaaataaataacaaaaaatgcttaaattaacaataatttttagaaattttggaaaaacggagacggacaaagcggaaaatgggcggcggaagagggacaaagtgttgtttgagggcaaatacaaagttccattgctgcggaaacaagtggaagtgatggaaaagaaagaggaagacaacgaagagacggcgccggaggggcattcgttgagcaacaaagaacaggtgaaggaggagcacacccagtggaagggaaaggcccaagcaaatgcccaatttttgttattttgttggaaaatacccaattggacgaggtactggaggtactttcccaatgttccgcctcccctggaacagtccatgccatggtttttaaaggggaaaatattacgacccaaaacaaacaaacaaaaataagcattgcgaatggatttggccaacaaattaattttatgagtgaattgtgttgatgattttatccctgtttcaggatgattatgtgttgagcaagttgctcagcaaaaaggtcggtgttcactctgcgcttcagcatgaccaaatcatcaaagagagttccgccgccgacattcagctgatcgaagacgaagcgaacgcagtggcaaaaagggcagccgatgtgttgaaacgatcgcgacggttggccaatttcttgtggaactttcattgtttcattcttctcaaggcgacacctcgaattcctgtcgaatgcgtccgaatttggcccaatacaaacaaaaaagtcattgttcggtcgcaaaagagtggccgggttcacaataataagcaatggaattgaaaagactgatggaaatgggggcagagacggagcgccaaaagaacggacagaaaaggaagaggacgacgaggaggaggaaggtgaaataagggaagaaacacgagtgggaaagggagttgtttgttcagggtgttcaaagcctttcgatgggagcgaaatgttagggcggaaaaagcgcggaaaatgcgatgcgagcggcgccgaattgctcaagtcgataagacagcgaaaggagcgccaattggacattgacggggagggcgaacttgcggaaggggaagaggacgaagttggtggacaaattcaaatatttctaaatttttgctttccatcgttgcaataa

SEQ ID NO: 46592 - DNA, 3522 bp, Heterodera glycines
  misc_feature (169)..(169): n is a, c, g, or t
  misc_feature (3084)..(3084): n is a, c, g, or t
  Genomic contig location: Contig_ID=SeqID_8376; Location=1..3522; Strand=+
  SCN-specific regions: Sequence locations=1-240,263-409,431-468,519 -844,868-872,894-1030,1052-1184,1206-1233,1256-1426,1459-1548,1570 -1980,2002-2059,2081-2343,2366-2381,2403-2665,2687-3150,3172-3522
  Gene Ontology: Biological process=growth
caaatgatgtcccattaattggagtaccaccgggcgggtgtcatgtgttcgagtgtccaaaaaattaaccagcttatttccagacagtggcatgtcaagggtggccttcctcctccctgtcatctgaagcggcgaaggcaccctgccgactcgcgccggacacccatgnacgcgagaaaagcgacgaccacgcgggcatttccacgcgtttcggcacaccgcccgaacaatttgctcaaggtatggtcaaaaataagcgactatatatgatgtacaatgattattttgcattcccccaggttactgtactactactgtcgtgcacttacgaacacggcgtgtgctgtcgttgtgatgatgattctcacaggtaccatatacatgctgtaaatacagtatccacatgctgtacatacagtatccatccgcttatttccaagcataggtattcaaaaaatggttttaagctaatattaaaaaaactaaaaataaaaacaattaatattgaaattaatatactcttttgcataaatcatatacatcgtgtcagtcaatgcccaaaattacggtagtaaacgcaactttctccgtttttcattatttgctatgctgtattttttaaacacagacccaatcttaacacacacacacacacacggtcgtttatactgtagattgtggagaccttactgtattttatactataaagtaagaacaactttccatatagcctacttgtacgtctccatctttggcctactgaacatccgtgctgagttgcggcctgagcagctgtttttgcgctcctctgacgtcattgagctgttgcatctgcgcaacgagttgccaataaattttgaaaattttgcgccaaatttaaattaaatttttttctcacccagatacatcatgccattctatgcagtgtgcatggtttttgtgaacaaaccaggcaatttctccgacccggttcagcgtcagagatggcattcgctggtgcgcgcgataattagcaaaaaaaatctcaaaattttttgtcttaaaattttcaggtttccgattttgaggggttgcccagctctgttggccgcttctccaccaaattttggctacgcgactatgagcaatttgtggagcaggacccggaggcaagaataaagtttttgaaaatttggattgatatgaaattaaattttttatttaaagcgcagggctagtttttagaaaattagaattttcaatgtttttaaaaaataaggagccagggtttgtttttgttttttttttgtttatttaggagactcgggatttttttgaaaatttcatttttttcctcccttaaaacatccttgggttcaaagcaaaatttaggatgcagcacctccattgaacgacctagcagcctttgaaggtaggaggggttaggattttttttttaaattttttttttgaatttttcatccgttacaaattaggcatccccttaactgaacgaaagcgcaacgaactggccgaatttcttcaatggcccgaatttcaagtgatcatttatttattttccttaatttcgatcaacgcacatatgtaaaaaacaattttgtttgaatatttgatttttcatatcccaattgttagcgctaaattttttgggacccagttactaggttacgaaatacaaaatttttttagttttggaatggttttctgaggctagaatcatccagcaacacaacaaacagctctgccaattcgtcggagctggtgctgagccgcttcttcttcacaacggcttcttatgggacagagttgcgcgaatggtccaagcgcgagctgttgcttggtcaatgggcgcagggttgccgattcggtgaggagttttgtttttctttttacaaaaatttttacagtatcccgagctggaggtcagcgtgtacgtaagtgatttgtaattttaacttaattccgctgagttggcctaagatttatgcaatattttaaatctgctcgcgtatttgcttaattggtctggttaggaaaatttattaagaattgaattgcctaatagctctccattttcctcattacgcttaatttgcacacatcattaagtccaattatgttcaggaagatgacgccaaatttttggatctgatcccgacaatggtatgtaaaacgtctcaaataaatttaaagcttgccattttgatcggttttttttgtgtcatttcgttttcttcccccatagattccgcagacaattcagtcctctgcctgcactttgttatgtatgtttctcgtctgtctgctgttcatgaccaacccaggcgctctattggtctcaaattttgccattttctccacttgcattggtgcgttcaaattttgaacattttttcctaaattttggcgaaatgttttccaggcgtttttggcatccaatcgttactcggcactctgcttgatcccatttttatgaggtagtggtgtaaatatttatcacatatgtacattgcaaaatgaaaagcaaattactggagtctatttgtgattcgtccttaaatccaagggcagtccttgatttagtagcctgcttgatgtattgtaatggatctaatttttatgaaaaattgctggtttgaaaataatgaattaattttttttttgacaaagttaaaagctgaaaatcctaatgcaccatacatattacagtattaacttaaaaaaaccgtatcactggcaataattttttgaaatttatcagtgctgccatcatgtcaattggattctctgtggacattccggcacacattgcctatcatttctacaagacgagcgttggcgaaaaggcaggcaccagcttagatgtggaacaacgactgatggactgcttggctaccattggtcagtcagtttttgtgtgcaaagagtaaattacggttagtgtgtcccttataaagtaacagtatagcttgaggttttcgtatgactcaatatacggtatttgtacgattaaggtgacctgaattattcggtatttgtagcttgcgattttagcgtaatccaatacgcatgttattgtgaccnccgctgaaatatacaattatggtagttcgaaatgagacaattaaacgatacttcattctagcttattgttaatctgatccagtgtaatgtatttttgatttgtttttgcaaggctttcctgtgctggaagctggtctgtccacgctgatctgtacctcgtcactgttctttgttgacttgcacatggccagggcaagttgtatacaatagcctttgattacagtatactctggctactgtatacgtacctacagttgctaaattttggtacaaatataggtgtttgcccgcacaatgacgctggttgtggccatcggtttgctgcacgggctgttggtcatcccggtgatgttttccttgtgcaacaccatacggcgacgagagcggcagcgccctactgtaaccggacatgccgttatatggcctactacagtactt

SEQ ID NO: 46593 - DNA, 537 bp, Heterodera glycines
  Genomic contig location: Contig_ID=SeqID_39281; Location=232..768; Strand=+
  SCN-specific regions: Sequence locations=1-21,43-172,195-537
  Gene Ontology: Mol. function=structural constituent of cytoskeleton; Cellular component=cytoskeleton; Biological process=regulation of striated muscle contraction
atggaagaacaccgcccaggcaacacgtcaatcttcttcccagccgcaaagcgctctgaatgcggcacctatgagctacggctgaagaacaacgtgggcgaaacggaaggccactttgaagtgctggtgcaagaccgtccggcaccgccgaagggatcgcttgcggtggacaacgtagcgcgcgactcgtgcacactgtcatggcaaccgccggaggacgacggtggctccgaagtcaccaactacgtggtcgaatgccgtggtgtgggcagccaagtttgggtgccggtcaacaacgttgttggcacaaacagcaccgtgccgaacctgcaggagggccacgaatatgaattccgagtgtgtgccgtgaatgcgtttggctgttccgacccgttgaacaccgactcggccgtggtggccatggacccatacggcccgccgggacgacccgaggtcacggaccacgacaacaatcaaatcagcatcaaatgggcaccgtcgacggacactggcggatcgccaatcgcttattatgat

SEQ ID NO: 46594 - DNA, 385 bp, Heterodera glycines
  Genomic contig location: Contig_ID=SeqID_39400; Location=98..482; Strand=-
  SCN-specific regions: Sequence locations=1-177,201-385
  Gene Ontology: Biological process=embryogenesis and morphogenesis
atggcaactccaggaattgaaggtggaattcaattaaagaattgtttttatacacttaagcattagttcatatagcaaatttagcatctgaagatccgacttcaaattcgaactccgccgaactgtccgatgcggaaagagaactcgtgatcgaggaactgaaaaaggtttgacaaaatttagcaaatccctttgaattctaaagatttatcttcagacggagaatgaaatcgccacacttcgtcagctgttaaccgcgcgtcagaaacacgtggcacaactgaaacgaaagcttggaatttcgccgttaaacgaaattaccagcgaaatggcacaaggactgaaaactgtcaaggaaactccggcgtatgttttcgttgtttaa

SEQ ID NO: 46595 - DNA, 878 bp, Heterodera glycines
  Genomic contig location: Contig_ID=SeqID_39426; Location=1..878; Strand=-
  SCN-specific regions: Sequence locations=1-95,118-139,161-609,631-878
  Gene Ontology: Mol. function=citrate (SI)-synthase activity; Cellular component=peroxisome; Biological process=citrate metabolism
aggtgtgccgaagagcacctactgggagtatgcgtacgaagactcgatgaacctgctcgctaaactacccaccattgcggcaatgatttacaggtaaatggatgggatccatcctggatggtccttgaacggaggagtcccccatatttattgaaagacaaaatctcttcattttggacattttataccgcgcttggaactcaggaatccgtattattgaataactatcagtactggcattgagtttttcttggtttataatgcttttagtcagttcctaaaaatgaaaaaattgtttggtccaaaaattacggatttttggacagcatgaaagtctttgctaaattatctcatatttttttttagaaatctctaccgtgatggttcttccgtgggtgtgctcgacccgaacaaggtttttttttgtttaatttttggttccatggttaaatttgatgccaccctttaaaggattggtccgctaacttttgccatatgcttggctacaccgaacgcgaattcgtggaactgatgcgtctctatttggtcatccattcggaccacgagggtggcaatgtgtccgcgcacacgtgccatttggtcggctccgcgctgtccgacccgtacctgtcatttgccgcttcgatggccggccttgctggtccattgcatggactggccaaccaggtatattttgccagcacatcgttttggcaccctctttttagagtcaaattgcatcggtttaatgtaataaattacgaaaaaaactgccttaattcccgaataccctgtaaaattttaccaatgatatcatgttctacatcaatttacttgttcaggaagtgcttgttttctgacaaaaatggttgccgaca

SEQ ID NO: 46596 - DNA, 1107 bp, Heterodera glycines
  Genomic contig location: Contig_ID=SeqID_8420; Location=40..1146; Strand=-
  SCN-specific regions: Sequence locations=1-287,313-348,370-703,725 -740,762-964,986-1107
  Gene Ontology: Cellular component=integral to plasma membrane; Biological process=cytoskeleton organization and biogenesis
atgacctacaagatcgggtcagacccatcacagctgaaatttgcggagaaattggtcattttaaacggtgagtttggcttatagcaagcaaaatgccttacaaattgtttgtcagaccgtacagtcggcatgttgacccgcttctacaacatgaagaaggcgtgtgcagacccgaagtcaaggccacagtttttgaatgacaaatcacttgactcggctatttccaccattgtcaaacgctttccgatcattgacatcaaacggaattcggttcgaaaaactaggggaattttataaattttaaattttttaccattaggtgaaaaaatgctctgttagagggaagtgttaattaatttaaattttttacgcaattttatggaaaaaaatgcattttttaatttagtttgagtttgatttcgcttaaatttccgaaattttaaatgctagcaccgctaaatccgcatttttcaaattttggttagacataaaaattttttaaacgaattttagaccgctttttcatgtgtgaatgaaatgaaaggggacattctgaagaagctgtccctgtactactacacttttgcggacttgctcgacttgaaggacgccattttgcaactgttcaccgcaatggacgcaaatcagtgcaaattgaacattgtatgtaatggttatgacaatcagagaagatttgtaccaagaaatataagaaattaaaaatttaagagttgacaaaattacaaatttttaattttcacctttttttttgggtactaatttactttgtatccgctttttttttttcgcatttttcaattttttttcctttttattgtcacaattgcttttagattaatggaaacacttaaaaatttaaaacttgatgctttattcaaagttttggctctaccagacgaagaacataaagcgagatttggcactcacagcatcacgttgtttccacatacatttctgattttttgtggcgtaagcaatttggaggaccggatattttttataatttgtggacccaaatcgcggaattgtacccaataagcacataaagctcgtttatttgatatttaaagcaattgtgacaataaa

SEQ ID NO: 46597 - DNA, 1367 bp, Heterodera glycines
  Genomic contig location: Contig_ID=SeqID_8422; Location=896..2262; Strand=+
  SCN-specific regions: Sequence locations=1-492,514-634,656-796,818 -1073,1096-1105,1127-1343
atgggccccgttcttccgtgcattggccaaaacaataaaaagcacgaagtgatgaaaaagaaggagaaaaatgacgagaaaatgaccttggaaacgaacaaaatggcgggtgaaaagcgaaaaaggccgcagagtttgtccgagaaaagttttccatacaacgccggactggagaagaacaaattgtttgtgaagaaattggattggtcgtgtacgggcgaggaactcaaagtaactaagaaaaggggaaatggagtaagattatgctttttaagaaatttttcgagaaattcggaactgtagtggacgcgcgaattgtcaccaaatggaacggtcgctccaagggttgtgcttacgtcgattttgccgacgaacaaagcgcctccgccgctttgatgggggcggacggaacggagataaggggcagaaaaatatcagtttatttgagcaatcctccgcccacaaaacggatgaaaatggaagaggcaacattggacgaccacaatttgacaaccgataaaacgaatggagcgacaacctcaaagactgtggacgggaaaactgaacaaaaacaagcgaaacaacagacgaagccctcaaggctgatgccacgggcggcttttctgaccggcgctggacaaaggatcggaaaagcaagccgattgatgttgccgatgagcggcatttcgaagagaagcggaaatatcgcaacggaaggaaagagtgaatcgcccgtcggcgttgtcactgaatcaacgaaagatatgagcttatagaggcagaggcgaacggacaaatgatgaaaatgattaaatatccattcaattgtttcccaacgaagagtaaccaaaagactaaaatcgcaaaattcggtccttttttgacaaaatttgttaacaaattgcactaattcgaaaaactcccggccggaccccacccgccatttgaaagcacaaagactaaagaagctaacacataaaatctcagcgtttaggcttgccaaaaacatttgattaatttagtgattgttgattattttcgtttgcaactttcggtacttgtgtggtttacgggacagatttcatatacatttttcaaatgcctataaatgtattcattttttaatgaaaataggttttaagaggattttggggtcggtgatcacgaatccgggctcagatcagcgctaccgttcactacatgagctgtacagggacaaagaattgataggcttcctgaacaaataataccctcattggcaagatgcccatgaatataccataggtacgatatacatactatatgtatagcgaattacgggcaaccttttgcgtataaagccgatgaagaattctttattgtttaaa

SEQ ID NO: 46598 - DNA, 1189 bp, Heterodera glycines
  Genomic contig location: Contig_ID=SeqID_1116; Location=1060..2248; Strand=+
  SCN-specific regions: Sequence locations=1-8,30-51,128-190,245 -549,573-676,698-966,988-1189
  Gene Ontology: Mol. function=structural constituent of cuticle; Cellular component=extracellular; Biological process=cuticle biosynthesis (sensu Nematoda)
atgcaagagactcacattgttctcgggattgcctcggtgtgctctctgttggctatcatcgccacagtcgtcactctgccatctctgtactcggagatgagccaaatgaacagcaaagtgcgcgacggagttgaggtactcagccggccgcactcagacaaaaaacacaccgaaatttgccaatttttccaggccttccgcgtcaacaccgactcggcctggactgacttgatggacgtgcaagtggtcgtgacgccgccgtcgaagccccgtgataaccccttcaactccatcttccgtgccaaacgtcaactgcccggacactgccagtgcgctggcctccaacagccaagctgtccccctggtccgcccggcccgtccggaccgcctggacagcccggacagcctggaggcgcaggacagcccggacagcctggacagcctggccaacccggtgggcattttttgactaaccctatgctaatcagccccttccattgcagctcctccttgcccgccccagaacatcccctgcccacgctgccctgctggcccgcccggccgccccggaggacagggaccgcccggacagcaaggagcccctggacaacctggtacgcccgctcaaggtggaggacctggaacgcctggcgcgcccggaccccaaggacagcctggacagcccggacgccccggagccgctggccaacccggacagcctggagcgaacggagttgtctcgtaagcactttaatcatggcttttaagttaaaacccggttccactcgttcagacgcccaattcctggcccgaagggaccgcctggagcgcctggccagaacggaaaccccggaggccaaggtcagccaggacagccaggaggccaaggaccgcccggacctcctggcgcgcccggtcagcccggccagcctggaaactctggccagcctggacagcccggagcaccgggacagcccggcaaggacagcggctactgtccgtgcccgccccgctcttccgtgttggcagtcaaaaagaagatggcggcagccaagaaagcataagcgacaagcgcagggagaagagaaccgaaagacaaaggaccgacgcgaaagcgaagctgaagatgatcataattgggtggaagttgttgtcggaatttgtgttcaccagcgcatttcccacacga

SEQ ID NO: 46599 - DNA, 1325 bp, Heterodera glycines
  Genomic contig location: Contig_ID=SeqID_39627; Location=4..1328; Strand=+
  SCN-specific regions: Sequence locations=1-43,65-477,499-557,662 -716,743-811,841-892,914-1325
ccaaccatcagtgatttgcgatatcagcagcccttttgggctttagtccctgctgaagacaaacaggaatacttccttgaagtgaaattatcattttggaaagtaaatttgttttttctctcttttttcagattatcaaagagggcactgtcattggcactgtccgtctccacaacagcgcccatcaaaaatcattttggtccattggccgttttgagccgtgtgacatcaaattggagcatccgtccgtttctcgtttccacgccattttacaatacggagaatgtataaaggggagaccgggatggtaaaagatggaggataaaaggggttttaccaatcaaatgttttctctttccaggttcatcttcgacatgaacagcacccacggggtgaggctgaacaagcagccgctcaaaaaacgcacttacgtcccattgcacaacggatttgtgttccaaatagcgggtcggaattaaatattttaaattgaatgaacaacttttggcaatgtttttcaggcagttcacgtcttttcactgtttgcggtggtcccaaaagagaacagaaagaagaagaaaacaaagaaaaggcacaaccaatgggaaaaacggagaacaaaaaggacgcagaagaggaaggagaggacgaagaagaacaacagctccgatactacgagaaggacccgttgggatggctgcaaaagtgggcaaattcaacattttttaaaatttaaattgttgacggagaaaacgaactttcagatactttgagcgcgaaggacttcccatgcactttcaggtggattttgaattttaatttaaaaaattcataaaaaatggatcccgatattttgtccggtatttttcagtttacaaaatcgtcgtccgatggaggcggcggtggcgctggggatttactggcagaatttgaggacgaacagaacaaaaagaggggacgacggcattccgacgagggccattggacctgttcaattgagtgagtgccgaaaaggcgccttttccttttctgtttccgtttttaggttggttagcgatgtttctctgaccagtggcaatgtggtcactgtgtcggccccttccaaacgattggcccaattgcaatgttcgctggtcgcatgcgaacggctgaacgacgcgtgtcttttgcgcatttcgtccctttggaacaaacgcaaaaattacacggagaatgacttttacgacagcgacgaggacacttttttggaccgaactggacaaattgaggagcaacgggaaaagcgccggaagcgatttggggtagtcaatttgaccactgattaa

SEQ ID NO: 46600 - DNA, 2056 bp, Heterodera glycines
  Genomic contig location: Contig_ID=SeqID_8467; Location=57..2112; Strand=-
  SCN-specific regions: Sequence locations=1-285,307-324,349-729,768 -1253,1290-1528,1570-1635,1665-1748,1823-2056
  Gene Ontology: Mol. function=oxidoreductase activity, acting on single donors with incorporation of molecular oxygen, incorporation of two atoms of oxygen; Cellular component=membrane; Biological process=protein modification
atgccgttatcttcgcccgccgatgccattgcaattgtcgcatttgtgttgaagccgacgccatacattgaagaatttttgcaccgtttgtctttgttggaatatccggacaaaaacagtcgtgtcaatctgcgcatttacaacaaccaaatgtacaacaaacaacacattgaaacatgggcaaaacggcgaagcggcaaaaaaaacgacgattttggcattgtgcaaattttgaatggcacggcaatgggcgaacacaaaattcgagcggaagcagtgtcagtgaaatttggaatataaataaatttgagaggagaaaagcccaaatttttggggggaatcctttttaattgtatagcatttttggaacaaatcttgttaaattttgaaattccaacggggcctgagtcggtcttaaacttgaaaaaaaagtgtttttttttcgttttttaggcaatgggcaatcgaaataaatgccgattttttgtttttgattgacgccgaagcgcacattacggcaccagacacactcaacattcttgtccaaaaggcacgcgaagacaacaattatcggtccgtttcacatgagagaacataaattttatgtattttttaccgtttttttttctattcggcttgcatttttctatttaatttataagccaaaaatcttataaaattgagaatttaaacaattttcgatttaatacggtgaggcaatgactcgtcttttttttataaaaaattttgatttatgatattattttctggaaaatgggtgggtttcatcaaaaaacctaactttttttaacataagaattttttaaaatctaattcgtaattcaaaaaaattgcaaaaaataaaactttttttgccatgataaatacaaatgttgattcatcttttttcagtgcaattcttgcccctcttctgcttcgtcccgacactgtgtacagtaacttttggggtgctgtttccgagtccggttattatgcgcgttcatttggtacattcattttatgccaaagaaattttgtccaatttttcatggcattttttcctccccgtttttcagattatttggacatcatccacggcaaatcgcctgcccatgtttggaatgtgccattcattggggcggcaatttttgtctcaaaacgcaaatttgaagcgctatccaaagcgttcgttttgaagggtggcgtcgatgctgacatttcgatggcacaattttgccgggaaaatgtatcggaatttaaataaatttattcttaatttcaaattttaagggccattttatgtttgtggattcgtccaaaggcatccaatattttggctttttggtcaattcggactcattttcacaactgccaaaggaggcgcgactcaatttggagctgtacgattatccgaacaacaaaaaggtcggctaacatttatacgaaattataataatttttcataattttgtgggaaaactatatgaaaaagtgaaaaaaaatatttgaattggaaccgttatcttacaaataaaatattaaaaattattattttaacaattttattttggaatgaaattttttttgccgacttccacgcttttttaataaaatatccgccgaagttaagtgggcatatttttttaattttaatttttataattctgaaaaaatccagaaagttatagaaaaaaaactatctagcctttttaaatttaaattaagaattcgtatatttttcaaaatgctttttttcataaaaatataattattttttttctataattttttccgaagaaaaattttattaaaaaattatattgcttctaatactacaaaaaaataaaattgaacttcgaatcaccaccaccccttttttcagctgtgggaaagtcgttacattcacccggaatatttcactgtgctcaaacccggcactgatgtgccgttggcctgtccggatgtgtacgattttccgtttttgtccgaacgcttttgcgaggagctcatcgaagtgatggaggagtttggccaatggtccgagggcaaacaccag

SEQ ID NO: 46601 - DNA, 960 bp, Heterodera glycines
  Genomic contig location: Contig_ID=SeqID_8468; Location=2276..3235; Strand=-
  SCN-specific regions: Sequence locations=1-95,117-234,256-482,504 -922,944-960
agcaacggacaaaagacagcagattttgattgaagaggctggcgacggccaacatacggaaaaatcgtgcatttgaatcgattttgagcaataaatgttgattttgttgacaattgagttttagactttttgttcgaatttgggttcggggttcgaaatgggtctaaatggatgtcggattcgtgatcagtgatcagcgaccccgaaaacctatattttgacttttttacttagaaattaaaaaaaaatttttatgggggacaaactgaataagagccttttaaaatttacatttaaatttgctttccaggattctcggcttgatcattgctggccatttgaaatgggaacaacggccgctttggttcgacgcttatgtcgcccattcaccgcattacgagccaaaatgggacatcaaaatgccgaagcgtgacgaaccgttgccacaaattttctaccaagaggaccttatcagagcgtaaattctttcatttaccaacaatcttggtgtcgtcattcgaaagctcatctaattctctttagccttacaaaaattacaaagaatttcataaaaaagttataaagaaaaaaattcaaaaattttgatttttttcgctattttcatatttctcttagttgtcagaatttgcgaaaaaatcaatttttaatctgatttttcggttgatttatggcctcttccatcattttttgggtttttcatttttttaactgcccttgacctggtggacacatgcctggatttttcctagacccatatgcctcggcaaatctaaattttttttctaaaatacctaactttattgttttcaattaacttttctacttcttccccctataaatttcactattttaagcaagaaattgctggagatgcgcaacgaagaaccgaagtatgagcttgatcagcaacaacagcagcagcctgatcagcttaattag

SEQ ID NO: 46602 - DNA, 282 bp, Heterodera glycines
  Genomic contig location: Contig_ID=SeqID_39677; Location=393..674; Strand=+
  SCN-specific regions: Sequence locations=1-144,168-251,273-282
  Gene Ontology: Mol. function=structural constituent of ribosome; Cellular component=cytosolic small ribosomal subunit (sensu Eukarya); Biological process=protein biosynthesis
atgccattccaacaaaatccattttttttctttgctttcagtgtccgtcgtcaagtggtcaacatcccatcatttgttgtccgtctcgactcccaaaagcacattgatctgtccgcaaagtcgccgtacgctggcggtcggccgggccgtgtcaagcgaaagaatgcgaaaaaaggtgccggaggcggcggctcgggtggcgaggaggaggactgatcgacgatgatcagttgataatttttttttgttcgacaccccctttttgttgaaacacaatgttga

SEQ ID NO: 46603 - DNA, 791 bp, Heterodera glycines
  Genomic contig location: Contig_ID=SeqID_39706; Location=1..791; Strand=+
  SCN-specific regions: Sequence locations=1-7,29-152,174-237,259 -444,466-563,585-791
tgatgttaaattatattatacacatgaaaacgatgaccattcgaatcagttggataaagcaattgaggctatggaaaaatggtcaaaaataaatgggttagaaatttcaactgaaaaatgttttgttttatatttagggaaaaataatatgaaaaaagaatattttattaactcacaaaggatttcagaatcggataatgttcgtgacttgggaattataattgactcgaaactgaatttttcagaacacataagcaaaattatacgaaacgcatatcttagaattttctaaattttgagagtgttgaaaagcagggaaataaaaactctaacagcagcctataaaacttttgtacgacctcaattagaatacgctaccgaagtttggaaccctaatttaaaaaaagatatagacaaaattgagcgggtacaaaaattttttacaagaaaagcacttagaaaatgtggttttgtgtacaaaaaatatggggaaagactaaaaatcacgggtttacacaaattggaagaaagaagaaaaatcaatgatttaacaacagctttttaaataatcaaagggttcaccagcctcgatgctgggaaaagtttctttttctcagaaaggctcaggaggcctttatttttgcgagtaaagcgccacacggccaaaacacaaaataatttttttcataggatagtaagaaactggaataaccttccagtggtagcggtgcaaattaataaggcaaaggaattcaggggtttactaaaagcaatgagttctgagtaggatt

SEQ ID NO: 46604 - DNA, 2346 bp, Heterodera glycines
  misc_feature (1909)..(1909): n is a, c, g, or t
  Genomic contig location: Contig_ID=SeqID_1124; Location=63..2408; Strand=+
  SCN-specific regions: Sequence locations=1-47,69-114,136-272,296 -314,441-524,546-553,581-614,679-832,863-942,968-1047,1069-1107,1152 -1155,1178-1426,1494-1722,1776-1912,1934-2065,2104-2280,2344-2346
  Gene Ontology: Mol. function=polynucleotide adenylyltransferase activity; Cellular component=cytoplasm; Biological process=mRNA polyadenylation
atgaaaattgtggtggagcagcaaaaaattggtaaaataatccactatttgaaaatcatttataaaattaattgtttcttgctaagaaaaaaaattggcatttaaatttattttttacagagacttctttaatttctgctgaatatgctcaatacaatttgataagaacaaatccaacaaatcgtgagctcgattttaagcagtcggaagaagtaaaaataattatcttttctccttactctatttctctaatatgtataatttccgttttcaatttctttctttctctctttgccgtccttctcttattcacttctctctctctctctccctctctctttctctgaccttctttctctctctctctctctaacgttctttctttctcactcactcctctctcattcaaacactcactgtttctttctctctctctctctactcctctaacaactctctcactctctctttttcattttcattttttagattagcaatttaataaaaccattctgtgccaacgaaaacaaaataactctgatcaataaaatcaaaaagcaaatatattcaaatttaaagcaatgggtgaaaatagcgactaattttgaacgtacatttatttgtttaaacatataattaatattaatattttttattgacaataaaaattaaaaatttgaaaatgttacagatcccttgctgttaacaaacggttcccatatgatgaatgctgaattggacagctccgatttggatttgctgtgcattgtgcccgcacaaatcaatttgaacaattttttataccaacttaacattagtttcttttcaatgcttaaaaaagtaaattttttaattaaaattagagcttgggctttaggatttttagctcgtttcttttgtatatgggtcagggtaatttcgtttttactgcattttataaagaaatttttggaaaaatcaaaatttacttcgaaattattacttttgcaaaattttatcttaaaattatcatacaaaaaatcacttaagacccccgaaaatagcataacaacagaacttaaaagcaattctttcgtatattttagaccaagaagtcctaatgcgaaaatattagtgaaataaaaagaaaaacatcttgaataaattctatttaagtaattattttccattttataaattaaagttttatgaaattattgaatgttgcccaatttactgttcagaatttaacgaaagcaaaagttagcagtgtgtccggcagagtgccattgatacgaattgagcaaaaccaaattgaatttgatgttttgttcgttcctgtcccattacaatatttggtagaaggtgttaatttggaaagtgatcaactgatcagagaattgggcactgctgaggcgctttattcattggcaggtaaacacgctggaaaatattgtaaattttaatattcaaaccaattttaattaaaaatagttttagttaatttaaaatatgaatctttcctaagcttttatttttcatttcggttttgataattgcaaatgctccttttaataccaatgttttcggactttaattgaagattgcatttcgtaattttaatgaatcatttttataacttttaaggctacagatccggcaaatttcaattgtcacttgtcaaggacagagaaaccttttcacaatttttgagagccattaaactttgggctaaaagtgagcaaattttattgaaaaaattcataataataatttaagattaacattaatttttagatcgtttaatttattctggattatttggctattttaatggagcaactttgtcagttatggccactaaaatttgcgctttgtttccatttgcacccttggcttatttattgtaccaattcttcagcatttactncaattggtaattatagaaaaacattaataattatgcatataaagatttttacgaagttttaattaaaaattgcattacgaatcacttaacaaagtatattctaatatttttctgtatgtttaataaaaaaaattttccaaaattccctcttcttaataaaataattgtaatcattaaatatcaaggaattgggcatctgaacctgtaatgattgaaaaactgagtgaatttccgccacaaagcactctgaagccgccaaaaattgctgaaaattcaatgacagtgatcacgccaaggtttccagaacaaaatgcctcattcaatgtcaacaaatttaccattcggacaattgttgaagaaattggcatcggtaaaatttttattatttaaataattgtttaagaatttataatccttaaaattaaaaaaaaattgga

SEQ ID NO: 46605 - DNA, 342 bp, Heterodera glycines
  Genomic contig location: Contig_ID=SeqID_39778; Location=279..620; Strand=-
  SCN-specific regions: Sequence locations=1-342
tcggattggcctggcattcaatttgatctgagccgggtgcttcacggcgaacaatacattgaactgtacgcaccgtttccggccgacggtgcgcgactgcgctccgaaatccgagttgccgacctgttggacaagggggcgaacgcagtgatcatctccgagggtacaacaacaaaaacaaaatgcgcaggggatcatcaatcatctttaattttatcggagaaaaatgatcaaattgctggactagatggatttggacccaaaatccttccgggatgggatcccatttacataatcgccgcatatgatctattatcattaaactgtggaggattaatctag

SEQ ID NO: 46606 - DNA, 1580 bp, Heterodera glycines; identical to SEQ ID NO: 39792
  misc_feature (1481)..(1481): n is a, c, g, or t
  misc_feature (1515)..(1515): n is a, c, g, or t
  misc_feature (1573)..(1573): n is a, c, g, or t
  Genomic contig location: Contig_ID=SeqID_39792; Location=1..1580; Strand=+
  SCN-specific regions: Sequence locations=1-61,85-174,196-296,319 -845,867-1358,1380-1580
  Gene Ontology: Mol. function=ATP binding; Cellular component=nucleus

SEQ ID NO: 46607 - DNA, 1292 bp, Heterodera glycines
  Genomic contig location: Contig_ID=SeqID_101; Location=4086..5377; Strand=-
  SCN-specific regions: Sequence locations=1-491,513-594,616-944,968 -1177,1200-1292
  Gene Ontology: Mol. function=protein tyrosine phosphatase activity; Cellular component=integral to plasma membrane; Biological process =motor axon guidance
atgtccggcggtggaagtggacgccaaaataggggcaagacggaagcaccgcgacgcccaacccgaacgcagcagactcgtcagcccggcactcagcagcagcaaaggcgtccaacaccaacgcaggaacggagtgcgctcgcgcagccaactcttcgcagatgggaggacacggcagaattcttcttcgccctggaacgcttcgtcaacgacacaacgccgcgctccgtgcaggacctggtcagcgaattcaccgaactcaacgcagcgccacgaccggagccatcgcctgagtttacacggtgggttttggcgtcgttttcaatttgtgcatgtctaattttcccaattttcaattgcaggaacttggaatgcaaccgctaccgagatgtgatctgcacggaaatcaaccgggtgcgactccacagcggacgctacatccacgccaactggatcagcacgttcggcgagaaccgcttcatctgcactcaaggcccgctcgagacgacctgcgacgacttctggacaatgatcgtgcaggagaacatcgaaggcattgtgatgctctgcgacaccatcgaacaaaatcggatcaagtgtcatcagtactggccgaccgcggacaacaaggtggggtttgaaatttacccaatttaacaattaatcatttccccttccctcctagctcatgcgcttcgccaacaaccagatcattgtcaaattcgggcgcgaacaccacgtggaaggcgcgctctacaggacggacctcatcgttggagcaccgcagatgcgacagggccacttgcgcgttcaacacttccactggcgacaatggcccgaccgcggagtgccccacagcgacctggccccactgcgcctgctgtaccatgtgatcggcgtcccccgagcggttgtgcactgttcagctggtgagttaacggaaacaaaaacattgaaaaattaatcatttttcccattgcaggcatcggacgcactggaacgctcgtggcggtgtacttggccaaccaaacgctgcacctcggccagcctctcaacatcttcgctctcatccgtgacctccggcgccaacgatcgcaaagcatacagacactcgaccagtacctctacatttacttcgtgattcttcggtgggttttcaaattttcatcaaccagaaatgaaattttaattttttcagttatgcacaaaacaaggcgtcaaagctgaacatcaacgtgaacgcgctcaacgccctcgtgcaggcactgaactccaccatgcgacggggctga

SEQ ID NO: 46608 - DNA, 177 bp, Heterodera glycines
  Genomic contig location: Contig_ID=SeqID_39863; Location=789..965; Strand=-
  SCN-specific regions: Sequence locations=1-177
  Gene Ontology: Mol. function=structural constituent of ribosome; Cellular component=cytosolic small ribosomal subunit (sensu Eukarya); Biological process=locomotory behavior
aatacgcactgccgaaactctatcacaaattgcactattgtgtctcgtgtgccattcacagcaaagtcgtgcgcaatcgttcgcgtgaagcgcgtaaggaccgaaacccaccgccacgttttggccaacggtctgccgtcgatcgtccgcaacgtccggggggagcggcccctggag

SEQ ID NO: 46609 - DNA, 1035 bp, Heterodera glycines
  misc_feature (31)..(31): n is a, c, g, or t
  misc_feature (1016)..(1016): n is a, c, g, or t
  Genomic contig location: Contig_ID=SeqID_39908; Location=1..1035; Strand=-
  SCN-specific regions: Sequence locations=1-385,413-788,810-1035
  Gene Ontology: Mol. function=general RNA polymerase II transcription factor activity; Cellular component=transcription factor complex; Biological process=G1-specific transcription in mitotic cell cycle
ctgtttgtaatgcgggaactgcacaattganccggtcgagacggcactttggtcgccatggaatacatcgaggaatttccaccgctgctcaaccaaactgggatggcatcaaaaattaggaattactacaaaaaagtgggatatttttatcaaaaaaaaactgttttcatcttcttaactttgcttttcccctcagaaattgaccaaagaggaggaaaagcgtgagttcgaatttggcgagaccgctttctcccacacttcgccttttcttggcaatttgtcgccaaacgaatcgctgcaggccatcgagaacaacatgtacagagcaacaatcttccaacaccacccgatgggcacggactttctgttgatacggaacaaatacgggtgggaggaaggagaaagagcaatcggaaaaagggtttttaggctgttcatcagacaattcccggtactttttgtggtcggacagcaaatgccgctttacgaagttccgacgccaaattcgaagcgggcgaaagattttaacaaagactttatgatggtatgcaaaattacattagcactgtttcaaaaaacaaaaacggcattttaagagttacattttccgtcttttttggcaaagtgacgatttgccaaaacgcattcgaatggatgagatgaagcagatgtaccccgggcaagaggggctgatccgcaagaacttgaagcaatgtgccgaactgagacgcatggaagggcacgaatattgggtgggtttagggggggatgatttatcgaccggcacatttaaaaagtattgtgaatgaatgacaggactaatttggatccctgaaaatcaaaatgcaaaaatatacataaacgaaaagagggctaactgcaaacatttgaatttccaccggtcaggtgttacgggaagactatcgcctccccaacagagaggaggtgtccagcatggtcaccccggagatgtactgtgcctacgcgtcaatgctggccgcggaacaacggcttanagtcgcttttcgtttcaag

SEQ ID NO: 46610 - DNA, 531 bp, Heterodera glycines
  Genomic contig location: Contig_ID=SeqID_39924; Location=79..609; Strand=-
  SCN-specific regions: Sequence locations=1-115,137-444,466-531
  Gene Ontology: Mol. function=protein domain specific binding; Cellular component=cytoplasm; Biological process=protein targeting
atggtcgacgcagtgaaaaaggtgacaatttgattttggatacattcagcagcttctaatgcttttccttccttttcagttggtcagcatttgctccgaattgtcttataacaaaagacagttgctgtgggtggctttcaaaggtgcgatttcgtcagccgtggcgtgccctctgcgccatcgaacaacgcttctattcggatactgaggggcaacggctggtgcgcaacacattttttttagtgttttatcttttcattttcaggggttcaagtcctatcgcgaggagttggaatctgagctgcttgtcaattgccgtggagttttggtccgtttcatgccttcatttttgatatcaatccaaataccatcgcttttcaggagttcctcgactcaactctgattccaaatgcgacgaccaacctggaggccaaggtgttctacctcaagatgaagggcgactacagccgctacatttccgaaattgcgctgggcgaggacagaacgagtagggaatttgttttgatgtag

SEQ ID NO: 46611 - DNA, 926 bp, Heterodera glycines
  Genomic contig location: Contig_ID=SeqID_39971; Location=234..1159; Strand=+
  SCN-specific regions: Sequence locations=1-306,370-385,407-926
  Gene Ontology: Mol. function=glucosamine-fructose-6-phosphate aminotransferase (isomerizing) activity; Biological process=fructose 6-phosphate metabolism
cacgccgtggccccgtttcgctggtgctcgacgaaagttgcaccactgcgatggaaacgccaaacaaactcaacgcttccgacatgttcgcctctttcagcgctccttttaatggttgccattgggtttttcaaattacactcatttatcttttttagacacaataaattctacggcacgtaaaatcgaatgcagcgattcgacgcgaagtgttcggccatgcgactcggcaaactttgaggtggaatatttcgtggcgtcggatgcgaggtgaacattttgttgattccaattgcaacactcttttctccccctctctctttctctctcctctctctctttccttttctctctctctctctctctctcacacactccacttttctttcatctcttccccactctctgtcccatttattttctgtaaattcagcgccgtcattgagcacacgcgtcaggtgatctttctggaggacgacgacgtcgcatttgtcgaggacggcgctttgtccatccatcgcatcaaacgcagcgacgacaccgctgctttgacagaacagacgcgagaagtgcaacggttgaccatggaactgcagcagatcatgcgcggcgatttcaagacgttcatgcagaaggagattttcgagcagcccgactcagtggtgaacacaatgcgtggccgtgtgcacgaggacggacgcattgtgctgggagggatcaaagtgagtggcgacggtgagagacgcgtaaacaatgcccaccaccgatgtcaaggagtacacgaacgaccttcgccgttgccgtcgtctgatcatgatcgcctgcggcacttcgtaccattcggcattggcttgtcgtcagctgatggaggaactgaccgagctgccggtggtggtcgagttggccagcgacttcatcgatcgtga

SEQ ID NO: 46612 - DNA, 755 bp, Heterodera glycines
  Genomic contig location: Contig_ID=SeqID_39983; Location=73..827; Strand=+
  SCN-specific regions: Sequence locations=1-159,191-200,222-236,269-755
atgcgcggccagccgacagaacaaatgaaaatgaccgttttctaccgatattgggtgagttatattcggacaaacagcaaggagtatgagaaacaaacaaaggccgtattaatgacttttacccacattgtggaattttgacttttggttgtgtgcccgcatattaatattttttaaaaaggtacaaaaagggcgttggctgtgtaaaaaagggaatgttttggaccctttttgagttaaactaaaaataaaaatgttttattgtgagttgcaattcgcccgttttggatatgccaaaatggaagccatattcatgaaaacccataggaacacgttgtccaaaccattaaaaccaaaacctgagttcgctaaagattcgatggcaaaaattcattcattatttgatactttagtgtctgaaagaagccattatgaaggcgacagggcatggactcgtgaacgacttgagccgttttgatttcatcatcgatccaaatgaacgttataagcaaggtaagaaaagggaatgggcgactgaccaacgaaaagcgctttgcttaaaggcagtttcatcacatctacgaccttcacggaggacgcaattaagcagccccaatgggttttcgaagaatcatttgttgatgcgaatcacgtagccgcggtttgcagagaggtgatttaaaataaaatcattggaaccaaaataaacgaaaaaaatattttcagaaagctcatcccgcggtctgtacgtttag

SEQ ID NO: 46613 - DNA, 633 bp, Heterodera glycines
  Genomic contig location: Contig_ID=SeqID_8538; Location=745..1377; Strand=-
  SCN-specific regions: Sequence locations=1-111,134-633
  Gene Ontology: Mol. function=hydrogen-transporting ATPase activity, rotational mechanism; Cellular component=vacuolar membrane (sensu Fungi); Biological process=hydrogen transport
gtggacgacattgaatttctgtctgaacgtcttcacgcctcggtgcaggatttgagttcgtttgacgaatactgtgccgaggtccgatcgggcagactccagtggagtccggtgcataaattggagaaattctggcgcgaaaatgcacaacgcttcaatgaaaagaactttgaattgataaagtggattattacttttttttataaagcttataaataacaaaaacaaattctcagaatactcatcaaaattctcgagaccagcagcgacccattgccgctcagtgttgctgctcatgacattggcgaatacgtccggcattaccatcgcggaaaaacgtttatcctaccgcaaaatttcagaagaacaaaacaatttcattttatttagaattgtcgaacaataccaaggcaaacaagcagtgatgaagttgttgagtgcagaggacccaaacgttcggtaccacgctttgttaggtgagtagggataataagagaactatgcgtgtggccagataattaaacatctttttcagcaatccaaaagttaatggtgcacaattgggaatatcttggcaagcaaattgaaggactcgaaggggcaaaaggctctgcgggggaagaagcaaaggaa

SEQ ID NO: 46614 - DNA, 1060 bp, Heterodera glycines
  Genomic contig location: Contig_ID=SeqID_8539; Location=2244..3303; Strand=-
  SCN-specific regions: Sequence locations=1-839,861-1060
  Gene Ontology: Mol. function=chaperone activity; Cellular component =cytosol; Biological process=protein folding
tagatgattttgcgcattaatccgttaagggaattggacatcacaaaacgccgcgttgaaaaaataattaaatcgggtgccaacgttgttctgactaccggcggcatcgacgacctttgtttgaaagaatttgttgaggctggtgcgatcggagtgcgtcgctgtaaaaaggcggacttgaagcgcatagcgaaagcaaccggaggtatctttgatcaataaaaacggaagaattgcccgtttagcgacattgaccgcctcattggccactttggagggtgatgagcaatttgatgcgtcactgctcggcagtgctgacgaagtcgtacagactcgcatttcagacgacgaattaattttgatcaaaggaacgaagttgaaatcggctgcttccatcattctgcggtagattaggtattcatttgttttaataatttaatccctatttagtggggccaatgacatgatgttggaagagatggagcgcagtgttcatgatgtactttctgttgtcaaacgagttctcgaaggcaagaaacttgttgttggcggtggtgctgtcgagacagcattgaacgtttatttggagaattttgcattgaatttggtcagtgaaaatagtgcatttccctgcaacatactgtattacacaattgttgttcagactagccgtgaacaactcgccgtggccgcttttgccgattcattgctggtcatcccgaaaactctggccacaaatgcggcacaggatgccatttctctgcttgccaaactgcgtgccttccataatcgcagtcaaaccgacaaaaagttcgagcatatgaaatggtcatttttgcttttaattaatttttatctatgttattcgattttgaggtctggacttgatttggaggaaggcgctgtggcacagaatcgtgacgccggtgtttttgaaccgcttatcagcaaagtgaaaagtctcaagttcgcaacggaggcggcaatcacaatcttgcgcattgatgacttgatcaaactggacaaaatcgaaaagaaaccgcacgacgaagacgaatgt

SEQ ID NO: 46615 - DNA, 1263 bp, Heterodera glycines; identical to SEQ ID NO: 40102
  misc_feature (1158)..(1158): n is a, c, g, or t
  misc_feature (1166)..(1166): n is a, c, g, or t
  misc_feature (1208)..(1208): n is a, c, g, or t
  misc_feature (1219)..(1219): n is a, c, g, or t
  misc_feature (1239)..(1239): n is a, c, g, or t
  Genomic contig location: Contig_ID=SeqID_40102; Location=1..1263; Strand=+
  SCN-specific regions: Sequence locations=1-427,450-577,599-681,703 -711,733-886,908-913,937-1263
  Gene Ontology: Mol. function=signal transducer activity; Cellular component=intracellular; Biological process=muscle development

SEQ ID NO: 46616 - DNA, 548 bp, Heterodera glycines
  Genomic contig location: Contig_ID=SeqID_40112; Location=603..1150; Strand=+
  SCN-specific regions: Sequence locations=1-111,144-171,198-234,268 -348,370-498,530-548
  Gene Ontology: Mol. function=Hsp70/Hsp90 organizing protein activity; Cellular component=endoplasmic reticulum; Biological process=cell organization and biogenesis
atgaaaaaatcattcgtttcttttctgttttttacggcattgctcgtcattgtttgctcaaaagaggaggaagggggcgcaaaggaaaagaagtacggcacaatcattggtattgaccttggcaccacctactcctgtgttggcgtctacaaaaacggcagagtggagataatcgccaatgaccagggaaaccgaataacgccttcctacgtggctttcacaccagactcgggcgagcgtctgatcggagatgctgcaaaaaaccagttgactctaaacccggaaaacaccattttcgatgccaaacgactcattggacgggaattcaccgacaaaaccgtccaggacgatatgaaactttggccttttaaggttccgaaaagcacgaatatttaataagaaaaaactatttttagatctacaacaaggcaaacaagccccatgttcaagtgaaagtcggtaacgaggataagcaatttgcggcggaggaggtttctgctatggttctgacgaagatgaaggaaattgcggagtcttaccctcggtaa

SEQ ID NO: 46617 - DNA, 1985 bp, Heterodera glycines
  Genomic contig location: Contig_ID=SeqID_8569; Location=1864..3848; Strand=+
  SCN-specific regions: Sequence locations=1-312,374-427,449-657,682 -1780,1802-1985
  Gene Ontology: Mol. function=transporter activity; Cellular component= mitochondrial inner membrane; Biological process=transport
aaaattaatctcttccgttcttcactttccattcatgacttttcctcattaagtatgtccaggccggtttctttacgggtgtcgccacaagggcgattatacaaccattcgatgtgctcaaaatccgactacaggtggacttacacacacaatggctattgcagttcacacgaccataaaataattaaacaacgttcatgcttcataactttttctagaagcatccaaattaaacattcttagtgtcctttgacagcgctaacaataagtgtcctattcaaaatctttgttttctaaacatttttggccataactttagaaacaaaacgaaatttgaaaaagttatggcacattaaatttgccaaattattttatggtcgtgtaaactgcaataaagcccaatcaatgataaatgccaaaatatcatttaatttagcttcaagaagaacctttacgtgggaaaagtcgtggaaaatacagtggaatttttcaatctgccaaattgatttaccacgaagagggaatcgcagcattttggttcctaaaaactgtaattcgaattcccgcattttttaaggcgtggtcatatcccagcgcaaggcctctcaattgtctatggcaagtttatttagaattttgtaagttggaatgtattagttattaaatttaaattatttttatctggagggtaaactctctgacttattgttagccttgtggtgggacgacacccccccccaaccttcaaaaatctttttatggtcgattttttggtcttttctctttgctgattgtctcccattctttcggtctggtacagttttgcactttcgagctgctcaccaaacaggccggcgacttcggctttcacaatttctcaaaatcagtcgattttgtctgcggtgcctctgccggctgtgagttattttggcattttcgccgttcatttggaaaatggcgctcttttgaggtttggccaccacttgtgcaatgccttttgatgtcgttagaacgcgaatggtggcacaaggcgcccatcggacctaccgtaacatggcacacgcattcatcaaaacgtggcgttatgaagggccggcggggtatttccgcgggttggtcccttccctcgtgcaaattgcgccattcaccggtctgtcatgcccattcggaattcaaaggaatatttcaaaaatgcaggtctccaattcacattctacaacttggtcaatgtgtactgggacagcatttggcagggcgacagggaatccgtcggacgaattgtgtcgggatgggtggcggggatggcggccaaaacgataacggtgtgactgcttcacatttaatgcaaagggtggtcaaaaaggacccaaagcaacaatcaattgagaagggtatcgaaacattctcccatatgggcccaaattaaatgcaagtggcgcgcaattaaggcgacaaaaccaccattctttttcaaaaaacattgactttctttgttaattttcttttgtcagtatccgttcgatttggttcggcacagactgcaggtgaaccggcacattcgcaaggacacattcggccagaccacttccgacgggggcatgctgcgcacgtttgtgggcattgtcaaaagagaaaccgtctttggtaacacatttttttgtttaaaaagaaccccttttcccaacgcaaatcgaattgtcaagacctctaattagaaaaatacggagaggcgatcagagagtccttttttgcgatataaaaaaagttgctctaattttcaaattattttaaataatcttttgggggtaaggttttctcagagtgtattccttttttattttctaaactctttgaattcacataatttaggtctgttcaaaggtttgtcccccgcggtgctaaaggcagctgtccaatcgtcgttgtcattctttttttacgaattgatctgcgactttttgcgtactgttgcttgatcttcttgt

SEQ ID NO: 46618 - DNA, 711 bp, Heterodera glycines
  Genomic contig location: Contig_ID=SeqID_40160; Location=64..774; Strand=-
  SCN-specific regions: Sequence locations=1-555,577-601,623-659,681-711
  Gene Ontology: Biological process=chromosome segregation
atggtggtcaaagagtgggcaaagcgtcacggcatcaacgactcggcctgctcctccttcacatcgtactcgctggtgctgatggtcatccactatttgcagtgcggtgcacagccaccggtgctgcccaatctgcagcaaatgtacccgaaacggttcagcgtacgtgcggatgtgcgcacgctgaacgtgtcgttgccgttcgagccaattccaaccgcgatgggctggcagttcaaggacgacgcgacgctcagcgagttgctgctcggcttcctccgttactacgccttccaattcgagtgggactgattacacgaagggggaactcctcgggaaacttagggctttattgcggatatttgtgccgttgatgaattttagcgcccggttcagtccccgttttccccatcacccaccctcaattgttaacaactcattcaatagtgtgttattactgtccattcttttagctttgacgcggacgcgataagcattcgaatgggcaaaaaggtcaacagggcacaggtggcacaaaatcaagttggtttttattttctcatttgtcagtgtgttggggttggtcgaatgtgcctgataaatttccagtcgcccttcaacacgttgtcccaatggcattgcatttgcattgaggagcctttcacactgtcaaatgccgctcactctgtgtacgatgagcgcatcttccca

SEQ ID NO: 46619 - DNA, 4665 bp, Heterodera glycines
  Genomic contig location: Contig_ID=SeqID_8576; Location=173..4837; Strand=+
  SCN-specific regions: Sequence locations=1-362,390-761,784-789,811 -837,930-1064,1096-1267,1299-1517,1539-1819,1849-1915,1937-2623,2659 -2769,2791-2924,2946-3067,3091-3224,3246-3639,3661-4217,4239 -4323,4347-4665
  Gene Ontology: Mol. function=RNA binding
gaagcgtcgtcgattcgaaattcacgcgcattgacattcacgagttctggctgcagtctcacgttccgttgaaggtgattttgatggccttgaaatgacggaccgttcgttacgaatttattcgcttaattatgctttattacagggaaccaccaaaatccctcaatatgtcttcccggtgaaccaagtcatggccaataacaacgagttgcaaaggtggattaatatattgagaaaaatttacgatttctatgtaattggaaccaaaaaagggacaaaaacggtgccgaggggtgggggattccgatatcagcaacttgaacacaaaatcgtctccaatttctttaatttgttgctggtgtcatgctttttaattgattttccagttttctcctttcgctctgctgcaattggcaaattgtgacattggccccgggtttgccaacccccgtccgccaggctgccgaattggccaagcgcgggcgtgccaatttcaacgagctgaagcggtgagtctccctagccaatctaatcaattaacggtgataattaatccctccagcagtacgccaaaattcatcccgcgcgttgaggacaccgaccagattaattatactgtgctgaacaaccgcctctgttataacgggcatattttggcggacacgcgtttcaacgcttaagggttgatgagactgatcagtgagacggaacgggcggacgatcaaagggacggaaatgagaatcaaattcaattttggatgaaaatatttggaaaacacattcgtcatatttgtctgttctgttctttgccttaattcttcactttgctactttatcaattattgtttaaaaaataacaaaattaaaaaaatatatatggaaaatacacaaattcattaacctaattttttaaaaattaattttaaattcgttttcttcacaaaagcaaaagaagacacgaatggtcacattgtcaaaactagagtccggcgggggttttactggattcccgcccccgtaattttgacccaaatacgggagtaaaaatacactggtaagaattgtttttttttgttaaattaataattttttattgaaactctgtttatatatccaaaatttcaaaaaaaggtttcccgtcggcgcctatcggcaccaccgacccttataatccttaattctcttaaaaactggcttaaatttgcaaagattggtcatttttggacaaaatctgaacaatgtattgtgttcgaatattcaattgtttcccgggccgccctccctcctcctccctggtccctaaaaagttcttttcaaaaaatacgctgcaaagagttgttaaaattaataaagggagttgaaaaataatgttaataaattttttgttgaaataaattagagtgccagtttttttcatctgaaattctatacatacttaaatttcgataacaatagcagttcgtacaatacatttttttacaaaattaagcttatagcttgggccaaatctaacaagggaaccgtcagaactgtgtcagaaaatgcatgtatcataactatttgatagtgcagggccggctactctgaatttttaatgttagcggtgtgttgaagccgaatagaaaagttattggacctcaaaaatcaaaattttgactgtgttttccccttcagggaggtggtgaagtggggaaaattaaaaaaaaacggtggatcagtgggttaaattcctatttttcggaggtccaggttcgaacccaacatgaaaaaaatacattttaattaatgtgcaacaaagttaacgattaaaaaaaccattttttatttaaaaatatacataggtaataatttttctttagtgaaagtaaaccaaaagtcgactaaaaaagtgactgccccatggggcccaatcggcggggcccaaccggcggggcccaatcgacccccaccgggttttaggttctaaaaaagggaacgggtcgtttcggcgccgccgtttcggcgacgccgtttcggcgacagggtcgtttcggcgccaaaaaaaatttctgatttttaaggccctgcaacttttgaagcagacgaaatcccaagccaatcctatccctctcatttccaatgttatcgtgccatttcttcctattcacctctgttgcatatgccatccatttctcttattcccttttgtgtttttccgtcattacccctcatcctatccaaaagtccatccccattgtgccagtatataagtccatccaatttccccctcgggggctgcgagatgtctgcggtgggtcagtctgtgccattccttgcctttggcaatcctttcccaaataaccaattgcactgacccacccaaaatgctctgaggttgttgttgacccaaacatattcccggttttcaattcataattatttgtcaatgcttttccttataataaattcctctctcctaaaacggtaatttgaaatggctgaagccttaaacccggggacacaacataatccctagcccgaactcgaataaaaatcgaaatttttaatttttcaaattatgattttttgttcaaatttagattaggaaatcggaattgatcaaaataatttttcgtttcacatgttttaaaaaaattaaattattcataaatttattaagtatgaaattctatccattcttacaaaggcaataactcgtacaatagcagttcgtacaatacatttttttttacaaaattaagcttatagcttgggccaaatctaacaagggaaccgtcagaactgtgtcagaaaatgcatgtatcataactatttgatagtgcagggccggctactctgaatttttaatgttagcggtgtgttgaagccaaatagaaaagttattggacctcaaaaatcaaaattttcactgtgttttccccttcagggaaggtggtgaagtggggaaaattaaaaaaaacggtggatcagtgggttaaattcctatttttcggaggtccaggttcgaacccaacatgaaaaaaatacattttaattaatgtgcaacaaagttaacgattaaaaaaaccattttttattttaaaatatacataggtaataatttttctttagtgaaagtaaaccaaaagtcgactaaaaaagtgactgccccatggggcccaatcgtaccggggcccaatcggcggggcccaatcgacccccaccgacaagtgatggacggttttgatttttgtgttgccaatggcacagaaaggtcgttaattaacaatttattcataggcacattgaagaggaaagtcgaagtgacgagcagcaaaggcacgagaaaacggcggcgccgatgctaacgacggcaccagcgatggcggcggcacttccgtaagttagtggttcttgaaagaggagtaacgcgctaccgtttcccaccatagttaatcgtcgtttccctttttccaacggtagcagcgcgcgcattgttcggacgccacacattggcacaaatgcccgcgagaatggcaccgcctcattgtccgccatcactccaatcgctgccgcctttcgatggtgcactccgctggccaacacaccaactgtaaggtgcacttttgcatcttttttagcggagatggaggtcaatattttgaaataaaaattatttggctggcacaaattggggacaaaattttggaggttcaacagtaaatatttcgtggggtatttcacgaagggctaaaccaacgggatttagtcgtctcactttgcccttccgtacgccatgttttgtccatatttctgtccatgtcaatcctggtcatttcttcgtccaattgccctcccatccgacattttcgtcgcttgcgctgctcaaccaatatatgctcaccgtatacacgcacaatcagccgggcgttggggcaccaggcttggccaagccgtacgacggtaatttggacaaataatgttagggttcaagccaaacattgttcatcctgcctgtttcctttcagtcggcgtgctttgcgctgccccggcgtacaacggatggttccgcgccattactttggcatacgaccaggtggaaagcgttctccaatcaatcccattttaataatattttatcctgttcattgtcaggaccaggatgagatgttggtccgtttcgtcgattacggcggcttcgcccgtttgcctcgggcggatttgcgccaaattcggtcatttccccgggggtttttccagctaatgtcatcatctcttcccatttcagtactgactttgtgacccttcccctgcagggcatcgaatgctatttggccaatgtgcagccagctggtaattaattgtccctaattgccaattatttcttagggcattttacctttcctttccgttcagatggatctttgcattggagtgacaaggccaacgagttgttccagcagttgtgcgtgtccaaaatcattcaggcggcgctggtgggctattgcaaaacggacggaattccgtgcgttgagctttttgtgatggacagcgccaacaaaaaggtgggcatcagagggcaattgttgtttattgctcaacgaatgagtccgttactcctcaaaaatccaggggattctcgggcgaaaaccctggactctagcaaatccctagtgctaatggact

SEQ ID NO: 46620 - DNA, 669 bp, Heterodera glycines
  Genomic contig location: Contig_ID=SeqID_8577; Location=523..1191; Strand=+
  SCN-specific regions: Sequence locations=1-179,201-381,410-418,536-669
atgtggtgctgtgagacggtgatggaaatgacattggcattcaatcgttgtgttgagctgtcctcggcacgttgggctcgtctgcttttccagggcaaacgcatttacttgtggatgcttttcccgaccttatacggcttttactacttctggtacacccaaccgctgatttttagcggcattttcttctcatggttcttcaacccacatgttggatacattgacgattttggcaaaacggtgagtgccaatgtaactcaattttttttaattggcaaaacggtgagtgccaatgtgattaattggtaaaatcgtgaattttttttttttaattggcacaatagttgctaaaggaatatctatgtaatatatcaatttgtgaaataaacaaaaaatatattttttttttgatgggaagaatttattatttttttttagtattacgtaataaaatattaattaaaatttgttcatcaaatctgtatttgagaaaaaatatttaaatatattaaaaaaaatatttcaattatttaatccattagatagattaaattagaaaagtaaattcaaaattaaaatttacagttaaatttttgcctataaacttgaaaatatttttaatttttgttatttttcgaaagttgggaaaatataattaaagattataaa

SEQ ID NO: 46621 - DNA, 2267 bp, Heterodera glycines
  misc_feature (2021)..(2021): n is a, c, g, or t
  misc_feature (2233)..(2233): n is a, c, g, or t
  misc_feature (2244)..(2244): n is a, c, g, or t
  Genomic contig location: Contig_ID=SeqID_8593; Location=311..2577; Strand=+
  SCN-specific regions: Sequence locations=1-79,103-155,178-189,213 -254,277-297,340-344,366-366,494-695,719-845,867-1160,1182-1306,1329 -1375,1397-1436,1459-1779,1801-2204,2226-2267
  Gene Ontology: Mol. function=protein binding; Biological process =positive regulation of transcription
tcgttgctgcgaaaagaagagttgcggcaatcggaacgagacgcccagcgacccggtgatcatcgacaaatacttcctgaagttcttcctcaaatgcaaccaaaactgtcagttttaccgtacccataggggtggcatactgtaatcaaacacatttttgtaggcttaaaaaatgccggaaacccgcgggacatgcgccgcttccaggtggtactgtgtgccacgcctcgcgttgacgtcgacgttttagttggattttttaaaaaatttaaaaatgccgagcggggtttaaaatggaaaatttaattttttgaaaaaaatttctaattaaataattatggcgatcaattttgtaataattggagcatttataattaatcatatttttttagaattttaatatataaatcagtaaattttacatttttggaaaatttttgcattaaaaaaataaaaatttcgaaaaaataatataaaatttaaaaattaattagtgatatataagtacaatattataatttgtagtttttttctcgataaatattttgacctttttttaaatttatgttttcataccgtacaaataaattgtcgcaattttaatgcctaaaactgactccgaaaaacgcggatttgaagctaatccgaaacggaaatccccccgttttttcaaggcaatgtccgacaacatgttcgtgcacaacaattccaagcatggacgacgtggcaaacgcggcagcagtgaaccgtcgatggccgaaggtgaacaaaaaatatgcacattaaaaagtgatagaaagaattttgaccgtccaaaatttttacaaaaaatatgcctaaaaattctgaattttttatagaaatttcttatttacgagtcggaatattagaattcgggcactggctgctgtaggccctcctaacatagttaaaaatggaaatttgatatgttattggtgggcggtataaaactgtaaatttaatagtaaaaaaatgccatcatttaacctgtcgaatatggcatcattagagtgtttttaatcgaaaaatgccaaattcgctccttaacttcagaaaaaatgccatcattccttgagtcttattgatttggtgtctaaaaatggcattttcttcccaatcataattgtttcaagcccatcaaaaatgacatttttgcaatttgacatacaaaaatgctatccaagtcatcaaaaaaatatgccatatttttcaccccaaaaatgccgtcctcattttccccgccaaatgccgtgcgcatattactgtccaatccagaataacacccccaaaaatgccatgccatcattatcattcccatatccccctgtctccccgtcagaaatggcattggcaccctcctcctcatcctccaccgctccatcctcaacaactgccggtggtggcatcgcttcctcttcctcatccgtctcctcttcatccatagttggcacctgttcatcctcatccgccggtggcacaatgccgtccatcaaaatgatttttccgggcgaagtttggtgtcaaagtggtggcacggcgatgatcatcggcgaacagttccacgagggcatgcaagtgatggtcggcggtacggtcacttggcccgaggtgacgaaaaatagaggggatatggcacaaatgatggcatttgccatattttttttggaaaatttgtgccatctttttggctgccatttctatgattaaaaaaatcaactctttaaaaatttgtaaattttgtggtgaaattcaccgaacaaaattttttattttttatttcgcttatttcgttaatttttaactctcagtgaaattcattatttaaaaatgttgtggttagctaacaaaaagtttgttgttgcccccattataaagatggtcactgcccacgcgatcaaagtgaatgtgccggcccgggcaagtcccggcgccgtggacgtggtcgtctgctccccgaaggggcaaccaaaagtgcgctccaatgccatccgcttctcatnacgtttgtaagtgccaaaaataaacatttatagacttatggtaattaaagcagggcaaattccggcatttttggcagtgatcaaattccgaagaaaaaaaatgtattttgtaatttgtttggattgaaatgtttgtgattagaatttgatagcaaatttcacgggactgaattgaaacaaaaatgaaaaatgctaaaacttttcggtagttnaataccctganaacctttgggattttttttttgg

SEQ ID NO: 46622 - DNA, 658 bp, Heterodera glycines
  Genomic contig location: Contig_ID=SeqID_40254; Location=343..1000; Strand=+
  SCN-specific regions: Sequence locations=1-46,68-384,406-421,445 -475,502-658
  Gene Ontology: Mol. function=DNA-(apurinic or apyrimidinic site) lyase activity; Cellular component=cytosolic ribosome (sensu Eukarya); Biological process=protein biosynthesis
atgattcgcaaagccatccgtggaaatcttcaaaaattcccgttgcttgagaagctgttgccttacattgtcggcaacgtcggattcgttttcaccaacgaggatttgggtgatgtgcgcaaaaaactgttggagaacaaacgagtaacttttaaaatttaatgttccttcgagtcaatggatcagggttctgccagagttccctgttcgtccgtttgaaaaaatgtcggactcagttttagacaaaataactttttttcccaaaagccgtgttttagtcctatttttaactgttccttttgttggaaagtcagagagttccagccatagcattcctggttccgaaatttacaaaatcctttccaaattttacaaaaaaaagttaaataaagacaactaaatgtagggcgcgcctgcaaaggctggtgccattgcgccatgtgacgtgcgattgccgcctcaaaacagtggaatgggtccagagaagacgtccttcttccaagccttgcaaattccgaccaaaatttcgcgtggtaccatcgaaattctcaacgaggtccatctgatcaagactggggagaaagtcggcgcttccgagtcagccttgcttaacatgttgggcattcaaccgttttcctacggactggtcgttgagcag

SEQ ID NO: 46623 - DNA, 641 bp, Heterodera glycines
  Genomic contig location: Contig_ID=SeqID_8611; Location=67..707; Strand=+
  SCN-specific regions: Sequence locations=1-641
atggcttcggccgcgccgcccctcggcccttctttggggcagcgaggcgtaaacgtggcgaacttctgcaaggagtttaacaatttgacttcgactattcgatttggtgggttttcgcgtttgtgttttcctacatttgatttataaggtacaaatttgcctgtgtctatccacgtcaaaccggacagaacttacgaaattgacattagcactccgaccaccgagtggcttctgcaacaagcggcggggatacgacgtaaccggcaggaggaaggtgggaaattcaatcgctccgttctttccctggcaaaccctttcaatgcttttcaggagaaatcgtcggaatgatttcggtgaaacacgtatacgaaattgccaaagtcaaatctcaagacaaatctctcattggagtgccgttaaaagtaaagacagccaaaagacaaacttgggtaaattagccgatcttttagaaaatttgtcaattggtcattgagagagcggattcgattggcatcaaagtgcaaaatgaagatttagacccggaagaatataggaaattcctggaacatcgtcaggaagttgtgcaaagacaattggaggaaatagcgaagcaagaagaggccaaactggccagaacatga

SEQ ID NO: 46624 - DNA, 1048 bp, Heterodera glycines
  Genomic contig location: Contig_ID=SeqID_8613; Location=507..1554; Strand=-
  SCN-specific regions: Sequence locations=1-408,430-569,591-598,621 -1048
  Gene Ontology: Mol. function=transcription co-repressor activity; Cellular component=nucleus; Biological process=negative regulation of transcription
atgaacagttacaagagcaagcagatcattattggcagtggttaccaagttatgctgcccgagtgtaacaaaaaaataagaaaggacgataaaatcgacgaggaaagagacgaatgtttgtggtcgaagaatcaaggaaaattgggcgacacggaaattgttgagttttgtcgtgacgcattaaatcattatgggattggccctgatagggtcagtcggttgttgggataatacaaatatgcaaaaattacactaattttcaggcactttacatcttgctaaagtctgaccacaatctaaaaagagccaagtcggaattggctttaagaaacagtgtgaagaagcgcttttccgtagaagacgaattcgctttcagagaggcccacaaatgtttcggcaaaaacttcgccaaaatccaccaaatgctttcccacaaaaatttgtcagagctggtggaacattattacctcaccaaaaaacaacaaaactacaaaagctttatggacaatgaatgtggcaaaaatggaacatcggaaaggtgaaaaagtgcacagggaaaacacaaacatttaaaattttgtggattcaaaaataatacatttttcatttaatttaagtgacgaggagggacaaacgcaaatcaaatcggagctgcacagattaatttgcgagggttgccaaaacgaagtgctcaaattatacagtgccaatggacttgagctctgccgagcatgcaaaaattactttaagtaacgtttggaaatataaatgttttccctgcttcaaaatgttagtgcttttacagggcaaccaacaaacaccgcgtgtgcgctcagcccatcgaagaaaagaaacgaatcccaatttgtcctcctgaaatgaaaaatatcgcggaacaatttgaggagatggcgcgggtggtgatgggcgaacaatttgatgacatttccgatggattggacgaagtgcaagtggaacagaacaacgagaccatttgtgaacagaaaataaagtgagaaagcaaacgaagaatgggggggggaataaa

SEQ ID NO: 46625 - DNA, 757 bp, Heterodera glycines
  misc_feature (41)..(41): n is a, c, g, or t
  misc_feature (117)..(117): n is a, c, g, or t
  misc_feature (174)..(174): n is a, c, g, or t
  Genomic contig location: Contig_ID=SeqID_40308; Location=1..757; Strand=-
  SCN-specific regions: Sequence locations=1-2,24-53,75-81,104-303,325 -536,558-757
  Gene Ontology: Mol. function=catalytic activity; Cellular component =mitochondrion; Biological process=lipid metabolism
atttttagaaaatattatttgttatttgcaaaaataattanaatcaaacaatatttttattttcgatggaaccattcgataacggatatcaggaatggcatttcgagacccaaaatnttatcggaaatcgggattccaagaatactttcaataatgctttatctccgtccttgncatttcagtccaatttctgatcggtggcgatggtccaaaacgagtggacattgaggaaatgcgagaacggtgtcggttgcacgaacgcgtcaaaacgttgggcacaattccccaattctctctgatcaaatttttctggtgctttttcattctaaatttacttttgtgttaagtcttcatgtggtgtctactcgcgttggaggaattcccgaagttttgccgccggaattcatctctttggtcgacccaaatccaaaaggtattgtccaattttttatgaaattacacagtatcaaatactattgtagattggttcatgtttaccgtagccaaatttaaattaggttgttcccattgaatttaacaataatttttggttcttcgatcattatttgactcatttataatccaaatactttatacagcaattgcagttggtcttttggatgccatccgtcggcgtgagaatggcgaattgccgtgcccggtgaagaagcatcgacaggtggccgaaatgtacaattgggcggacattgcgcagtggacggaacgcgtttatggcaattcgatggaagagccggag

SEQ ID NO: 46626 - DNA, 872 bp, Heterodera glycines
  misc_feature (23)..(23): n is a, c, g, or t
  Genomic contig location: Contig_ID=SeqID_40370; Location=24..895; Strand=-
  SCN-specific regions: Sequence locations=1-53,81-130,155-397,420 -752,774-827,849-872
ggttttcccaccagcagcttgancccatgcacaagtctcgaccaaagctgtggttcagcactttaaaaatgtttttccttccagacatcgtggggaattgtccatccacgagaagtatcggtacgatctcagccgtgcccagctgaaggcttcttcgcggacttccgctctgcttgccggcttcgccatggtccgtttggcctaccgcttccttttgatgcccattctcagatcgctctcgtcgagctgcagtaccaagagtcgacccccaagccgttgctgatcatgctcggcgtggtcacttctctgctcgtctccgtccacctgctcgctctgatgatgtccacctgtctgttgccgtacatcggtgcctttcattgggcgcttcgatggcattgccaaaattggcactttcagaggccaacggatgcactcaggactcccctcacataaaactgcgcttttacatcgaactttcctggctgttttccacgtgcattggccttcttctctttctgttggaaatcggtgtcatttttttcgtcaaattcaattcaattggctacacttttgccgcttacattacgacgggaatgttgggtgagtgaacggacggacggcacaaattaatggcaaaacccgaaaataataacagccaaaggccatttgtcccaccgctaatcacttttggtcattttacagttcccgtggtcattgtgttcatcatcatttcttatttgattcatcgcaatcggtacaaaaacaatttcccagggaagcagccgaaatcattgatttaaaaatcggaatcactgcccaaaaacttaaacaaaaaggaatttaatcttaagaataaatcgaaattgtttatt

SEQ ID NO: 46627 - DNA, 1194 bp, Heterodera glycines
  misc_feature (12)..(12): n is a, c, g, or t
  Genomic contig location: Contig_ID=SeqID_8653; Location=124..1317; Strand=-
  SCN-specific regions: Sequence locations=1-439,481-495,517-548,571 -1194
  Gene Ontology: Biological process=carbohydrate metabolism
ctctttccaagnccaagatgttttcgagtgcaaactccgctcagaaagcggagtggtcgtcaaagtgatcagcttcggtgcaattatccgcgattggctggtgccaacgcctcaggatcagctgcggtcggtggtcctcggatttgacagtttagagaattacgtcgagcacagccctttcttcggtgccattgtgggaagagtggcgaatcgaatcggaagagcgaggttaaaaagcagagtgatcagcagcagagcaggatggaaatgagcagccaccaacaaaagtcatttagattcacggttgatggaaaggaatttttgctgacaccgaacgaagggaaaaaccaattgcacggggggacagagacatttgggagaaaagtacgggggggggcaatggcaaattaaaaggaagtaattaatctcaatgtatgactttaaataataatattaaattaaaattttaaataaaaataagttaatgtcaatcaaaagcattatttgtaaattttcacggggaccaatgactttggatgagaaagcaaaagctcaacaaaggtgtggaagatggaaccgttgtgtgacaatgccgcggccaaatggccctcgggcgtccgtctctctttggaaagtgccgacggagagggcaccttccccggaaatttgcgagtgtccgtcacttatcggctgaccgcaaataaattacgaatggtgagaaaatggagacaaggctaaaaaatgacgaggagggatgaacggacattcacttttttgcaaaaattcaaccgaaaaaggggggcgaactgtgccactgataatctgagtatttggccaggacattgaggccacttcggatttgccctgtcctgtgaatatcgtccagcacaattatttcaatttgtctggccacggggacatccgcgaacattcgctgaaattggccgccgattgggcgagtgatttgcccatttcaaatccattttaaaccatttcctttagttcacgccgacttcttctgatcagattccaaccggagaaatactcaccgtttcaggcacagaattcgactttcgggaagagaaaaaactccaaacgaaagacggaaaaccgattgaattggatcataattttgtacttaccaagggaaaaggaacggacgcacaaattgcagcagttttgagagctccggac

SEQ ID NO: 46628 - DNA, 658 bp, Heterodera glycines
  misc_feature (123)..(123): n is a, c, g, or t
  misc_feature (155)..(155): n is a, c, g, or t
  Genomic contig location: Contig_ID=SeqID_40507; Location=218..875; Strand=-
  SCN-specific regions: Sequence locations=1-159,195-524,634-658
  Gene Ontology: Mol. function=zinc ion binding; Cellular component =nucleus; Biological process=intracellular protein transport
atgatttccgaaaaccgcgaaggaaaaatgtgctctgctcgtcaaatatgtgtccaactcgcccgctatgaccgttcttatgacatccgagacagatgccgttttctgcgcaatttttggttngacaaagaccaaaattcagtgagtttaaattntctcatataaatgttaaattaaaatattttatttattttcagttaaaatttcctttggacattttcctgcaagaacgtcctgcgcctgctgtgaataattctttcactgatcgggctgagcatttccaattgggcactctttctcacctgctcaaccaggcgaaaattatgattattagcttacactgatagaatccattcatttatttggtttattaattagttttttttcaacatttagaaatgcaatggttacactgaacttcctgactttccgtcggaacagcccgacccaaccattcgacgttcggcataccctttgccaagcgacggtatcgtacaaggaacggaaattgcaatggacgaagcggaggaggaggaggatgactcattggatgaagaggaaagtgaagaggaagatgaggaagaagacgaggaggaggacgaagacgaggaggaggaagaagaggaggaggagagcgagggagaaaaagtaccggatg

SEQ ID NO: 46629 - DNA, 1902 bp, Heterodera glycines
  Genomic contig location: Contig_ID=SeqID_8678; Location=2186..4087; Strand=+
  SCN-specific regions: Sequence locations=1-377,399-1073,1109 -1270,1292-1808,1833-1902
  Gene Ontology: Cellular component=cytoplasm; Biological process=post -Golgi transport
aacaaatttgaagaggaaattggaagtttacaactgctctctgaccaattccaagtttggttttccgatttggcgaactcccgttagaatggccaatgaattggccattcattcagagcaaattgaacacactcgagcagcagcaaaacaaagacaaaaccgactatttggactctctgcagcgattgcatgacaaaaatggcgactctcttgaccaattgaaagtttgtatcgcttatttttgttcatttcggttcctctaataattctcaaatttgacaattttcagcaactcgacctcacaatgcaaacggtggccgcaagggtcgtccatttgggtgaccaactcgaaagtgttcgagccttttcctcccgtcttttttccacttaattttttaggtccatgagccgcgtgctcgcgcgtttgaagccttgcaactgatgcggcactttgatgaattcttggcggatcagccactgaattcggcgcttttcacagacccggacagagtcattaaaagaaacaaaacaaaaataacaatttaaaaaaaattggttacaattatgctaatttaaatgaaaccatttgtttaagctgctcgagtcggcggaagtaatcgcaaaattggcctcaatcgcacaggaattggacaagaccaaatttgctgcagttcaattacgaatcgcgcacaaatacgatgaaattgagcaacttttgattgaggaatttgtccgatcgcatgacagaaaaagaatgcgcgaaattgcgatgattctttcggaattcaaaggttttccgacgaaaattacacaaacattttgaaattgtcatccaaattgtgaaggattttcgcgttgtgtggacgcattcgttgaacggatacaatcggttggcccacgttcccccaatgtcttcgaggacatccaaaatttgtgtgaccgcgctaaacccatcattatggagattttcttgagttcgcaatttgttgtctccaaattgctgttgaatgttttccatgggaaattgcaggtgaaaaaacggaaaaggaaggggaaaaggaaaaacgaataggaaatttattaaattaaattaaaaaatgaatttaatgacgaccgaatcgggctctttttaggaagcagttgtggcgacattggaggagaacaaaggcaacccggagcagtacctggccaatttacatgagctttacctaaagtatcattgtcgttttggaaaaagtcgatttccctttttgaatttaggacacacaaattgctgggccttctgcaggagaaattccgcacgaattcgttggacccccaatttttgccgacgctcactcagtcggtgttcggcccctatttggtcacatatgcaaaaattgagcacaaattcatcgccgacaaatgcacttttacgctccgaaagttctacgagtccaaagggcaccaaaaacggagtattctctcgagcgggtgggcatgcaaagcacaccccaaacacacggacatcatttcgaattcagacttcaagaactcaagtcgcgtctgctgacagcggaggattttggtggcgaaacttttctttccgaaatcatagcgataaacattctgcaggagtttaagaatgccttcgcccgctgttcatcggtacaatttattttattccaacttttatcccccccccctcccggtaaagagcagataaacatgtagaaatggaaattctaacaaaaaataagtcaattttgggacaacaatgggaatttcgcaacgggataatctcggaatggtggtgtagtccctcaaacagtttctattttcacttaatttttagctttgcaaaaaaacggagtctcttgaactgaacacagtgctttttgacatgcttctcaaatttctgta

SEQ ID NO: 46630 - DNA, 1217 bp, Heterodera glycines
  Genomic contig location: Contig_ID=SeqID_8690; Location=1..1217; Strand=-
  SCN-specific regions: Sequence locations=1-1217
  Gene Ontology: Mol. function=LRR-domain binding
atgagttcgtattcgtcctctcggcgtcgtgcgccggccagttccttcatggaggagcatgtgctcgacaggatatcccgcgaggcaataaattatcacttttccccctttttgcacattttcaacataatgggctcaataaaaatgtgaaggttttgcaaattcccatggggttggttccaaaagaaagaatgtttcggcagattttctatagcaatggcaaatcgacaagaaaagttcgacttattttttatttctaacttccgttttattaggccgaagagcgctccaacaaaaagcgccaggcgcgcgacgaagcgcgccaaattcgcatggattgtcttgagaagtcaataaaagcgggtgaccaaaaagactaccatttgttggccgacaatgacaatttggtgggtgaggagaagcaaatgaattatttaaatatgggtttcgaattacgaattattattttagcctataaattcttaggaaaaggtgaccgaattggaaaacaaataccaacgggcgatgttgctgtacacacaattggacaacgaaaaatcggcacttctctacgagattgacttgctcaaggacgaaatggaggagaaggacgtgacagtttttcaggttttaccaaacttttgcttcattccctttagtttttaaggtttcaaaagagaatcgcgagatcagcgaggagttgaaactgctcagaaagaccgtcgaggcactccaactgcagcaccagcagatgaaaagcgaaatatcgcaaagagatcgactgattcacgtgggaaaattacgagttggaaattcggctcgaaattggtcactattttcaggagaatggcttcgtcattgccgagcaggaccctaacgacgatttgctacagccaccggcggtgcccagcaattcgaacggatccaccggtagccaatcaacaaacaatgcgccgtaagtcgtcggccgatattttgcatttgcctttctctgtcagcaaattcgaccccattttgttgtcccacgtgactttgtcggccattgaaaaggcactgcccggcacttcgtcggtagaccaaaaggttcaaaggctggtcgaatccaatcggaagttgcgcaaccaaattgacgaaacggagaaggcattgtacaaccacagaagacgccaaaatgaaaaacacaacgccacaggaagcacaagcagtgacgaattagt

SEQ ID NO: 46631 - DNA, 763 bp, Heterodera glycines
  Genomic contig location: Contig_ID=SeqID_8699; Location=55..817; Strand=-
  SCN-specific regions: Sequence locations=1-125,147-688,718-763
  Gene Ontology: Mol. function=casein kinase I activity; Cellular component=endoplasmic reticulum; Biological process=endocytosis
atgtcattgaccggacgtgggctttacagtctcctgaagaaggcgggcggaatgttcagccctgggacagcgattggcgtgtcgattcagctactccacgcactgaagacgctgcacagcatcggctaccttcacttggacatcaaaccggagaacgccgcaattggacgacgggaaaccaatgagcgccaacggatcttcttaatcgactttggacttgcgcgccgattcatcagcagcaaaaccgtgagatcgctccccccccccccccaatcatttttttaagaacttatgattttttgttttttcacagggtaaacatagacggcagaggaaaaagacgcactttcgtgggacgccgatgtacgcatcgatctcagcgcatgcgagaagcgactactgccgaggagacgacatcgagtcctggttctacatgctggtcgacatgtacaccggttcactgccatggagccgtgtgaggagcgagcaccgggtgagtgggaggagggcacttggacatttttgagtatatttcatacattttcagacaggtaaaatgaaaagacgccgtctaagccacaaatcggaagtgcgacgaaaggccctgtccgacctgttgcagggatgcccggcacagctgggcccaatcttggaacacattgtgggttattcacacacgcttatccgattatgcccacttcaatttccccctcttttcaggaccgcctggatttttacgaccgacccaactacgaatggatag

SEQ ID NO: 46632 - DNA, 400 bp, Heterodera glycines
  Genomic contig location: Contig_ID=SeqID_8714; Location=2120..2519; Strand=-
  SCN-specific regions: Sequence locations=1-400
agttgtggtgctgacgttggacaaaagcccatgtgttgatgcgggatcagtgcaaaaacattgcccaagtgttgtgggacatgtcgttggcaaagacttcgtcggtcaaaagcaatgaaagcaaagggcgaaagagaggcgtggaccgtagcaaattggagccgagtggaaagggaaaaaaggcatacctcttcgatttgaccggtttaatcgcacattttagggtggtcttccgatgtcgccgcagacacgcatttgcatcattcgcgacagtgatgggttaattcaaaaaaacaaaaaaatatattcactttatcagtgtgtctttaagggtggactatgtgattcgtgcaggcattcgcgcaactttgctggaagtgaacgaagacatggttgacaa

SEQ ID NO: 46633 - DNA, 1072 bp, Heterodera glycines
  misc_feature (980)..(980): n is a, c, g, or t
  misc_feature (1025)..(1025): n is a, c, g, or t
  misc_feature (1046)..(1046): n is a, c, g, or t
  misc_feature (1065)..(1066): n is a, c, g, or t
  Genomic contig location: Contig_ID=SeqID_40717; Location=229..1300; Strand=+
  SCN-specific regions: Sequence locations=1-599,622-632,655-813,836 -870,893-1072
atggacggtctagcattggacattgcacggaaattggaggtgaagcccgcccggtacgctgtgcgaaagacaatgatgaagtcgttgttcattagtcagggacgatttgaatttaatgcgaatctgtttatggaccaaatcccccgtcggataacgttgggtcttgttgcaaactctgactatgtcggagatcctcggcgtagtccttttaacttccaaccattcaatgtgcgtgagatttccatagttgccaacggcagagcattcccgcaggctccgtactctttggactacccacggggaaaatatgtccgagcattcaacgacatgaacgaggctgtaggcttcagcaacacaacagaaggtaacggcataataatttggtacaacccattgtatctacgttttcaatatgaccaacagtggagatgatcaacccgggctttttgacttgatcaggaatggaacaacagctgtgagcattaaattcaatgagggcgtgcccatcggaggaattgtactggttgtgatgggagagtgtgatgctctagtgatgctggataaaaacagatcgatttcaactgacaccaccatttaagttttttcataagaaataaacatgaagaactcactttcttttgccgttgttttgttgatcgttctaattcaacaccaaaccctaactctcattgttgaggagggagtaaagccagaaaatattcctcactataacgaatgggcgaaacagcttgggcttaaagctaatttaaacaagacaacaaaaaccaagaatggtgtggcagcatcaactgtaaaaactacaactgtaaaaacaaaagtgggcacaacatcatcaaacagtactaccaaaggcacaccacccaaagctgcaaaacaattttcagatttaaatgcccctgtttcaatttttccgggaattcaactgtgtaaggacatgccagctgctgataattacatgnggcacatcttctgctgggctgtgtttgcactttatgctatgatgnatgtatctctgatcatttatncattacgctcgatactttnnggataa

SEQ ID NO: 46634 - DNA, 569 bp, Heterodera glycines
  Genomic contig location: Contig_ID=SeqID_8722; Location=3427..3995; Strand=+
  SCN-specific regions: Sequence locations=1-238,262-365,387-396,419-569
  Gene Ontology: Mol. function=tubulin binding; Cellular component =cytoplasm; Biological process=cell organization and biogenesis
atgtcggtgccagcaacgtccgcaaaaccgatggtcatcgacatcagttcactttccatcgatgaattgtccgttttgcagcaacaattcgacgcagaattggcattcttcaatgattcactgaacgagttgagaaatgtcgccgcaaaattcggccgatgtcaggcgacgttggattccatcagtccgaaggaattaaacaaatcagcgctggttccgctctcagaatcggtacctattttatatttttgaattttatttgtcattatttcctaatacaggtttatgtcagagccaaaatgactgatccggacaaatatttggttgaaattggcaccgggtattttgttgagatgaaccgtcagcaatcatcagaatattttaaacggtgaataattttctgggaaattttttctttcctttagttaaataacaaattcaggaaatatgcctttttggaatcgcaagttgagacgataagccgtaaaataattccggaaaagcaacaggcgcgtcaaacgattgtggcagctctgcagaagaaagtgcaacttgccacttcgaaatag

SEQ ID NO: 46635 - DNA, 3092 bp, Heterodera glycines
  misc_feature (95)..(95): n is a, c, g, or t
  Genomic contig location: Contig_ID=SeqID_8744; Location=3907..6998; Strand=-
  SCN-specific regions: Sequence locations=1-607,629-1109,1131 -1685,1710-2029,2051-2211,2235-2971,3001-3092
  Gene Ontology: Mol. function=inositol/phosphatidylinositol kinase activity; Cellular component=1-phosphatidylinositol 3-kinase complex; Biological process=germ-cell development
gggcccgcgggaagcagtgcggacatgtctcgagtgcacagaatgtcttcgggtaaggcgaacaggaaaatgccgggacgtatggtcaggggttntaggccgtgatctttcccgcttggccatcaatttggaccaattgcgtcgcttttggacggtccaaccactgctctcgcgtgaggattggcttcagtgggttggcactttgcgcaaccaattcatccgtcagagtccgtcgtccgcacttcgcgcctgcgctgtgttggccgaaatgtgcgaatcactctcaaagtccgttctttttccccttacttttctatttttaatgaaataatttacagggaattattcaatgccgcttttatgtccgtttggactgaactgccggagcgggaacagaacgaactgaccaatcagctgatcgatgtgttgaggcactgcccccatgccgaacccattcagaccatactgaatttggccgaattcatggaccattctgagaaggcaataaacaaagcgcagtaaaaaaaaaatttttttttgtttgtttattctttaagggacctcttccaattaaacatcgaatgctcagcgaatcggcggagaagacacgtgcatacgcaaaagcactgcgttacaaagaaatggaaattttgagcacccgcggcaacggagaaccgaacgcggatgactgtcaaacgatgataatgctattcaacaaattaaatctggaagaaggcgccgccggcattgttcagtatgccaaacgtcacaacatggaaatatcggtaagtcgtgactttcttttctcaacatgagttttaatgccttttttcgttgctcaccgattcaactgtttttagggtcgttggtacgaaaaattaggcgaatgggaaaaggcgttggagatgtatcagaacgacatgaccaccttgcccgacgaacaactatcatggaaatctatttcgtcacacagtgaaccccaattgctcccgactaacagagaggagttggaccagtccaaacccactgcaaacgcaggactcggtgatgatgccgccgtttccgccagtgcttccacgaatcgaattgcgacaccgcagcaacaaaacggagtacaaacacacggattttatgttatttttcaagcattctcctgactatttagtcttctcgctccgatcttttgctgcaccaaatgcgctgtttggaggcgctcggtcagtggagtcagttggaccgcatttgtgagacagcactcgccgaggaggaaagcaaccagtacaaccccaacttcaacatcgccacagagaagcagcagccgcagcgacaattgttacggaaacggtcgagcaggagaagcggagcccgactccctcaactacacgccctcaggcaaccgacaccgttggtggacgcagtcgccgccgaatttctgaacgcaacgctaagcgaagtggcaaagcgacagaaaattgcgacgataggagcccggggctgttgggcagtcggtacttttttgaagcccccaggaattggaaaaaaaaaattttgcaggaaatttcaagaaaatggaagattatgttgacaaaatcaatgagaacaaccgcgacggcgcctttctccgcgctgtccttgctgtgcataacaacgacttcgacaaggcatactcctgcataaataaggtgattttttaaacaaattatgaaaaatagcgaatttttaaagacccatcaagatctaaattcaagttcaaaaaaaccaatttaatttcaagttcataataatttatctcacaaatacaaaaggtcagagatatgtttgactcggaattgaccgcaatggcagcagagagttatgagcgcgcttacggagcaatggttttgctgcaagaactgaccgagctcgaggaggccatcgagtacaaaatgatccccgagcgcgaaatgcgtatcgctcttttgtggagccgacggttgcaaggatgcagacgaaatgttgaacattggaggcgcattttgatggtcaggtaggaaaaacaaaatgcttaaactcacttggatttgggtttaaccaggtcgatcgtcttttctcaaactgagttgcgccctctttggataaaatttgcggcactttgtcgttatgaggggaggcaggtgaccgtatctcgcaatgtcatccgttctttgttggaagtgccgccggacactccgttggagaaagtgccaatcccattgccattagagaaaacacagttggcactggcactttgcaaacaattatgggttgacagccaccgtcgaacggctttagttcaattggaacagctcacgcaggcaaaaacggacgatttttttttcatttcgtctattcctttagactttgcatcgatgtattgagcgcaatcgcacaatgctcacccgcgaacagcttgaaccacacgcaagactgaccgcgaaatgctaccttaagttgggtgaatggcacgactcaatcaccgccatccaatcgccgctgggtttgtttctgatcaacattaatttcccaatcataaaacaaagaattgttgacaacctaagactcgagcatgtgtttttcaattgcagtctcgactagcacaccaccgatcgcgggtcgtcacggctctatcagccttcactcgggtgctccttctgccgcactttctactgctcaaattgaacaacaacacaagcaggtgagctgtaaaaagcaaaattacaatcgtataaatatattaaatacgaatatgttgctctaaattaatgtttccattaaattttcagctttttgcttggtccgccacagttcagcaacacccgactgctatgttcacgccctctccaattggaacttatttcactgggatggaccagtcgggagcaaagaaactgattcttcaatgttacatcaacgcgaccaactttgaccccaactggtacaaggtgttgtgctgcttgcatttgtgcttttcctttattttttcatttaataggcttggcatcgtctggcaacaacatattacaacatgataatggccgaccggcaacagcgttccgtcacaatttcgccagcca

SEQ ID NO: 46636 - DNA, 1192 bp, Heterodera glycines
  misc_feature (104)..(104): n is a, c, g, or t
  misc_feature (141)..(141): n is a, c, g, or t
  misc_feature (161)..(161): n is a, c, g, or t
  misc_feature (942)..(942): n is a, c, g, or t
  Genomic contig location: Contig_ID=SeqID_40843; Location=689..1880; Strand=-
  SCN-specific regions: Sequence locations=23-390,412-913,939-1192
  Gene Ontology: Mol. function=phosphofructokinase activity; Cellular component=6-phosphofructokinase complex; Biological process=glucose metabolism
aaaataaataaatatttattttcgtcatttaggatcggacacggctatcaatgccatctgcaaatggtggacaccataaaccaatcgccaatgggtccaaacgncgtgttttctcatcgagacgatgggagggcactgcgnctatttggccacggtgtcgnccatcgccacgggggcggacaatgcgtacattttcgaggagaaattcacggtggacggtgggtaatccgtgaattctttttggtcaattttgtattttacagacattaaagaggacgtcaaagtgatcagtcagaaaatgcaaaagggggtgcaacgttatttgatagtgcagtcggagggcgccagccataattacgacaccacttttgtacaaaagttattcagcgaagagggcaagggagaggcaagtgctattaatgtaattttgttttttgagggcaaccagggcctttccaacggaggctacagtcggtggtgtcccccccctcgaaagccgaaaatataattaagaaatgtaccagaatttccttaacccataaaattgccatttttggcaaatcttttaataaatcacacagtcgttcgttgggtgttttcgacttctattgcgtttgtatgtaaaaaaataggataggaaggagttggtgagaaaatcagtgttctgttatcctctcccaaccttgccttgccttttagttcagcactcggatcaacattcttggccaccctcaacagggaggcaagccaactccattcgaccgcaacgatgggcacaaagttaggcgcccgtgcgttgaaccatcttatcacacagatcaacgctaacttcgacaaaactacggaaagatgcaacgcggacaaacccgatactgccactttgctcggttagtttctaatgaatagtgtcgtggttttctgtccttttcctttttgttccgnaaattggatgtccttcagtcggttaactgattgtgagctttcttttcctcattttcggtctgatcggtcgtgaagtcgtcttctctccgctggaagagctcgccgctgagaccgattttgagcatcgtttgcccctcaaacaatggtggctgaaattccgtcctctcctgcgcattttggcaaagcatcgtgcttcttacgtccaagaagcaacttaaaagccagcggagagaatgagaaggaagcgaat

SEQ ID NO: 46637 - DNA, 561 bp, Heterodera glycines
  Genomic contig location: Contig_ID=SeqID_40878; Location=1..561; Strand=+
  SCN-specific regions: Sequence locations=1-59,103-257,279-561
  Gene Ontology: Mol. function=structural constituent of cuticle; Cellular component=extracellular; Biological process=cuticle biosynthesis (sensu Nematoda)
caaacgcgccatgcgagcccacgacgcctcccccgtgcaaaccatgcccgcagggaccgcccggccctccaggaccacccgggtcacctggtgaccctggcgaggccggcacacctggacgaccaggaacagacgcatctccaggatctccagggccgcgaggaccacccgggcctcccggcgaacctggaccacaaggaccacctggcgagcccggagtgcccgcgcagagtgaaccgcttgtgccgggagaacccggagagcaaggagaccaaggtaaaatgctactaattgattgggtgatcatggtaatgctgctttgccaacactttaggaccgcccggaccccccggtccgccagggtcccctggcgccgatggcccacccggtccgccaggcccaaagggcgagccggggccggatggactgcccgggcaggacggacaacccgggccctcgggaccacccggacccagtggaacgccgggcgagaaaggcatttgtccaaaatactgtgccatcgacggcggagtgttcttcgaggatggcacgcggcgataa

SEQ ID NO: 46638 - DNA, 2670 bp, Heterodera glycines
  misc_feature (40)..(40): n is a, c, g, or t
  misc_feature (91)..(91): n is a, c, g, or t
  misc_feature (97)..(97): n is a, c, g, or t
  Genomic contig location: Contig_ID=SeqID_8761; Location=1..2670; Strand=-
  SCN-specific regions: Sequence locations=1-768,790-1227,1252 -1352,1375-1635,1658-1672,1695-1718,1740-2246,2275-2461,2499-2670
  Gene Ontology: Mol. function=polyphosphoinositide phosphatase activity; Cellular component=membrane; Biological process=cellular morphogenesis during conjugation with cellular fusion
gactccctcacattttgctgaccaaatgtcctccgcgcancctccaaaaaatcgaagaaaacatttctcatttcactgcccaaactttcgnccggancgcgcgaatgcttttgcagcatggcgtcgttcgttcgaattgcgtggactgttggaccggacaaatgtcgtccaattcggaatcggttggatttcctttccatttgggtgtgttgcgtcgagccttttatctgttaataccacttaaatttcatacacgtgactacattaggcttttccttgtaagggaaggtggcacttggctggcaactttactccatgggctttttggctttgccatggtcgttgcagcttcacagtgaggtgtgccgtgtttttgaggaaatgttcgatgagcacggcaacactttggcatggcaatatgccggttctcaattggtccattccataaaaacgtacaaaaggacagccgtttttcaggtacggaaaggcaagcgaatggttttaattattctccaaatttgttattaaaggaaagaagtcgagatgtgttccaaacaatttcgcgctattacagcaacactttcggcgactttgagaagcaggacggactgaaccttttcctgggcattttccggtgagtttttcttttcccctcggcattttgcttcaacgaatgactaatttagctttaaacacaatgaattacttttgagtgacactggcttttcctttggtgtcttttcgcttttggcttcgttttgcttttcgtccctttctttctctcgtcgttctctacgctttcttcgtctccatcatcgtcgcttttgtctgacattgttggtacgtgctgaacaaagtctaaaagcgacggacggaacattttgcttccgactgtcagtgattggtccatcggtctcaccagcatttgctcgtgcagttgcatcagtctttgcgcgtatcccacttgacacgcttccattgccgggctcatcgccagtgcgtcctcatccgtcgctgaaccatccgtccaatctttcatttccaaaaatgtacttacgactgatgaacagattggccgccgccctcggcttttcgtgccgtttgtttcccgccatatgtctgtccgcaagcaatgcgaatggcgcaaccgctgaacgttttccccaaccatcggagaaagtcatctgggaatgggccactacgacggcaaaggcgaagaagcaaaatgttgggaggagaaggagggagggcatttgcttattgcgcaggaaaaaaagtcggaatggatttgagagggcgctaaaagttttcgactgcaaaatgaaactctttcagacaagaaattaaccaagctgtgagcaattatttttatttggttggatgcgttagtcctttaacgtccaaatgggtgaaattatgcaaattggtgcttttgtaaaggattaaacggaaccaaaggcaattagcgaaggcgggggacacacattttgttcattcgaaatgcaaattgttgaaaaagctctcacatttgctgatgtgtacgcctttgtaacgaaacaacatttctattcggtttgacaattgcgcgtatgcggaaaatgaatgtggaggaggggactgaaagtggccacaacaattgaataattaatttgaaaaagaaattggcactttccataatgtgtggacagtgagaggggaaagagcgattttttccttccatttgtactgaaatagaaaacggacggacattgcgcgcctaatgataattgcgatggacttggataaaaatgcggagacggaaggagagacatcggatggattagttcgaagaaatcatattcactaagtacatcagttaatttgaaattggaaatctagagacaatatttgtcatcgcgcagcgatagatgaagcccatttcgcccctttcccccccccccccccgttcgacactcatttaacggaatacggattaggtaggtccgcatttctcttttaattcttggtcttaggcattgaaggagcttcttaattaaagcggtcaaccaaaagttttattattggcccacggaagcagtgatgcattacaaattgaaatgacaaaataaattgttgaaggccaaaaaaagcgtaaatggggagggaatgagaataactgattatagcagaataaaacaaatagtaaaggttaatttgatcagcaggaacactgtcgaagcaaaacagcagcagaacatatcctttgcaatattattttatttgatttatttaaatggaaagaaagttgtttgttgcccctaaagcccaatatgagggcgacgcggtgatgataaaattaaattagtaatggacttgagggaactctctaatttcttattggaaatgaatgccaatgatatttgtgggaaaatgaaacggattcaactgaatgaaatgagcagaatatttaggtggtagatgagaaagggaaaatgcacaaaaacggaaaaggatgaaaaccaacaatttccatggaatttttagccatcatttgcattaaattttaatggtacctccaatttatcatccaaaataggcatttcacgcaaacatttctaaaagggtgtattttttagtgcatttgatgcaattggaaccattcgagacggttacttggggtggaaaatgaaa

SEQ ID NO: 46639 - DNA, 2508 bp, Heterodera glycines
  Genomic contig location: Contig_ID=SeqID_8762; Location=315..2822; Strand=-
  SCN-specific regions: Sequence locations=1-344,366-448,470-769,792 -1186,1216-2350,2372-2508
  Gene Ontology: Mol. function=polyphosphoinositide phosphatase activity; Cellular component=extrinsic to membrane; Biological process=cellular morphogenesis during conjugation with cellular fusion
atgtcggatcggatgtgttctttgagtgtttatgagacagcggctcatttttacataatcggttccgatccaaagggaaaacgatttcgaacattgaaaattgatcgggtgactgacaaagaattcatagctgctgaacccgaccaagactacacacaaggttaattaattaatgcgtaactcagctttcggtcattaaatcgaatttgtttagctgacattggcgaattgctcgccaccgtttcgtcgtcttcaagtgatttttttgattttgaaatgactgttgaagacgcccaatattcttttgtagttgtgactcccactgaaaaatggaacaaacggcgcagctgcgctggtggcggcggattgttgcgcaccgtggaaaaggcgtggggaatcattggcgcggttcgcttcatggagggattttatctattggtaaaacaagcaaatttcatgttattccttccaaacacacgctttgagttgcgtttttcagattgtctctcgtgccaaaatggtcgtttccatcggcgtccattccatttacaaaattgaggacgtttcaatgatttatattccggcgaccggcgccgccacccatcccgacgaaacgaagtacagcaaacttttcctggtaaagcacaaacgactgatttttcctcatttttggctactgttcagtctgtcgatttcaccgctgatttttacttttcttacacataccaattgagcagaactctgcaagagaattgtctcgccggatttgcccacaaatgggaatgaaataattacggaaaaacgataggacccgagaaaaaatttgtgtggaacgaatatttgatggaaccattgtatagggcgggggtaatccgacaagtggcattttctgaagaactgtccaacttttacaggtcaatcgcaaatggacactggaattaatgcgtgggtttgtcggtgagattttcatcaatcatggagaatggagagctttaatttttagcacaaacaaaaaagtaaaatttaggaaccgcccattctccgtgattgacacacttttagtgctttttctttgcgcttttcatggagaaaccatcaattcaattcatttgcttaagcccaccaacttttggaattgccttgtgccaaattggatcttattctgattgctcgccgatcgtccgcctttgctgggacccgttttctcaagagaggcgtcaattgcgagggtgcaattatcaaatctttaatttcttcaattttgcgatgctcaaaatgcttttcaggagctgtggccaacgacgttgagactgagcaggtcgtttgggacacgagcagtcctctgtcctttcgttccggcaaattctcctccttcgtccaacgccgcggctccgtgccgcttttttggtcgcaggaccccacccaccgcggctccccaatggtcgtcggaaagccgcccattttgatcgatcgggtggagccgcacgcactgaccacggccaaacacttcagagaattgggcagaaaatacggacatccgttggtggtgctgaatttggtgaagagagaggagcacagacataacgagaacctactccacaaaatatttctgaaagtgcatttgtttggttcttccattgttcatttcgtttggtttttcagactgttcgctatttaaacgatttccgcagagttggcgaatgcattgattacatcagtttcgatgtcagtcgttgcaacaaaagtggccgcgttttgcagcgtttggaggaaattgggcaacgggtggcaatgtccggcggatggttccaagttggtttgcttcgttttcaaaatacaccccccttcagaatttccctcttcttcattctcgactccctcacattttgcttgaccaaatgtcctccgcggcacctccaaaaatcgaagaaaacatttctcatttcactgcccaaacttcgccggacgcgcgaatgcttttgcagcatggcgtcgttcgttcgaattgcgtggactgtttggaccggacaaatgtcgtccaattcggaatcggttggatttcctttccatttgggtgtgttgcgtcgagccttttatctgttaataccacttaaatttcatacacgtgactacattaggcttttccttgtaagggaaggtggcacttggctggcaactttactccatgggctttttggctttgccatggtcgttgcagcttcacagtgaggtgtgccgtgtttttgaggaaatgttcgatgagcacggcaacactttggcatggcaatatgccggttctcaattggtccattccataaaaacgtacaaaaggacagccgtttttcaggtatggaaaggcaagcgaatggttttaattattctccaaatttgttattaaaggaaagaagtcgagatgtgttccaaacaatttcgcgctattacagcaacactttcggcgactttgagaagcaggacggactgaaccttttcctgggcattttccggtga

SEQ ID NO: 46640 - DNA, 890 bp, Heterodera glycines
  Genomic contig location: Contig_ID=SeqID_40927; Location=12..901; Strand=-
  SCN-specific regions: Sequence locations=1-171,193-209,231-890
  Gene Ontology: Cellular component=cytosol; Biological process =transmembrane receptor protein tyrosine kinase ligand binding
atggctgaccaccagcacaatgacatcgaactggcggaggacgcctccgccactgaacacggcaccaaacagaacgtgtcggttgcggtcaaatggttcttccacggaaactggcgacgttttcaatgctccgagtggacttacagcgcacttcaggctgaaattcgcaccattgagcccaacttcagtggccaacttttttatcgaggttttttcattttgcaaaactgggtaatagtcataatcacgttattaagacatttggcagtgtttctgtttagtaaatcaccaaatgtttaattgtacatttgaagtttcaaaagagaactaaaagtttttttgaaattcaagagtttggcccacttttagtgaatcccacagaatctctcctcttgctaatgctttttcattttcaagacgccgatggagatgcaattgttttcacaacggatgccgaaatgcgtgtgatgctcgaccactttcagaagaaaatgaacaaagacacagtgacactcgaaacgatgggtttgtttctttttttttgttatttcatattacaaattggtctttaaaagtcgcaaaaatattagaaatttatacaatttgtttctatttatacgattacaggaggcgaaggaactgttaagaccggagttgtcaaaacgggttgcccttacatcaacaaaatcggcaaaatgcgtgacgtcactaatggcaatggggacaagtcgttgcatccgcacattatgtgcgatctttgcgacgggggtgtggtcggcattcgttacaaatgcatggtctgtccggactttgacctgtgcgaacaatgcgagaagacgggcgtgcacgccgaacatgcgatgtgccgtttggccactacgaacacgccg

SEQ ID NO: 46641 - DNA, 2155 bp, Heterodera glycines
  Genomic contig location: Contig_ID=SeqID_8772; Location=585..2739; Strand=-
  SCN-specific regions: Sequence locations=1-221,245-393,425-460,482 -496,525-819,842-967,989-1058,1080-1127,1149-1231,1253-1262,1324 -1373,1421-1571,1596-1737,1759-1995,2017-2076,2098-2130,2152-2155
  Gene Ontology: Mol. function=protein binding; Cellular component =focal adhesion; Biological process=cell adhesion
cattggtgtacgacgtgaatgcaccagcggaagtggctcgccgcggttcatgaagcgcaaaaagcccaaaagtcacgaggtgcggtttttgtcagcgcgatattcgtgcacagatagacatgtacagtaatttgaaagtaatttaaacttggatgtacagtatacccatttagatcaaattaatttaaacaatagtagttatcataactacttacaattaattttttaacaccttttaatatttgtaggttcattttttattgttagtcttgccaaattgcttaaacatttttatccaaacttaaacaggagatcgaatatcgtctgcgcctaacacctgcacccgacgaagccgatttgtaccaacaggacgaaatgccaccacttggtagctatttaaatttaatttttaataattttaattcggttgcaatggctatgcaatttattcctttttttaatttaatttattcattcatctgaatattcttgatacaaaaatatttttaaatatttttttttttgcctacatttttatatatgaagaaaagatagaattgttacaataattaggggagcagaattgattgattgggcggggcaggcagacacttaagaactttctttctgctgatggtggtattaaatattttttatgtaatcaattacgattagttaaaatgaatcaaagcgcgcgccaacaaaggcagtcgcacaaaattggcgcattaatcaatcatttttggctcatttgtcagagagaaaggacaaaacgtcaaaattgggtacttccgtgttttgctcccccccccctttgagaaattttaaaaattcatattttacattttcaaacaatcatggatattttgttaaatctatgaacagatgtcatcatatgtcaaaacaaacaccatattcgtgatcagagtgaccttgaacaccacaaaatatgaatttttaaatttttcgggggggggggggcggggggtagcaaaacacggaagtacccaaaaacctaaaattgtggtttaatatccattagaaccgatttagagcccgaggatgagttcactgtggagcatgtgaaaaaggattacgacgtcgacctcatggatgagtcacaaatgtaataataaaatatttaaactacccaacaattaattagattgcaaatttacatttgttgattgagttgaggaatgaatcactgtgttttttaaaagtcgtgattatggcatttttcaaacaaatccgtgggtctgaatttttaacataaaagaaatatttttttagatagaaattaaacaatttttaaattattttgcttcattcagaaaaaatgttaaaaggtaggtagatggggttttcatacgttaaaaataaaaaatttatgaattaaaaaatgaatttgttaaaaaatcggtgaaataattggacaatacttttttaaaataaaacatgacaattcttccagaagtagcttgaaacgtcgcgcacgttcagcgaccccgcgccgaacactgaatatagaggtatttgaaatttggcaattctaattgatttattatgaattttaaaattgctaattaagaatttagtagtgaactttctaattttaaatccgtttgttcagcctgccgggccaatgggtccaatcccggtgtgtgcctattgtcaagaggaaattgatgggccaggtcactaaaaaaaaagagaattcaaatacttcttttgcccaaattaaaatttttttaatttgtcagttctgacagcgctggcaccgaatgccacaaaggcacaaaagtttcatccataccactttatgtgctgttattgtcaaaaagtaaaattttttattataccgtatatgctctttttatcccccatggggaattatttttcaaacgcctcgtagactgtgggatagttggagactgggggattaatggagattgggggataattagagaatatacggttatgtaatattatacgatttaaaaaaaataattttaacatgaaacaggcattgaatttgcatggaacattccgcgagcatgagcgtcgtccatactgccatgactgtttctacaaactgtggaacggtttgatgtatgagccggacaacaatcagcgcaaaattgagaaactgatc

SEQ ID NO: 46642 - DNA, 3499 bp, Heterodera glycines
  Genomic contig location: Contig_ID=SeqID_8774; Location=650..4148; Strand=-
  SCN-specific regions: Sequence locations=1-170,209-278,300-704,728 -779,801-858,889-1132,1156-1217,1239-1336,1359-1433,1455-1456,1479 -1609,1631-1640,1664-1802,1824-1846,1868-1910,1933-1967,1991 -2005,2055-2292,2314-2338,...
  SCN-specific regions: Sequence locations=...2360-2554,2577-2739,2762 -2892,2914-3349,3396-3499
  Gene Ontology: Mol. function=GPI-anchor transamidase activity; Cellular component=integral to endoplasmic reticulum membrane; Biological process=embryogenesis and morphogenesis
acaaaattaatattatatattccaaacttattcattaaaaatttcaaaattccgtgacggcgagtgttaatttcaaaagaaagacattgacattaaaaagagaaaaacaatttatgtaattaattctgtcaaaagtctttctcaacgaaatgagaagctaaatggtaattaagaaaactgagaaaaatagaatttttgttaatggaatctgagtccaaaaatatggcgatgaataaattaatgcaataaaaaaaagaagaataaattgattcaatacaactgaaaaggcagtataaaagaaggtagaggaatttattttcatctttttttcctgcaattaatcgtgctaattaagttagttgtctctgacaacatttcttccctaattatgcaattatttatgttattattttcaattttgggtgctatttttttgccattaattaatgggtaagtggttgagaatgttttgaattttgaagattttctagtcaaccgcttcccacggatgaagacaatgacaacaggaacagcaccgaggacgggaacatttgggctgtgcttgtggccacttcgaacggatgggaaaattacagacaccaagtgggctgatcagtgtttaattaatggtggaaaatttgaattttacaattcggatattttatggggcggttccattttaaattatttgatgggattttttgaataattcaaaaaatatatattgagagttccagagaaacaatgaggaaaaatcatgaaagacaatgacaattctcaatttagcatcaaataaaaaacatctctttttgagtacgattttttgaggaaaaaaattaacaaattttcttttttcataccgaaatattcctttaataatttcaaacataattttcaatatttttttgtgctttttttctgagtccaatgcgcaaaaaaatattctatgattaggccgatgttagccatgcttatcatacactgataaaccatggagtggaaaagaagcgaattatcacaatgatggtcgacgacattgccaacaacacagagttagagagagaacagagccataaaaattaattattaaacaaaagagaattctaattaattattaatgaaatcattacaagaaaattcattctttgacagaaatccacagccaggaaaaattttcaatgtgccagacggagaggacgtttacaaaagtagcaaacatttaatttatttttgaaaatgcattaaaactaactaactaattagtctttgttcctttttggaagaaccctttaataaaaatgcaaatgccaatcaaattttgtaaatttgattgcacaaagtacttttcttctaaaaaatttttcaacttaaatagaatttgtcatttcttattaaggagtcaaaattgactaccgtggccatgaggttaacccccaaaatttcatggccattttattgggcgatgagaagcgaacgaaaggaaagccggtgctaaaaaggtgcagaaaaaaacaaggacaacaatttgagataaatgaagcttttcccaaattaagcactggaaaggacaaagtgtttgtgtacacttctggccacggggactttggctttctcatcttcccacactcagaagtattctaaaataattaaaattatgctatcaaacggtatttgctgaattgaataataccaaattcataaaattaattttacgtagttaatttttttagaaataaaaatttttggtaattaagcagactattaaggaaaattcagcgcaactgaaaatatcaaaaattgatatttttcaacatggaatttaagaaaaattctggaaacctttgcttaaaatgttttgtgttttcagctgacagtgaaacaattgacacgaactctgaagacaatgcatgagaagaagatgtatgccgaaatgactttgtatatcgaagcatgcaaagcgggctcaatgttttttgaaactttgaaaaaggagtggaaaagtaacatttaaatttatattattattttaaaaatattattttatttttatttaagtttatgctgtcactgcgtccaatccctacgaattcagttatgccactttttgtgaccctgattttttgaacggcgaatgtttgggtgatttgttttcagcgaattggatgaaagactcggccaaggcattaattttgcaatcatttaccaattgataaatgataaaattgaaggcaaatttgggcaaggaaactttgagggtccaatttgaaattgtgcgcaaaaaaacgaacgaaagccatgtgatgaaatacggagatttgacaattcaaagcgaaaatgttgccgaatttatgggcaaaaaacaggcacaaaaacggaacgaacgtcatcatccagcagtaatgtttgaagaattttcaattaaatgattaagaattttgaggcatcttcgcagcacaaatttctgacgattccatcacgtgctgcttctctgttgatgaagcgtcagaacgagtcccaacaagatcggcacaaccttcaacatgaggtggagatgaagccaaaaatttaaaaaattcagggacagaattaggaaaggcattcgtatgctttttctcaaaaaaacttgctcaaatgtttagatcagagacaaggaaacaaatatatgaccgggttcggtcccgttttcccgctgttccgagattaagtcgcgggttggaaatggaaagatgccgtaaaattatgtatatttatgcatttttgtaggagagaaatgttgtggagcaacagatcaagcaaattgtgaacaaacttgtgcaaaatgccaacgacagccaacgaattttgacgaaacatccgaaacgaattggcaatttggactgccatgacgaggtaaaaaacaatcagcaaacacaataattcgaaacttattcacgagattccaatttcctattcgtacgtgcaacaaaaaatacaaaaattatttaaaaagtattattgttttatgaaattggaaaacattaataagggtgaaaataatgcgatttgtgtaagaaaatttccgtttgttcatcttatgaattgggaatcttaatataagttggaagaatatagaacgaaacggcctaataaaaattgtgctttcccaatccagtttaattaatttttttttagcattttttgctttttagaatcgccaggctttagcagcacaaagctgaaaaactggacaattaggaattgagaaacccaattattttttctatttgatgattttgacaaactccaaaacatggttctgattttcaggtggtgcacacttttggcaattcctgcttcaactttagcgatgtaatattatgattaaatatatataaaattttattaaatattttaatcatagaatctttatgccctggaatatgcttatgttttggccaatttatgcgagcagtccgagctggacacagaacgtatcaaaaaggtgctgatggagcagtgt

SEQ ID NO: 46643 - DNA, 683 bp, Heterodera glycines
  Genomic contig location: Contig_ID=SeqID_8784; Location=71..753; Strand=-
  SCN-specific regions: Sequence locations=1-360,382-634,657-683
  Gene Ontology: Mol. function=signal transducer activity; Cellular component=signalosome complex; Biological process=positive regulation of growth rate
atgtcggactttgaaatggacgatggagaagattatggcttggttagtgaggagtttttaatgccatcgaatagcgcgattgaaatttcgcaaattttctcgcaaaaaatttcatcacgtatttttcggcatttttgctgcctgttttttcagcaatattcggacgactcgggcagtgagccggacgtggcgctggagaaccaatattatgcagcaaaaacgctgaaatcggacggcgaccagcgcggcgcgttggacgcctttcgccgcgtgttggagttggagacggagaagggcgactggggcttcaaggcgctcaagcagatgatgaagctgaactatgccatggttggcattttgtccaaattggggaaaatttggagtaatttggcaatgccaggccatatttcatcccattttttcaaattttggaaaatttggcggactttaatatttttaattttaagggcaattttgaagagatgctgcgccattatcgcaatttgctcacttacattcgttcatcggtcaccaaaaattacgcggaaaagtccatcaactccattctcgactacgtgtccctctcgaagaacacggcactgctgcagcaattctacaaaatcacgctggaagcgctcaaggtggtggcacaaatttcgcggcagtttttttttggtttttaa

SEQ ID NO: 46644 - DNA, 913 bp, Heterodera glycines
  misc_feature (65)..(65): n is a, c, g, or t
  Genomic contig location: Contig_ID=SeqID_41006; Location=6..918; Strand=+
  SCN-specific regions: Sequence locations=1-202,235-320,342-734,765 -781,818-827,850-887,909-913
  Gene Ontology: Mol. function=calcium ion binding; Cellular component =endoplasmic reticulum lumen
atggttggtttatcattttaaattcatatggcccttcctatagaatttggcaaaattataatttntggctcaataattcgaccaaaaaatttgtcattaaattttgaatttgttgatatagattagggctattctcacaaatattttgaattccgctgtgatttgatcgattttctatgcttcggttcacttataaatttcgttttttatttttaaattttttcaattaattttcttatatctgactaatccttaaaaataaaataaagttttttttacagaacaatgatgttgagcggacatggaaaaattacaaggaggagcagctgaagaatggcttgctcgattggcaagactacaggtgaagaaaatctaacagagggcgagaagggtggaaaatttataaaattcttaaacttttcaggaatttgatttacggaaaaccacaggagggccaggagatttcaccggaatacgtcaaaatgattgagcgagacgaacgtcggtggaaggtcagaagcaggccaaaaagacctgctaatttatattaaatcgagaggctaacggccaaattttaatatttttaaatgctttccatacagtaaactcaaaaattgatttacaggtggctgactacaattcggacggtaaaatggaccgcacggaatacggctgtttcatgcacccggaggactgtgaccatatgagagacattgtggtgcaggtggattagcaaatttatttatttaaaaaaaattaaattagattattgcttattaaagtccctttttcaatgattttcattttatatatttttcacttgtcttaacttggaacgggaaaaattcacctcaccctaattctcatatttacccagtattgttgcctaattatttaaaatgatttattatta

SEQ ID NO: 46645 - DNA, 3353 bp, Heterodera glycines
  Genomic contig location: Contig_ID=SeqID_1169; Location=1796..5148; Strand=+
  SCN-specific regions: Sequence locations=1-260,282-1151,1173 -1653,1675-1710,1732-1824,1846-1989,2011-2419,2441-2571,2593 -2657,2679-2833,2863-3167,3189-3353
  Gene Ontology: Biological process=body morphogenesis (sensu Nematoda)
atgaccgaaaacaaggagctgaagaccaaactgagccaacagcacagccaatcgcagcaattctatccgcgaactccgaagaagcgcaagtcgcagtttccgtacgcggacgacaacgatgaggacgcgtactgctcgcggatgggcggcgacgcgtcggcggttcgccgctccgtttccatgccaccgccggagacaccgctgggcattatcggcacaaccgctgcgggacagagcgttgtccgtgccggcattaccaccgccgccgcacgccaggcactgaccgtcaacgccagcgggggcatcaaacgccgacgggcgctggtgccggcgttggtcaaaaacagtcggatcagccaatcgcatggcgacttgaccgggtggggaccatagttttattgcaagaaaataccaaaagacggcggcatttgatttatccaagaatcctatcttttaatggaatttttggactgaatttgtgagaatttttggcaaattctagtgaagttggtggttccgcggtgccgacaaataccgtttgaattcaataatttgtttgttcgccatttttagtagaaacaattcggacgaagcggtggacgacttgctgccgtcggtgtgcgaaagtccgtggctgttcgccgaccaaatggttcacgggttccagaagagacgcaacctcctcaaacactcgtgcactcgttgcgagaaaaccatcggtttcatgtcatttatgtgaaatgcacgcgatgcaaaggtaagctaagaaattggatttgggatgaaaacggattttttagaagtttttcacgagtcgtgccgccattttgcgcctttgccctgcgtccgtcggcacaacaccccgaaagtggctgggaatggcaacaaatcggctggacgtcctcgccttggtgggtctttgtttaggaggactaaccagccaaaatgtcggttctcttgcgtttttttggtcccactgaattttacgcgtccaaagtgccaaccgattttaacagtgaaatgaaaacctgttgaagcaatggcaagaaatgccatggaaagatgcaaaaaaaagaaagaaaaaacgtcaaaaagtgccaatttttacaagaaatccgcttattttcaggtgatttctgtcccgacgctcgcccgatggttcctccgctggtcattttctgcacttatttcttggaccactgcaaaacatacatgccgtacagggacttgtaccaaattgaggggtaattctttaatgaaacgggcaaaaagaaattctgagggcaaatttacgaccatttgtttattttgggccttaaattcaaaaatttccaaggaaaacattggttccgataggtgccataagtaaaaattgcaagccaaatcattagtggaaatgtctccatttttagaaaccctgctgaagttgaggccgtcacaaagcaatttctcgtcccaaacaaaagctacccgaaattggtacaataattgattaattatactaattattatttgcccctttttaggacgcttttcctcccgcagtcatttccgcttgtgtcaacaaatttttgatgcaaatccgcgacccgttgatcccctattcatatggcaaggagatttgtgcacttttggaccgctgtttggccatcgatgggcccattttggagggatttgccggcattgtcgaggatttgccagtggtaagtgtttccatttgctgagttttttagacctattcccattaaaaggcacacatggacacgttgggccacctttgtcgccattgaatcgtttggtcgcgaattcggtgagaaaattgtacaaaatttttgcatgaaattcactgacattcgtaattatgccataaaattcgttggcccaattttccactggggttttcattttgagacttttcttccatttcatttggttatggggcaaattttatggtccaaattgctctttcctgaattttcagcatttggcaaaactctttctactgacaatggtcatgcgttatttaaaaaattttatgtccattgaatttttggcataatttcctagtttgattgtcgaacccttaaaattcggacaactctgacaattattgaaaattgtttaagttcggtctgttgaccattgacgctctgtcagttccgcttggtccgctcgttttcggctccgctcgccctgactgtccgccgctgctgcgccaccgctgcgtcagtgccatggcccaattgcttcggttgggcaacgacgacttctggaccgacacttctgtccgcacactgaccaccagcagcagtgggggcacgccaattgtgcgcaatccgtcgcaacgctcggcacggagtgcggtggtggcggacggcggcggcggaacgccacagcagcccaattttggtaattcaaattcattttgaaaaatggagtccgagaccggtacccattttctattaattcagagccctaaactcaaattcgaacaaaaagacgaaaattcaaactttagtcacaaacccattgaaataccaaaaaacgctcctcccttttgctgcacagttcgccactaccagcagcagcagcttgaagtagatctgaacgcgacgggaaacggtgacaccagcaacaattgggagtcggctcggaacagccaacagtgatgatgaaagccgagatattgattgattgggttgactgtctgactttgtttgatttttctctctcctccggcccaattcactttcactctttgtttctgattacgttttgaacttttatgcctgtttttcccgcaaatttatgctttgccaccgtcaatcattcgtttatttattttatttttattgaaaattactttttctgaccctccatttatttgaatgagcggaaaaaaaatctgaggacgcaacaattagccaaagtgccgaattttgtgaacctttctcttgactctcattgattatgaatctcatcattgtcatcgcgtgcaccgacccgagttttgtttatttatatgacagttttttggagatattggcgataaaactgctcattttcggaatgtaataattgcacaacaaaataatgtttgatggaaggagacactaattagttaattaattagtaattagggaaggcacacaatattttgcataggtaaataaataagtgatcatttgaatgcgctgtgtgtggcgttgtaccttcttcagtcagcgtcagcacaggtggcaatagtaattaatcgccacgacaacgacggacagcggcacaatgacgagcagaagcgtgagcatattggagttcttgatggtccgttcttcgccatctgttatggaaaatga

SEQ ID NO: 46646 - DNA, 549 bp, Heterodera glycines
  Genomic contig location: Contig_ID=SeqID_41061; Location=426..974; Strand=+
  SCN-specific regions: Sequence locations=1-549
  Gene Ontology: Mol. function=ubiquitin conjugating enzyme activity; Cellular component=proteasome complex (sensu Eukarya); Biological process=sporulation (sensu Saccharomyces)
aacagaactatttgcgtttatcatcatcatcccttcattgtgcaataacaacaacacttcaaaagcgacctcatcgccgtttctcatcgttcattcgtccgtccgtccttcacatcaattcgctcgccgttttcgcaatggcacgtcgacgcatccaaaaggtggcaaatgacaactctctgatcaaccaatgctttaaatgttttgatccatttgcaggaaatggcggagctgcatcaggaactggtcacgacgggttacaccgcggcaccgatggatgacggcagagacttgtaccattggaaggcctccatcaaaggaccgcccgagtcgccgtacgaaggaggcaccttccatttggacatcgttttccgtcgcgactacccattcactccgccaaatgtgaaattcgacacgatcatttaccatccgaacgttggagaaaggggcgacatttgtttggacattctgaagcagatgtgggcgccgtcgatgaccatttctaaaggagaaggagaccacaaaacggcgaccagatatcttacttag

SEQ ID NO: 46647 - DNA, 628 bp, Heterodera glycines
  Genomic contig location: Contig_ID=SeqID_41096; Location=750..1377; Strand=-
  SCN-specific regions: Sequence locations=1-448,485-628
  Gene Ontology: Biological process=embryogenesis and morphogenesis
agactttctcgagaaggaggactttggcacgtgctccttcgactttgtcaaggtgaacccggaccgtaccaagctgtatgtggcggtccgctttgagagcaaatcgtgcgcacgcgaagcgatggaacggtgcgtgaattgattaaactgtgattgcctacagtacccaggcgggaagagaataccgtgcatactgtatttcctatattattttgcagagcaggcagaagcgggatatgattcccagaaaaatttaatcccatggatttggaaaattttggccccagtggagcaaaaaaaaaaagaagaaaatttagggtccatgctcataggataaagtggaatttagagaatataaaatttttggttgagaatttttgtttgcgaaagaagcaatttaaaggggatggtgcctttttaaagaattttgggcaaaaatgccaagttgttaaaagtaatttttaattttcaaatttcaaatttcccggcatctcaaatattatagttgaacctaagaccgtcgtttattgttacagatttggccccgagggggaaatgcttggctacaaggtggagctgagttggttccgtgacattcgtcgctatttggcgcattgtgccaaacaag

SEQ ID NO: 46648 - DNA, 1387 bp, Heterodera glycines
  misc_feature (1381)..(1381): n is a, c, g, or t
  Genomic contig location: Contig_ID=SeqID_8822; Location=1..1387; Strand=-
  SCN-specific regions: Sequence locations=1-352,377-903,925-1308,1330 -1387
  Gene Ontology: Mol. function=sodium:hydrogen antiporter activity; Cellular component=integral to membrane; Biological process=sodium ion transport
aaattgtcgaaattataaatgggccaattagaatgccattcccatcttccaaattggcatatttgccttatccttcgtttgctcagattgtctcgctgaattggcatcatgtggaaacgccgtacaccgtctctgtttggattctcctcgccagcatcgctaaaattcgtacgatggccatcatcattaagcataattatcccctaattgccctatctgtccgttagtctttcacgtgaacaaaaagttcggagaagcaattcccgacagcgcacttctcatcgtcgttggcctcgtgttgggctatggacttcaccagttgcacgtcagcatcgacctgtacaaccttaaatccaccatatttttcctttaccttttgcctccgattattttcgatgccggtaaatgcttttgtttggcttaatcgtcgccaattagtcattctttgtcaggctatttcatgccctcgaggcaattgttcgagaattgggactccgttatgctcttcgctattgtcggcacaatttggaacactttgtccattgggttcggttgggtaaaaccgactaaacgatggccaattagttgaatttgaaggttcaccttgcatgtcctcggccacttcaaccttttctccgtgcccttctcccccttcgaaattctcctctttgcctctttgatcagtgccgtcgatcccgtggcagtcattgctgtctttgaagagattcacgtcaacgagttccttttcatcaatgttttcggagaggtgaactgctgttggtctttggttaatcagtttgtcactgattgatcagtccaatcaattccctttttgctgatcattattcactgttgatcattcattccattcaatccatcattttggtcccccccccaatcgtttccccccttttttaaggcgctgttcaacgacggagtcagcgtggtcagtgaattgttgcgtttttgaattgaaagtgaaaaggggcaacattttccggtgctctaccaaatgttccgcaagttcactctgatcggcgttgatcagttgtctctcgcggattatttggccggcgtcggctcttttgtggtcatttcgttcggcggtgctctcaccggattgtttttcgccttttttgtctccattttgaccaggtgattgggtcacagaaaatcactgtgaatttattctcaaaacgcttagattcacaggacgtgtgaagattcttgcgccggtaagcgatttttttttttgctagaagtgatagtcccggggaaacgggggggggggggtaattaacaacaatcattaattaattattaattacacttggccatccccttctcatttgttttcgtctcttatcccttctccccaaanaggtgt

SEQ ID NO: 46649 - DNA, 1138 bp, Heterodera glycines
  misc_feature (23)..(23): n is a, c, g, or t
  misc_feature (108)..(108): n is a, c, g, or t
  Genomic contig location: Contig_ID=SeqID_41157; Location=657..1794; Strand=-
  SCN-specific regions: Sequence locations=1-88,119-317,339-360,390 -396,427-472,500-505,527-528,550-588,610-640,665-1138
  Gene Ontology: Biological process=reproduction
atgccgttaacaatgcacgaganagtgcgttgcatttggccacacttaatggtcacgcaaatgctgcccgcctgctgctcagggttggaaaaaattttcaaaaatttntaaaaattttccgtaaattcagcaccatgccgatgcccgactgcgaaatgcccggatggaaaccgcgttggacatcgccgtccgaactgacaaagccaacctttgcagacttttgatgctcaattgtcccgaactgaatttgatggtgagaaaattgggttatgaaaattggacatagaagagtgcatttaaacacgagtttatgaattaaaaattacttttttgaaaaatgcaaaaaaaatgttttaatccattttttaattaaataaattacaaaattaggtaaccattgttttttaaattaaatttatgcatttaattcgaaatcaaataaaattcagtgtgcctcggactgttgttcctccactctaacaacaacaacaacacctgtgtcaaaatcacattcacctccatatccgcttcactctgctgcgagacttggccacactgattgcatggtaaaacaaatttaattttgacaatttattgaaaaattaaagttcatctgtgcccctactgatagatgccaccgaaaattttaaaaacaatgaattttcaggaggctttgttggagcatggctttgacccgaactatttgggccccgatggcactgcgcttcatgttgccatacgtcagggacagtgctcagcacttcgcatactgttggattacggtaagggagtggattaactaaaattcgttttcggcagaggctagcctcccccagctttggctatactcccctcgtttttaggtggcgcccttgacatttgtgacagtaatgggcaaactgtttcggattggttgtccacggggttgtcgagcagtactcatgagtctgacgatgggatggaccaacggttgcgtgactgtaaaaaattggtggacgaggcggtggaacagcaccgtaaggcacctcagccagcagcggaacgtcggcatggacaattatttcaaatgcgggaaggcatttggaagagtgccgtgccggagcccaaattcaagcagttcaacggcactaacaatggg

SEQ ID NO: 46650 - DNA, 1130 bp, Heterodera glycines
  Genomic contig location: Contig_ID=SeqID_8831; Location=518..1647; Strand=-
  SCN-specific regions: Sequence locations=1-3,27-51,79-116,139-245,268- 374,414-431,454-1130
  Gene Ontology: Mol. function=fructose-bisphosphate aldolase activity; Biological process=fructose metabolism
atggagaatgccaatgtgctcgcccgatacgcgagcatttgtcagcagaacggacttgtgcccatcgtggagccggaggtgctttgtgacggcgaacacagcttggaacgatgccagaaggtttgatttggattgttggccatcggttgcttttacaattagcccagtccgaccaatgtgcccaaaatttattggttgagtcttcgagagcaatttaatcatagagagaaaatgttgaaacgcggatgagcatttaaaaactgaagatcatcgggtgttttgttgcacacattttcaatttcatttttaattgttgtatcggtctttgtttaggtgactgagttgactttggcctacacctacaaagcattggccgaccaccacatttacctggagggcactctgctcaagccgaacatggtcacccccggccaatcccactcgcccaaggccacgcccgaccaaattggtctcgccaccgtgactgccctccgccgttctgttccgattgccgtccccggtgcgtaatgagtgcctttccttcgcattttgcatttcctttttcaaggcattgttttcctctccggcggccaatccgagatcgaggctacacacaatcttaacgccattaacagtgtgcccgggccgaagccgtggacgctgtccttttcctacggaagagcgctgcagtcgtcagtgatcaaaaaatggaacggcaaagacgagaatttgggcgatgcgcagaaagtgttgctgcaccgtgccaaggtagggggggggcgactgatgatgcccagcaattggttcttttatgctgtcctcggtaacatttcatttctgactttcctttaggccaacggcgacgctcagcaggggaaatacaccggcgaggaggcagccgcgtctgccgctgaatcactttttgtggcaaagcacgcttattgaacagaagtgtggaatatgcgatggataggcgcgaatccgagaatcactcatcatatattttagctggaggaattggcagaataatctgacaatgaacataatgataatttcgtttcatatttcattgttgtcacttccgtttggtgcacttaataattaacatatagtgataattgataaataaa

SEQ ID NO: 46651 - DNA, 265 bp, Heterodera glycines
  Genomic contig location: Contig_ID=SeqID_8838; Location=1817..2081; Strand=-
  SCN-specific regions: Sequence locations=1-265
aggtggaccaacacgtggccagcatcccggccgtgctcgaaatcccctccaaagaaatgccttatgacgcgtccaaagtaaggacatttacttaaatgaaactaattcgtttttcgtgtttaggatagcattttgaaccgagcacgtggcctggtgaacactgacgacctcaagtcatagaagaagacattacaaaaaacaaattctcctttattagtcaatgaatgtgtttaattaattatgggaatgacgagaacctacatac

SEQ ID NO: 46652 - DNA, 1162 bp, Heterodera glycines
  Genomic contig location: Contig_ID=SeqID_41207; Location=447..1608; Strand=-
  SCN-specific regions: Sequence locations=1-233,255-439,461-491,513 -536,692-805,832-1124,1158-1162
  Gene Ontology: Cellular component=Golgi membrane; Biological process =Golgi to endosome transport
tcctccaacgcgcaaattcgctgctctgaataccctcgcgacccctctttttcattgtcaggttggtaaggcgaaactcccaaaacccatttaaaatgcattttgtccttccattttttcaaaattaggagaccaatacggggtttttcaaattcggtgatcattggtcaccatatgaaagggggggggggggtcgtagcgaagggaaaagagggaaatttctgaaaaattagactaatttctaaataaaattcgttaaaaacctaaaataattttccccagcggcgcctatcggtaaccgccggaaccccatttgccaaaaaagttttatgaaaaagcgcttcgcaaaaaaacgggtttgaaaaacaaaaaaaggcattaatatcggcgtttgtacccactcctttcacaaaaatttataccgacgtttttcgaaaatttacatttttaaatttaagaccagaaccagttattttttttcctaaaaaaatatacctttttgtcacatttctgttcgttgcgccccattcattagtcttttccccctcccacgtcgttccttcctctctttccctccgtccctctccatttctccgtttctctccgccactctcaccccgttccttttctccctctgtatccatctttttcgttatctctccacactctctctctcccttcccctcccttttgatccgtttgtttcccttttagttttggctttctgtggggtcctttggcgtattgtcaatttctgttctccgagccccgtcgcgtggtcaccgccgtttatttgctcagtgttttggccactctttacacttctctgtggcttcaaagttcccttctcaccgtaatcactgccgcccttcaaacttttggcctcatttggtcagttttttattgcattttccatgttttaattggttttattcctaactttttctcccccattccttccctttctcccctttttaggtttcttctttcctatgtcccgggtggggaaaacggcctcaaatggatgggccgaatggcaaaagtggccttttgtgcgcgtcagtcgtccactttggttttgcccatttgacgccagccgatgcgactgaatattaatttacctatttttgtttctcttttctgtttcctctttctttcattt

SEQ ID NO: 46653 - DNA, 1307 bp, Heterodera glycines
  Genomic contig location: Contig_ID=SeqID_8857; Location=1347..2653; Strand=+
  SCN-specific regions: Sequence locations=1-329,351-1307
  Gene Ontology: Mol. function=DNA-directed RNA polymerase activity; Cellular component=DNA-directed RNA polymerase II, core complex; Biological process=transcription from Pol II promoter
atgccatatgccaaccagccacaggtgaccattttgcagctgagcaacgagtttgtgcagtttgtgctcgaggacactgacctgagcgtggcgaatgcgctccgtcgtgtgttcatcgccgaagtgccaacattgggtgagcgtcggcatttgcatttgatggcacggcatttgggtttatcctggccagaaacataagaaatgcccgaatttgggtaattttaatgcccgatttgtggatccgaccgggaaaatggacaaaaaaagcaatcggtctcaggtaaacctgacaccagaaaagaagagaatgcccgaatttgggtaatttttaatgctctattggatctgaacctgcacgaaatctgtgttgggtccctatcgaacacttggcgaattttattgcaaaaaaaaaaaaatcgaattcgaattttctgggcctgatcttggcaaacccaaaaaatttcattttatgccctcaatttccaccattttgaatttttggcatttggcattaaaaggcattaaaaaaaaacattttttcagcgattgattgggtacaaattgagcagaacacgtctgtgttgcatgacgaatttgttgcccatcggatgggcatgattccattgtccagtgacaacattgtggaccgcatgcaatacgctcgggtcagcgaaacaattttttcctccaattaatgagtttgtctaaaatccggcattttgggtctaattttcgagttctcggggattatactcgaaaatgaagcaaaaaaagccttaaactaatggccattgttaaattgcaaggtaggctggcctcgtaaaaaaaaaaattcggaacggagtcaaccgactttttttttcctcgaccagaaaattttttccggtttttcgaattatcgtcgtcatgggcgaaaataatacccctttttagaagtttcccctccattttaaggaattttaagaatataggtaataaaaattccaaaaaaacacctgtttttcttaaaagactccgtttttcattttagggggcgtgggattcccaaaaaaaattttttttttttggtttttaccgttttctgtgccccctcttcctctccactaggatttcattttatacgaaaaaagcccccccccccccctttttttttgctcttccgttgactttgctgtctgtattcccaggattgcacatgcaccgaattctgtgacaaatgtgcagtgctctttctgctgaacgtacgctgtgaagaggaggcgaccaaagcggtcacatcggacgacttggagtccaacaatgtcgag

SEQ ID NO: 46654 - DNA, 1804 bp, Heterodera glycines
  Genomic contig location: Contig_ID=SeqID_8864; Location=493..2296; Strand=-
  SCN-specific regions: Sequence locations=1-429,451-1019,1041 -1273,1297-1463,1485-1593,1615-1690,1712-1804
  Gene Ontology: Cellular component=nucleolus; Biological process =embryogenesis and morphogenesis
atgcgttctgatggttccgtcattttcggacgttgcgacgaaccgagggaaatcattcaacttccggtggaccttcggacactcagtgacgacgagcgaaggatgcgaatagccgagcgaaagccaattgccaagaaagtggttgaggtgagaggacggggaaggaacaaatggggaaatttaaaaataaaccaaaaaaactaaaaaaactaattgtaagtgatgtcacattttggcacacaattgctaacaaaatcctagcaaaaactaaaaaaatattcaactttgtaattattgtcggatccaagaaattttagacccggttgtaaaaagacttttatattggtttttcggacaaaaaaaaacaatccctttttttctgttggactctccaagacccacctcacaaataatcccaaaaaattcgcgaaatttttccaaaacccttttaacgaaatttgcgttaaagtttgccaaatttacatatattttttctccttgccggaaatgcattgaaattaaattagtatttttggctcgcctcttccaattcatttactacaaaaggctccatttttggatcaaaatctattttaaaaaattcgccaaaaatgccagtaatcaaaagtcacggaatgaacgctcctttctgtttaggatacattggacgactccttcgactttcacaaatatgtgtctcaatggaagcgatgataaaaccctttctttgttcgttagatttttgaataataaaaatggtcaaattgtccgttgtattcatttttacggttttcacctttttatcttttgctattgtttgttctttcgagggaattgtcacaaaatcggcacattttgagatttcggttccttcttttcattgctatccgtgcctcatccctttcttatttggctaataaattgctgaaaatgcaatcggatgacattgtgtggaatcagttgaacaaaggccattgctcctacaaaattttgtaagtaaacaaagggaatggtccaaaggcttttctttgggattgattcgtttcaggaccaaggccaagaagttctgccgcaatgagttcaacttgaccggactgtgcaatcgtgcttcatgtccgctggccaacagccaatacgcaacagtccgagaagagaacggtgggccatcaaaagcgaattgacgaaatgagagaaagtgatttgttggttgattaaggcgtgtgtttcctttttatgaaagtggccgaacggagtcatttcccgggcaaactttgggagaaggtgaagctgcacaggaatttggccaaggccgttgaacagatcagcacgcatttgctgcattggagtgaatacgtccgcaaaaagtgcaaagcgcggcttatgcgccaccaccaatgtctgaacagaatgcggaagatggagctgaggggacgcactgcgaaagtcatcccattgcaggtgacaaaacaaaaggaaagggaagcgaaaaacggcggaaaaattggaaattcagaggaaaatcgaacggagggaacgccgcagggaggaaaaagcattggccgcggcaaaattggacaatgccatcgaaagggaactgctgcagaggctgaagaagggcacatacgggagcatgtacaaattcagtgacaagacaattgacaaagcgatggaaagggtggacgagtcggagcaaagtgaggaggaagaagtggaatatgagacggagacaacgcgggagaagcagcgacagttcgtggaagactttgacgagtcggaggagggggaagacatcgaagactattag

SEQ ID NO: 46655 - DNA, 1431 bp, Heterodera glycines
  Genomic contig location: Contig_ID=SeqID_1184; Location=386..1816; Strand=+
  SCN-specific regions: Sequence locations=1-153,177-275,322-788,811 -878,900-1011,1033-1431
atggacccggaaaaggcacgacagcacattcctgagccggcaattttcacttatgcatccaaagatgccattctctacgccttaggaagtgagcaattaagaaaagtgccgccggcaaaattaaaaaaaaaattttgggtggtctaagtttggaaataaaaattttaaaaaattttgaggcctactcaccaaaatttaattatctttttatccgccgagttcaattttttagttggtgccaacactaccgaggatttgcactatgtttatgagggtaataaaagaaatttaaaaaatatatataaataataataatttatacgcaaagcgtgacgccgccaaaataaaaacaacaataagataaagcaaaatggtcacatatgagagtggttcataaatgtgtaaaacgaaccaaatcaattgagtcaagaagtttagaaaaaaacagttgaattttgtaacctaacttctttaggtaataacctatagaagcgagaagcacgaacaaaaaatgaatggtatctaacattagttgagcaaaaagttggcttaattaaattacccagtctactagaaaaattgggttgaggtttattatattaaatttttcatttttcccgtccaggccatcccgactttcaagtgtttccaacctttgctgttgtgcctgggatggtggccgtttcattggtcagtttttaaaggccaatgtaatagaaattgatctgttggccaatcgaagaaagtgccaaaagcatttttggaatgcgtcatctgattcattattcatttcctttcatggtctgatcagtgatcagaaaattgatcagaaatcatcgttcggcattctgccggatttggtgacccataaaacaggggtttttggcaccaaaatcagccgatcccacagccaaagtaatcacaaggaatttaagaaaattggcattttgccggattttgagaccaagaaaatttgggatttttggcaccgaaatctccgctcccccagccaaatccattctgtcccaaaattttgatcatctctacgcatctagaaggttaaaactgatcacacatcgatttaagtcggattggcctggcattcaatttgatctgagccgggtgcttcacggcgaacaatacattgaactgtacgcaccgtttccggccgacggtgcgcgactgcgctccgaaatccgtgttgccgacctgttggacaagggggcgaacgcagtgatcatctccgagggtacaacaacaaaaacaaaatgcgcaggggatcatcaatcatctttaattttatcggagaaaaatgatcaaattgctggactaaccgatggatttggacccaaaatccttccgggatgggatcccatttacataatcgccgcatatgatctattatcattaaactgtggaggattaatctag

SEQ ID NO: 46656 - DNA, 1261 bp, Heterodera glycines
  Genomic contig location: Contig_ID=SeqID_8871; Location=796..2056; Strand=+
  SCN-specific regions: Sequence locations=1-457,479-731,760-786,808 -1014,1036-1261
  Gene Ontology: Biological process=embryogenesis and morphogenesis
ttagccttcccctcttctcagagttatgtgcacggctgctccgttcagccccttctttttgagacaatcgccgaaagactgagaacggcggcgagcaaatggccaaaccgcgaatttgtcattttcaaaagggagggaatccgcaaaagctacgcggaagtcttggcggatgtgagccaaagggtcggcttcgttgtccgaatttgaagagtttgtttagagcgaacggttggccgccggattgattcatttgggcatggaaaagggcgaccgattgggcatttggtcgcccaacaaatacgaatggatcaccgcccaattcgccagtgcactcgccggctttgtcctggtcggccatttagttcgaccaattggccaattgtcccgattaggtcaatgtcaatccgatgtaccattctgaggatctctgttacgctgttgaaaaagtcggcattaaaacagtaattgcctttgtcttattattatcccaaaagtacctttgacatcagtgaattttgcagttgattgctccgcccacattcaaacgaacggattattatggcattttgagggaattaatccccgaattggaagaggcgccccggggggacgggcgcctgtgcaccgacactttcccgaaattgcgcaatttgatcattttcgatgcggaaaagagaacatttaagtgagtgggaatgggagagttataaaagaccgacacataaatggacaattaattaattagtcaattaattaattggaatttcagcggcgcatgggcatacgacacggtgatgggaatggggacggcggagagccgaaggaaattggcacagtacgaagcgagcacacagcctgacggtggctatttgttttccctttggtccacccaaattaatccgtcccccattagtccctccctcttattagcccccccccccctttagacccctgcaacatccaatacacaagcggaacaaccggcaaaccgaagggggccacgctgactcaccacaacattttgaacaatgcctttttcgtggggcttcgcgccggttacgccaaccatcggacggtgatttgcatcccaaatccgctttaccactgcttcggctgtgtgatgggctctctcgccgcgctcgtccattttcagacgtgcgttttccccgccccttcttttgagcctctcgccgcgttgcaggccatccacgaggaaaggtcagcattcagtggtcggtcttagtcattcgtcatgggaaat

SEQ ID NO: 46657 - DNA, 2055 bp, Heterodera glycines
  misc_feature (93)..(93): n is a, c, g, or t
  Genomic contig location: Contig_ID=SeqID_8873; Location=1..2055; Strand=-
  SCN-specific regions: Sequence locations=1-299,322-865,891-1224,1247 -1660,1684-1727,1749-1768,1790-1825,1848-1956,1978-2055
  Gene Ontology: Mol. function=protein tyrosine phosphatase activity; Cellular component=membrane; Biological process=NGF receptor signaling pathway
attacttagttcgaccaagcgaatcgaatcccgaagattacaccattcccatccaccaggggagccgtgtgactcacgtcaaaatacccttgnacaacgcatcaaatgtctacagatttcccagcggacaggaatttcgatcactcgaagaaattggcaaagcgttaagcaacggaccggacatattgaccgattgtgaagtattcaccagtttgagttcgcctctgaagatacccttctgtgaaacggtggttaatgtcggaagagatcgtaagtcgttcattttgcgatgtttaaaaattttcatattttaatttcaaagtttttagtctcgagtttcaattttcattctcgaacatctctaatttcttttctgttgaggtttctttcacatttcgaccagtggtcaggaggcggaggctttgctgagactgaaacacgaagggacttttctgttgcgggagagtacgagcagtgagggcgaatttgcgttgagtgtgaagagcaccgacgcggtcattcacgtgcgggtccatcgtacggtgcgcgttctgtccctcccttcagttacttcccatttttgcttaagcatggacgctttggcattgttccgaaggacaatttcaggggttttgccgatctgttagacaattacgtccgaatgccaatggttcaggtccaatgcttttctggtggtattttttcccattgtaattagtatttgcagaatgatggaagtgctgtgaaactcgtcgccgccctcccaacgacgcgattcacagccgcgacgatcgatgatcggatcgattgtttgttacaatcgcaaagaaaaaccggcgcaaaggacggttttgtagaggaatttgaggttttgaaaacaaataaaattgctttgaaatcagtggggtcattttttgcgaattatttgaaaaataaatcattgcatagcaccttattattctcactacattttctgttagggtttacaccgtgaggaggacgcacaaatgttcattagctgtaaagagggcggtaaaaccgaaaacattcgcaagaatcggtacagaaatgtggtgccctttgatcacacgagaataaaactgaagtcagtccgcgagaatgactacatcaacgcgaattacataaaggtacttttgattgtccaatgcttcaaattaaaattgactttttcaggttccattggatgcgaggagatacccggaatttggggaattcagacggagttacatttcaacgcaaggatgtttggaggaaacggtcagtgttcgtctataggcccatttctccccatttaaatcacttttgcaaatgaatccgtaattttacaggtgaccgacttttggtaaatgtttctttcgtccgatttgaacccaatctgtcgtactttttttaccaggcaaatgatatggcaagaagaaactcggctcattgttatggtgacaaaagaagtcgagcggggaagggtaaagcaattaaagcagcttttatttgacagtttctttctcattgtcaggttaaatgttttcgttactggccggatttggacgaacgaaaaaattatgggacgacaaatttgaccgtcaaagccttgcaggtagtataaattctctgaaatttgaattttcaataccataccatttataatttcagtttaaaagctctcaaaatgggggaccccttcgcacgcagcgataggggggggggggaaagaggaaaaattttcaaaatcgtacaatttttaaccaaattattaaaaattccccggctgacaatgagcatattggtaatgccgacccctaaaagcccttaattcttttaaaatttggctcaaaataacaagatttgttcatttttggcaatttcaaagcgcaaattaacaagggtaacaaaattattgcaactttaagagatgtaatacaatcgatttttatatgcttacccattctttaggagaatacactggatgattacgtccatcgtttgttttcttggaggtgtcgaaggtgaatttatttgaaactgaaccattctatc

SEQ ID NO: 46658 - DNA, 950 bp, Heterodera glycines
  Genomic contig location: Contig_ID=SeqID_8880; Location=1284..2233; Strand=+
  SCN-specific regions: Sequence locations=1-80,116-266,289-502,565-950
  Gene Ontology: Mol. function=actin binding; Cellular component=Arp2/3 protein complex; Biological process=embryogenesis and morphogenesis
cagagtgattctcctgttcctaattggctgcttaacatcggaccaatttcttgccatgcgtggaacaaggacaaaactcgtaaattattttctttttatttaaaatgaattaatactttctagaattggctgtttcgccttccaacaacgaaattcacatattcgctcgtttggagactgtttggaacccgttgcacgtgctaagagaacacgacttgctgatcaccggattggattggtcagtgggaaagtggcacgaaatgtgggatgatgttgttgtttcatatctgaaacatttcagggctccgaatactaatcggattgtttcatgttcgcacgacaaaaatgcgtttgtgtggacatgggaggctgaaaagaacagttggaaaccggagatggtggtcgttcggataaacagagctgccacctgtgtcaaatggtcgcccaacggtcggtttgaccattccttactcattcattggcccattctttaaaatgtctcattttttaaatacatttaatttaagaaaaatgtttatattcgttttaatttatttttattaagaaaacaaattcgccgttgggacgggtgcgcgtttagtcgctatttgttattacgaagtagcgaaggaatcttcccccccccccttctaattgttggcttttaattggaaattaagcgtgaaaatgactggtgggtagcgaagcaaatcaaaaagctgattcgttccactgtcacctcattgaattggcatcccaacaacattttgttggctgttggcgcctgcgacttcaaaacgcgtgttttttctgcttatgtgaaagaggcgagtgaaaacgcaaaaataacaaatggaaatttcactgcctttttagattgacgaaaaaccaacgccaaacccctgggggaccaaaatgccatttgggagaattgctcaaggagtaccagt

SEQ ID NO: 46659 - DNA, 436 bp, Heterodera glycines
  Genomic contig location: Contig_ID=SeqID_41380; Location=458..893; Strand=+
  SCN-specific regions: Sequence locations=1-15,141-202,224-224,269 -280,331-337,427-436
atgcaaatcttcgtcaaaactctcaccgggaagaccatcacccttgaggtcgaggcgagcgacaccatcgagaacgtgaaagcgaagatccaggacaaggagggcatcccgccggaccagcagcgcctcatcttcgctggtacatcgacttttgatatgccgaaacaatcatttttatacccaacccttattttcagggaaacagctcgaggacggacgcaccttggccgactacaacatccagaaggagtcgacgcttcatctcgtcttgcgccttcgtggagggatgcagatcttcgtcaagacgctcaccgggaaaaccatcaccctcgaagtcgaggcgagcgacaccatcgagaacgtgaaagcgaagatccaggacaaggagggcatcccgccggaccagcagcgccttatcttcgctggtacaatttga

SEQ ID NO: 46660 - DNA, 1299 bp, Heterodera glycines
  Genomic contig location: Contig_ID=SeqID_1188; Location=2566..3864; Strand=-
  SCN-specific regions: Sequence locations=1-661,683-689,719-730,754 -998,1020-1211,1233-1299
  Gene Ontology: Cellular component=eukaryotic 48S initiation complex; Biological process=cell organization and biogenesis
atgtctctaccacaatttgatctgcctgaatgtgtgtcgaactccaacggatggggtccggggtctgtaagtgacagtcaagtactctcagagtttgtgggccttccgtatcaacatttcaacaaatgcgatcggattgggcgtatcgtcgattggttgggcgtcgatcgctttttcaaaaaaggcgaaacgcgtaatttttgacagagtttttcgagaggattttgtttttttgcaggagatcggtacaatgagcgtgtgtatggctcctcagcgactgcgggcgttcaattcgattacatccacgacaacgaggaatcgaacttccaattggtcgactcgagtcgaccacaaaagccgcagaggcctttccgtcgtcaaattccatttgtatgcaaaactatcgcatatttcttaataaaatatatgttgcagcgtaaattggctcaacgtgagcaggaacgccgagaatatgagaagtacaatgtttcgacgaagatgaagcggagtatactcaagtattgtaattactctgctaatgtattggttttgccatactttaacaaagggggaagatatgtcctaacaataggcaaattcgtactttcgcttatgacattcaaaaaagttgtgaccaacgagtccgaaaactcttaaatacaagttttggttttgtaaaaaatgtactcaattaaaaaacattaaaaataataatttaggactgggtaatttaaaattttagtctttttataacgaatttattgttagttaaataaaaaatcgactgctccaaaatttttctttaagggagcaacaaaaagcgtacaaagtgtttttgcgtcggggcggtggaactcgcggcacagcgcagcgaccgaccgggcggcgcttcaatgaccgacaggcgggcaaagggcgacagccttcggttcaagttcgacccgattgggcggttctgaaggagttggactttgtccagctgaacaaactttacctgccaaacattgaacctggaaaggatatgtaagttctttctaagggaattctctaaacaaccgatggtttagacccggcgaaacgtacggcacccttcacttttatgataaagcattaatggacaaactgagcgtcaaaaaccccctgcatttggagaaattccacgcgtctttttattcgctgaccaccactgaagacccggtgttcagaaaggttgttgtgttcacttctttgctgaatttcgcatggttaagctgtcctgcaacaatgtcggcaatgtattcgccacagatatcattttga

SEQ ID NO: 46661 - DNA, 1670 bp, Heterodera glycines
  Genomic contig location: Contig_ID=SeqID_1189; Location=1448..3117; Strand=-
  SCN-specific regions: Sequence locations=1-31,55-191,214-326,348 -404,428-551,580-783,812-1552,1574-1598,1630-1670
  Gene Ontology: Mol. function=protein phosphatase type 1 intrinsic catalyst activity; Cellular component=cytoplasm; Biological process =cellular morphogenesis during vegetative growth
atggcaagagaggactactgcttcgatgcaacggcggcggcagcggcggagcagtctcggccttcggcaacgacttcaacacttgtgcaaggagatggcctgtcaagcagcttcgtggacgcgatcatcaggaaggtcaggcattcgcctgtccaacgcttcacggatgaggtgggatttttttgacatgacatttcaacaattaaaacatttcattttttccacagatcaccgacgaggagctcaaacaactctgcatggcggccacggacatcttcagaatgcagccgacgctcgtcaggattcagccgccggtcgtcgtcgtgggcgacatccatggacaattcacggacctgcagaggatcttccacacgcacggcaaccctccagagcagcagtacgtcttcctgggcgactacgtcgaccgaggcccccagtcactggaaacaattgttcttctcttctgctacaaggtgtggttttgtgaatctttaacagaccaaattaaatccccaaaaccattgcaggtcaaatacccagcgaacttcatgctgctgcgcgggaaccacgagtgcgccaacatcaacagagtgtaaggatcgcatttttttgtgttgtttcagacttaaatttccccccccccccacctttaaggtatggcttcttcgatgaggtcaaccgccgctaccagcgtccgggtccccgccgcctctacgacctcttcaatcagacgttcgcctggatgccctacgtcggcctgatcggcgacaaaatcctgtgtgagtcacattttttgttgttgttgtccattcatactaattcattatttttcaggtatgcacggcggcctctccgaccagatcaacagcctggagcagctcagccacctgaatcgtccgcaaatcgacccgccgcttcggacgctggagatcgatcttttgtgggcggaccctgcgcgcggagttcgtggcgtcatcccgaacaccagaggagcgggcatcgcattcggcgaggacgtggtggagcgggtgtgcgacatgctctgtctcgactacatcattcgggcgcatcaagtgagtttttttcatttgcttctggactaaattcccacttcccctttccaggtcgtgatgaacggagtggaatatttcgccggccgccggctcatcacccttttctcgtcggcgcgctacaatggccgcaacaacacgggagcaacgctgacaatcgcggcgaacctgagccacagcatcacccgcttcccgccggcctgaggacgatgagcatcgaacactaacagaacagaaggatggagaagcgccctgggaacgcgactggagatcagacaattccccttatcattttgtgtgtaaacccactcattttcatatttccgtatgtatgtttgttgaggtgtatatgtgctgataaacattatacaaatgcaaaccaaattgtactatcagtttaatgcttctcctttatttttgatcaatcttccatttgttagtcaaatgttatcatacacggcgattcaattttgggctccaagtacaattaagttggttttttcgtcttagtggtctgtgagttagtcaccaaaaggggggtcccaggttcgagtcccatgcatgctttaactgtattttgaggtttttaaagcaaataaa

SEQ ID NO: 46662 - DNA, 1199 bp, Heterodera glycines
  Genomic contig location: Contig_ID=SeqID_41430; Location=12..1210; Strand=-
  SCN-specific regions: Sequence locations=1-10,40-42,65-131,153 -279,302-369,407-496,518-523,546-740,762-775,797-1199
atgaataaggaaaattataatttattacttttaaaaaaaggtatttaattaaggaagtaaatgagagggatttgaaaaaagtttcagcatattttcgggagtgccccagggaagtgtcttaggcggccactcctcttttaattttataattaaaagatcgccgtccttttgcaaatgaagcatcatcagttggcataaaaatgtatgccgatgatgttaaattatattatgcccatgaaaatgatgataaaacaaatcatttagataaagcaatagacagctgaagataaggaaaaatggtcaaaaataaatgggttagaaatttcaactgggaaatgttttgttctttatttagggaaaaataatatgaaaaaagattatttaattaactcaaaaaagatttcagaatcggataatgttcgtgacctaggcattataattgactcgaaactgcatttttcagaacatattaacaaaattgtacgaaacgcttatcttagagttttccagattttaagagtcttaaaaaccagggaaataaagactctaacaacagcttgtaaaacttttgtccgacctcaattagaatacgctaccgaagtgtggaacccaaatttaaaaaaagatatagacaaaattgaacgggtacaaaaatttttcacaagaaaagcttttcgaaaatgtggatttgtgtacaaaaaatatatggaaagactaaaaatcactgatttacacaaattagaagaaagaagaaaaatcaatgatttaacaacagcttttaaaattataaaagggttcaccagcctagaggctgagcaaaatttctttttctcagaaaggcccaggaggcctttacttttgcgagtaaagcgccacacgcacaaaactcaaaataattttttccataggatagtaagaaactggaataaccttccagtggtagcggtgcaaattaataaggcaaaggaattcaggggtttactaaaagcaatgagttctgagtaggattttccatgttgccatatttacactatatttttatcacctgtgaatttttaacatttgattgatttatttttattcattttttttattacggtattcattttgtattttttatttgaccaactttatttgttgttttctttttggcaccatataagagcactcatgtgcctttggtttgctcgataaataaa

SEQ ID NO: 46663 - DNA, 609 bp, Heterodera glycines
  Genomic contig location: Contig_ID=SeqID_41482; Location=252..860; Strand=+
  SCN-specific regions: Sequence locations=1-61,83-354,376-517,539-609
atggcctgtgacatgttctaccaaaatccgtcctacaccaaccagcaagcgggcgccaccggtggggcggacagtcggaaaatttgtcacctgttcaacaaatatgccaccggtttgttcattttattattgatgataattccggtgtgcccttggaccgtaaaaaaaaaataaaacggttcggaaactttgaatttacaactttttgttcgagtttgcattagtagggattagcaattggtcaaaataatgttgtcagagaaccgtggtcaacaatcctgaaaccccaaaaccaattgatgatcacaaattttgttttttatgctccatcctaaggtcgagactacatatccctaacaaaacaaaaagcaatttttcctaccccccccccctcttttttcagatccaaaggacaaatctcagaaaattggacccgatcggatcggtcccaatgggatggttcgtttcttgcgcgacttgaacatcgagccaacgagtcgggcagttatggttttggcgtggaaaatgggtgctcagaaacagtgcgaattcacactgcaggagttcggcgacggaatttccacactgatgtttgtgtctttattttaa

SEQ ID NO: 46664 - DNA, 2748 bp, Heterodera glycines; identical to SEQ ID NO: 8908
  misc_feature (14)..(14): n is a, c, g, or t
  Genomic contig location: Contig_ID=SeqID_8908; Location=1..2748; Strand=+
  SCN-specific regions: Sequence locations=1-68,90-204,255-564,587 -766,788-878,900-1191,1220-1357,1385-1899,1921-1949,1989-2215,2249 -2252,2275-2514,2536-2542,2568-2571,2621-2748
  Gene Ontology: Mol. function=peroxidase activity; Cellular component =extracellular space; Biological process=gametogenesis

SEQ ID NO: 46665 - DNA, 2519 bp, Heterodera glycines
  Genomic contig location: Contig_ID=SeqID_1190; Location=1..2519; Strand=+
  SCN-specific regions: Sequence locations=1-551,581-704,726-809,832 -1507,1529-1682,1742-1851,1881-2519
  Gene Ontology: Cellular component=endoplasmic reticulum; Biological process=cell organization and biogenesis
agcatgtcatttttgcgcttagtcccagtgagttgctgcattcaaggaaaacataaggacatgccaagggcaatttttgtaatttcaaggtgattttgccaagatttggctcctcaaacatgccctcctcgtcgtctatacgcccgaccgcgagcattttggcattgtgccgattgaagcgatgttcatgcgctgtgccgttttggcagtgaacagtggcggaccactggaaagtgttgagaatggcagcagcggctttttgcgcgattcgaacgccgaagaatttggcaaagtgatgaaattggcggtgaaccgaccacaactgatgcaacagatgggcgaggctggtcggtccatcgtttgtttattctccggggaaatggaaatttcaattttaggacgaattcgtgtcgaaaaacatttctcatttggcgcctttgcgaataaaatagatgaaattattgtcaaacttggaacaaattcccggcaatgagaccgtttattccccgcaacccagttttaattgagtccctcccagaacatttggaatgtttttattaatttctatttatatattattgtttgatttttttagagatttgataaattattctgtgctttcactgttctacttagtgcaggaattttgagattgtcgggcatagggcttatttgttagaacacttgcggccgcttttttcaacaaatttttctggcaattccaacaggcttgctcgcgttttggtctagaatatgtcccaaaaaatagacacttcgtactttttagtcgatgtttaatgagtgaagacaaaactttttaaaacaaaaaatcaaattacaaagcatcacatggcttattgctctttcaaatgctaacggaagaactgattggattgcgcattttggccaaaatgccgcccatattctgcgtctgacgattgaatgagcgcgacggggcgaatccgagcaatttttgcaaattctggcggagactcattgtgcacagaatataaaggaaaatgaaggaacagtcggtgaaatcgtcgcctgaaaagcaggggaccaattaagaaaatcagacaattaaaaaaagaaatcactgaccaaccaaattgcgatggctaaggccctggacccaagtgatcggctcaaatggcaatttggcaaccacacgaccctcgaaaatgctggagaaagtgctgagcaaagcggcgaacacaaaaccaatggcgagccttagaaagaggccaaatgagtgggtgtggtgctgttttggtccacaaaagttacatggacttcatgcggaacatgctcaggtcgcggttggtcgacttcagtctctcctcctcccgctcgattttccgtttcgtcgttttgctggccgcgttcgccgcacccgcaccgcctgccgcgtcccctccggcgccaattgcgtcctttttgcgctccaacttcttcgatttgcgttccatcgaaaatttcagccgtttgtactcgtcggaccttcaaaggcacatggacaattttggccaggaaaacattgtcccaaatttttgccaatgaaaatgcaattggccccgttttgccaccgacctgtagacgagcacccaagtgagtccctcgccgagcaaagcggtgaaaaaggcgatgaaaattatcaacaaggcgtcgctgtacatctaacaaattatgggaaatgcaaaatgattttaattggaaaagaaaaagaaatgcaaaaactccggtaacaacggaataaatatgaaaacgatgagaattattaaagctttgttttccattcgtcaacgttttaaacaaacattcaaaaaaaaaaatggaaaatatcggccaaaaagcgaatataaattagaaactgtatcaacaatcgcaataataaactaatacagtacggaaccgacatttgccataaacaaaatatcaacattgggtataatcatcggacattgtcacatcgaattgactccacaaaataacttcgaaatcccgaaactgctcttcagacgaggaacggctcgatgttcagctccagcgccgagcatggattggtcagcgcgaagttggcgagaaccgtcgggtggagcactccgaaagtgccaacgcacgcattgcagaacaaaacgttggcacaccgtccatcaaaataactggggtcttaacgggcaaaaaaaggactaatttggcaaaatgtgttactaattttgccaaccgtccgattggacgatgcgatagcccccgacggatggctcggagtcgttgcgctcgtaggcaatgcccaacatttgcatgattcggtccaacagtccgtggatcacctcgaaggagccgcttttgctgtagaaaatggccgccaaatggcgctcatttcggcattttgtatctgatgtttgcgctttttaaccattttgccggaacattgccaacctttgctctcgtcgatgaacaccacgtcctgcacttcgaagagacgtagtggcagtgccatgtccttgttgttggcg

SEQ ID NO: 46666 - DNA, 2822 bp, Heterodera glycines
  Genomic contig location: Contig_ID=SeqID_1190; Location=1097..3918; Strand=-
  SCN-specific regions: Sequence locations=1-143,165-492,514-839,861 -2038,2068-2177,2237-2390,2412-2822
  Gene Ontology: Mol. function=phenylalanine-tRNA ligase activity; Cellular component=phenylalanine-tRNA ligase complex; Biological process=phenylalanyl-tRNA aminoacylation
tccgagtcgtcgcatctccgcgaatatttgcacatcatccgcgacaagccgttgtacccggtgattttggacgcggacggcgtcatctgctcaatgccgccgataatcaactcggaacattccaaaataacactgaacacgcgcaacattttcatagaagtgaccggcactgacctggtcaaattggaaattgtgctggacatgttggtcaccatgttcagccaatattgcacagagcaattcaagtgagtggcatttggagagaccaaatcacaattaattggaatgattgattatccggcgaataactcgtactttccatttacatgttttagcgttgagcctgtccaaattgtccagccgaatggcaccttcagcctttttccggttggttcaacaaaaagtggaatgcgaaacccaaacattggtctttaaaagggccaacttcacttaaaaacgctgtctttgtttaaacggtcgtcgttttcaaaatttgtttgtcttttaattgttcaaaaaaccttttccgcattttaattcctggtaaatgtgagtgtgtcactctttgttttagaaattggattaccgggaccatttggtcgatgtgctgagtttggccgccaaaattggcatttcggacatcggagcggacaaagccgtgcaattgttgtccaaaatggcgttggaatgcgtgccgatcaaagatgaggaacagccgcaaacggtggacattggcaaagcgttggaattgttgaagctgacaatgagcggcgaggagaagcgaagtgaaaaagcgcaaaatggggacgaagtgccggcggttttagtcaaagcaagtttcaatttttataaattaatttgccagagggggacttttgtaaaaattaattgccaatttaaatatttgcaattgccaaattaataaacctccgttaggtcactgttccgcccactcgccacgacattttgcacgagtgcgacttggccgaggatttggcgttggccttcggatacaacgcaattccgacggcactgccccagtcgaacactgtggcggaaccgtttccgctcaacaaactgtccgaccagctccgtcttcagttggccatcagcggatggacagaagtggggcagggcgagaacaaatcgaattagagtgagtttactcattttaaattccctcttttaaaaggtgctcacttttgcgctttgttccacggaagacgtcggctcgaaaatgcttcgacctgaccacgaaatggactcggtggtgcgaatttcaaatccgaaaacgatcgattttcaggtgccattccccaaaatttagacaaaatacattattcttttaccatttttaggtggcccgcaattccctgctgcccggcattttgaagaccatcgccaacaacaaggacatggcactgccactacgtctcttcgaagtgcaggacgtggtgttcatcgacgagagcaaaggttggcaatgttccggcaaaatggttaaaaagcgcaaacatcagatacaaaatgccgaaatgagcgccatttggcggccattttctacagcaaaagcggctccttcgaggtgatccacggactgttggaccgaatcatgcaaatgttgggcattgcctacgagcgcaacgactccgagccatccgtcgggggctatcgcatcgtccaatcggacggttggcaaaattagtaacacattttgccaaattagtcctttttttgcccgttaagaccccagttattttgatggacggtgtgccaacgttttgttctgcaatgcgtgcgttggcactttcggagtgctccacccgacggttctcgccaacttcgcgctgaccaatccatgctcggcgctggagctgaacatcgagccgttcctcgtctgaagagcagtttcgggatttcgaagttattttgtggagtcaattcgatgtgacaatgtccgatgattatacccaatgttgatattttgtttatggcaaatgtcggttccgtactgtattagtttattattgcgattgttgatacagtttctaatttatattcgctttttggccgatattttccatttttttttttgaatgtttgtttaaaacgttgacgaatggaaaacaaagctttaataattctcatcgttttcatatttattccgttgttaccggagtttttgcatttctttttcttttccaattaaaatcattttgcatttcccataatttgttagatgtacagcgacgccttgttgataattttcatcgcctttttcaccgctttgctcggcgagggactcacttgggtgctcgtctacaggtcggtggcaaaacggggccaattgcattttcattggcaaaaatttgggacaatgttttcctggccaaaattgtccatgtgcctttgaaggtccgacgagtacaaacggctgaaattttcgatggaacgcaaatcgaagaagttggagcgcaaaaaggacgcaattggcgccggaggggacgcggcaggcggtgcgggtgcggcgaacgcggccagcaaaacgacgaaacggaaaatcgagcgggaggaggagagactgaagtcgaccaaccgcgacctgagcatgttccgcatgaagtccatgtaacttttgtggaccaaaacagcaccacacccactcatttggcctctttctaaggctcgccattggttttgtgttcgccgctttgctcagcactttctccagcattttcgagggtcgtgtggttgccaaattgccatttgagccgatcacttgggtccagggccttagccatcgcaatttggttggtcagtga

SEQ ID NO: 46667 - DNA, 3639 bp, Heterodera glycines
  Genomic contig location: Contig_ID=SeqID_8920; Location=1..3639; Strand=+
  SCN-specific regions: Sequence locations=1-580,602-1015,1037 -1653,1675-2194,2237-2250,2272-2277,2317-2384,2419-2933,2955 -3169,3191-3361,3384-3639
  Gene Ontology: Mol. function=ubiquitin-specific protease activity; Biological process=protein modification
agagaaaacatcttcaaggatctttttaacatccacccccaccgggcgctttcagaagaacctaaagacaaagtttaccccttgttttttccttaatttttcagcaatttagaagccttgtctcaaatttgataacgaacaacaacagataaagacggaatattctctccgtatttacccattgttcactgttcctttgcttataaccgaaggtgccgacgcgggcattccgcaaatttgtgacgaaattattgcacatgtcagtgccgaattacagcagcgtcttaacagtgggattagcgaatgggacggcgaagagcgaatggttgcgaaagctgcagaagaccttgttcaggtcgtttttaggcaatcttgaagaatgggttattttttactagtaattcgacgtatttatttcgagccttatacttcatcgattgtgactgttttctaccggaaaaacatgtttccgccggatccttacttttagaattttttgggtcctcatctggttcttaataattttctaaaaaccccatatttaaataaagtccaaaaacgcagacggaattagtgagaggattaactttttataattttttagctcttgtatgacggtccgccaatttcatattcggaatgggaatgcgcacagtgtgggctaaaggagaatctttggcttaaccttaccgatggtgcaataatgtgcggtcgcttttctcaattagctggcatcaaaggcaacggacacgcgaaggcacactttgagtcgacgggctttccattggtcgtcaaattggggaccattgagaacggagacggcgatatttacagctacaatgaggacgtatgatttgcagcattaacatgtttataataccatattagatgaatccgtaactaatttcaattaggggtttagttttaaaccggcctaagaatggacacactttaaattgatttgtgttttattttagtaaaaacggtgtatcggtacaaagcaggcgaagaacaattccttttgttgtgaatttttcgaatttaggcgccggtctgcgacccatggcttggtcaacatctggcacgttttggtctcgacatcaaaaaattccgcaagaccgaaaaaacgactttggaaatagaacttgatgcgaatttaaagtagacatttcgaaatgttctgttttcattccgttattaggcacgaattctcggcaattcaagaagaaggattggagttggtcaatgtgagtgggcctggctacactgggctgatcaacctcggctcttcttgttacatcaattcggtgcattctttttccctttttttgcctgaatgttccttttgaggctctccaagttctgcttattgtccctgactttgtccgtgcgtttactgaagaactgttgctaagaaaacaaccacccgaaataaatgaggatttcgccgctcaattggctaaaattttcgtcgcgatgaaatcgggggattattcgcgagaagacaacaaacatggtgccgaaaaggagaagggcattcgaccgacgacattccgtcggattgtgggccgaaaccaccccgaattttcaactgcaaaacagcaagatgtggaggtgggcaatcattggaagtgccaatggacaaatgtcgttttccacaggaatatgttcgctttctgtttgagaaggtcgacgcgtgctccgacctctcctcggaaaatcccgtcgctgcgttccgatttcgtctggtcactcgtttcctggacgaactttcagattgcgttcgctattctttccgtactgacaacattttatcggttgcaattccaatggacttgtgcaaggaggtgaacattaattcgttatattcatttgagaaccaaaaccttacgttttgtcattcctttttattttcaaatcggcaaaatttgtcctcgtcgtttagtttaacgaatgttaattatgttaatttagtctgacactgttgtgaatggggtcagacgaaagagtgtcactttggagcagtgtttggccgccacatttgaagaggaaatcatcgacgattatttctcacctgttttgaaaatgaaaggccgagcgaaacaacaacaacggatgggcagtttccccgactttttgcttttgcaacttcgcgtgagtaggcattccagggacgagcagcattgttttccagatttaaatttaaaaaaacttaaaattttctaatttataattagatgttttcctgttaaaaagggattttttcaaaagaatttgatttttattttttatatttgtaaaaaataattttaaaatccacgtctttcaataaccattttttgtagatttttcttcatgaaaaatcctctaattgtaagagttagaaaaataaaaaatttatatttgttttttaatttactggtgcggaaacgaattgcttaaacatgtgttaattgtttttaattttttagagattcgcatttgattggattctcggtacgcagcataaattggacgtggacgtgcatgtttcggacgaattggacattaacgcgttcttttcaactggagaattacagccgaacgaaaaggcacaattagaaaaaccatggaaattaaaataaagattaaaattgctttgttctaacagagtttgcctgttgacgacacttcagccgtcataaaggagcgcttatggcaagagccgaaccatgaaattgtggccaaggcaagcagtgattattacttttgtaattttgataatttataatcagttgctttcgatgggtttcactgaaaacgcagctaaaaaagcggcgcttttcacaaagaacgaatcagcggaatcggccattaattggattcttcaggtgcctctttgccccccccccctaacattccttaacaataaaatacgaaaaggcacgaaatgctgctttttgaaaaaatttaaagcatgagaatttcacccgaatgtttatgaatgatttatttttagcattctgacgacactgatgtaaacgatccgcatccgatgttaacgaaacaaagcactccgccactgacatccaaccaaggtaaacagacaagaggaacacatggacaaattaaatctaacaaataaggagtactcaattaatggtctaattgcatttttaggccagaacgcgtctcagaaagttcgtcacggcaaaggtcattaccgactgcgcgccttcatttcgcacattgggtcgacgccaaattctggccattatgtcgcacacgtaaaggcagacaatggccagtggtgagttcgcagagttcggtctggactttggtccaggctatacattaaacaaggggggggggttcaaccaaaattttggcgaacgggtccggcggctctgtaaatcgacgacccattttttgctttcgaaccgctttattagtgcctaaaaattaggttttttgcgattacgaattaattttttaacgaaatagggattttttgggggccggttggttgcaattcctaaattttctatcggttacttgataatattctttgacaggcacatttttaatgacgaaaaagtggccaaatctcaacatcctccgaagactcttggctatctttacctgttccaacgggccacc

SEQ ID NO: 46668 - DNA, 171 bp, Heterodera glycines
  Genomic contig location: Contig_ID=SeqID_41568; Location=589..759; Strand=+
  SCN-specific regions: Sequence locations=1-171
  Gene Ontology: Biological process=growth
gccgattggaccttccgcggcaaacatttgggcgtgtacgaattcggcacggacctgaacaggtccgactgggtgctgatccataagcacgaggagaagaagttcacggagaacaggcagcagatgggcacgctgaacattcccagcactttccctgtgcctcctttgcag

SEQ ID NO: 46669 - DNA, 1894 bp, Heterodera glycines
  Genomic contig location: Contig_ID=SeqID_8928; Location=3984..5877; Strand=+
  SCN-specific regions: Sequence locations=1-141,163-326,348-355,398 -572,596-806,874-953,980-1098,1139-1606,1628-1694,1717-1850,1882-1894
  Gene Ontology: Mol. function=protein tyrosine kinase activator activity; Cellular component=cytoplasm; Biological process=protein targeting
atgcccattgactattctgcttggagtaacatcgaagtgtcggatgacgaagatgacacgcatccaaacgttgacaccgcttcattgttccgctggcgtcatcaggctcgtgtagagcgagaggcggagatgaaacaggccaaaaaggaggtgaaggaggaacaatcgaacgtgcgcaacaaaatgcaggtttaatgaatgactcgaacaaactgatatttaaaggatacaaattcggcactattaccgttattcccctttaggaaattgaggaaaagttgaaaagcgctaaacttgaggagaaggagcgcatcagtttggaactcgagttgaacaccatccgtactcaggaggaggagttccggaagaaggaaaaggagttggaggaaaaggaaaaacatcagccatggaatgtggacacgatcgcaaaggaagcgtggagcaaaacgatcgtcaacaaaccgaaggagggcaaggaacagccgaagaagggcacgaccagcaaaagcgaagaagacgaagagatcaaccgaatgcagaaatacttcaaagtcagtaaacgcagtgcacccattcatttttcaattccaaaattagatgaaacattttttctgtttgtttgagtataatgccctttctgccaaacttaggacaatgaaacacttttgcaccaactttgtgtcttggatggttttgacaaaatagaagaattcctgctggagcatcctcagctcgccagtgagtacgccaccaattttctgactgttgaagcactcaattatgctatcgatgcgaatgtgagtttgtaattttttagtttttttaatatattttttgtttttattattaaatcacttccaaaatattttttttgcgaaaattctttttttttttggctaataataaacagctggtttttattaaacatttttttatactgccattattttcgaaggatttctttaaaaacaaacaaacattatgattaaggagataaacatgggtcgggttgcggagaattacataatgattcaatacgaattggaattggccaaatcgctgcacgcgatggccaccaataccaatgtgataaagaacttcttcaaaaagtttgtttctgtttatttttctttcataatggcttaaataatcgtttatttacattcagaattcgtatcgcggaacaaaattatatgaaaatgttcacggacgaagtggaagcattcaaagaccgtctgagaaaacgcgcgcgggacaaaagggaggcgatgctaagcgaaacggaggtggaggagaagaaaaagcgtgtggcccagtcgccaggagggcttgacccgcaagaagtgttcgactcactgcctgcggtgagttattctatgagatggaatgaggaagcagtccaaaattagaaatttgcagcgattttcatttaatggaaccacctgaactattcaaaaagtgcatatattatataccactaataggtcagggccgttttgtattctgaatttttaattttacgtgctaacaagggcaataaacctacaaattatggggccgcaaaaatcggaattttattgtctgatggcgcccattttccaaatacaaaacaaaatgttcaaaagcagaaaatgcatgtgctatccttgatctggttactggcgagttgggagattttttcttagtaatgaaacttgaattttaggaaatgcaagaagcgttcgaaacgcagagcatgtcaaagatatttgaagtggcgaagagcatggactccgaggtgttcaagtaccatttggatcgctgcactgcctccggactttggattccaaacgcaaaggaagccgagggacatggacaagaggaggaggagaagaaggaaacggaggagaaatga

SEQ ID NO: 46670 - DNA, 201 bp, Heterodera glycines
  Genomic contig location: Contig_ID=SeqID_41663; Location=159..359; Strand=+
  SCN-specific regions: Sequence locations=1-33,55-201
  Gene Ontology: Cellular component=mitochondrion; Biological process =growth
cccctcgacaaaaaacacgaacaatcgctgaacgacgccctgcaaaagtttgccacgcgtggacagaagctgaacttgaccttcactgtgaagccggacttggttggtggactggtggtgaacatcggcgataaatatatcgatttgtcaatggcaacacgccttaagaaaatggacgcggtggtaaagggatcgatctga

SEQ ID NO: 46671 - DNA, 4189 bp, Heterodera glycines
  Genomic contig location: Contig_ID=SeqID_8943; Location=413..4601; Strand=+
  SCN-specific regions: Sequence locations=1-294,336-444,469-608,630 -786,884-921,944-968,998-1004,1028-1222,1244-1298,1320-1478,1520 -1568,1599-1759,1782-2129,2151-2267,2296-2656,2710-2958,2980 -3036,3089-3263,3286-3287,...
  SCN-specific regions: Sequence locations=...3333-3797,3826-3866,3888 -3935,3959-3974,4158-4189
  Gene Ontology: Mol. function=1-phosphatidylinositol-45-bisphosphate phosphodiesterase activity; Cellular component=cytoplasm; Biological process=response to abiotic stimulus
aaacgtaccgttacccgggcgcaacaatcaacatccatccgttgctttcatcgttggtcaactatacacatcccatcaaattttcaggtgttttttttgggctaaatgtgcgaaaacccctgaaaatcccaatccccccccccccccctcaggacggaaaatccattttttattgggcgatggctcttcaaaatgccattttaggcggggaagggtgatttgaaagttcatttaaaatttatttaaatgtagatggtaaaaatcttaaattgcatttatgtcaatgaacttgggaaaaaaattatattcacttaaaattaaaaattattttttttcccgtttcaggctttgatgtggctgaacagaacgatttgcactttcatatgtcgtccttttcggtacaaacagttttaagttgggggtcattagtaagacggggattttagttatttaaatattttttctacagctttattttgatgagaaatatacgaaaaaaaacatcatttttagcggtaaatgtggttcattttaattatacattatgcaaaactagagtgccacgggaccgggaattttgggcaaacccgggaccgggaccttttcgggttgaaaaccttttcgggttgaaaaatcgggaatttttggctgggaaaaccgggaaaaagccgggactagtcccggtcccggtcaaaaccgggaccttggtactcagttgtccgctaccaggtcccggtcccgtggcactctatgcaaaacataaaaaaaacatattgaacggttttcataaataaaatattaaaaaaatgttttatttttatcaatacatttgtaaatattttgatattttaactttttatcaatattctcataaaaatattttggcattttcgaattttttgagaaattccttaactaaagtgtaataaaaagagaaaaaatacagtccctaagaattgagttttttgaaaaaaaattcaatttttataaaataaatctcagccttagtcatttgcatagcaattaaaagtgattaattataaaattaattagccaacttttacatattaatccttttttaaaggaaagcaccggacttggactgcttaagcagagtgcactggaatttgtcaactacaacaagcgccagctgagcagaatttaccctaaaggtgcacgggtggactccagcaattttcttccccaggtaaacaaacaaaacacaattgtgtgccattagtgaaaaatcagtctcgagagtctcgactcgatcgtttttttttgcgcatattttggcagtttatacaaaatttgttttcgaattcacgaggaactaactgtctattaaagctcaatttttaagattgaaaattatttatgttgtataaaaaaatagttgaaacattgatttatctgatattaccaatttaattaagttaattcccttaatttaatttaataagacaatttaaatagggaaataaaaatatatattaattatttttatgtatatttaattgagcggtttatggcttcgattcccatttattttagtttaatcaccatcgattaattaatcaatcaattaattaattaatcattccccgggctcagattttttggaacgccggctgtcaaatggtggcactcaatttccaaacgccggatgtgtgcatgcagctgaaccagggcaaatttgaatacaacggccaatgcgggtgcgcgttgtttcgcccatttttttgggaaatattacgggaaattttaaaattttaaaaattggcttaatttttgcttgaaattttttctacccctccccccgttcattttaatttttcttttattttgaattccattttccctttttcaaggtatttgctaaagccggattttatgcggcgtccggaccgtacatttgacccattttccgagtcgcccgtgggtgagtttgtgccaaagcaactaattacagaattaaatacctaccgtatttgttaagaattagcttatttggggacggggacaccttagtccacgccttttcaagcccagtcaaaatgccaaaaatttataagccccccccccaacttttagatggcgtcattgcggcacattgttccgttagggtaagcagcagctgcctcagcaaaaattgtcccctaaatattttccgtttttttcagataatttcgggccaattcctttgtgagcgtaaaacgggtacctatgtggaggtggaaatgtaagaaaaaaaaattttcgatgcctaattaattattttcaaaaaatttttttgcataggtacggcttgccgacggacaccatccgcaaggagcacaggacaaaattggtgccagcaaacgggctcaatcccatctacaacgaagaagtgcggtgaaattaatgggcacactgacctccgctcttttttcttgaagggcctagttgaaatggattttattttgaaaaaaaaagtaatttacaattttcctcaaaattttatattttccaaatttttcgcccatctaaaaaatacaaaatttttcttcgtgcgccaagactcattacagatgagagtttcggaacaaacatcattattcccccctcccctggggggggggggggggatgaatcgtcggcgaatagggaaagatggaaaattaatgaaaaatcaaataaattttaaaatattattttacataattaaatccgctggtttgattaatttgactttgtttgatcacttttaattttgatcactaactaaactgatcattttccctaattaactctcctccccccaaatatttcagccatttgtgttccgcaaagtgatccttcccgaactcgcggtgcttcgtttcgctgtgtatgacgagaacggcaaacagttgggccaacgcattttgccgttggacggcctccagtccggctaccggcacatttcgttgcgaacggagcacaaccaagcgagcacgttgcccacattgtttgtgcatttgcaactgaaaacctatgtgccggacgaactgagtgtaattataaaaaaaaaaattggaaaattatgttaattttttgaaaattttttcaggggttggtcgacgcattggccgacccgaggcaagtttttaaggcttgtttgtcttaaaaaattctgaaatttttgaaaatcagaaaaatggaagcctaattttagggctaactttttctttgttttttttttgagtccactctaactttgctagatatttgaacacttttagaggagttatttatgaatgtttgggatttaatttttcaaaaaattattttaaaataataatttaaaaaatgcaaaaagtggcacaatttccaagggcttaaaattagcaaatgccaattaattccgctttgtttttccgcatgtaaaattttaaataatttcaatgaaaaaaaaaatcaagaaaaaaacaaaaattcatagagaaactaaaatctttttcggacttagaaacggcggattaatgggggataaactgactattaaaatttcccttttattaattagttcctaattacttatatgtccagggcatatttgtcggcacaagaaaagcgggaagaggcactgcagcagatgtgcgtggacgagctggacattgtggacgatgttgtgccgtcctccaatcagtcccagccgcaacagcaacagcttggcgtcggcgcccgccgggaccgaatcggcggcgccggcgcggacggcgtgccgttcgactcgaacaactctatccgacgtcttcagaatggttccacccgggaccatcagcagcagcaacagcagatgaacagcgtgcagactacgggcacaataattgagtgagtacggcataatataaaactgtataacaatgattgagataaatgggggaaggtgacatggtaaaattaagacaagatgaggcacacaataattttctgtacaatgacgatatggcacaaaacgatacgatataaaacatacaaaacaaatacgatacacattacgaaacaatactatacatatatgatacagtacacggtacaatatacaaaacgatacgatataaaacatacaaaacaaatacgatacacattacgaaacaatactatacatatatgatacagtacacggtacaatatacaaaacgatacgatatgacattactctaca

SEQ ID NO: 46672 - DNA, 876 bp, Heterodera glycines
  Genomic contig location: Contig_ID=SeqID_41698; Location=1..876; Strand=-
  SCN-specific regions: Sequence locations=1-43,65-105,127-415,437 -540,562-876
  Gene Ontology: Mol. function=citrate (SI)-synthase activity; Cellular component=mitochondrial matrix; Biological process=citrate metabolism
taaaaaattatcatggttttttatcttaaaaaaattttgcaaaacaaaagggtcctccctgttgtttcaaaaacggccacttttagactagcgccaatttattcaatgtttccatttcattataattctaaaaaacctatttttccgatttcgattcattaaaatttccttttttcaccctcagatttacggcggaatgcgttccatgaagggcatggtcactgaaacttcggtgttggacccggaagagggcattcgcttccgtggctactcaatcccggagtgccaacagaagttgccaaaggcagagggtggtgaagagccattgcccgaaggcatttggtggttgttgtgcaccggtgaaattcctgaccaggtttgtcaagctgggaaacttttctgaattacgacatctcactattttttgcattgttttacgtgggttatattccgcggtcaaaaagaaaacaattcatgttattagctacaaatccggcacatatctttagctagaaaaccataaaaaacaggacagaccattttggatttgctcccaaaaaagacggaccattttcggtttgctccaaacttttaaaaaccaaaatgccattccttttttctaactagcactaaaatatgctcttatgctatataggagcgctcaaaaaccgtttaaacatgcatgcaaaaatgcggcataaatcctggagttttagcattgactttgtctctgacaatgagagtaatcccccacccacatctcattgcagaaacaagtgaacgcgatcagcaaggaatgggcatcgcgtgccgatctgccagcccatgtggcccaactgttggagaatatcccgcccaatttgcatccgatgtccc

SEQ ID NO: 46673 - DNA, 841 bp, Heterodera glycines
  Genomic contig location: Contig_ID=SeqID_41716; Location=270..1110; Strand=+
  SCN-specific regions: Sequence locations=1-157,187-230,252-669,695 -774,797-841
gtcttgtattggaatgctgaggccgaaaaccgcggtgccattctcaacgacccggaaagggacgattatatgcgcaacccatgcgaacgggcgcagaacaaatttctgatcattgaattgtgcgagactattcaggtacctaattaaatatgtctacaataataaaacaattaatttttaaattttgatggttcgtaattagttaattattttttgctttattttttaaccttaaaaataaactcacaaattttcagcccactgcgctggaaattgccaattttgaactgttctcctccagcccccggcagtttcgcgtttggggtagtgaacgatatcccacgcaagaatgggcactcatcggcgagtttgaggcattggacaatcgcgaagtgcagctattcaatgtgctggaacacacttcgtacgccaaattcgttaaggtaatgacctatttgcatatttttaatctaggcttccctaatcttaatgttagcccaaaattcattttcatggcacccccaaatttatttttttacacaaaatacagttggaactgctcactcactatgggtcggagcattactgcacactgagcactttccgtatgtacggcacctcaatggttgacgaatacgaagcggaaactgtggtggcggttgacgccatgcaacaacagcaacaccaacaacagatggactcggtgttcggccgcacattctccacacttccgtccacaaattcagcagcggtgaatgaagctgtggtggccacgggtggggaggaggaaaacagacagaacaacggcacaataacggaaaagacaccgctgacgacagtg

SEQ ID NO: 46674 - DNA, 392 bp, Heterodera glycines
  Genomic contig location: Contig_ID=SeqID_8953; Location=2384..2775; Strand=+
  SCN-specific regions: Sequence locations=1-210,246-392
  Gene Ontology: Mol. function=pre-mRNA splicing factor activity; Cellular component=spliceosome complex; Biological process=mRNA splicing
atgcgacaatttatgttggtggtctggacgagaaggtcaccgaggcgagtgagtgttgttgcacattttcaattttaatgaaggatttggaattgagtgaaacaaatttacgaatcgcaatcaatgacctcaaaaactactacaaacaaattttcaagaattattattgagaaaaaagattagaaaaaaatcccactagttgtagaggggtcttttgaaaagtttaaaaatgttttattcaatttttgagtttttttttggcttgcatcctttatttttcttttattttttgcagtcctctgggagttgttcgtcaacgctggtccggtgaccaacgtgaacatgccgaaggatcggatcaccggcaaacgccagggcttcggctttgtgga

SEQ ID NO: 46675 - DNA, 1400 bp, Heterodera glycines
  Genomic contig location: Contig_ID=SeqID_8953; Location=1..1400; Strand=-
  SCN-specific regions: Sequence locations=1-525,547-911,934-1094,1116 -1120,1142-1158,1203-1400
  Gene Ontology: Mol. function=transporter activity; Cellular component= membrane; Biological process=transport
aaaaaattcctccaacgccacaaccacactttggcacaaatgttgtcgtcgcaaccgacgttgatcatggacaacggcgcgtacagcataaaggcgggctattccaccgaccaaagtgccaggtatttgcgtgttgcattcattttcttgggacatagattttttttccaaattttaatgaaaattgtgtaaaattaaaaaaaaaaatagccattttttcttgaaaaatcatgataacaagttctggtgtaatttgaaccaagtcattaacccaaactcgaaaaaagtcgagaaattaactgtcttttgaattttgttttttaaaattaggaaaagaaataaaatttaagtatatttttcatgggccttaaacagtaaaagtaccaatttggcacaattttggaacggatggggccacgatgccgacaaattgaccctccaattttgacaaaatttagagaatgaaacagtctttttggtatcatatttcatagttccatgggttttctattagaaaactatggcaaaaaagttcaaaaaatacaatttttttttcttctaaaataatctaagtttttttttaatttggaaattgaaaaactcggaaaattttgcggaggttatacattatttttatacaataattacactcgattctccccgttttttttttagaattttccccaacactgtgttcaaatcgaagggcgagcggaagcgcatttttgtcgccgacgaattggaccagtgcaccgaccgttcggcactgtttttcgtcttgccattcgaacggggatatcttggcaggttttcgggtcacattttttgggaaatttacattggaatttgtgcccatctcctaactgttttttaaaaatcgaaatacgaaaaataccccccccccctataagatcagaggccaaaaatttttctaaaaaacaaatcttagaattttcaaaatctagataattttctcaaagaaaaaaaaagattttttttcttgtttttgcggaagggtctccgccaaatttagataccttttcatacatggaaaaggggagggggtcggaaatttgcctttacaaaatacgaaaaatacccctccctccctccctataagatttccaaaaaaccttgggacccgaaagaaaattcatgaaaaaattttttcaatgttttaaaatttaatttcaaaaattattgatgtttttccataaatttgtgcaaaaataggaccaaaaccatgcaaaaattactctaaaaattttttttccaatttcagttaactgggacacgcagctgcagatttggaaccgcgtgttcggcacggagggcgccggcctcggcgtggactgtcagcagtgccgcctggtgctcactgacccccacgaagtggcatt

SEQ ID NO: 46676 - DNA, 2640 bp, Heterodera glycines
  Genomic contig location: Contig_ID=SeqID_8954; Location=5..2644; Strand=+
  SCN-specific regions: Sequence locations=1-165,188-490,513-610,634 -1001,1025-1134,1156-1261,1289-1616,1638-1819,1843-2154,2176 -2255,2284-2384,2406-2556,2583-2640
  Gene Ontology: Mol. function=pre-mRNA splicing factor activity; Cellular component=snRNP U5; Biological process=mRNA splicing
acggatgcaggagggatcactcacttcagaagtggaatgacacacgacgaggaccaaatcatcccaaatttgtacagatacattcaggtaatgctgaaattcttaaccctgatattttttatgtcgtatttaagccatgggaagcggagtttgtcgattctcaacgtgtgtgggctgaatacgctcttaaaagacaggaagcgaatgcgcaaaatcgacgtttgaccttggaagacttggacgacagttgggaccgtggcattccaagaatcaacactctgttccaaaaagaccgtaacacgttggcttatgacaagggctggcgagtcagaacggagttcaaagcttaccaaatactgaagcaaaatccgttttggtggactcatcagagacacgatggaaaattgtggaatttgaacaattatcggactgacatgatccaggcactcggaggtgttgaaggcattctcgaacacactttgtttagggtttgtcttttcattatttctttttccatgattacattctttagggaacatatttccccacttgggaaggtctcttttgggagcgtgcgtctggtttcgaagaatcgatgaagtttaaaaagctgaccaatgctcagcgttctggattgaatcagatcccaaaccgtcgcttcaccctttggtggtctccgactataaacagagcgaacgtcagactttttaatccttaattcgaaattgttttgttattcaggtgtacgtcggtttccaagtgcagcttgatctgactggaattttcatgcacggcaaaatcccaactttgaaaatctcattgatccaagtaccttttttgtacttggcttttctataattgtttttcagattttccgtgcccacttgtggcaaaaaattcacgagtcagttgtgatggatttgtgtcaggtgttcgatttggagttggatgctttggaaattcagacggtgcagaaagaaacaattcatccgcgaaaatcgtacaaaatgaacagttcttgtgccgatatactcctttttgctcaatacaaatggcacatttcgcgtccctcgcttttggccgatacgaaagacgtaaaactgaggggctaatggggcattcgttggttggctaatataaatattgagtctttattttacaggtaatggacaacacgaccacgcaaaagtactggctcgatgttcaactgcgctggggagactacgactcgcacgacatcgagcgttattcgcgtgctaaattcttggactacaccacagacaacatgtccatttacccctcaccaaacggcgttctcatcgcaattgatttggcttacaacctgtacagtgcttacggcaattggtttccgggcatgaaggtgctcctacgtcaagcgatggccaagatcatcaaggccaaccccgccttttatgtccttcgagaacgtattcgcaagggtctgcaattgtattcatccgagcctacggaaccctacttgacttcacaaaactatggcgagctgtttagcaatcagatcatttggtttgtagacgacacaaatgtgtaccgtgtgaccattcacaaggtcattggcttttttatacggttgttacggttattgttacaactttcagacatttgaagggaatttgacgactaaaccgatgaatggggccattttcatttttaatccgaggactggacaactgtttttgaagatcatccacacaagtgtgtgggccggacagaaacgtctcagtcaggtgggctgaacgccgatctatgtttgtttctacttttaataatttagctggcaaaatggaaaacggcagaagaagtggcggcattaattcgatcgctgccagtggaggagcaaccgagacaaatcattgtgaccagaaaagcaatgcttgacccattggaggtgcatttgttggacttccccaacattgtcatcaaagggtcagaattgatgctaccattccaagcaattatgcgagtaagctgaaaagaacgacatacgatttatagatctgctgattaaacttaattaatttctttttcagattgaaaagtttggtgatttgatattgaaagcgacagagccgcagatggtgttgttcaatttgtacgacgattggcttaaggttgtttcaattttacttttttaccaaacttagtattttttagactatctcgagttatactgccttttcccgggtcattctcatcatgcgtggaatgcacattaatccggacaaaacaaaagtgattctgaagcctgacaggaccacagtgactgaaccgcatcacatttggccgacactttctgacgaggaatggatcaaagtggaattggcattgaaggacatgatcctgaatgactatggcaagaagaacaacgtgaatgttgcttcactgactcagtccgaagttcgcgacatcattttgggaatggaaatcagtgcaccgtcccaacaacggcaacaaattgccgagattgaaaagcagacaaaagagcagagtcaggtgaccgctacaacgaccaaatcggtcaacaagcatggagatgaaataatttctgcaacgacgagtaactacgaaacaacaacattctcatcacgaacggagtggcga

SEQ ID NO: 46677 - DNA, 1216 bp, Heterodera glycines
  misc_feature (73)..(73): n is a, c, g, or t
  Genomic contig location: Contig_ID=SeqID_41748; Location=7..1222; Strand=+
  SCN-specific regions: Sequence locations=1-315,337-468,490-1216
tacggtgggctgtcggatgattcaccggcccctgggggactgatcggacagtttggattctgttcggctccancaaggacggtaaaccaacacccgacgctggtggaatcggaagggcggttggcaattgtttgggcggtagcaattcgccattgcccggcaaacaattcatcaacaatgtgccgacttttcactcactcatttgccaatgctatgccatttttgcaggttctgtacaaaacactgacctccggctccgtgctgccctcctccgcctctgccaatgcttccgccgaccccctcaacgccacttcggccctcggccttccctttcctcagtccgtctctttgccgcctgttttggccgctttgttccccgacctgaacacttccaccccaatcactctgaccgccgcccaacaggaggcgatcggggagaatttggagatgatccaaaatttgattgtgcagccgtccagtccgttgtgcagcccaaagcccgtggcggtggccgagttcaatttggacgcatttatgggacaatggtaccaggtcagtagtcagcatggcatgtgccatgaagaagggatttgaatgttgcttatgtttgtttcaggtgatgtacagtcctccgctcgtccaaagtgcgtgcagtgtcgtgtcctatcgcaaattggccgacattaacagcggcggaattggctccatttttgaagtgtttgaggttggaaagttaaagcacagagaggggtcgggtggcaaaagagcataatcctttgatggtttccttttcctacagtacacaacggacggcactccatacagtaagccaaagatcacttccggctacgcaatcattaaacaaatgggcgaactgatcttccggacgaccgcccaccaggaagacgttaacagtaagagatcatttgcgcgggattaaccaattaattaattgaccggctaatttctgttcagtccatgtgttgttcaacggacctttgaacgagcgaggacagtatgaattcactgtagtcagcaccaactgcaattatcccgtgtacgtattcgcccgagaccccgtcagatacaaacaggtcgaattcggaggggggtgccaacgggtgcttaatttgggcaccactcaaaatgcctttcagaggtacgaaatggcggtgcaacagcttctggaacagaagggcgtcgtcaatggtatcag

SEQ ID NO: 46678 - DNA, 1059 bp, Heterodera glycines
  Genomic contig location: Contig_ID=SeqID_41768; Location=1..1059; Strand=+
  SCN-specific regions: Sequence locations=1-594,624-903,925-1059
  Gene Ontology: Mol. function=DNA-directed RNA polymerase activity; Cellular component=mitochondrion; Biological process=mitochondrial genome maintenance
aagcaattgatcgcaattggaattgacagggacaaggtgagtgccatccataacagttatccgaacggaccgggccacaaatgccaccaataataataatcgttgtgccattcattttaggccaggacatatttcgccccctatttaacgcattgtgcatttgaaagcctcacgcaagcattcacaaattcaatgtttgtctttccttttgcgctgcttttcccccgttcatccttttttaccccagggcattgatggaatggttcaaacggtgtgcccaccaaacgctgaaattgggccgtccgatggaatgggtgactccgcttgggctgcccgtggtgcagccatatgttacggtggacaaggagggcaccggccttgtgtttcggcccgtcccacacaaacaggtagcccaaccaccacacaccgcatgggcatgtctattgaagtttggacttgggaggagggggggggggagcggatgccatcccatggtgcaacttgaaatggcacacaatgtgccaatgtatgacataatttcctctctaattcaccgaacaggtcaacgcttttccgcccaattttgtgcactctttggactcctcccacatgatgctgaccgcgctgtgctgttaccgacacggcatcacttacgcttcggtgcacgactgtttttggacgcacgcgtgcgacgtggacgaaatgaacagggtaagacaaacggtggcagggcgaggggaggggggggggaatccacctgtgttgatcaatcagatcagttaaatgatttttccagatttgtcgtgatcagttcatcgctttgcatgagcagccgattaccgagcaactctcccgggtgctaactccacttttagccccttttttattcccattattctttagtttttcacttcaacatttttaccacccgaactgcgccaattaatgtccgtcgacgaccaaccgttgctgaacaaaattgtggaggagttcaagctgaacatacccccgggcaatttggacattaccaaagtgcgcgaatcgaaatactttttcagt

SEQ ID NO: 46679 - DNA, 1221 bp, Heterodera glycines
  Genomic contig location: Contig_ID=SeqID_41775; Location=172..1392; Strand=-
  SCN-specific regions: Sequence locations=1-1221
  Gene Ontology: Mol. function=RNA helicase activity; Cellular component=small nucleolar ribonucleoprotein complex; Biological process=rRNA processing
ggtgtgtgtagtttctacaaatgttgcagaaacttcgttgacgattccaaatgtccgttacgtcatcgattctgggcgggaaaagaagagggaatatgacccgattacgggagtttctcggtttgtggtcggatggtgttcaaaggcgtctgcagaccaaagatccggtcgtgccggacgagttcagtccggatacgcattcaggtgacatagtaaaattaggacttttgaagggatttgtgcattttggtttagattgtattcttcggctgtttacgaagatatgcgcgatcattctactcctgagatccttaataaaccgatcgaccaattgattcttatgttgaaagcaatgaatttcacgaaaatcgacaattttcctttcccgactcctccaagattggaccaaatcaaatcttctgagctgagactttctcacataggggcgcttagagttcaagaagttgatccatgagtcacttttcttgttttttataattgtcctttcaggggctttataccatcacacaacttggacaatcacttgcgcagctgcctctcactccttcttttgcgaaggtcgtcatcagttcaattcgtggcggacttcttccttttgccgtcactttggtgtcggctctctccgttcgtgaaccattattgttcatttcaagcacaaaagaggacggaacggaagagagacgaaaaagaatgtccgaagtgattaagcaaagatttctttggtgtgctgttggcgaggctcgactctttggtgatttgacagtaattctgaacactgttggtgctgctgactatgaggaagaggtgggccacagaccaagcacttcaaatttaattaaaggagatttgtaaaggaatattagccagatttccagaataaacatttgttactgtcactattaatttgcgcaaaaaaattcatcttaaaatactcataaccagaatactcaaaaaactttcttcttgccattttgaccataaattttggttatttatgaaaaatgaggtaccattttcaaacagaacgctcacgcaatcgaagccctaggacttcgccctaaggccctaaaggaaatcaacaaacagagacatcagctgacgcttcttctgaacaaatccgattctggtggagaagttgcccgagaagttcagaatggatgcaccctcccaagaacaactgaggagattaaggttgagtga

SEQ ID NO: 46680 - DNA, 1156 bp, Heterodera glycines
  Genomic contig location: Contig_ID=SeqID_41809; Location=135..1290; Strand=+
  SCN-specific regions: Sequence locations=1-497,521-542,564-889,940 -1156
  Gene Ontology: Mol. function=transporter activity; Cellular component= secretory vesicle; Biological process=locomotory behavior
tcacttaaatcttatatttatcaccaattggtcaaggttgaatacacgggtgccgtcgacgacattttctatgctggcacggggctgttgctgttgaagaacgcggactctgtgcaaatgtacgacttgcagcagaagcgtgtgctggccagtgtcaaggcaacaaaggtgttgaacacaaaactgggtgttcaaaattactgaaaatttgaaaaaaagtgtttgaaattgaagttttatccaacgataaacctaaatcgtcactctgtttccgcaatgtttttgctttcaggtaaagtacgtcatctggtccaagaacatggaatgcgccgctttgctcagcaaacacaccgttaccctcgtcaccaagagattggaggtggcgttgtactctttggtctcgtcttacaatcttttttctccaggtgctcggcactgtgcaggagtcgactcgggtgaaaagcggcgcttgggacgcgggcaatgaggcctttctgtacaccacctccaaccacatcaagtacgcgttgaccaccggaggtgaccatggcatcatccgcaccatggatattccgctgtacattttggcggtgcgcggcagccgactgtactgcttgagcaggttggagttgtaaattccttttttaagacatttcggaatgatctttttgcatttattagaaatttttaacttaactttttacctggctcaattttttcatcctttttatgtgatttgttacacagagaggcgtcgcccgtggaattgtccatcgatctgaccgaattccgcttcaagctggcgttgacccatcgtcgttatgatgaggtgttgaacatggtccgcaatgccaatctgctcggccagtccatcatcgcatttctgcaaaagaagggctacccggaggtggcactgcactttgtgaaggacgagaagacgcggttcggactggcgctggagtgtggcaatttgcaagtcggtttacgagtagaaaactcaactttagatgggttttgacataaactgatttcaaccaattatttttaatgacaagtttcaaactccaaggacttgaaattcttcattgaaaagcactctcattttttattttttggtatgtgatggaatgaaatgcattaattttgacaaaatctc

SEQ ID NO: 46681 - DNA, 2036 bp, Heterodera glycines
  Genomic contig location: Contig_ID=SeqID_8970; Location=1796..3831; Strand=+
  SCN-specific regions: Sequence locations=1-226,264-635,657-800,823 -882,906-948,988-1085,1107-1370,1394-1544,1566-2036
atgagtgcagaggaattcagtgccaaactgcgcgaagtcactggctcacaggtgacccaaaaaatacggcaaaatttttgtgcaaactcttttctatttaatttcgttgttaaattgatcatatgaaaatcccagcaaaaatttgattaatttaaatttgttttatgatgccatttgatagagaaatgtttgctgatcattttaaaataagtttaattactctacctttattttaattttttttatgaacttttaaaaattttgtcatttttatcgatttttcggaactttgatcaaatttttctgatcatttttggcgccggagccaaaaaagccgaaaattggcaatagtaaatcgactatgctctacacgataaaagtggtttaaaagtgatttgaacacatacagttcgtaatgttcccttgtaaatgtacaataaacaactttttcgcttcattccatttatttgctctgtttaaggacaaaggcactctgttgccctttttgaaattgtcacttccgttgctgcgcgtctcccttcgcaaaggcgaacagaatgaattacagcaaatgcttcgtttggacggtgccggaagcgcctcgcccgaagaaactgcggttaatctgatgacagaacatttgagtggggtgggagacgaaaggcgttactttcaagaacaaggcaacaaaatgccactgatttttaatttacgatagttttcttagattatgattcaatcaaaagaaaatcatttttattcttgacataatttttaattttttggcagttgctttctccgcaacaacaacaactgtcagacaacggcgtcgatgaggcggtcacggcacagcgacaacttcaagtgtcgcgcagtgtgccgccgccatcgcttcagcaacagcaaattcaaccggcacaaattgtcaacgtggtccgtccgctttctgtacaaagtaatttttaaaaagaaactacgaatcagtaaaaatttttttactcctttagattctctcaacgcgctgtacccggcgacgaccgcttcgaccactttcgttgtcgagcgaaagccgccaacaccacagcagcaaccattgcagaaacagacgcccattgcttccgcctcaccggcacaacaagttcaagcagtagcgcaacagccgcaacaactgcaaacgaatcggcccccttctacgagttcatcaatggcaacaacaaatgtgcatgagagcagcggtattatgtttattcagatattagttaataaattaaattcattaagccaaaatcatcgcaaatttttaaaatttttagcatcaacgacaacattagcccaagcgcaaatggcacccgaaagtttgcaggtgggcacttaattttttgaaaaacagggactttttccccttcgttgcgaacccccctatttaatgtattgtaggaaaaaactaaaaatattacactaaagataaaagtatttaattcctaagccaaaaaacggtcatttgcatgaaatttttggaaaagcacactctgtttaggtagattcttataaattattatagattactattttcattcaatattagaatttgccaccgatgttgctgaatccacaagcactcgccgatcgcattttggcacatatgccggacgcgcaaggcgttgatgccgaagtgctttccatcatttcaatggtattttcatgatttatcgaatccattttgcccccccccccctcttaattttttcaggctgctgaggctcgtctgcgcaatgttttggctcaattggcctcgttggccgatcatcgtcaacggccgttgcgcatcgacccgaactatgcattggtggacgaaccgcgaaaacaaatgcgtttcatggaggacattgagaggagggctcacgaaagtcgcgagacggcagaaaaagaggcgatgatgcgaacggcgaaaagcaaagggggcaaagacagagacgtggtggagaaagcgaaaatggtgggacattgggcaggcggaaattgacccaaattaccaa

SEQ ID NO: 46682 - DNA, 730 bp, Heterodera glycines
  Genomic contig location: Contig_ID=SeqID_1201; Location=1351..2080; Strand=-
  SCN-specific regions: Sequence locations=1-118,140-534,557-682,706-730
atgattatttccgtgtggggaatcgtctttctaggccttcttggcgttttcttttatatgcacgctgtgactttgtttccagaccttcaccttgaggaagaagcaaagctagaaaggtaaatgccttttaagataaaaactcgctgcaattaagctaaataagcaaatgcatttttgaccgaaaaacttttagacaaatggtggaagaaaagtacgaggaaaaggcgaaacaatgctggatagctgcaggcatgtatgtggtcactttgattgcagtgttttggcaaaaccgattcaacaccacacaaattttataattcgttttcaatgacaaatttattcgttcattatgttacacacattatttgtaaacaaacatattttaagaccatttgattaaagaaaattttctcctaccccagcagactattgtaaatctcccatttattaagatccgttccaaatctattttttcttctgggtcagtcgcttttgtcccgtttatcttcagtgcaccagctctcatcaaatttattccatcctgttttgtcattgcggcgagatcacccattgtctttatcgaaccacatacaatttcgaaggttgaggccgagccgaacatttctgtgatttcatccgggttgagattttccagttccgaactcgaagcgcctaaacattagacattaaaattcaaatatttaatttgtggtattcaccatcgaataaa

SEQ ID NO: 46683 - DNA, 1673 bp, Heterodera glycines
  Genomic contig location: Contig_ID=SeqID_1201; Location=23..1695; Strand=+
  SCN-specific regions: Sequence locations=1-161,185-403,428-601,623 -1353,1377-1502,1525-1673
  Gene Ontology: Mol. function=tyrosine-tRNA ligase activity; Cellular component=mitochondrion; Biological process=tRNA modification
cagtttcaaatcatgctgtatcaaaatctaagaaaaattgtgccatcagcagattctcaaccgttatcctccttcattcatgatttattacgacggaagttattaagctgcactcatcccgaatttccatacaaacaacaaggtgtataatacatcattgtgttctttatttcatttttaaatactttacagatataactgcatattcttcgacattgccaaacgtgctttacgcgggtgttgatccaacagctgacagccttcaccttgggaatctcctcgtgctcaattccctgattagagcttccttttttggttgttctcctattttattaattggagaagcaacagcttccgtcggagatccgagcgggcacaaaagaggtgccagacaaaacatctaatgaattattgataattttaattagacaggaaattgttattacatgaatttatctatgcgaattcaaaggcgttgcaaagacaggtggagaaaataaaggcgaatgtttcatcattgtatggggaagacatttctctcgaaattcgaaataatgcagaatggtataaagaggtgagtttggctcgtgggtctcttaattttcagctttttattagatgcggattttggactttttcgaatcaacaaaaagatttcgcatgagtgacatgctgaagagtgggccgatcaagtctcgtttagacgactgtgaaacattgtcctatgctgaattttcctaccaaactttacaagcaattgactggctaaaactttacgaagaaagaggctgtctttgtcaagtgaatttattatcgaattataatttccataccccaaaaattctcttttgctgttagattggcggaactgatcaatttggaaatatgagagccggttttgagcacatacgagcaaataccgaacgtttatcaattgcgctttgtatgcccctactaactgataaaaatggacgaaaattgggtaaatcttcggaccaaaacggaggcactgccccactctggttggatcagttgaagacctcagcttttgcattttatcaacatcttcgacagctacatggtaaaagcaatgttttaataaaatgcacttttttaagccgtatttcataaaattataacgtttagatgatgctgcggaacattttttggttagcttttctcttcgcaaataaccgaagttgaagatgtacttgaagaacacagaaataatttgggaaaatgggtcgcccaattcatctagcagaggaaatgacagccattgttcatggaaaagctgcgctggaaagagccaagaaatgctctaaaattttattcgatggtgaataccacaaattaaatatttgaattttaatgtctaatgtttaggcgcttcgagttcggaactggaaaatctcaacccggatgaaatcacagaaatgttcggctcggcctcaaccttcgaaattgtatgtggttcgataaagacaatgggtgatctcgccgcaatgacaaaacaggatggaataaatttgatgagagctggtgcactgaagataaacgggacaaaagcgactgacccagaagaaaaaatagatttggaacggatcttaataaatgggagatttacaatagtctgctggggtaggagaaaattttctttaatcaaatggtct

SEQ ID NO: 46684 - DNA, 618 bp, Heterodera glycines
  Genomic contig location: Contig_ID=SeqID_1202; Location=648..1265; Strand=+
  SCN-specific regions: Sequence locations=1-25,47-95,119-566,590-618
atgtctgcgttaattccatttataattgttacactgttttgggctgtcattggtgcaggaggcccatttttggtaccaagtggtatgaacagaggtaatatatattttcaatatatttcatcgttttcgaatgttaaaatgaataattatttgtttccgattttgtatcattattttttaagggatcattcaaacgatgatcgtactgaccgcagtctgctgttatatgttttggctgatcgtctaccttcaccagttgaaccctttgataggaccacaactgcccgtgaaaacgatttggtggattcacaacacttggggtatataaatattgtacaattgcctatttctcaacacacatagtcgactcaatcttaattttcatttctcaaaactccgaattaatatcttacaatacatttctatttttagggaatgtgaagaattgatgatcgatgattgcagtgattttccacttttgggtgtagtattagtgaattctctatttctgtgaaaaactggcatgacaaaaagacacatataatttttcaaccttttatttctataaaaattgctttattttttattccattgaattaataattgttttcattatca

SEQ ID NO: 46685 - DNA, 1045 bp, Heterodera glycines
  Genomic contig location: Contig_ID=SeqID_41840; Location=283..1327; Strand=+
  SCN-specific regions: Sequence locations=1-186,208-731,754-1045
  Gene Ontology: Mol. function=enzyme activator activity; Cellular component=DNA replication factor C complex; Biological process =embryogenesis and morphogenesis
atgtgcgagtggaggaaattcccttttcggtaagaaaatttgaaaaagttttgatttttcaaaaattttgttccctaatttttattcgttctttcaggtgcccagcggtaagaagcttcaaattcactcggtcaacagtaactaccacatagagctgaccccgaggttgtccccaccaattaatttgctaatttttacattttctgtcaatttataatatttagacttggctttattatgactgttttccctcatccgtgacccatttcagtgacgttggcatttacgaccgagtgattgtgcaagaagtggtcaaaacaatggcacaagttgagcagctgaacaggtccacgcaaaaggctttcaaagtggtcgttctgatggaagcggagaatctgagcagagaggcgcagcattcgttgcgtcggaccatggaaaaatacgcggggacgtgcaaaatcattttgtgttgcgagtcggcgagtcgcatcatcgacccgttgcgcagtcgatgcatgttgatcagagtggcggcaccaaacgacgcgcaggtgggacgagcccaacgcagcgcgaaaaacttgcttgggggttttctgggagtggggataatcgaaaatacaagtgtgaaatcccttataaaggccctgaagcggcacttatggccaaaagatactcataattttccttgtaatttggggccgggactgaacaccaaaaagacccgtcagaataatgaacattataaaaaatatattcatcaaaaccctttgtcttatttgtgtaaatctcaggtgttacacttttccgagtttctcaaattttcaatttgaaattcattgcgattctcgacaaaacatttcttcagatgcgcgaatgcattgagtcggtctgcgcaaaggaacgcgtgaatttgtcggaattttggatgaaaatgttaatcgaaaaagcgggcggaaatgtccgacgtgcgatttgtttgttggaagaggagtgtagcacaaaagtgaaggaaataatgagccaatttaatgggaatatgtga

SEQ ID NO: 46686 - DNA, 1285 bp, Heterodera glycines
  Genomic contig location: Contig_ID=SeqID_41864; Location=1..1285; Strand=-
  SCN-specific regions: Sequence locations=1-460,482-563,585-801,823 -1005,1030-1264
  Gene Ontology: Cellular component=peroxisome; Biological process =lipid metabolism
tttagggatatcgactcacttttgtcatcgcatatctccgggtaagttccatcatcttacatctcattgacattgtcggctaggaagaaaaaataaatttaggacatggccatggattacgcagtcatcggtaggatttgtgaatgggattttgtggccaagtttaagtcccgcaaatatttttgatcacaaagttatgtttatggcttaaccaccaccataattaaggtgaatcctttgaaacatcagtgccttggtaaaaaaaacggttataatttgcggattaaattcactgttttatcaataaggtcacgcgtgttggacgtgtgccgaaatgtgcgcactttgctggtgcatgaggcacgacggcacggcattaaatacccggtgttggccacgtgccggtcagcagttaacattaatttatttgatggctgattaaattttcggatgtaatgccgaattttccataaatttttatactcgatttccaatgattccattcaaaagagggtgtattagcaaacagttattaattagtcccgccattactgaaattgcgccctttctttcgcttcttctctttcagtgtcacccaagtgtacgatgccggcgcctgcatttatttttactttggcttcaattgccgaggccttgaaaaggacccattgcatgtgtatgagcaaattgaggtactgtgccattcatcatattcgctgctcgcgactcttgccatcattagcttctctggacttttagggaaatttattagatttttgagtcattggcccgtttccaagtctcgagatcattcaaaaactcattgaattgtacgacccggttcccatgctaaagtctaaagtataaacttgaaaatcttcgactcccaatctcatcgccgctttaatcagcccgaacattaacacaaatttttgcagaccgctgctcggaatgagataatcacatgcggcggttccatctcgcatcatcacggtcagaaagtggaaataatttaaaaattataaaaatcattgattggattgatcagcaggcccactaaatgatcatttttgctccttgcttttcaaaatgatttaccacaatcccattttgacattctaaaagggaacgaatataccgatagaaccttgctaagaccttaatccaatggcaaagccatgggtgcgaggccaggggtgtagccatggtttagaaattcccgcggtcacggatcgcgcaagaaagaacgatcattcactgcccaggaatcggcaaaattcgaaaa

SEQ ID NO: 46687 - DNA, 636 bp, Heterodera glycines
  Genomic contig location: Contig_ID=SeqID_41892; Location=83..718; Strand=-
  SCN-specific regions: Sequence locations=1-13,35-365,387-407,430-636
atgtcaccagaaccaacgcctccttttttgcctgttgcgagcgcacatgcaaaagtggaggaagaagtgccaataccatcgacagctttgaagccacagacatcgctagagctagacgaggtcaagaaagaggcggaatcacgacgagaatccgctgaggattacgacgaggactatgacgaggaaaagcccattgacaaatcgcctggtaattagcgggagggaatggctcaaaggtcaaccacaaatcgatcctttagataaccgatttttgaaatttgatgaggaattgggtcgcggttcgttcaaaactgtttaccggggtcttgacactgaaacaggcaaatgcaattgttcacattggcatcacatcactccacaattcattcgtttctgcaggtgttgctgtcgcttggtgtgaattgcaggaacaaaagttgaacaaagcggagcgccagcggtttcgggaggaagccgaaatgctgaagggcctccaacatccgaacattgtcaaattttacgactattgggaacggacggacgggaaaagaaagttggttggcttcccattttattttgtttggggccgtcgattcaaaaatgcaatttgcagatacatcgtgctcattacagaag

SEQ ID NO: 46688 - DNA, 532 bp, Heterodera glycines
  Genomic contig location: Contig_ID=SeqID_1206; Location=1508..2039; Strand=-
  SCN-specific regions: Sequence locations=1-389,412-532
  Gene Ontology: Biological process=gametogenesis
atggttcacgatggtactgttgtcaatctgacgcccgggtcggtgattaacgagaaaatggttcggccggacatacccgagtttttcatgcaatcacactatccaaaaaaggtcagaagcaactgcaaagttttctctaaattaaatctgcttgttttaggggactggcaagccagtggagtacagtgtgttggtggacgaaatcggcatgacgcaggatgaacttcagggctttctgaatgcattgtgctacagccaccagatcattagtttcgctatttcccttcccgagcccatttggcaggcggatgaattggccaagaggggccgcaacaattacttaactatgaagtgagtttggcatggagagtataacgttaattgcattttcactttgtattttttgtcatttaggcgcttcttccccaaagatattccgcgacttcccaacggtgtggtcgacacgaagcgactgacggaaggcttatgctatcgcaacggacgtttgagcgccacacgtttcactgcttaa

SEQ ID NO: 46689 - DNA, 475 bp, Heterodera glycines
  Genomic contig location: Contig_ID=SeqID_41963; Location=963..1437; Strand=-
  SCN-specific regions: Sequence locations=1-153,175-187,209-211,234-475
atgtacttggctgatcaggaagcggtacaatttgttgccaatgctcttcaatggcttcggcctgacggttatctccatttgcgcgagtcgtgctcagaaccttcgacaagtacgtaagctatttgaaaactgggatggctgcatacttattaatttttaaattgtacagaaaaatctgctgatcactcaaccaccacaaccactaccagcacttcatcatcctcatcctcgtcgttgcacaacaattcgaagccaaatccgacccgttaccgcttctcatccgcctacatccaactgttgcgctccctccggcacacggacgtgcaaagcggaacccagtggcgcttcgatgtgcagtgggcgtgctcagtcggcgtgtacattgaggtgtggtgattggtgtaaagcggctagctgaaaaaattatatatttgaatgcaaaaatcaaatagaaaagaattaagcaaaaaataaa

SEQ ID NO: 46690 - DNA, 4461 bp, Heterodera glycines
  Genomic contig location: Contig_ID=SeqID_9016; Location=665..5125; Strand=-
  SCN-specific regions: Sequence locations=1-143,181-227,249-491,515 -556,581-591,613-766,789-809,832-959,999-1174,1196-1357,1384 -1551,1573-1576,1607-1742,1861-1924,1961-2005,2030-2136,2170 -2296,2500-2529,2551-2969,...
  SCN-specific regions: Sequence locations=...3015-3101,3123-3500,3523 -4283,4305-4461
  Gene Ontology: Mol. function=protein kinase CK2 activity; Cellular component=protein kinase CK2 complex; Biological process=flocculation
atgccaacttattcagcgatggacagtcgtcggaagaatgatggtggaaatggagcggttacagaagtgaaggaatacaacgccaagtgggcggacgaatacggtatcggccaggacagattgccaaagaatgtggccaagacgggggaggaggaggaggacaaggcggacgaggaaaagttggtggtgatcacggtgccggacaaattttcgccatggacgctagagaggaggaaaacccaccatcagttgtgagaattctctctcgagaatctcggccataaatgggactcatcgagaatctcgacagtagtgccaagtcgcaggaggcattttgccaaagttttttgtttgttttttgtcacaatgtcaagaaattgtctaataattctcgggaatctcgaccattgatgggcgggcccctcttgtcagtctcaagtctcttggcaaattttatttccagttttcacaatgacaagaaaaatggagcaatgttgtgttgttgtgttttttggcactggccctcaatttcggcacgaatttcattgcttttgaattgttttactgtatatattttttgcggttgaaataaaagagaaaattacaaaaaatagcataataatccataaaaaaaatttctttatgggccaagtcgtgcatcaaacgaagccacctttttgaaaaagaaaatctaaattttttggaaatttttgacacagtttcgtttgaaaaaatttttcgcagaacttcggccagcaaaaatcacaaattaattaaggggaacaaaaaataataaattcaccagcgaaacaaacaattacaatgtttatatacggtgatattacggtaattgtttttttaaatgtgccaacaaatagaagataaaactttttttttttgctttttaatagagaaaaaattcttatccactcgcctgcttctgtaaggccaggataccgccgggaaatttttaaaatttattcatttttcacagattttgcgccattgaatattattagagctgggatttttatgtttttacatatatttctttgcggcttagttacgacgagataagcccaaaaatagcattttctccaatcgacatacttgttgctggtttattttgtagttaataaaagcttagattgtcaaaacattaaaagtaattacttaaagattaacaaaattatttaaatgcaattttttttgcaaatcaactcgtacgaaaacgtcctggcctgtaaaaatcaagcacttctaacaaattttcaaaatgtttttttatttatttcgaatgcaaaaatagccaaatcgagttcttaattgagtcattggatttcgaagttctctgctgaaactttcaatttaaaaaataatttatcaaaaaacaaaaaacaattttaccctaggacgccttgacacgtatttgatttgcgattgtgcgggcgaaaattaatatttttcctatttttagcacatatttcagcattttttagaacatattttattacatatttcaggatttttagcacataaaaatcccagctctaaatattatacataaaaattggactaaaaaataactatttttttaaattttataccaaaatcgagaaaaaaaggaaaaaatgaaaataaggtggtagaatcttcgaattaaggatttcgcaaatttctaagaacccctccgaataagtacaaatcagaaaattaggacaaatagtaaattttagagtgccacgggaccgggaccgggaccgggccgggaattcccggtcatccgaggtcccggtcccgggttttgaaaagctcaggtcccggtcccggtagggcaaccgggaaccgggaaccgggaaaaacaagcactggtaagaatgggggtctgagtgaaaaattagtgaagaaaattggagtcaaagggaaaaataaaaaataataattaatatattctttaaaagtaaagtcgacgattgtgcggatggcctagtggctagtctccctgtctttccctttttctttcccatagtttaattcctctacagtaattaaattattttgaattttctttttgtatactcgtgggtttcctatagagaaaatatgattcctcatagtttttttttaaattgatacatattttatcattttttaaatgaaaatcctaccaattgagcttaataatcacaaaaaccaacttttttttgttgaaaatctgtaacaaattacacccaaatttcaaaatttcccaaaaattttttgaaaaagcgcgccgaaaaaatgttatgtgaaaagcaaatattaatttataataatatcaatcatttagtccaaaaaaatattaattgtttgaaataattaaagaaatttgtttgaaaatttcattaatttaatttattaaataaaaaaccaaataattttgtattattttcacttgatataaattaaaatttgaatttttttttaaatttttaaaatttttttgaatttttaaaatttcccggttggtcccggttcccggtttttcttgcggtcccggtcccggtcccgaaaaaaaatcgaggtcccggtcccggcttctcaggtcccggcaagtcccggtcccggttttggcaaaaattcccggtctcgtggcactctagtaaatttgcccgatttggcgctatttgcaaagagcaaccttttgaaattttttttcacttttttttggtcaattttttttttgtttatttttaatgcagaatttgtttttttaacatggaacgtattgcatactatttaataaactgaaaaaaacattttaaaagaaaatttagcgctagttaaaaattgacaaattttgagttttatcaaaaaccaaaggggggaccctattgttttgcaaaatttttttgagataaaaaatcgtgaatatattttttattcgccataattatgctgttaatacttaatattcatcattatgtgtcaaaaaaacaaaaaaaaaaaaattgaccaaaaaaagtgaaaaaaaatttcaaaaggttgctttgcaaatagcgcctatttataaatcctattgtgtttttttttaatctaaaatactcgatgatttttggcttaatacatagcatatttgttctttagattggttgtgacttagaatgagcagttccgaagaagtttcttggatctcttggttttgtggtttgcgtggcaatgacttcttttgcgaagttttatgacatataatataaatcttgacattttattgtaggttgacgaggagtacatccaagaccgcttcaatttgactggactttctgaacaagtgccgcactttcgacaggctctcgacatgattttggatttagaaccagatgatgactatgaggagggacagtcggatttggtggagcaggcggcggaggtaaaaaagcactctaactctggtaaatgtgtatcattggcccagagccaaaacgaaaaaaaaaactaccttattaccaaaaacaaactcaaaaatactgtttcaatctttaaatttgtttaaaacttaaaaatggggaaagaagcatgcttaatcttttaagacgtcaagcccggttaaaaaattgaaccgctttaaagactcattgtcagatgtcgttgggtgttttggctctgggccgtatgatacacattttccccagctctactcattgccagccattcttagatgctatacggactgatacatgcacgttatgttctaactaatcgtggcatccagcaaatgatggagaagtggaagaatgaggagtttggcacatgccctcgggtacactgcgaaaatcaggcagttcttcccatcggttggtgttttatctgttggcctctcactgttccatggttcaggtctttctgacgttgtcggtgagtgcatggtccgtgtgtattgtccgcgttgctgcgatgtgtacgtgccgcgctcttccaagcatcagcacaccgatggtgcctatttcggtcagcggtattcttttcgctttacttaaagcatcccatccctttaaggcactggctttcctcacatgtttttctttgtccacccgggactgagacccaaacgtccgaacaaacagtacgtgccaaggcaagtcctccctcggacacatcggcaaacaatcgactaattgcaatgttttcagattatatgggtttaagatcagtcccatggcctaccaattgcaggtggtcgtttaaaacactttttgccatttgcgaatctttcagtattaccaaagtcaatcgccagttagcggtgtccagggcacttcacagcagcaggtcaatcttctgattttgttgacttattgtcaatgaatgactgtttgttttgaatttgaggccgtcaccccccagcagacgactcaatcggtggcgcaaacccaacttttgaataacggaggaagacaaagcatggacgcatttgacgactga

SEQ ID NO: 46691 - DNA, 938 bp, Heterodera glycines
  Genomic contig location: Contig_ID=SeqID_42074; Location=56..993; Strand=-
  SCN-specific regions: Sequence locations=1-135,160-214,236-502,534 -601,624-725,747-938
  Gene Ontology: Mol. function=translation factor activity, nucleic acid binding; Cellular component=eukaryotic translation initiation factor 4 complex; Biological process=regulation of protein activity, epigenetic
atgaacgcaccggaaagaaatgatgaagaagtgaaatatgaggtgggcaattaattattgggggggggggagggcacggcaccgagcgaattccaactgattaattcttaattggtgtcgagtatatttggtcgaatgttggggtgaaatccatttcattggaattacagttggattttcgaaaatttttaacacgggacaaattccatagaatggagtctctgagtttcaatccgtccaacaatttcatttcgatgaaatttcagaagttgtgcaaagaaatgcgcggactgctcaacaaagtcactccgtccacttacaaagacttatccgaggaattcatcaaatacaaaatccacgaagaccccaaacttttggaggttttcgctgtctcaaaactaaaaaatcataataatattgttatcctcacagatgatcattgatctgatctttgacaaagcggtggaagagccccacttttgtccattatattcggatttgtgcaaaaagcaagtggaggaggagaaggtggcgatggcagacaaacagccgacggagaagagcttcaggcaatccggggaattaattagaaaaagcccaatctttgggctttaattggggctaaatgggtactaattagggccaaatgaatactaattctaagttagccccccaataaggccattttgcatgggttcttcaaaattaaccaaatttggctaacaaaaattaattttcaattttataggactgagatcattcagaagtgccaaaaaactttcacagtttccaatcattttgacgataaaatcgccgaactgaggaagaaaatcgacgatttggaagaaggcgacgaaaagggaagggcacaagtggaagaggaaatagagggacgaaggagcaaggaaaagcgacgactgctcggcatcatttcgtgg

SEQ ID NO: 46692 - DNA, 935 bp, Heterodera glycines
  Genomic contig location: Contig_ID=SeqID_9036; Location=139..1073; Strand=+
  SCN-specific regions: Sequence locations=1-383,406-681,704-855,878-935
aggaactgaagaatgaacccaactgtcgcctcttcgctcagcaaattgcacggaccgccaaagacatcgaaattctgatcgattctttgcccgccgacgaacaatcggtgcgcaaattaagccatttaagcgtcaattaattaattgtcccttaattatccccagttgtccgtggaagagcatgagaaggcgttgttggagttggacgacgaacgcgcacgggcggccaaagtgcgtgaagcatttgcatttatgggaaaccgataaaaaaaattgaatcagagaagggattaatcggccacagttattcatgccatcgtaaatgtccggcaatatcagaaattttaattggaccaaatttaaaacccgcaaaaatataccaattttttccaaaaaacactttttacatttaatggacacttttggattttcgaattgaacctaactgttatctcaatcatctaaccgagctgtccagccgaaattcaaagttgtgccgtaaagctagagtgcagcgggacctaaacacggacaactgagtaccgaggtcccggttttgaccggggccgggactagtcccgggtttcccagccaaaaattcccggtttttcaacccgaaaaggtctcgtttaagcccaaaattcccggtcccgctgcactctacgtaaaactcataaacgatgggggaggggaaacaatttaatttggataatttatttggtctaatggatttaatttgtttatgcaggagcttgaacaagcagtggaaaaggcggagaaactgacggatcagttgggcgaacttttgtcacgcattgcgcgccttcaaatggaatcgcgcccgatggcattttccacctgaaaacaaccttttcaacccacattttttttgtcgaatttatttgaatattaatacgcataaattaattttatta

SEQ ID NO: 46693 - DNA, 1313 bp, Heterodera glycines
  misc_feature (24)..(24): n is a, c, g, or t
  Genomic contig location: Contig_ID=SeqID_42102; Location=1..1313; Strand=-
  SCN-specific regions: Sequence locations=1-427,449-1313
  Gene Ontology: Mol. function=high affinity oligopeptide transporter activity; Cellular component=integral to plasma membrane; Biological process=oligopeptide transport
cggccgttttcgcgtcattctttngggtgcgcaaaatatcctatttttcaaatttttattatactcataaatacagaaaatgagcaaaaacggaatgattttaaacttaaactgatcaaattgatctcccttttttagttttccaaatccatcgcttttttcatcggagtttttttcatggccaaaacaaaaaagcaattaaattcttcacattataattaacatcattttccgtcatttaattcgttgatgccttcgtcaggtgtcacttgtctatgtgtttggccatgtgctgctctccgtcggtgccattcccgtcttggacagtttggtccgcaaaacattggactattccggcttggccgtgatcgcattggccaccggcgggataaagccgtgtgtgtcggcatttgcggccgaccaattcggcgacgaccagcagaggcagcgaacgcagttcttctcggtcagttatcggtgccaacgaaccaacaaccaattgttgatcagtagcctttaaatcaaatcaattttgtcactttttcccaaggctgatcagtattggtcctgatcagtggtcgtttgccatacaattggcaatagtcccaaatgatcaatccgccgttcagttcttctacttcgccatcaatgccggctccctgctcgccatgggcatcacccctcggctccgtactgtccaatgccttggtgccgaccattgttttccgttggcttttgccatccccggccttctgatgctcgtcgccttcctcacctttctgtttggctggcgcaactacaaaatcacgccggccaacaagggcaacattctgtggaaggtcgtccgctgcattttcttcgctctccgacgcaaaatccgcaacacatgctggtgaataattgggggaggggagactgatcaaatccagcacagagataagacaaagtgatcagaaaatgccatcgcatcgtattcggcggaatcgatgctcaaattttttgtcacttagagggcttaaactcatagtttccgcccatccttagccattgatggcatttgctaaaccttgaaattgcctaatataacaataatttgccctatgaattgtctcaggggaagcaaaagccgaagccatcggcgatcgcccgaccattggttggactacgcgcgaccaaagtacgacgagcatctgatcgccggagtcaaaagcatgttggccattattgtgctgtacattcccatcgtgttcttctgggctttgtacgaccaacaggtgggaaaagcggttttaacacttttcatgacattgtct

SEQ ID NO: 46694 - DNA, 177 bp, Heterodera glycines
  Genomic contig location: Contig_ID=SeqID_42123; Location=217..393; Strand=-
  SCN-specific regions: Sequence locations=1-39,63-177
  Gene Ontology: Mol. function=endopeptidase activity; Cellular component=proteasome core complex (sensu Eukarya); Biological process=ubiquitin-dependent protein catabolism
atggcccgtcgctatgatactcgtacgacaatcttctctccagaaggccgtctctaccaagttgaatatgcaatggaagcaattggtcaggctgggacttgtcttggaattcgagctcccgatggcattttcattgctgcacaaaaactaacggccaacaaattgcttgatgatcga

SEQ ID NO: 46695 - DNA, 1111 bp, Heterodera glycines
  misc_feature (19)..(20): n is a, c, g, or t
  Genomic contig location: Contig_ID=SeqID_9049; Location=104..1214; Strand=-
  SCN-specific regions: Sequence locations=1-72,95-221,246-301,329 -422,453-1111
  Gene Ontology: Mol. function=ribose-phosphate pyrophosphokinase activity; Biological process=nucleobase, nucleoside, nucleotide and nucleic acid metabolism
ttgcaaaagcgcttaaagnnaaattcagcaataaggtgggcttagagaccgaaagttacagacacaaataattgcttcttaaggaaacaaatgtcgaaataatcgaatctgttagaggcgaagatgtctacataattcagagcgggtaatttgtttttctcggcgcaattcgctttactctttggacaacttttgcaggtgtggagaaatcaacgaccacctgatggagctgttgatcatgatcagtgcatgtaaaattgcttcagcttgccgcgtcactgccgtcattccgtgctttccatatgccaggcaggacaagaaggacaagtcacgggccccaatcacagcaaaattggttcggttatttgcctttttatgcggagctgttctgtcaggtggctaatatgctttccatctccggtgctgaccacatcatcaccatggacctacacgcttcgcagatccaagggtttttcgatattcctgtggacaatttgtatgctgagccggccatcctgaagtacatacgggagacaatcccgcactggcaggaatcggtcattgtgtcgcctgatgccggaggtgccaaacggtattggcataaaatattccaggtttattctgcccatttagtgtgacatcaattgctgatcgtttgaatgctgcttttgcactcatccacaaagaacgcaataatccaaatgaagtggagaagatgacactggtgggcaatgtgcaagacaaagtggccattttagtggacgacatggcggacacttgcggcaccattgttttggctgccgaaaagtcactgacttcaaatatactagcgaatgttgctatttatacttttatattttcaggcttttcgaagcgggagctcgtaaaatttacgcaatttgtgtccatggcattttttcgggaccggccatcgatcgtttgaacaaatcgagatttgaagcggttgtagtcacaaacacaattccacaagaagaaaatatgaaaagatgcaacaaaattcaagtatttttagcgggccatgggttgctaaaaagcatttttggcaaacctaccgatggtatcacaccttttttgaaaaaaatattttttg

SEQ ID NO: 46696 - DNA, 975 bp, Heterodera glycines
  Genomic contig location: Contig_ID=SeqID_9050; Location=1016..1990; Strand=+
  SCN-specific regions: Sequence locations=1-26,50-66,88-136,158 -208,230-711,736-800,822-948,970-975
atgtatggggcacgaattgaacagacgcaaaaggaggaggaagaaaaggcgctgaaattggtgcgaatgttagaagagctgaaagagaacgaaaaatgccagtggaggaaagaggaaacacgggaagaagacaaagagaatgttatgttaaagaaaggaccaaggaaaacggcggtggtcgacggatgggaggaggcgcaaattgaggaggaagaactgattgaaaagtcgactgaaaggaaagtgccatcggatgggtgggaagaggcacaattcgacgacgaacaaatgcacctcaagaggaatgaacaacattcaaattcagtggatgggtgggaagagacagaaatttggacggatgaagcgaacgaagaacggttcaaatcgaaggatgtttttgaagaggcgcaaacgaaggaagaaattgtaatcaaagttaaagaacgactcaaaccattggatgtgtgggaaaatggtaaaagtgaagagcgcgaacagtcaaaaggtgcattagtgctaataaaacaacgaattaaagccccactaattaacagctgaacaatcccaacttctcgaggagaatagaaaattatttgaacggtttactaccaccaacgcagagctttcgagaatagaaacgcaaatgagtgagatccagcggttgcagggcatatttgcggaaaaggtaaataccatttaaaaattacattgtaattttatttgattttttaaagataagtgaacaggaacaagaaatcgatgtgatccattctaggactgtatacacattggacaatttggagactgccaatgaatttatcagagaggcaattaaaaatcaggccaatcgtcgggtcatcctcatattctgtttgcttgtactcactttcacgctcatattccttgactggtacaatccgtgattcggagtttgtgatatatgattcgatattttatttatgataaaatcgccaa

SEQ ID NO: 46697 - DNA, 615 bp, Heterodera glycines
  Genomic contig location: Contig_ID=SeqID_9052; Location=124..738; Strand=+
  SCN-specific regions: Sequence locations=1-615
  Gene Ontology: Biological process=histogenesis and organogenesis
gttgtcagtgttaccgcctccacttcccagggaaagccattggagcaaaatgaggtaatttcaaatttttatcacaaaaaaatcaatgggtttttatagctggatgttatcatcgaagcttgttcaatggctgaggaactgtatgatttgcgcatgaaaatgcatcttttcgtcgaattgcgaatggctctcatcgccccaaatctctgccgaattgtcggtgccggcaccgctgccatgctaatttctcaggcgggcggactcgtaccgttggctaaaatgccggcgtgtaatgtgctaatccttggcatgttttccaccttttattcgtttttattgcaaattttaggaaaacagaagaggactttggccggcttcagctcctccgtgatccttcccaacaccggcttcatttaccaccacccaatcgtccaaactctgccgcccgaccttcgcagaaaagcggcgcgattggtcgctgcaaaatgcacattggcttcccgagtggattcaattcattcttcgttggacggacgaattggggagcgattgtcagtagaaatcaaagggaaattggaaaaaatgcaagagccaccgccggtcaaaaatgccaag

SEQ ID NO: 46698 - DNA, 926 bp, Heterodera glycines
  Genomic contig location: Contig_ID=SeqID_42163; Location=1..926; Strand=-
  SCN-specific regions: Sequence locations=1-10,32-54,77-239,261 -421,460-801,823-926
  Gene Ontology: Mol. function=electron transporter activity; Biological process=negative regulation of cell proliferation
ccctgccttcgcccttggattttttgttaagttacccctctctgtccaacagaatgaaattaaaaatttgttttattttccctttttttcaaattccaatgaaaggttttgaacgaggccactgctgcgctgctttaccattcgatcagtttgggccgcgaggatttggtgaagttcaaggcgctcaaagttgttgtccgaattggctcgggcgtgcacaatgtggacatgcaagcagcgactgaccttggcaagcatctttggagtaaaatctggcataatgccaaagctaatgaattctgacagtcgctaatggatcagcggaatatgaatttgtgacaatgcttgttaggattgccacgattttctcaaagagattgataaatccctggtgaggggtgggggtatgccaaagatagggtaattaaattttgtttttgttattaatttattttaaatgcatccccccccccccccctcaggcattgccatttgccattcgcccgccgaatgtgtggaggaaacggcggactcgacaatgtcgctgattttgaacatgttcaggcgaacattttgggccgcgagaacggttcaagcgggaaaacaggtgcgtttaatttgccataattagtgttgctaattcaaaaaaggccgatcgtacgtacctaatttatttttgttttttagcccgggagtgtcgagcagttacgtgacctgatgtccggctcagcaaggatcaacggcagtgtgctaggactgattggcctgggccgagttggcactgccgtggtgggaatttggccaattcaaatttaactacatttttaattgtcgaaaaggctcttcgcgcaaagcatttggcttcagagtgctcttttatgatcctcatctgccaaatggtgacttcatacattataaattctaat

SEQ ID NO: 46699 - DNA, 1084 bp, Heterodera glycines
  Genomic contig location: Contig_ID=SeqID_42196; Location=182..1265; Strand=+
  SCN-specific regions: Sequence locations=1-416,453-722,744-1084
  Gene Ontology: Mol. function=heat shock protein activity; Cellular component=cytoplasm; Biological process=SRP-dependent cotranslational membrane targeting, translocation
aatcgttccgtcggacgtcaaccctcttacaacgggcatcgaaaccgtcggtggagtgatcgacaaaaccgatcactcgcaacaccgtcattccgaccaaaaagtctcagatattttctaccgcggcggacaatcagccaaccgtgactattcaggtattacaactacgataattattacaacgctgactatagtcgccagaaaaaagaacatttacattcgatcgagttttaatatttcccacgggttgtccaagcattggcttcgtccctatttaagcaatttttcgtagcattttgtgcttccaaagagaaggaaaaatgggcggaaatctaagcataatagtagttaagacgcatttagtacaaagtgttttaaatgactggattgccaatttgtatctatattaaaatcccttttaaggttttaatttaaaaataattctcattaaaatgaaaaaattaacaggtcttcgaaggagaaaggccgatgacgaaagacaatcatttgttggggaaattcgacttgaccggcattcctcctgctccccgaggcgttcctcaaatcgaagtcacttttgagatcgatgtcaatggaattttgcacgtgactgccgaggacaaagggactggcaataagaacaaaattacgatcaccaatgatcacaaccgactgtcgccggaagagattgagcgaatgatcaacgacgcggaaaagttcgcagaggaggacaagaaaaccaaggaagtggtcgaagcgaggaacgagtttgagtcgtacgcctactcactgaagaaccaggtgaaacggttgtcctttgctagagttcattacgacaatttagctcggagacagtgaaaagttgggaggaaaactcagtgcggaggacaaaacgaccatcgaaggggctgtggatgaggccatttcgtggttggactccaacaaggacgcgccacctgaggagcttaaggagcggaagaaggacctcgaggccaaagtgcagccgatcatcagcaaactctacgcagggcagtcgcctccgcccggcagcgaaacgccgccgactgaggagaaggacgagctg

SEQ ID NO: 46700 - DNA, 594 bp, Heterodera glycines
  Genomic contig location: Contig_ID=SeqID_42221; Location=189..782; Strand=-
  SCN-specific regions: Sequence locations=1-594
  Gene Ontology: Mol. function=DNA binding; Cellular component=nuclear nucleosome; Biological process=chromatin assembly/disassembly
atggacaaaggaaaagctgacattggccaaagcaaagggatgggacaaccgatggataatgaaacgatgcaaaattggagagacagcggcggttcattgggaagacggaaattgggacaacaattttgtttcattcacaatcgaatcatacattccctttcctgttcacatccacaggtccgtatgccaaacgtctcgcgaacggagtgccggtctacatgactgctgtgctggaacacatcacgggcgagctgctcaagaaaattggcgagatcacgcaggccgaaggcatgaagcgtctcagtgcatttcacatccgaactgcagcgcgcgataacgacgagttgaggaaggtcagtgattgagtggcagaggttttgcggcacaaggacagacagcggcacatcaaaattattggcatttcagctgttctctggcgtctctcttgccgaggtgtgcgtgctgccggagctcgaatcggatgtggagcaatcatcggaaggaagtggcgagtccgactccgatgaagaaagtacggaagggagcgcgagcggaagtcaggagggtggcggtgctgctgctgcgcagcaatga

SEQ ID NO: 46701 - DNA, 2762 bp, Heterodera glycines
  Genomic contig location: Contig_ID=SeqID_1226; Location=318..3079; Strand=-
  SCN-specific regions: Sequence locations=1-1,23-305,337-349,385 -847,885-919,942-980,1010-1037,1059-1128,1152-2284,2306-2495,2517 -2670,2692-2762
  Gene Ontology: Mol. function=15-hydroxyprostaglandin dehydrogenase (NAD+) activity; Cellular component=membrane; Biological process =transport
atgaaaaatttaaaaaatttgctgttttcccccagggaatacattcgggctggtggtggtcctttgctctgctcattggtcattgctgcgttcattctgaatgttggtgccaacatttttggcactgtttggctcaaaaattggatggtacgacttaaaaatttgttttacctacttacagtaatcaaaaaaaaaaaattacaaaacctaattatgtcccacattagcgtgccgcacacagcaatcacagtgccactgatggaactggtgggagtttggccgacagtccatccttttacatcaacatttatggtgggtgggtgggttggttggttcacattttctcggcaattatattgaaatctaaaaaatttattttttattccatttttttgcgttttttatatgccaaaaaaacttagaaaatttcgattataatccgcagaaaatttcgattataatccgctttaatgcagctattaaatattttttttccaaatcttttttctttttttttttgtaaattttaattgtgagtcgtttttaggccaaaataaaatgcataacatttttcagctttcactttgcttgtgttgtttatcagcggactgctcaaggcattggtgtttgtcaaggtgtcaaatttcacaaaaaaaaatcattaaataaaatgattttggtattttattcctacaaaatttgtcccatagtttacgcttactgccgccacacggttgcacaatcggatgttgcgccgtgtactgtacgccactgccgcctttttccaccgtacaccgtccgggcgcattttgaaccggttcagcaaagacatggacgaaagtgagcacagcttgtttttattttgtttatttgacttacaattaaaatgatggctaattttttcatagttgtctgaagcaaatttaaatttaaaaaatattgtaaaacttttagcatccgctaattccaaggcatgaagaatttgtaattaaattttatttaattggattgcttttcacaaattgttttctaattttccaactttgttcagttgatgtgaagttgcctttttcggccgaagcattgcttcagggaatgttcacctgtttgggttcgtttgggcaagggttaatatttttaaaataaattatcttttttccctaggatttattttcatgatcatttggactttcccactctttttggttccatgtgctccattgtttggcctctttttgctctttttcctatgcttccgtgccggcattcgatggtaacaattttttattttttttttgcattttaaagaaaatgtttatgccccaaagatttcgccccttgttgaccgttttaaaaattttgaggtgtaggcacaaaaccgaatgtattttagcaatcgaacaattccaagcatgcttaattatttggtttacaaccaaaaaaaaaaaaaatacggtccaaaatcctcaatcgacatttttgagtgcaccgaatcgaatgctttttttttgttttgttttcagtttgaaacgtgttgagaatgtcacccgttcaccagtgtttgagcatttgaccacttcgctggacgcccttccgacaattcacgcgtttggccaaacccaacgctttgtggagcagctgaagcaacacttggatgagaacaggtaagagtttttggtgttctagaaatgaacgccaatatgtcactttctttattcctcctccgtactttcccaaattttaaaatttcttcaatttcgaaaaaaaaatttaaactacctcattgtaatgaatgcagccaaccaaggacgtagccaggcccttggcttcggtgggctaagggctaactggtacaactcccccccccctccctgtatcgttttcaaaataaattacaatttgaaatttcgcaacaaacaaaaatgaaaattccaaaaaaaaattaaaaattttctacgattattcaagaaaatgttatatttcccgcaattaaaaagaccattttctattcggtcgtcaaagtttttggtttttaacttgtcgttatgtattcctcttggcccatttttcgtccgtctgtttttttttgttgccacattaattttttcgtttttttttcattttccagtggtgctttgttcctctaccattcggcaatgcggtggcaggcggtgtggcttgacctgttggtggtcgggctgaccttcttcgtctccctgttcattgtgctgctcaccgggcgcattgacccggcggaggccggtatggccattgcatttgctatgcaggtgaacatggcagagcaatgatgcatgaatgtgaatggggggggggggctaattgcaacgggagcagctcgttagctcgccccccccccaacaagtattacaatttttataattattatgctcaattttacagacttacttaatgttataaaattattaagacagtttgatgatgcaaattagtaaatcgttgctttccaattttagtttaatgttgataaaatcattaatctatacatttgatgacttctacattttgcctgtttttcacaacattttttatgtaaccctaggacatttttcatttttagcttaattggctaacacttaaagaatgcaatttgaatgttttggattgataaaattatcttcagatcagtcattataaatatcaactaaatagcacgaggatctgaaatttggagaacaaccaggaccggcacttgcccggatgaaaaaaactccaatattaaa

SEQ ID NO: 46702 - DNA, 543 bp, Heterodera glycines
  Genomic contig location: Contig_ID=SeqID_42353; Location=277..819; Strand=+
  SCN-specific regions: Sequence locations=1-186,208-504,526-543
  Gene Ontology: Mol. function=CTP synthase activity; Cellular component=cytosol; Biological process=pyrimidine base biosynthesis
ctcggtggcaccattggtgacattgagggcatgccgtacacaatggttgcgctttgaccctttttgcgcgattcattttcttctaattttaaggctttcagcatggcatttcgccgcaaaacataccgtaatcgttttctgactgtgcacgtgaccaaattgttgcacgaggcaaacaatttgtgctagtatatatattagttaaactatgtttttcagtcgggcgaaataaaaacgaaaccggcgcagaatgggctgcgcagtcttcgcgagacgggcctttaccccgaccttttgctctgtcgttctcaaaaaccgttgacccaagcgctgcgctccaaaattgccagctttgcccaattggacatcaacgaaatcatcgacgtgtacgactgtcacgacattcacagtgtgccgttgcttttgctgcagcaacaaatgaaagagttgctgatcagccaactccaactgcccgacatgcgaacgaaggaggacttttccgccttctacagatggcaacagctcagtgaaaagcaagtttaa

SEQ ID NO: 46703 - DNA, 766 bp, Heterodera glycines
  Genomic contig location: Contig_ID=SeqID_42461; Location=48..813; Strand=-
  SCN-specific regions: Sequence locations=1-140,171-270,317-433,469-766
  Gene Ontology: Mol. function=adenine transporter activity; Cellular component=integral to plasma membrane; Biological process =embryogenesis and morphogenesis
agtggacaaggagaagcagttcttgaagttcttcgccatgaatttggcttcgggcggtgccgctggcgccacttcgctgtgttttgtgtaccctttggactttgcgcgaacgcgtttggcagcggatgttggaaagtgagattaaaattttaaaaatacttaaataaaatgtccctttagggccgatgcccgtgagttcaaaggtttggcggactgcatcatgaagatcctcaagtcggacggtcccatcggtctctaccgcggcttcttcgtctccgtccagggcatcatcatttaccgcgccgcttacttcggctgcttcgacaccgccaaaatgctcttctccccggagggcaagcagatgaacttcttcgtcaactgggccattgcgcaggtcgtcaccgtgtcgtccggcgttctctcctacccgtgggacaccgtccgtcgtcgtatgatgatgcagtcgggccgcaaggacatcatgtacaagagtaagtgtgctctctattctcaggataaactcgtttatcacccaccctcactaatcaaccttaaatttctgaatttcagagggttttcttgattccttttgctaatttccaagaaaaaatggtaaaaattgaacaaaaccaaagcaagcaataaaaaatggatcatttatttgttgctctttcattcgctctttttagacactttggactgtgccatcaaaatcatcaaaaaagagggacttttcactggcatgtacaaaggtgccctgtccaat

SEQ ID NO: 46704 - DNA, 1190 bp, Heterodera glycines
  Genomic contig location: Contig_ID=SeqID_9153; Location=435..1624; Strand=-
  SCN-specific regions: Sequence locations=1-208,230-486,508-565,588 -611,647-917,948-1190
  Gene Ontology: Cellular component=Golgi transport complex; Biological process=intracellular protein transport
atggatgatttgacaacgacggaattgaaatggcgaccagcagaaagagctaatgatgacagcttaccactaaaacctcttaccgatattgagagacaaatgaatgaaattcgtacagaattatttatggcaagacaggaggaggaagcgataatatcacggatcaaagatgaatttcggcaaacgcagaaagttttaggtcaattagaataattattttatttaaaatgtttgaaaattaacagttaattagtatttcaggtactgataatttccagcgtctgttcgatcaatcagttgctcgcattaatgccgaatttgaaagagtcgggtccaatgctcgtcaattggccaattcgcttgattctgtctctgccttggctcaaaatatttcctgtcgagttgtcgcgttggatcttggaaaaagccgtgttgtggagtgtttgcaaagagtgaacgacttaaaagaccttggaacctgtgcattcggcgtgcaggaggcattgcgagctgaaaaatacgaagaggcagcacaacatattcaccgtttccttacgcttgacacggccgttttcaaaatgggcgaccatcgggagagcaaaggtcgacatggaaaaaccatttccattaaaaatgtttttaactaatcaacattttttcagatgctggatattccgtgaaaaattcttatgaaatccttagaaatgcgaccagtgaattaaagcgcatcatcgaacaacgttttgacgaggcgcagtcctccggcgacgtggcatcgatggaacgctttttcaaactttttcctctgatcaacgaacacaacagcggactgcagcggtttgggactcatctttgtggtcaaattgaggcacttggtgaccagaattttcgtattatgcaggtgttcatttcactttaaattccatttattttattttatttaggccggtgggactgacgacaaacgcaaaaacgtactttatgcggacactttgacaatgcttttcgagggcgttgcacgtatcattgagctgcatcagccgataatcgaaaatttctatggcccagaaaaattactgttgctgattgagctgattcagcccgaatgtgacaaacagtgcgtccgagtgttgaacacgttcatccaacgaagacattttgaggagaaagctcagcaggtgtttttttaa

SEQ ID NO: 46705 - DNA, 870 bp, Heterodera glycines
  Genomic contig location: Contig_ID=SeqID_42570; Location=1..870; Strand=-
  SCN-specific regions: Sequence locations=1-14,56-312,334-870
  Gene Ontology: Mol. function=catalytic activity; Cellular component =microsome
tcggcatggctctctgttggcttttccttttcattttcatccttttgctgttgctcgtcgccctccatcgaccgctccccgcgcgaatcgccgaccgaaggaaaattgcgctttttgagtttttgatgcgattgttcaacgaatatttagttggtgggggataagtgttaactcagtgcacacattctccgattcattcggcttttccttttccttttgcttttccctctcatttctctccctttttcccccaaagggttccctcgtcgaaatcgccgccggtcattccgcacgtaacaaattgagtcgtgccctttctctcctcaccttccccgtcttccctcgttggcttttccgttggctcttcgccgcccattggtgcgatgtgcgcgacgaatccattgcgggggtgccgtgccgattgtacgtgccaaagggggacaaacgacggcacaacggtgctgttgtgtttattcacggcggcggatggtgcatcggaaagccaagcaagcaaatctaattgactaatttagccaatggaagtggcgccatttgtcctaagcaaacaattgatcgtaatgttgcccattttcagggtattacgacggcgctttgctgtgtttgagttggaaagtcggcatcccaatcatttccatcgattattccctttcgcccgaggcaaaattcccaacggcacttctccaatgtgaaagagtcattgcggaattgaacaaagtgccattttcgacttatggcatcgacccgaccaagattgcattaatgggcgattcagcgggcgctaatttatgcgccgtaatttgtcagagatatctgaaggccacgaagggaccgacgatcagggcaagggac

SEQ ID NO: 46706 - DNA, 2671 bp, Heterodera glycines
  Genomic contig location: Contig_ID=SeqID_9158; Location=1726..4396; Strand=-
  SCN-specific regions: Sequence locations=1-73,96-217,239-375,398 -638,668-716,738-1032,1054-1097,1120-1199,1227-1722,1755-1784,1806 -2462,2485-2671
  Gene Ontology: Mol. function=ATP binding; Biological process=protein kinase cascade
cgaacgctttcaacgattcccacgacaaacctttgcccccaacgccgacgcattgcgaaagcgcacactttgacaatggcaacaacaataacaacggcactttggtgctccgttcgtccgtttccccgcagtggcgacggcgcagcaacagcagcaatttgttgcggagggcggaggagaaaaggcagcggacggagtcacggggaagtctgaacagagtggcaggcattgtcaagccgtgctcagtgccagaagtgcgagggagggaaaggggacggcacgggaggggtgattagggtaattaggtgccccagtagttgggggtcttagggcgggagggacaatggcacggcagacgggttacaatggcagtacttttggcggtgattttccatttcttgtgcagcagcgttcgccactgcgaagcgacgacttcgattcctcgtcggatgagtcggaagggacgggcgtggaaatggacagccgatcactggggggaatggtcgtccatcggcacggcaaaaagcctttgtccgaagtcagtggccacggctcatcggcaattgaggacacaccgacggaagagcaaatcgtttacgtaaatcgggtggcccaagtcattttgagagaagagcaaagggcggaggaggaggaaatggtggaggacccggtccaaacactgaagagaccgggccaactgaagttgaggaacgccgaggggagaagcgaagagcaatgccaagtgaggccgaaggagcgggaaaagtcattcatcggatatttcgccggagggggcaccgcactcgtcagagacagcaacgaggggccgctggcgggcgccattcattcgggcaccgtaaaccgacccggacggatgccgaatccgaaccaagtaaagggaaaacgggggcggcacaaatttagacaatgatcgaattttaaggtccaagtgaatgtgaatccaaacagtgccgcgagcgacggagacgcgccggagattagaaaatacaaaaagcgattcaacggggaaattttgtgtgctgctctttggggggttaatctgctgataggtgagagtgacaagcacttacaaaggctttcagctttttatttttaattggcatttaaattcttttccgtcaaagtgtgccatggcattttctcatgcgcaatttcaggcacggacacgggtctgatgctgttggacagaagtggccaaggcaaaggtaaagcggtgatcaaaggatggccaatgccattccgtgctaattgctttgtcagtttaccatctgatcactcgccgtcgctttgaccaaatgtccgtcatggagggacagaacattttggtgacaatcagcggaaagaaacggcgcgtccgcgtttattacctctcgtggctgaagcaaaagattctgcggactgaaggggtgggaaggccaaaggaaaagccaagctcagaaacatggctttgttcagttgcaacagacggagaaaaggaacggatggacaaatgtcggcgaattccaatgcgccactcatttcaaaatcggtaaacggcgccaaggcttggccttccgcatttgttccgttcagtgcgctatgagcgcatcaaatttttggtgattggcattgaggactccatttccatttacgcgtgggcacccaaagtcagtgggaagggccagctcttttttccctttatttgtttaaatatccgaatttagccttacaacaaattcatggccttcaaggtactcatggtaagcccacaacaatcggtcgcttctcttctttcagagttttggccaattgtcccatgcgccggtaatcgtcgatttgaccatcgaagagaacgcgcgtctgaaggtgctttacggcagccttgccggcttccacgccatcgacttggactcgggttggccccacaatgactcattggcattcgccgccaaaatttaccttttcagcgtccatttacgacatttactcgcctcaacaggtgccatttgaatgtaattttggcaaattaaaaagcaccatacacttttgaagagcacaatgtgccaagggatgtgcccgcattgcattgtgattctgccgaataccaacggaatgcaattactgttgtgctacgatagtaagccaagggagtcacgtacagtaggccctaaccaataccgtaacccaatcgacagatgagggcgtctacgtgaacacttacggcaaaattgtgaagaatgttcaattgcaatggagcgaaattccctcttccgttggtaagtgccaaaatgggccaatgaacggcaaaagttaacgaattcagcttacatttccacaaaccaaataatgggctggggaaacaaagccatcgaaattcgcaacgtggagacggggcatttggacggtgagcaaaaaaaggggagggaagaaaaatgccataaaaagagtggaaagaatgccatagaaagtgtgccattggaaatgtgccatagaaattgtggcaatgtcggttagctaattggtcctctgtttttaaggcgttttcatgcacaaaaaggcgcagaagctcaaattcctttgtgaacgcaacgacaaagtgttcttttcgtccgccaaaggctcctcctcccaaatttattttatgtcgctgaacaccaaactgaacaattgg

SEQ ID NO: 46707 - DNA, 1146 bp, Heterodera glycines
  Genomic contig location: Contig_ID=SeqID_42594; Location=127..1272; Strand=-
  SCN-specific regions: Sequence locations=1-1146
atagacacggtcatccatttcgctgccattacacacgtggacgaatcgtacaccgatcgcattggcacaattcaggagaatgtgattgccacaacaacgtaagacccacacaagtagccaaagggtgacttgcctttaaaaacattccttctcccacttttttagactgctcgaggcgattaatttctatgggcgagtgcgtcgtttggtccatatcagtaccggtgtgtggcattgtgccgcaaagtttaagcagaggcattcccttaagacgaagtgtacggcgattcgatggacgacacaacgccgaagtgcgaggattcgccgctgaacccaacaaatccttacgcagcaagcaaagccgcgtgtgaggtgatcgtccggagttaccatgtgagggagggagggcacggacgcacttggaaaggcggagacaaaggtcaatttcacacccttaagcactcctacaaattgccctatgtgatggtccgaatggtgagcatggattgtctcggcatcgtccaaatgcactgcgattggccctttagaacaatgtgtacgggccacggcaagcgtactccaagctgatcccgaagttcacccgactggcgctggagggcaagccgtacccgctgatgggcgacgggatgcactcgcgcagttggatgtacgtggacgactgtgcggaagcgataagacgcataacggagaggggaagaatcggacagacgtacaacatcgggacggagttcgagaagtgcaatttgcacttggtaagagacagcaaaggcagacagaacgacgaacgaacccccttaagacggaaatgctgcaggaaaaagtgcaaaaactgatggacaggcaagcaccgcccaactgatcaccgccaactcacccccccccccccattttaagggacccctcccaaatatccttcgaaccgatcgccgaccgcccctaccacgaccggcgatattacatcgtaagcccaatcgaaggaacggcatttgccaccccgctgttcagaacttcaccaaaatacgcgaggaattgggctgggagtgtacggtgccattcgcgcagggtttagccgacactttggattattacgtgaaagagtaccgcaagacacacaatgccatgctg

SEQ ID NO: 46708 - DNA, 762 bp, Heterodera glycines
  Genomic contig location: Contig_ID=SeqID_42604; Location=1..762; Strand=-
  SCN-specific regions: Sequence locations=1-229,251-314,336-622,644-762
tttttaatttttataaatgatctgccgtccgttattacaaatgaagcggcatcagttggcataaaaatgtatgccgatgatgttaaattatattatgcccacgaaaatgatgaccattcgaatcagttggataaagcaattgaggctttggaaaaatggtcaaaaataaatgggttagaaatttcaactgaaaaatgttttgttttatatttagggaaaaataatatgaaaaaagaatattttattaactcaaaaaagatttctgagtcggataatgttcgtgacttgggaattataattgactcgaaactgaatttttcagaacacataagcaaaattatacgaaacgcatatcttagaagctttcagattttgagagtgttgaaaagcagggaaataaaaactctaacagcagcctataaaacttttgtacgacctcaattagaatacgctaccgaagtttggaaccctaatttaaaaaaagatatagacaaaattgagcgggtacaaaaatttttcacaagaaaagcttttcgaaatgtggatttgtgtacaaaaaatatatggaaagacttaaaatcactgatttacacaaattggaagaaagaagaaaaatcaatgatttaacaacaccttttaaaataattaaaggattcaccagcctcgatgctttttctcagaaaggcccaggaggcctttacttttacgagtaaagcgccacacggccaaaactcaaaataattttttccataggatagtaag

SEQ ID NO: 46709 - DNA, 1286 bp, Heterodera glycines
  Genomic contig location: Contig_ID=SeqID_9166; Location=674..1959; Strand=+
  SCN-specific regions: Sequence locations=1-52,76-239,262-1286
ttccaaccattcgatgcagcttacactgccggtggaaaagaagctgaccgtttaaagtttggatggaaagtcaacgattgccaggggctgttcagcattggcacttggatgggcttggtagttgccactctgctcatcggcgtgctctttttcggctttctgatgcttaattctgtgcagacaatggacagattcgatgacccgaagcagaaacagttgataattagttcgaaagagtgaatttcatcattttattttattacatttcccttaaaattttcattctttgtagctttataaatataaattttttccttgaattaagatttttagtagccattgttgtttcactttattgtattaaaaatgattgtagaatatgctaatttattaaagcattttatggaggaaagcgagaggataattttggttggtccgttgtttcgttttcctttacgttttttcagtgcagggaaagggaatgtgcacggcgtggcatcgccgttcctccgctttttgtggctgctccgatggtccgttattcgaagtgcgtcttgccaattaaacgatttatcctcccttcccattgcttttgttagacttccttttcggcgattggtttctttgtacggctgcgacttttcctacacgccgatgatttacgctgactgtttcaccaaatcggagaagtgtcgacaggtcgaattcgtaccgtcccccggtgatttgccaattgtgcaatttgcggccaaaagggcggaagaatttgcgagcgccgctcaactcgtttatgggttctgatttcaatccgatggagagtttcaatttcaaaaaagcgtagacattgccgtggaatcgacttgaactgtggctgccccaaaagtgatgtgcgctcggacggatacggctcaaaactcttggaagacccgcaattagtggccgatattgtgcgacagtgccgcgcttccatcgccgatcccgactttaccatttccatcaaaattcgcattcaatacccaatggaaaggacagtcgatttgtgcagaaaagtcaggaacataatcaagcaaattgtcagcagaagaaattctcaaagttccaggtggagcgtgccggtgtttctcacatcgctgtccatgccagaactgtcagtcagcggtcggagccgccggattatgcggcggtggcactgctgaagcaatgcttgcaagtgccaattttcgctaacggtggctgcaaaacttttgaggactcattggaaatttcgcaggcgacgggcgccgatg

SEQ ID NO: 46710 - DNA, 559 bp, Heterodera glycines
  Genomic contig location: Contig_ID=SeqID_9167; Location=2640..3198; Strand=-
  SCN-specific regions: Sequence locations=1-88,110-559
  Gene Ontology: Biological process=positive regulation of growth rate
gttttgacatcagtggacacgccttcctgttgatctacagcattttgataatctgcgaggaatccacctcattccaaaattggccctcaaaacctcgtgttaccattcatcacgttccttcccgcaaggaatttgaactatttcaacggaataccaaaataatccaggcattcatgcatttctgtgactttttcaccacaggctccctttttctagtggcttttcgtttctctaatgctccttcacttgctatgggatttgcaattgttgatcacttcactttattaccacgaattttggcaaaaactcattggggcaagcattggagtgttctcgtggttcggttggtgattgttattatttaagctttaaaatatactttttaagtgacctatcgcttttggttcgtcgtcggattcccttttttacccatccggcggcacatcaaaagtttctgacctgcgattatccgccgcttttgctcacttcatccgacccttttagaatgcctttgctaccgtaaattcctcaaacgattgaatagcttttgagaaaatgc

SEQ ID NO: 46711 - DNA, 600 bp, Heterodera glycines
  Genomic contig location: Contig_ID=SeqID_42679; Location=122..721; Strand=-
  SCN-specific regions: Sequence locations=1-600
  Gene Ontology: Mol. function=ATPase activity; Cellular component =mitochondrion; Biological process=mismatch repair
atgatggattgctcaactattttggaatgcgcaactgaacattctttaattctgatcgacgagttgggcagggggacgagcacttatgatggatttgggcttgcctatgctatttcagagtgtgttaatactaaaaaatgagataaattagtcatttcagggatatcatctcgcgaattggttgttttgctatgttcgcaactcattttcatgaaatatctcgacttcaatcgaaataccccggaaaagtaaaaaattaccggatggatacgatttgcgaaaatggagaactcacaattctatttcgagttgtttctggcgtagccgaccgctcatttggacttaacatagcgaaagttgttggttttgcagatgagataataaaggtaagttcttcatcatgttcaaggcggtgggaggggttaaacttttgactttaatttatggcataggtaatgggtcgagaactgcctacgataaacagactgataacaaaagaaattgacaccttcccacccctgaacacttttgatgttatagtgaattattttttttaaggacgccgaagtaattttgaaccaattggaagccggcgagtag

SEQ ID NO: 46712 - DNA, 687 bp, Heterodera glycines
  Genomic contig location: Contig_ID=SeqID_42695; Location=1..687; Strand=-
  SCN-specific regions: Sequence locations=1-5,37-140,171-241,263 -325,371-582,605-687
  Gene Ontology: Mol. function=glutamate-ammonia ligase activity; Cellular component=cytoplasm; Biological process=glutamate metabolism
cacgcgtggtttggcatggagcaggagtacacactgctggacgttgaccagcatccgttcggatggccaaaggcgccgttcggcttccccgggccccaaggtcatttcccggcctaatcattttttggctctaattactctataaaattttaaaattgaattaatatattcaaaaatggcaaattaagggccttattattgcggtgctggagctaacaaagtgagattgactataaattagttgacaattttttctgttaaatcatttttaggcttatggtcgtgatattgtggactcacactatcggtgattcttttttagcacttttatttaattaatttatctatttatttactatttttaatttaactttttcaagcgcttgtctttacgcgggtattctgatttcgggtacaaatgccgaagtgatgccgggccaatgggaatttcaggtcggcccatgtgaaggtcggtgtcatttttaaaataaaaaaagaagcaaattttgctttcatttaaggaatccaaatgggagatcagctttggtcagtttttcaaattaatccgaaaattataaaattgtatttaaattgcttttcattttcaaaggatggcccgctttttgctccatcgcgtggctgaagaagatggagtgattgtctctttcgacccgaaaccttcgcagg

SEQ ID NO: 46713 - DNA, 3087 bp, Heterodera glycines
  Genomic contig location: Contig_ID=SeqID_1243; Location=1186..4272; Strand=-
  SCN-specific regions: Sequence locations=1-405,440-1349,1372 -1419,1446-1686,1711-1775,1797-2072,2097-2413,2457-2661,2694-3087
  Gene Ontology: Mol. function=protein phosphatase type 2A, intrinsic regulator activity; Cellular component=protein phosphatase type 2A complex; Biological process=signal transduction
atggatgtgccagcttcttcctcggcaactccaccgccgttttgcggcaccgccttcgaagtcagcagcggtggcggcgacgaactccactggcgcttctcccaaataaagggaaacattgagacgggcgaggcgccaaccgacggttttttttacaatttttagtgaataaattaacttttcaatacgattggattggtaaatccaaaacaaaagttgtaaatccatgctgttcgtgtttcttttcttttcacttttcattcatttccgtttacttttttctatttttgctttatctttggctttatccccccaattgtcttttagttttaaacgttttaacagattaataaaagcattattaatttcagctgacataatttcgtgcgttgagttttctcacggttcgttttctttgttttgttttaaataaatacaaaaacttttgcgtttttctcgcacagatggtgaactgctcgctaccggtgacaaaggcggacgagtggtgatctttcaacgggaccaaagcgtttgtcaattccatttcaatttgcttctgatttgtccccttttcagggagtgtttctgaacggcgtccgcacttccgagtacaatgtgtactcaactttccaatcacatgagcccgaatttgattatttgaagtcgctggaaatcgaggagaaaatcaaccaaatcaaatggatgaagaaaaagaacgcggccaatttcatcatctcaaccaatggtgtttttttaattttgaattttattcggctgagacatttttaatgccctttaatattttgacatatttccctttcaaatgtttcaaatcccacgcattttttcacctcaaaattattttctttttccgcagataaaacggtaaaattgtggaagatttctgagcgtgaacgaaaaatgacggaaggcgggtacaatttgcggtgtgacgacggatcgcggaggtaaaatttaatcgaagggagaaattagttagatcagtattaaactgtctgttttcaagtgcttatgttgccttttgaggttcctcaaccgtgccatgcctttgaaactgcccaaattggtgcccatggaattaatcgtcgaagcgtcgccccgccgcgtgtacgccaacgcgcacacttaccacatcaattcgataagcatcaactcggaccaggagacgttcatctcggcggacgatttgcgcatcaatttgtggcaccacgaaatcaccaatcagagtttcagtgagtgggcagagagaacggaattcaaaaacaaacatttggcacaatgttttaagtcaaaatgggcatttggcgtgacattggaaagtgtccgttttaatgatttttaaaactggttcttttttcccaagatccctacgaaattatattttttgcagatattgtggacattaaacctgccaacatggaggaactcaccgaggttggcttcttccatttttattttttctttcattttttctcactttgtcaggtgatcactgcggcagagttccatccgtcgttgtgccatgtttttgcatacagtgaattaaaaaatacacaatcaaatccaatccaatttccattaaatgccgtatccatccatttttaggctcttccaagggcatcattaggctgtgcgacatgcgcgactcggcactttgtgacggaccagccaaaagtaattaattaaacactattaattaggatttggttttaatttatgcttccatttgagcattcgaggagaaggaggaccccgcttcgaagtcctttttctccgaaatcatttcttctgtgtcggacgtcaaattttcgcacaacggccgctttttgctgacccgcgactatttgacagtgaatgtacgttcattagagttttcaggcattacttaaatactggtggggcacatggccctgttaatctgtgagtttagtccccgtggttgggtaattaatggcacacggatattattcatttgaggagggatttggatttaactatttgcgagggcaatcacatacaatacatttcattcattcattgttcgtctttttaaggtctgggacctgaacatggagtcgcgtcctgtcgagtcgtaccatgtgcacgactatttgcgctcaaagctgtgcacactttacgagaacgactcaatttttgacaaattcgagtgctgttggagcggcgacgaccggtgagtggcgaacatttgcgaagggggccggcccatccatataaatcggcgaccttttgcttttcaagttgttttttgcggtgcacctttttcataaaatttttggggaaagggcgggtagtccgacgctgccgataggcgccgctgtggaaaatttttttcgattggtgagaaaatgacataataaccaaaaattaggggaaaatatgaaaatttaaaaagtttttttaaattttcaatttatcttcttttcaaatagaaaacaattgattcggaaataatttgtaaagggtaatcctttccttaactgaaagtacagaaatggccaatttcaaaaaaagaaaatcaagttttgaagaaggacttcttccagttaaataaatcaacattttttgtttttgttttcactccatttttgagcagcattcataaaatttttgagctttctccctaaaaatttgtgcttttttattctaaaaaatatgcaattttctgtcggcgtcgtcgggccccaaaggctttctttctatccccactcaatcaatctgtgatttcaacatatattttgttaattcattagacatgtgatcaccggctcctacaacaattatttccgcaccttcaaacgcaacacttcggtggagtccacgtacgaggccagcctcgacctgtgcaagccgtacagaatgggcggctatggcggaaggccgttgctgcaccacgaacggatggaattggcggcggcgatggccagcggcggttcgtcgccaggcggcaacaaaaagcagcagcacggcagcagcagcacaaatatgccaccggggaaaaagcgaagggaggaaatcagcgcggactatttggactttaacaaaaag

SEQ ID NO: 46714 - DNA, 401 bp, Heterodera glycines
  Genomic contig location: Contig_ID=SeqID_42734; Location=196..596; Strand=+
  SCN-specific regions: Sequence locations=1-366,389-401
  Gene Ontology: Cellular component=eukaryotic 48S initiation complex; Biological process=protein biosynthesis
gttgttgacattctccatccgaatcgcgcttctgtgcccaaatccgaggtgcgtgagaggctggccaagttgtacaagacgacccaagatgttgtggttgcgtacggtttccggtgtcaatttggaggaggtcgcagcacagggtttgcaaatgtgtacgactcactcgactacgccaagcgctttgaggccaaatatcgcttgttgagggtccgttatttttccaaagccttagggcaacaaactcgccgttttccttttctgcgctagtattgttttccactttagcaaggcgttggtcagaaagtcgagaagggaggacgaaagcaacgcaaggagcgaaagaaccgccagaagaaagttcgtggtgttaagaaagtgaaggttcaagcgggcaaaaa

SEQ ID NO: 46715 - DNA, 855 bp, Heterodera glycines
  Genomic contig location: Contig_ID=SeqID_42737; Location=8..862; Strand=-
  SCN-specific regions: Sequence locations=1-504,531-815,839-855
  Gene Ontology: Mol. function=chaperone activity; Cellular component =cytoskeleton; Biological process=cell organization and biogenesis
atgaagggggcgctgatcgatcagaaatcgatgggccacggaggccccgcgcgggtggagaaggcgaagattggcctcatccaattccaaatctcaccaccaaagcccaacgtacgtccatttcatgcatagacaatggggcggtgggggggggggggggggggttcatagatttgggcttgcaattaagcgaaattcaaaaaaaaaaaaattttggctaccttttcccaatacttaattggtatttcagatggaaaatcaagtggtcatctctgactatgctcaaatggaccgtgcgctgaaggaagaacgaaattacattttggaactgtgcaagcaaatcaaaaaggccgggtgcaatgtgctgctaatccaaaagtccattttacggtaagcggtgatgaacgctgactcgttttccgacatgttttcatttttaacattatcctctttagcgatgccatcaacgaaatggcgctgcattttttcgcaaaaatgaaaattatggtgatcaaagacatcgagcgggatgacatcgaattctatgccaaaatcctcgggtgtcgcccggtggcatccgttgaccattttgtcccggaatcgctcggaacggccgatttggtggaggaaattgagacggctgatgggaaagtcctcaaagtcggtggagttttactctcctttttggctatttttgtaactattttcaggtgaccggccttaaacagagtgggtgcgctgtgtccattttggttcgcggctccagcaaattggtgttggacgaagccgagcgctctctgcacgacgcattgtgcgttattcgctgtttggtgaagaaacgcgcccttctgcccg

SEQ ID NO: 46716 - DNA, 945 bp, Heterodera glycines; identical to SEQ ID NO: 42798
  Genomic contig location: Contig_ID=SeqID_42798; Location=1..945; Strand=+
  SCN-specific regions: Sequence locations=1-132,155-208,232-291,313 -551,574-760,801-815,844-945

SEQ ID NO: 46717 - DNA, 793 bp, Heterodera glycines
  Genomic contig location: Contig_ID=SeqID_42981; Location=207..999; Strand=+
  SCN-specific regions: Sequence locations=1-460,489-793
gtcccagcaaaaaagcgttcaccaaaacagcatcattacccaagttggattgtcaaaaagtcaaaacagcaggcaacctttctaaattttatctaaacttgtcgaagccaactttaaattttcaaggttggatgtgtctgcttcggtggatagttcagtggccttttcaatccacaaaacttggcccgacttgcaattgaaccaaagtcacttgttcttcgaatgcactctgttcctttactctgttcttgcgttgtttctacagtatctgaacctgtacaggactttgtggtggcttcccaagtctcactggcccaattctcttgtcggtttttcccttttcacttttttattgcttacctttagaaataccacctgataaacccttacattttgtcctgtattgggcttctacttggtcttcgagttaccaaatgcttttgggatacggtaacattttggaacccatcaaataaataatttatttagataactgaccgtataagcttcttttctgctgggcaagatggctggaagttcatttgttggaaagtgtttgaaaatgcaattgttaagactcctctcaccaccgttgtgttgtccagcttcctgttcagcttcacacgaatttactttgaattcggcatcaaatccttcctttgtttcacttgcccgtgggttttatgaaattgaagaaaaaagctcaaaatttttgcttaagatttgttaattttgtagaaaaatgaccatatttgatttttttatagatttttactaaaactatgtaattttc

SEQ ID NO: 46718 - DNA, 2153 bp, Heterodera glycines
  Genomic contig location: Contig_ID=SeqID_9254; Location=110..2262; Strand=-
  SCN-specific regions: Sequence locations=1-695,717-892,921-1085,1116 -1577,1639-1651,1675-1829,1852-1996,2018-2153
  Gene Ontology: Cellular component=AP-1 adaptor complex; Biological process=intracellular protein transport
agaaaaagcttttcattttttgtgttttcactttttaggtgctcatttcacgcaattaccggttagccagtcattcaaatatcattcaattttttgggtcttgattttgaaggggagatgttgacactgttgttatcgagaaattcgtcccacttttggtcgatctggaagaagagggtcaacttgcacccgtcgtcgatgttgagagtggcacccacatgatttggattcgtttcaataacatttatggtacatatcatgaagcaaatgtttatttctgggtcaattttgaacaccgaattaagttgttgctgtgtcccggtgcaataccaacgtgtcgttagtgcaaacattcttatacaaattggttgctgtttttgccgaatatttcaaggatgttgaggaggaatcaattcgtgacaattttgtgatcatctacgagctcttggacggtattaaatacccaattcctaatttatatttttcgttcttttaaagaaatgatggattttggctatccgcaaatcaccgaaggacgaatattgcgcgagtattttctatttgtctttttctgttcttcatttttttcaggtacataactcaggaaggacacaaattggaggccgcgcaacagccgcgtcccccgatggcggtgaccaacgccgtctcgtggaggttggttttgcatacaaatgccaaaaaggcaatgatgaggacggaaaaggacattatcaactcttgaataattccctgaacattggctgtcgtttttaggtccgaaggtgtgagacataggaaaaatgaggtttttctttttttaatattttattcgtttttttctttttaaaggtattccttgacgtgatcgaatcattgaaccttctggtaattgaaattaatattttttctttttaataattcaggacaacaaattttttattcgcgataagaagcttttttaaggcaagtggcgccggtacagtgttgcaaagtgaaattgtcggttccgtcaaaatgcgtgtttttctcaccggaatgcccgaattgcgcctgggtttgaatgacaaagtatttcttttaattcaattcaattgttatttttattattgttctttttgtaatacaaattaattaaggtccaatttgatgcggctgggagtaatttaaaaccaacgaagcataaatcccaattagtaatttaggggggagaatcaaagccgtcgaattgaaagacataaaattccatcaatgcgtgaggctttcgcgttttggtaatttgacaaataaaagtataaaaaaacaaaatttaattaagaaaatgatcgtacgataagttttattccgcctgacggggaattcgaactgatgagttacaggtacacacaccccgcactgatattgcattttcttaattttccaagattgagcacaattgtcaaaccactcatttgggtcgaagcggtaattaatttggttttgcgtttgttatttgcttaattttacaggtaattgagaaattttcgcacagtcgtgttgaatatatggtcaaagtaaggtcaaatgggaaggttgttaccattattattaaaaaataattattattttttaaattatttgtttaactacttaatattttatgcttttgcgtttgaaggccaaaagtcagttcaagcgacgttcgacagcgaataatgtcgaaattgtcgtgccggcccccagttattcggacagtccgcgcttcaaaacggccatcggaaattgccgttaccaaccggaagtggggaagagcaaaaggaattctcattcgatcttcgcacttttcctttttaggacaattcttttgtgtggaatatcaaaaatttccccggagggaaggaatatttaatgcgcgctcactttaaacttccgtccgttctcagcgaagaagttgaggcgaagcgtccgatcaaagtgcgctttgaaattccatatttcaccacatcgggtgagcgaagcaaaaagtggaccaatgtttggcttaaccacgtaagtaataatccatcaaatcaggcattcaagtgcgatacctcaaaatcatcgagaaaagcggctaccaggcactgccatgggtgcgatacatcacgcagagcggggactattccctacgattgaat

SEQ ID NO: 46719 - DNA, 992 bp, Heterodera glycines
  Genomic contig location: Contig_ID=SeqID_9261; Location=36..1027; Strand=+
  SCN-specific regions: Sequence locations=1-57,79-93,115-595,618 -882,904-932,959-992
  Gene Ontology: Mol. function=iron ion binding; Cellular component =cytosol; Biological process=citrate metabolism
atgtcacgtgctgcaagcattgcacgacaggtcaatcacataagaacaaggattgaaaaaagcctatttggccaaattataacaaattatgctaacaaaaacaaataaactgaatttctcatttccaggcttccaaacatggcttgaaagtgaaatccatcttcactgttacgccaggaagtgagcaagtgcgtgccaccatcgcgcgtgacggcttcatcaaggactttgagaacattgggggtgttgtgttggccaatgcttgtggcccgtgtattggccaatgggaccgaaaggacgtgaagaagggcgagaaaaacaccattgtcaggtctcatcgctaaataatgccatgtgcatctttaactgggtttataatcaattagtaaattgtaattcgtcagttcttacaaccgcaatttcaccggacgcaacgacgccaacccggccactcatgcgtttgtcacttcgcccgagttgaccattgccttggcgttggcgggcactttggactttgacccacgccatgacacgctgacgggctcggatggtttggaaatggttcaaaagggaaaatacttaaaaggcaatttcaggcaagaagttcaagctggaagaaccgaaaggcgaatgccttccggccaaagggttcgatccaggcgaggatctgtaccagccggcccgtttccaaggcgacgtggtggtggacccgaaaagcgaccgtctccaactgttggagccattcgacgcttgggatggcaaagacctcacggacatggttatcctcatcaaggtaatgggacaaggggtttaatcaatttcctctgataatgagtttggacaagccaatttaattataaatggtttaggtcaaaggaaaatgcaccactgaccacatcagtgcagccgggccctggcttaaataccgtggacacttggacaacatctccaacaaccttttcctgactgccaaaaacgcggagaacgacgaa

SEQ ID NO: 46720 - DNA, 755 bp, Heterodera glycines
  Genomic contig location: Contig_ID=SeqID_43019; Location=1..755; Strand=+
  SCN-specific regions: Sequence locations=1-226,254-546,568-643,665-755
  Gene Ontology: Cellular component=nucleolus; Biological process =embryogenesis and morphogenesis
ggaccaaggccaagaagttctgccgcaatgagttcaacttgaccggactgtgcaatcgtgcttcatgtccgctggccaacagccaatacgcaacagtccgagaagagaacggtgggccatcaaaagcgaattgacgaaatgagagaaagtgatttgttggttgattaaggcgtgtgtttcctttttatgaaagtggccgaacggagtcatttcccgggcaaactttgggagaaggtgaagctgcacagaaatttggccaaggccgttgaacagatcagcacgcatttgctgcattggagtgaatacgtccgcaaaaagtgcaaagcgcggcttatgcgccaccaccaatgtctgaacagaatgcggaagatggagctgaggggacgcactgcgaaagtcatcccattgcaggtgacaaaataaaaggaaagggaagcgaaaaacggcggaaaaattggaaattcagaggaaaatcgaacggagggaacgccgcagggaggaaaaagcattggccgcggcaaaattggacaatgccatcgaaagggaactgctgcagaggctgaagaagggcacctacgggagcatgtacaaattcagtgacaagacaattgacaaagcgatggaaagggtggacgagtcggagcaaagtgaggaggaagaagtggaatatgagacggagacaacgcgggagaagcagcgacagttcgtggaagactttgacgagtcggaggagggggaagacatcgaagactatt

SEQ ID NO: 46721 - DNA, 838 bp, Heterodera glycines
  Genomic contig location: Contig_ID=SeqID_1250; Location=1556..2393; Strand=-
  SCN-specific regions: Sequence locations=1-629,651-838
  Gene Ontology: Mol. function=protein tyrosine kinase activity; Cellular component=plasma membrane; Biological process=cell proliferation
atgacagaagaaacttcgggcacagagcgcgtctttgcattgtctgtgaacgtcggaggactggtcaaccacgtcatcttccgccgtcacaacgggatgtacaccttggacaactgcgacaagggcttccgaacaatcgaacgattcgtcgaccactacctgcgcaccggagcttccgtcaccaccgtaatcaaacagcttgaatcttattattttttcattttcccttttttcagaaacaacacgtcgctctcatcagggccgtgccccgcgcgcactgggagctgtcgcacacttcaatcatcctgaacaatgaacttggccgcggcacgttcgggatcgtcaagagtggcgtctacgtggatcagcaggggactcgagcgacggtggccatcaaagaggtgtctcagacgagcaccaaagagcaagtgaggaaggggggggaagctgtgtccatattaaacattgctccgttttttaaaagatcttggaattcatgaacgaggcgcgagtcatgcggcagctcagacaccccaatgtcatccagttctacggcgtcgcggttggccaggagcccctgatgatcgtcatggagctggcgtcggacggcagcctcaccaactacttgaagcagcagcggcggagcgcgcgggtcaaactctacatgtgtctcggcgcagctggcggactggaccacatccactcgaagggcatcatccattgcgacgtcgctgccaggaactgcctctacacgaacggagtggtgggtgaaaagcatcaaaaaaaaattttttttgtcatgaaacttctaaatttgttcatttttccccacaggtga

SEQ ID NO: 46722 - DNA, 1015 bp, Heterodera glycines
  Genomic contig location: Contig_ID=SeqID_9277; Location=1..1015; Strand=-
  SCN-specific regions: Sequence locations=1-456,488-674,701-803,852 -1015
  Gene Ontology: Mol. function=insulin-like growth factor binding; Cellular component=soluble fraction; Biological process=signal transduction
ttgcggagttctcaagcccatcttggcctgctaaaggtccattctttttttttcgttgtttttacattttatttgcttcttcttctttaggttttgaccattcactcaactcccatcaaaacgctttccaacaattttttcgctgggctttacattcgtcgacttgagcttatcaattgcgaaattgaacttttggagaaaggggcttttggaggattggaaaatgttttgcaggaattggccattaatgggaatcgggtaaaataaagcggacaaaaaaaggaaatgaatttgacaaatcagatcaaagaaatgattccggaaaccatcgcgggattccattcgctggtccgactcgatctgtccaacaattccatcgaagaattgaaggtcgaacattccctgccgaggctgccaaaagtaagagaaaacggacaaacgaatggacaaattgccaaattaataaactattttaaatttaaatttagctcacagacatcgatttgtcgtacaatcgaatctcagctgttcacaaaacttttttcgatggggtcaaaggcactgtgcagacgatcaaccttggccacaatgtcatcgaagaagtgcctgccagcggtgccctttttaatttataatattcactaaaattctttccagcagccctattgttttttggaataacccattttttaaaatttttcactcataaaaacttcaatttgttgacgattcatagataacattcaccaaatcaaaaaatttaacgcaaaaatctatttttgactgttgaattgaatttttctttaattggttaaataagtaattaattcgtaattaattaatttaattaacatttgcttaatttgacagctatccgtggctttcgtatgttgatggcattgcatcttcacaacaatttgcttaatggcattctgccggcactttccttcatgaaccttcccgtgctcagtcttctcaatttggcaggcaatcaactcagtgccatgcatcgcca

SEQ ID NO: 46723 - DNA, 479 bp, Heterodera glycines
  Genomic contig location: Contig_ID=SeqID_43087; Location=1021..1499; Strand=-
  SCN-specific regions: Sequence locations=1-40,91-139,161-380,407 -424,446-479
tagaaatttcaactgaaaaatgttttgttctttatttggggaaaaataacaagaaaaaagaatattatattaactcaaaaaagatttcagaatcggaaagtgtacgtgacttgggcattataattgactcgaaacttaatttttcagaacacataagcaaaattatacgaaacgcatatcttagaagctttcagattttgagagtgttgaaaagcagggaaataaagactctaacagcagcttataaaacttttgtacgacctcaattagaatacgataccgaagtttggaacccaaatttaaaaaaagacattgacaaaattgaacgggtacaaaaatttttcacaagaaaagtttttcgaaaatgtggatttgtgtacaaaaaatatgtggaaagacttaaaatcgcgggtttacataaattagaagaaagaagaaaaattaatgatttgacaacagcttttaaaattattaaaggg

SEQ ID NO: 46724 - DNA, 2177 bp, Heterodera glycines
  Genomic contig location: Contig_ID=SeqID_9283; Location=4722..6898; Strand=+
  SCN-specific regions: Sequence locations=1-11,34-184,206-327,349 -360,384-527,549-653,681-993,1024-2086,2112-2177
  Gene Ontology: Mol. function=delta DNA polymerase activity; Cellular component=nucleus; Biological process=DNA replication
atggtcaaggtggagggccaaagggaggagtttgtccgcaactgtttcgtcgttggcggttgtgagtcggtcgtcggctctgacattgtcgagtgccgtgacgagaaggaattgctcgaggcgagtgttttttttcctctccaatttttatattcatttccatcggtcccatgtgtgtagaaatgggccgcgtttgtgctttgcgtcgatcccgatttgcttaccggttacaacatccaaaactttgatcttccatacattttggatcgggcaaagcatttaaaggtattaattctcaacacacgattaattttttgtactaaaggaatacattttcctattttggttcgtacctttcgccaatttcatttattttatttttgtcacagattgacaaaaccgtctgtctgttgagtcgaattcgcgggtcaatgtgtcgacaaagggacgccgccatgcagtccaaacaaatgggcaatcgggtgaacaaattcgtctccatggacgggcggatcatcttcgatgtgcttcaggtggtcccttttccgtctgtcccatttcaatttatttttccttttccatccttttttcctcagttggtccttcgcgagtacaaattgcgcagttacactcttaacaatgtcagctattttttcctgggcgagcagaaggaggacgtttcctacactttcatcccccaacttcaggtatttttcatcaatctccaaatttttaagaaaatgcttagaatccaaaaaaaacattttctaacgctcttttgcccattttcacagaatggctccaacatggacagacggcggttggctttgtattgcatgaaggacgcctttttgccgttgcgtctgctggacaaacttatgctggtgatcaattacattgagatggcccgtgtcaccggctgtccgttgaatttcctcgtctcccgtggccaacaagtcaaaattttgtccatgttgttgagaaaggtgttagattaaaatttatataattaaaaaataataactttttccgttgtttgttttgcagactcgcgagcactttttgttccttcccgtcgtcgaaatgggcgagggcgccggcggcgacgaggtcggctacgagggggcgactgtcattgagccgttgcgcgccttctacaaggacccaatcgccacgctggacttcgcctctttgtacccgtccattatgatcgcccacaacctttgctacaccacactgttgcccaagggggccgtagccaaaaaggcgattccatcggagtgtgttcacactactttcattgttttttccaaaagttttcatttctttttgttcagttggcgcgagggagaagattacattgttacgccgtccggcgatatgttcgtcaaggccacccatcggcagggattgttgcccaaagtgctggaggagctgctcagcgcacgcaaacgggccaaggccgagctcaaaaaggagaaggacccttttcggtaatgctaagtccaagattttgccattaactcattaatccatccattagttgactaattacaattctttgaataattgactatttgtattttcttcaattgcagacaaatggtgctgaacggtcgtcagcttgcgctaaaaatcagtgccaattccgtctacgggttcactggtgcctcccgtggcaaattgccgtgcttggaaatctcgcagtccgtcaccgcttttggtcgtcaaatgatcgaagctactaaacaaatggtggaaggtgtgtgcaaccaatgccaactactatcatgaactgtttatttgcattactttaagaatcttacattgccggcgctgtcgacggactttgtcctgcaaatgccaaagtgatttatggtaaatctttttcaattgactttttaaataataaatgtttgtatattttcatcaccatttagaggtgacaccgattcggtgatggttaaattcggcgtcaaaagtgttggcgaagcgatggaattgggccggcacgcggcgcgagagatcagccgacgttttccgccacccattcagttggagttcgagaaggtctacttcccgtatttgctgatcaacaaaaagcgatacgcgggtctctattggaccaacgaggaacgacacgacaaaatggactgcaaaggggtaatggaagagaa

SEQ ID NO: 46725 - DNA, 812 bp, Heterodera glycines
  Genomic contig location: Contig_ID=SeqID_9284; Location=210..1021; Strand=-
  SCN-specific regions: Sequence locations=1-323,348-623,645-812
  Gene Ontology: Mol. function=RNA binding; Cellular component=nucleus; Biological process=mRNA cleavage
gagtccgtcctcctttcgggcagcaacgattttacgctgaaaatgttcgattattcaaaaactgcggttaaaagggcaatgaaaacgatcacggtaagtcatattctgaaagaattttacaatgaaatgtttggaaggaggtcgagccgatcactgcggtcagttttcatccgagcggagagttttttctatgcgcaactcggcatccgaccttgcgtctttatagtgccgaaacacaggtaccatccatatttttagattttaatttgtttaaaatcgctttcaatatgttcttccgtttttaaatagcatagaaaacattttttacatgattctgaaaacttcatcgaatctgtttctttagcaatgctttgtttctccaataccgaaggaccaacattctgattccattacggatgtgtgctattcggaaaatgcgcgaatgtttgtcacgggaagtcgtgatgggaatgtaaaaggtcgattattagacataggtcatatatggaaagaggggcgagggagtcgactcattaaagccatttttcgccgataaaaggtcccaaaaatggaggtttttagaattaggttttcagcccttgtccttctccctcacggcccccttcttttttgtcctttatttcactttttttttagtttgggacggagtttccaatcgatgcattgagacttttacccgcgcgcatgacggagccccgatttgcagtgctcagttcactcgtaatggaaaggtattgcttcattatgcataaattttcccagaaattaattactaaagtgtcattgctgtt

SEQ ID NO: 46726 - DNA, 645 bp, Heterodera glycines
  Genomic contig location: Contig_ID=SeqID_9285; Location=2660..3304; Strand=+
  SCN-specific regions: Sequence locations=1-411,433-645
  Gene Ontology: Mol. function=transcriptional repressor activity; Cellular component=nucleus; Biological process=regulation of RNA -nucleus export
gatattccgagcccacttgacgcggaaatccaaattgttctgagggaaattcagtcggaagtgcatcagctagagaacagtggcgaatacggggaacaattgaaaaatgcgcgtcgactgttggccaccggtaagaaatttgagcagcaaaaaccggattgactgcttttgaataataaatcccagaagcaaccaagctcgagaataacatcgacccagaatggctcgaagtggacatcaacaaaccgatcaaagtctccaagaaggtgctcatccccagtttccgtcatccaaaggtttcttccccaacctttttcattaaatataatcactgttatttggattcagtttaattttgtgggcaaagttcttggaccaaaaggcacgactttgcaaaatatcgccaaatcatacaaatgtcacgtgtacattttggggcggggcagcactcgcgaccgaaccaaggagcaggtaattctcactcaattttgtttttcttttcatttcttactttcttttgttctcataatggctatttctatcgcttggtcttctcaaaccaaatttcccaggaaatgctcagcagcggcgacccacagtacgctcactacggtgggcctttacacgtcaaagtggagacgactg

SEQ ID NO: 46727 - DNA, 960 bp, Heterodera glycines
  Genomic contig location: Contig_ID=SeqID_43141; Location=384..1343; Strand=-
  SCN-specific regions: Sequence locations=1-135,157-344,368-595,617 -638,661-960
  Gene Ontology: Mol. function=sphinganine-1-phosphate aldolase activity; Biological process=cellular response to starvation
accgtttctcggcgtcacttcaatttcctgtgacactcactaagtgtgccaaacttttgtccaattttgacgctttttttctttgagtatggttatgccccgaagggtacttctgtaattctctaccgtagccatgatttgcttcaccaacaatacttttgctcgacagaatggcccggtggactttacgctacgccgacactttctggtgagaacattcgccgcttcgaataataaaaatttcttggcaactgaatatccccccttttctgctgtccatttgtctaatgctcctccgccttttccgtcttaaggaagtcggccgggtctgaacattgcgctaacttgggccacactccaacacttcggagaaaaagaatatgcaagacgagcccacctaattctgcagaagaccacacaattggccgacgctgtcgctaaagtccccggaatttgccttgtcggaacccctgaagtgtccgtggtcagaaaatatttgaatatcatcccatatttgcattatggcagacttacattgaaaggtggccttttcttcacatcgctttaacattcacgcgttaggcgactgtctgagtaaaatgggctggaatttgaatttccttcaaaagcccgatgcgtttgtttttgcttttcctctctgtttgcatttcctttttagccttcatttttgtatcacttacaatcaaacggctgacggagtgctaaacgccttcttagtggaccttaaaaaagcctgcgaagaagtggccgcgttgcccgaccgaggggcaaattcaaaaacggtgccacatttggcggatgaggctaaattttgcctaattttttttaaaggctgcgatttatggaatggcagccaaaatcccggacaaagggcttgttgaggaagtcgcccatttgtacatcgatgcttgttactcgatgccatcgttcacttcctca

SEQ ID NO: 46728 - DNA, 1313 bp, Heterodera glycines
  Genomic contig location: Contig_ID=SeqID_9301; Location=30..1342; Strand=+
  SCN-specific regions: Sequence locations=1-313,335-375,397-409,433 -923,948-1023,1045-1250,1293-1313
  Gene Ontology: Mol. function=transcription factor activity; Cellular component=transcription factor complex; Biological process=salivary gland morphogenesis
attagcaggccgatcagtggttaattgcttttgcttattagaagccgccgttctcttacatttggctcacttacatggccatccaaaacagtgaggacaaaatgttgccgttgacagacatttacaatttcatcatgaatcgttttccgttttatcggcagaatacgcggcgatggcaggcaagtggcgatggacaaagggcaaaatgaaagaaatttgggttaattagtgtctaatttgagtacactgtgagcatggtcaattaagcagttcgcttttcgttcagaattcccttcgccacaatttgtctttcaatgattgcttcatcaaagtgccccgacgttcggataaaccgggcaaagtgcgttttttgagttttattttacattcttttgatgccatttcagtgttttctccaatgttttcctttctttcccctaagggttcatgttgggccattcacccaaaagcgattaaaatgttcgaaaacggaagttgccttaggcgtcaaaagcgattcaaagtgagcatgatttaatgatttaagtgagtttcgtttttgaactgtttcagctcgacccattcgcacccggacgaatgtcaaagcgaaaaaaaagcgaaggaggggagagaatggcacggccggagggacgagggagccgaatggcaccaggggaaagtgggggagaggagcggacagaaggggagacgagcgacgcatcagcgtacggggaggaggggagccaaagcgaacagcaaatggcacttgcaatgctggccatcaattcggcacttcaacacttcggagaggtgggccatctcacttaattaagtcggcactcattcgttagaaggtcggagggtggtcctttattttgctctgctcccgatccgtaaagggattgccatgggttgttaatgcaactccttcccgccccctccctcccgcgctcctcccattgctcttccttttcctttagctttgtgctcctcccattccgtcgcttcttcctttgtttgttccgccgcttttccctccgccgcccgctgtttccgattctccgcttcttctcaacttggccctgtgttattccacttgcgccgatgttaagctccctcccgctcttccccaactgttggccctttccctgccgtcccaaaggggccgagcagtgcttcgccctccccctcctccgattgtgccccttccgtttggcaatgccttcgccttccctccgccctcttttccttcctccccctccttttcttcctcctcctcttccaccttttccatcacttcgctgttggcgcaa

SEQ ID NO: 46729 - DNA, 1060 bp, Heterodera glycines
  misc_feature (1050)..(1052): n is a, c, g, or t
  Genomic contig location: Contig_ID=SeqID_43233; Location=1..1060; Strand=-
  SCN-specific regions: Sequence locations=1-343,366-1060
aactgtcttccaggcatgttcatcgtcgggctgccgtttgccgtcaaaattggcggatggtgtgccattctcgcgctgaccggcgttgcctggatttgctaccgcactgttagtacttttttgttcatctgtcgtccggtagcgtcatgattttgatcacttttgcatggacaccgaccggcctagttttttttcttacctaatgccaaaacctggcacttttctccatcggtcccagttccaaatattctaccgttcatttgcttatcattttgccagggtctgattctgatcgagtgcctttacgaggactgcccgactgacggcactgatcactcatcgcagcagaaaatgaagaggcgacgaaaagtgagacggaggtgaacgcttgggcagtagcagaaggcactggagatcaggggatggcacagaattccgatttccaaaaattttgtgcctcggaatgccatccctgctggagatgttcgagagtctatttttacctaagagaacagagttgcccagaaacgacactgaagtccctaaaaattcagttatcgggaagtggccgaggcggtgcgaccggggcttggcaaatttgtactcatcgcgcagctgaccgaacttgcgagcacgtaagcagacgaaaagcaaatgaatattaataggacatttaaaaaaacttcccccatttttggcacttttttaaaatttatcaattcttttacctatctttttgccccaccgatgtgccacaacctaagtatccaacaaattaagttgcattctgtacattgtgctggccggggacctgctccaaggctgcttcccgagtgtcggtgcgtttgcttttcccattttttgttgttgatcaaatctgtaagggacagtctgtgaccaaatgatcaggccaaatatggggggggcacttaattggctaacaattagtggcataccaaacaaattatgccgagaattgatcaaacatgtgacaaaatacaagcccgattgatagtgtccggtcaaaactaagggcgaaaactgctctannnaacccgaa

SEQ ID NO: 46730 - DNA, 951 bp, Heterodera glycines
  Genomic contig location: Contig_ID=SeqID_43291; Location=1..951; Strand=-
  SCN-specific regions: Sequence locations=1-58,82-153,182-249,316 -331,364-408,430-499,529-646,668-951
ggactgaatgagccgtgctctgtgaactcactggttgaagttgtggtgggcaattttgtaaataataattaaaataataaactagagtgccacgggaccgggaattgactagccactaggccatttgcacaattgctattgtttctttgaaagaatatattaattattatttaatatttttccctttgactccaattttcttcactaatttttcactcagacccccattcttaccagtgcttgtttttcccggttcccggttgccctaccgggaccgggaccgggacctgagcttttcaaaacccgggaccgggaaccgggaccgggaccttcggatgaccgggaattcccggcccggtcccggtcccggtgtcccgttcactctataataaacatatccaatttaatattacaaaaattgtaaagctaaagaaaataagtaaacaactttttcaaaaatcacaattttcttgtgaaaacaatcaaaagaaaaatcccgataattaattataattatttataatttttgcaggtcaatacgaagggcggttcctccggcgtcgccccgggcgaagtgtcaatttttgccacttcccccgctgggcttaagcaaaagtgtgaggttattcggcgcgaaaatgccttcaccagcacatttacaccggacagaatcggtgggtattaattaattgagtttattaatagctttaactaatttgaactacaggcaattggctgattggcattctgtacgagggggaacacattaaggggtcgccgttcccttgccaagtgttcgatgcttcgctggtcaatgtttatgggtgggtgtaataaataaacaagaaattaaaatatttaatggaggctaataattaattgcttttttaaggctcgatgttggactgattggccaagaacttacttttacagtggacgcgtcccgggcag

SEQ ID NO: 46731 - DNA, 3338 bp, Heterodera glycines
  Genomic contig location: Contig_ID=SeqID_9325; Location=1032..4369; Strand=+
  SCN-specific regions: Sequence locations=1-392,415-590,612-678,721 -721,743-1124,1152-2365,2387-2462,2497-2615,2637-3021,3059-3276,3298 -3338
  Gene Ontology: Mol. function=ATP binding
ggctgacccaagacaagatcgctttatttctccaaaatgggtccaacttcgtgaaagcacaaacccagccaaagatggccaattggcgggtgttgtaattggcgaagtccgcaattttacacttgtctcgtgtattacggacaaaacagtgcattcatacattttgaattccgaaggaaatcttctgaagacggtgccaaactttgataaatgacaaaatgcactttttggcacagatagtgcacgatgtgaagggttgtgaacggaaatgttggcattattcgaagacgaccaatcagctcattgtcgcgagtcgggaggtgggcaaatggcacaaacgaaggtcattggttggtaatttgcgagttgctaagatggtctacttctatgacattaatgactgcttggaaatgggtggcgaaaacggacgatgtcacgccctggggagaggaagtgaaaaagtgcaactgctggagaaagatgggcaaatcgcactggtcactgagcaggaaacgcaaattcagtgagttttgtcaaaataaatgcatttaattgagaaacaacgcgaccaacgagctggaaaaatctttgggttataccatgaaaaaatttcatatagggctactcttttttttctttgccttattacacttttatctgatggcacaatttgttgtcttttaaatgattttattttaaaatttcttaaaagttttaattgtttgctttccattttcactattcccatgccattcatttttcatagatcagacaacaacaaaatgaatgttctctatctgtttgacatcgaatcgcgttacatttcatttttctgctcaatgccttcgccctgtcatatttttacattgggcggtgaaatttatctgcgcaattccgagggagtgcttagcaaattggtagaagagagtgtggagaccaaattggacattctgttgaagaagaatctgttcgatttggccattaggtttggtcgagttttgcgtttccaattgctttttttcattttttaagcattgcgcggcgtggcaaatccgaggaactgctcaaaagcattttcatgaaatacggtgactatttgtataaggtaaagagagttatttttactctcatttttgtgtttattttcagaagggggactttgacaattcgattaagcaatacacaaacactttcggatttgtcgagccgtcgaatgtcatcaaaaaggttttgtttatttttaccaaattgttcatgtcaattgctttctgttgacagtttcttggcggcgctcgaatttcacaactttgtcaatatttggaaggttttttttaatgagaattgccaaatttaagtcccacttgctttagcgttgcatgccaataatttggccactggtcaccacacgactctattaattagtgcttatgttaagcttcacaatgttaggaagttggaagaatggttaaaggacggagctgcacaattcggacccgattttgatgtcgattccgcgataaaggcacctaaatcgaagcgataaaaggccaaagagtacatttttaagctgttacgatccgctgaactttttcacttggcctcaaaattagcagcaaaatccgatcgaccattcacatttttggacattctttgtcaggacactcgcgaatggggaaaagccgtcaaatttataagtgaaaggccgctgtcagtttcatgcgaattactggaaacttatggcccgattttgcttgaacatgtcgaggaacaaaccctcgcgcttatcggacgattgatttggtcggaaggtgagaaggtgttgaatccagttctttatggattaaatttgttagcaaatcggagggttggtgggttttaatgggtacctttttgtgttcacaatcaaccttttttcagtgcaatttttcaaattcaacgtaccgcagaaaaatattatttttaacagattttgcccaaaaaggcgatttatgttttctagaaaattttgctctgaataggaacgcaagcaaattttaatagcattttttacgcgttaaggagtgaaccttaaaaatctgacgaaaatattgacaaataaaccgaaaagaatggaggaactgttcagcgagcttaatttggctggcgaactgaaagacccgcaagtgaggagtcttttgcttgagcaacgcctgaaaactctccaagagagtgccacggttagtgcatttggacgccatactcccaaatggtcattttcattcagaacccttcgaaggcacagttcgcggaattggtctctctggttgattcggcctctccccaccactcccttctcttagcttatcagtacaattgttcgccgttggtcattcacattttgagacttttgaacaggtttaaatcgactttttgcttggcattgaggcctatgcacaaatcgttgtcagttattttaggtccaaaatataaaaatggccactttagattttgagcagcaaatcacattttatatactgactgacaagggaaccacccgaattgtaagtcaaaaatgcatatttattatataccattggatagaaccttgccccatactttgatttttttcacacaccgctaaaattaaaaattcaaaaacaagtcaactctgtcagtccaatggaaataatacaaatgcatttttcggcttaccgttcgggtggttcccttgcaagtttcaagttattccaagttaagcagtttgggtgtaattagtattctaatttccttgaccagcccatttaaaaagattttgggcatgggagtaatgtctgggcgcaaatgtttatttgttgttttcacacaaaggatcgaagaactcttccgttatttgctcactgagggcgacgtggtggcagcgatcgaattgtgtgaaggcaaatcactcgaggacatgtgggtcgaactgatcagtttcggaacgaagagcaaaagcgccacaaaaaaagaggatttgatcgcgcttctacgaaagttgcagagatttgcttcttttattaatttttacaatttcagaatttcggaatccgactctttaaaccctttaatcgttttggaaattttgtctcgggacgagtcgctccaagtgggcgatattcgcgagtttatcatcggatggttggaacgacagaacgagtcactcaaggacaatgaacacagaatcgcggagcaagagcgtcaattgcaaaaaatgagcaaagaaattgcggacctcgagaataagttgcttttcggggtaaaaggcggaagggaaagaaagggttgtcaattttccatgacaattcgtcatcggcggtgct

SEQ ID NO: 46732 - DNA, 907 bp, Heterodera glycines
  Genomic contig location: Contig_ID=SeqID_9328; Location=670..1576; Strand=+
  SCN-specific regions: Sequence locations=1-907
atgccgaaggtttgtgcttttcctgttaactctgatttgggcactttttcactattctacaggaagaagtgcccgaaggagttgaccagctgacttattttcgtgagcaatgcgagcataaggttgcccatttgaagtccattttggaggaatgcaacgagcgcgtgcggtccaagccgaagaccactgaaatttgtcacatggttcgatttaagtattatcattacaaaaagaatagacttgcgactttttgattggaatgttgcaaaattgggagacggtcacaaatagagattatctacgggccgggtccgtatacgggtttttagcccgtaacccgtatcgatgtcaaacccgtaacccttacccgtacaattacgatacgggttatttttctgacgttcttctaaggtgaaatggagtaaatttttaaattttgtgcagtcaattcgccaaaacattgaaatttggcggttacttttgtaaaattttctgtgaaaatcgaaaaagcactggtaaatgttggaaaattttatggaattggaaaaaaaaatcaacataaatttttatgttattcaatagcacttcgttgaatttatgaaattctctttcattttttccaattcttaaatttcttaagaaattggtttattcttcaaaattatagatcattttagtgaaaaactgtcagcaaaattcacgaaatcgtttaaaatcgcaaagttgggcattttttctataaaatctttgcactctaattttaaaaatttttcccagcggcgcctaccggcaccgccggactctcctccccatgttcctaaaaagttttttgagaacgcgcgccgcaaaaaaaagtagggtgaaaagtggtcgttaaaaatttttgagcatatttttatttcgtaaa

SEQ ID NO: 46733 - DNA, 966 bp, Heterodera glycines
  Genomic contig location: Contig_ID=SeqID_9330; Location=159..1124; Strand=-
  SCN-specific regions: Sequence locations=1-9,32-116,138-434,456 -874,897-966
  Gene Ontology: Mol. function=acetyl-CoA C-acetyltransferase activity; Cellular component=mitochondrion; Biological process=ergosterol biosynthesis
atgctcggccaaccgatgggtgtttgtgctgagaaaacggttgctgaatttggcttcacgcgtgagcagcaggacgcgtatgcactcgcctcctatgctcgtgcgactcgcgcgtgggcgggcggcgcatttggtgcggaaattgtgccggtgaaagtcaaacagcggaagggcaccgagttaatggtggcagaggacgaagagtatcggcgactaatgcccgacaaagtgccttcgctgcagccggcgtttgtcaaggacggcactggtaccatcacggcggctaacgccagctcattggttagcggttttggcactcaatgttgagcatttttgtaatttttgagtattttcagaatgacggagcggcatcgcttgtgatcgcatcaggccaagttgaaggggcaaaaccgttggctaaggttatcgcctacgccgaggctggcagagcgcccgtcgacttcacagtggcgcccgttgacgcggtcaaaacggtattcttggaaattaaatgcttgaccaacgcccacttttacattcgtttcgacttataaatccattaaatttgatttattaaattacttatagcaatccaaaaagtcttgtttatatttcaaaggaagggttaatgtaaaaattcagttgttacaatcggtgaacatttcgatcgatcaaattgcgcgttgggaggtcaatgaggcgttctccgtcactgccttggctttcattcgtcagctcgacttggacccggcacgggtaaacgcactcggcggagcggtggcgctgggccatcccattggatgttcgggagcacggattgtggtcactttggtgcatcaactcgagtcaggtcagtgtaatacaccgcgaaaaagccaccaaatttattaatcaggggaatttggtatcgctgcaatttgcaacggaggcggagaagcgactgccattcttgtgcaaagaatttga

SEQ ID NO: 46734 - DNA, 949 bp, Heterodera glycines
  Genomic contig location: Contig_ID=SeqID_43335; Location=1..949; Strand=-
  SCN-specific regions: Sequence locations=1-114,136-183,205-949
gccaagcgcagcagcgatgagtcttgtccatcagttcatttcggtctgcccgggtgcctttcctttttgttttccatttggtgcctctctctcctttcgaaattcgaatgccgttgtcccttttaggcgtgttttgggccgtgccgattcgtcctccgcccatgccgcaccccctccctgcgccaccggtggcaactcgcgcactaagcgtttgttcggccgtcagctccgtggcacaatgccaccgcaggtgaagcagaaaataattcaaagggcacagaaaggaaagcattgcttgttcagcccgttctgacgatgatcgaccatttgctgttgtacggctcggagacggagggaattttccgcaaatcgcccaaacagcaaacggtgcgcatccttcgccagcagttggaccaggtcattctttggcatttcccccctcccctctcacctcccccttttttcagggccaagtccctgacttccatcagttcaatgttcacgtgaccgcctcgctgttgaaggagtatttgcgctgtatcccgggtcagctgctcatttccggcaattaccgcctttggatggaagcgaatggggacggactaagcgacgaacagcgcatttgccggtgccgaaaactgctcacaatgctccctcccgcgcacacagtgctggtgagacggaggccaacgaaggaaaattggggggagggcgacttttggaaattggggaggtgacggaaaacactcgaaagatgccatggaattgggggggggggaaggactgaaaaatgccaagacggacggcattattgcactcatttgatgtttctttttcagttgcgctctgtcctccgtttgttgcgtcgcgtggctgccaacgaagaacacacaaaaatgggcaccaacgctttggcggtgtgtgtggcgccgagtctgcttgagaaact

SEQ ID NO: 46735 - DNA, 798 bp, Heterodera glycines
  Genomic contig location: Contig_ID=SeqID_43357; Location=69..866; Strand=+
  SCN-specific regions: Sequence locations=1-110,147-162,200-289,311 -316,339-533,555-568,590-798
atgtatgccgatgatgttaaattatattatgcccatgaaaatgatgataaaacaaatcatttagataaagcaaatgaagctttggaaaaatggtcaaaaataaatgggttagaaatttcaaatgggaaatgtgtttttctttatttagggaaaaataatatgaaaaaagattatttaattaactcaaaaaagatttcagaatcggataatgttcgtgacctaggcattataattgactcgaaactgcatttttcagaacatattaacaaaattgtacgaaacgcttatcttagagttttccagattttaagagtcttaaaaaccagggaaataaagactctaacaacagcttataaaacttttgtccgacctcaattagaatacgctaccgaagtgtggaacccaaatttaaaaaaagacattgacaaaattgaacgggttcaaaaatttttcacaagaaaagcatttagaaaatgtggttttttgtacaaaaaatataaggaaagactaaaaatcactgatttacacaaattagaagaaagaagaaaaatcaatgatttaacaacagcttttaaaattataaaagggttcaccagcctcgatgctgaaaaaagtttctttttctcggaaaggcccaggaggcctttacttttgcgagtaaagcgccacacggccaaaactcaaaataattttttcaatagaatagtaaaaagctggaataaccttccagtggtagcggtgcaaattaataaggcaaaggaattcaggggtttactaaaagcaatgagttctgagtag

SEQ ID NO: 46736 - DNA, 2101 bp, Heterodera glycines
  Genomic contig location: Contig_ID=SeqID_9340; Location=795..2895; Strand=+
  SCN-specific regions: Sequence locations=1-70,93-98,120-208,278 -1881,1993-2101
  Gene Ontology: Cellular component=cytoskeleton; Biological process =microtubule-based process
atgcagaaccagtgggattggatactgaacctgaacaagtgcctggagggccacctgcgcgacgcgtgcaatgccaaggcttttgtggaggagtcggagcaggtggagcagcagatgcaaaaacaattggtcagtttggcgtggcgtatgactgcatagggggaggggggtactgtttgtttccggctcaggaattttcgaaattacgaaattatttaaattttttaaatgttaaaaaatgattatttaattttttagaaaataaaaattattattacaagacttcccttctttcaattaaccatctagaatttccaggaaaataaaaatggtttttatttattttttttgaaatatcttttggtgagtttttttattgattgaaaaactaagcccatggaaatctcaacacgcttttggctctattcctgaccgctccaactgttttcaaatcttcattaagctggctatacgagaaaatgccaaaatccaaatcattcgaatgccaaagttgttgttggcatgcatttttttagtatgccaccactaattttggcacacattttttgggacgggggagggggagtggaccattaatgctgcgcttctgaacgttaattaaaggccatgccatatattcaggcttccttcccatcggtggtgttcggcattcctccgcctgacccgcggttggcctcgttcctcagccgactgcacaaccaattcgagaagttgcgcaaattgtgggaccgcacccatcatttggtgggtgttgtacaaatggggaggcaattaagggtcattagcgacggttatcaaactacgtaaatatcaccgaattagcttcgtgaccaccaaatatagtattgtataaatcctcttttgaccgtatacatctcagcacaattattctctgtcagtctcctcatccccgacattacaatcctactgtatcaaatccgctccgattgcttttccaattcttactgtatttgtctgtttacaggtccgttacaacatggtgctgaacacaatgcgcacagtgcgtgcatgggacttggacactttcctgtgtattctatccgatcaacgggacgagatcatcaaaacattgaatgaggacgtgaacaagctgctgtcagagatggaccccaacgatcccttggccaagcggctcaaggacgagctgcggatgaccaacgaacacttctacgatttgttggcacgagctcagaaagagccgggtaattaatgcctgactaattgggaattaattgattcattttttgccattgatttggtcgtttttgtgatgcgttaggaccagttgattgcgaattatttggcacataagtgattcagacaaaattgatttactacgagtaatagaccatttctgattaagcgagtaattaacacagctcaagctaataatcaaattaattaattatcgaacgcacttttttgactagtaaacataaccaaaacctaatgaactgatcagcgatcactttttccattccatttgaacttgccatgatctgtgtattgaatcagatctgatcgtgatcactcccgtccttttctgatcactatcaccctctctcttttcagagcccgactactccaaccagttcgatgcggcatgtgccgagttgttgtgcaagttcaaggagggcgggaagcagctgaaccaccgggtgcagaaacgaatggccaccaatgtgcgacgcttttccttccgtcgatcgtgtgccatccttttgtttctttttctgcttgtgtgcaagtttccgcacacaaacagtagagaaataacaattgaatatggcatgtgttggatcgaacggaatacggagacacgaaccgggatgtgcccttcgacaccaacaccgacgaccagcgacagcacaacaccgacgaccagcgacagcacaaccacaaccaccacaatgaccaccactccgccaacaaccacccaaaaaaaacaacctgacgatggaaaaaagccaaaaaagtcggatttttggaccgtgaacaagatcatttccatcggtgttccgctctgcatcctcgttctgcttgctctttcggcgccttg

SEQ ID NO: 46737 - DNA, 155 bp, Heterodera glycines; identical to SEQ ID NO: 43381
  Genomic contig location: Contig_ID=SeqID_43381; Location=1..155; Strand=+
  SCN-specific regions: Sequence locations=1-74,102-155
  Gene Ontology: Mol. function=succinate dehydrogenase (ubiquinone) activity; Cellular component=mitochondrial inner membrane; Biological process=electron transport

SEQ ID NO: 46738 - DNA, 1239 bp, Heterodera glycines
  Genomic contig location: Contig_ID=SeqID_9348; Location=1999..3237; Strand=-
  SCN-specific regions: Sequence locations=1-942,968-1021,1044-1239
  Gene Ontology: Mol. function=phospholipase C activity; Cellular component=mitochondrion; Biological process=protein-nucleus import
cttttgctgcgcggcgggaaaggacgcgcggtgattttgccgttgggtcgccttggacggttccattgcgcacctttttggcgcaaaatttggcgaagtagtactcttctggccagaggtgagatgataaatgggccattagccaaaagaaatctcaagcaacgcgaaagcattcgcagatattccattcggagtacgagcccaaacggaagattttcccacgagagacggccacaagcgaagagttggtttccttctggcgcgacaatgccattccgttggttggccaaatgacccgtgccaattcggccacgcggtaccaccgccgcccattggtaaaagcaccaaaaaatcatttgctgtcccaattggacattcgcaggtggccgtttattacaacgtcgacttctccttggcctacagagatgggacgcaattttggcagaagaaagtgttggccattgccaaaaaggtgaccgccaaatgccatttgtggccaaacaaatactcaccgacgaatttcagtacagcaaacaaaattatcattttgcggtggccgatgaggaggagttttcaactgaattaaatgcggttggcctcggcaccagtggacttgaacaaaatgtcattgtttttggggtggacggcaaaaagtatccgatggacccggaaaaatacgacgagaatttggaggagaatttggccaatttcctagaggacattggcaaaggtgaacagcagatgaacaagcgaaaagcactgcgtccgtttaggcaaggtgaagccatttgtcaagtcgcagcccgtgccaaaaggcgacaaaaagggggcgccggtgcgaattttggtggcggaaaatttcgcaaaaattgtgaacgacgaggccaacgatgcgctggtcgaattttacgccccgtggtcggttcagcaatcgaaaaacattttaaataggcaaaaaactttaaaaggtgcggtcactgcaaagcatttgagccaaagtacaaacaattcgcgaccaaacactccaaagaggagccgaatttaatcgtggccaaattcgatgcgagcgaaaatgacgtgcccgagggatatgccgtcgaaggatttccaacgatttattttgtgccttccgggaaaaaggacaagccgataaagtacggcggaaacagagacttggaggatctggccaagttcgtgaagaagcatgcggtggcgagtttcaagaagcaagaaaatagg

SEQ ID NO: 46739 - DNA, 2470 bp, Heterodera glycines
  Genomic contig location: Contig_ID=SeqID_1267; Location=363..2832; Strand=+
  SCN-specific regions: Sequence locations=1-291,313-405,427-978,1009 -1010,1036-1103,1126-1216,1238-1331,1356-1357,1379-1489,1511 -1954,1977-2027,2049-2066,2104-2139,2279-2307,2329-2434,2456-2470
  Gene Ontology: Cellular component=nucleolus; Biological process =ribosome biogenesis
atgccaccagatattactccgccgccaactttggaggacaatttggacgacaaatttcagatgaagtgcttggaaaacaaattgagaattatctgtgtttaattttcaggcttgaagacaggacaaaagtcagtggtggtgaaacaagcgaagatgaaattgctgacttttctggcaatgaaatatcttcccgctcctccgaggatccaatgttttggacagcggacgacgaatgcaacttttttaagacattgagtgcattaaaagaacgcgacccaaaaatttacgagcaaaatgcgaacttttttgatgaggaaaatcagaatacaaaaacttacaggtttaagactccggtaaattatttatgccttttgtttcagcgatgcattccaagacattgaggcaaaaaaggggcggaaaacccaacaaaaaatgactcttcgggattacgaacggaaattggtggttgaacgcggcggagagtttagcgaaagtgacgaagaaatgaacatgccaggtccgtcctcttcgccctcgtattttgaccagcaacagcagcttaagaaagcgtaagtcgactttaagaatagtttattcttttccattcatttaatcgtaaaatttagtttcaaaagtgcactcgccgactctgatgacagcggaacggaagaattgctaaggaaacgcgagaaaagtgaacaggaaaaagtgagattgttccaacccaatttacggtgtcatttcgatttttaggtaaaagagcgggaagacttttacgaatggctcaggaacgaaggggcggaggaaagcggggcgatcatcgacaaggatttggtcagttctcactcatttttttgttgttgttaaagtttcctttttaggtcaaattgaaaaaacgatggtccgccagcggaggaaatcaattggacgaagaagaaaagtttttgagggattatctgttgaaccgaaattatgaaaacgatgaggaggaggaagaagaagagggcatcggaggggaaaggtaagggaaaaagccgaattctgttcaatatcaatctgcgaatttctcaacctgacagagtgcccacctatgaacaaatcattcaggaggaggaggacgaagaaatggccgaccaattcgaacgcaaatacaatttccgttttgaggacccggaccaggaatttgtaagtcttataccatatgcctaatgaccgtatgttaattttatgattttgtttagcttaaacaatacccgcgaactgtgcgcgaatcattgcgaacgaacgaatcgaaacggaaacggcggagagaacggcagaaagaacagcgcaaagaggaagaacagcagcagcggggggtgaaggtggaggaggtggacattccattccgatatcgcactgtgctcccaaattcatttgggctgtcaacggaagaggtcagttagaccaaatccaaagccacgaaatcaatttaaaaaaggatggataatggcacctttataaactaaaagtcgtgccagtgcatacttaaacaaggggtgcgccagggcgaggcccatacgacggacgattggcgcaggggcgtgtgccaggaccaatttgtcgtacgaaggcccccaattttctccggcggcgacattttttttcctttttttgctattcaaatcatttttttgcgaccatttttttttgctattcaaaccaccttttttgaggcgcgctttttaaaaaaattatggggaaccggaaccgtggcgccgctgggaaaatttattgattttggaaatttaaatactggcccggttttttgacgactccaacccctccccctccatccgtctctcgtttatccttggcatggatctatggcattaaattttcccatctctcagattatgaacaccgatgacagaaggctgaatgcttgggctccaattaaaaagctgaatcaataccaatcagaggaggaggaacacaagcaattgatgttcttccaacgaaagtcgcaacacattgaaaaaaagcggaaacttttggaagaaattgatttcgcattgtaagataagataaatagaaatatttacaaaataattaaattaaattgcttaaaatttgcaggccgaaaaaggcgcaaaagtcaaaagcaaaaacagaggaacaaaaagaagacaatgcaaagagagaagaagcaactgaatcaaaagatgaagaagaaaaagcatcaaaaagaaaaattaaacagaaaaagacaaaagttgaaaagaagacgaagaaaaggggccgagtggaggaggacggaacggttgacatcgccgagttgggcatggataggctgagggcgtacggagtgagcacgaagaagttgaaaagagctcacttcagcaagaaaaaggcagcagcagcggagagaaatcaaggggaaaagcagcagaagaaatcagaaagaacttaccaaaatgggacggattga

SEQ ID NO: 46740 - DNA, 766 bp, Heterodera glycines
  Genomic contig location: Contig_ID=SeqID_1268; Location=981..1746; Strand=+
  SCN-specific regions: Sequence locations=1-686,708-766
  Gene Ontology: Mol. function=protein binding
atgcctttcggatgcattcgaaatgtgaagttggaacagcccatctttggcgccaattatttggctggcgaattggtcgcacagccggacggaaattgggaaggagaagtgaattggaaattgacgttcaatcggggcggatgcatcgaattcggccaagctttgctgaaaaccagcgaaatgggtcggttcaatactttaaagcttttccgtaacgtttgataattggcactcattaagccaataacttttgtcctcggcccgcaaatgcgccgccgccgtacgctccgccgcctggcgcttattactcaccaccacccgcttattattggagcggaggccaattcaacggataccaggcgccggtccacgcgtttccagaccaaccgccgcgtaaatccatctattttgagttatgataaatgtccccttttcaagcggaaagtgtgttcatgtacgagcaaccacctccatatgcggggattgggccaattcgtggtcaaaatccggttccatacccgtcgaatacgcccatgtatccgccacaacagcaagttcagagcgaagttggtagttttttttctaatggatttttttccttatttcattagcctctaccaaccaacactccttccgctccaccagcgttttatccgtcttccagtggcaatggcatcgccaattttgctccctacccggctgctccattgccgtcgtacaaccaggcaaccgaattgccacagaaaccaaaggtcgagtgaaatga

SEQ ID NO: 46741 - DNA, 1321 bp, Heterodera glycines
  Genomic contig location: Contig_ID=SeqID_9358; Location=8..1328; Strand=+
  SCN-specific regions: Sequence locations=1-352,374-581,610-1009,1034 -1044,1067-1321
  Gene Ontology: Mol. function=hydrogen-transporting ATPase activity, rotational mechanism; Cellular component=plasma membrane; Biological process=proton transport
atgggacaagtactcgaagtaacgaaggacaaagctgtcgttcaggtaaatgcgaatttaacaaattattattccattggtgaaagttaaggtgtttgaaggtacgtcaggtatcgatgcaaaaaacacaatttgcgagttcactggcgatattatgagaacacccgtttccgaggatatgcttggaagaatattcaatggatccggcacacccatcgacaaagggcccaatgttttggcggaggattacttggacatcgatggacaggttttaaaggcgtaattaatttgcaaattgatatgacctttaatgttttagcctatcaacccatggtccagaatttatcccgaagaaatgattcagaccggcatttccgcaattgatgttatgaatagtatcgccaggggacagaaaatcccaattttttctgctgcaggtcttccgcataatgaggtgactaaatggtgtcgacctgtgcaattctttccccattgtcagatcgctgctcaaattgtacgccaagggggcctcgtcaaacagccgaacagaaagaaggaaaatgaggtggagggtgacgacgactttgccattgtgtttgctgcaatgggtgtcaacatggagacagcgcgctttttcaaacaagactttgaagaaaacggttccatggaaaatgtgtgccttttccttaacttggctaatgacccaacgtaatttaatgtatggtaattcacgcatacataaaaaaattatagcatcgaacggatcatcacaccacgactcgcgctgacttgtgcagaatttctggcttaccaatgccaaaaacacgtcttggtaaggaggaaattacctttaaagaatagctttgtaaacacaatctcggataagaattatttagtgtttcgattgttttttaatgcttttgtattcgttaaggttgtgctcactgacatgtcttattacgctgaagcacttcgcgaagtgtccgccgcccgagaggaagtgcccggtcgtcgtggttttcccggttacatggtaatctccactagtacattttcatgtattttaactttgtcttgttgttagtacactgacttggccagaatatacgaacgtgccgggcgtgttgaaggccgaaaggggtcaatcacacaaattccaattttgtctatgcctaatgacggtaaaagaataattggtggtaggaattttttatttgaccttttagacatcacccacccaattcccgatttgaccggttacataacggaaggccaaatttatgtggatcgccaacttcacaatcgtcagatttaccctcca

SEQ ID NO: 46742 - DNA, 781 bp, Heterodera glycines
  Genomic contig location: Contig_ID=SeqID_43460; Location=288..1068; Strand=+
  SCN-specific regions: Sequence locations=1-781
  Gene Ontology: Mol. function=mRNA binding; Cellular component =ribonucleoprotein complex; Biological process=histone mRNA metabolism
atgctaaaattcaaccgactggcggcattaagcactgatttggaccagatcacctcagccctgaaagattcacatctcatcgacgtgtcggacgataacgtaaaaatccgtcgaaaccccgaagaaccgctacccgaaaacactttggaatattggcaggagattaagcgtcgtaccgtttacttggtaagttaattttatttcaatcacaaaagttataccaaaacattgtaccgctttagaaaggattcccgcaagagagcactttggacgaaattgctaaatttgtaggaaagttcggcgaagtgaaaaacattctgatgcgaaagaccagagggagcaaagaaacgcccaaagtgttcaagggatcagtcttcgccacttttgtggaccaggaacaggcgaaaaaattggcgtcggttaaggacctcaagttcaaggtggttgagctaaaaatcaaatgaaacaaaaagagaaaacgggcatttattgttttaaggacgaatacgcaatggtcaacaaaatgcaggaggattattgggcggaaaaaaacaatgaacgacgacaacagcgggaactgaagaagcaaatgcgaaaggagaccatcgataagcaaaatcagtcgcattttgtcaagggattggtgctgaaacttagcggtctgccaatgcaaagcggggagacgaagaaggaagtgagcgtgcacaaactcaaagagttctttgaaccgtatggccaaccggcgtatgcagtgatcgaaggctcggaggtgactgactga

SEQ ID NO: 46743 - DNA, 3056 bp, Heterodera glycines
  Genomic contig location: Contig_ID=SeqID_9371; Location=1875..4930; Strand=+
  SCN-specific regions: Sequence locations=1-2173,2224-2268,2291 -2837,2859-2956,2978-3018,3041-3056
  Gene Ontology: Cellular component=cell; Biological process=asymmetric protein localization involved in cell fate commitment
atggaagattctcttcttgatgctgagacatttttgtacaaatgttctcatcataatgttgcagcagattctattgaatttcatggcgtaaaaacaacacgaactgatgcattgaagaaggaagtggccgaattatttcgtgcaaataatctgtatgggtttttttctcaattaaattaaattcttccctttttagccaccaactgatacaaaattctggcaaagctgcaattcatatgatggtgggtcatccatccccagatattcgtgtgtaattttacttttgtatggcctcgcaggagatgggtcttttcgaggaatgtcaagcaatgattgacattgcgcctgggattgacaacggagagcagaaatacgtcggtcagttaaattctcaatttttggatgcatcaggccaattcagttaagttcttcgccaaagagctaaagaacgcgttcaaaatgaacataaaaatggaaatgcaaacgtcgggcgaaacggacgctggtctaattgcgaagaaagcagtaaattcaacacgaaatgaccacccaaacgtggtttttttttaacgtcagaacatctttggtcggggcgagacggcggaattgactttttcgaagggattacgaaaggacgggggctacagctttggattttcgggtttggtctggacagaattttgaattgctttggctttctttccgtccatttagcactgaagccactcctcggctggcagcgatatgagaatattggcgcccaaattaacaaacgatcagactttctgaaatggaacaaagctgacacacacgaaagtgctgcttctttcacgtttaacaagtactttccggagtatgcacttatgtcttcattcggcttcaactcggtaaagcgctgaggtcgaatggcgcggggttaattcatcagtttaattttcgtaaaattttctttcagaattggcgctcttttttggctcgcagtgacacgcctttcccaattcgagaacactccggacacacaaccaaattctcgtttgattacactcttttgtcggatggacgagaccggcccattttgccaacgaaagggtcgttgttcaaactgcgggcggagtacgcgccgggagcagtcggcgattcggcatttttgaagggcattttcgattttcaggtgcagtaagtaacccacttctcctgatttccccttactttcgttcctttttcagactgccgcccccctccccggtggccttttctgcggcgcgtcgtttcgcctcggcgttgtccatccggtggccaaccgcggcattcatttgctcgaccgcctttacctcggaggaccgtttgatgtgcgtgggtacgaactgaattcaatcggagcgacaaaggaaagtggcgcacttggagggtcgacactgctcgtaagtgaaagacgaaatgcaatttcaatgtgggttaagcattatttgttttgggattttgattgcgttttagcaaatattttgcattttaagagcaccgctgttcatctttatgctccgctgattcccaaggatatggtaggtgaagtttctttttcttaattcattcttcataaaaaagggggaggagggtcgccggcgaaggggaaaagagaagaattttcaatttttgacacagaagagtttcaggtttcatttaaaattcgcggcgcatatgttgtcgattaattttggctctattgaagtttacacaaccataaaataatttgacagtttaatgcaccattttttctaaaaacacccaattaacatttttgatattatttgatagcccaagtcctctatttcagttttttgctcatttcttcgtcaccgctggctctctgtcgccaatgcgctccaaacaccgactttatgacctttgggagttgcagcgcgtttccgccggccttgggctggctgtgaatctcatgaacatggtcaggctggagttgaactacacttttccgctccgaaaactccctggcgatgtttgctttcccggcattcaaatcggtgccggactgaatttcatgtaaccagaaaactgcaagagatttgttttaggctcaaaaaacaaaaaactgaatttttttacaaaattgcaaatgttttgttcacttttctttttgtttcatttgcatttggttttgtttttattgataaacaatttataattcaaaaaaataaaaagtttaaaataggtaattcttaaatttactttaaaaatcccttttcacttttacatcgttttattttgtttggattttacgatggctgccattcgaaaaacactaaattttgtgagtggaaataaacagaagttgcttgagcttcgtcttctgctcggagacgaatttgaggttggatggcaatggatagtaatcatttgctttctaatcacaaatccatggcatagattgctccgttggacattgaccttcccgaactgcaaggtgaccctgcggacataaccaaggcaaagtgtgccaaagcggtggacgccaccggtggcactttgaaagtaatcgttgaggacacggcactctgtttcaacgcattggacggactgccgggcccatacgtaaggaaagtgggctcaaatgtttatcagcgacgactttaggtcaaatggtttctcgcgaagttaaagccggagggattgcatcggttgttgggtgagcggaattgaaaatcaaattttaattgttttttttgtaatttagctggctacaacgacaagtcagcttattctctgtgcactgtggcctattcagagggaaaagacaagcccatccatctttttactgggacaacaaatggacaaattgttgagccgcgagggtcgcgcgagttcggatgggacccatgcttccaagtgaattaatgcttattcaaattaatggtttttatattcatcctttagcccgatggatttcaaaaaacatttgcagaaatgaccaaggaagaaaagaatcaaatatcgcacagagcgatcgcattagggaaattgagagaatttttgcaaaatgagaa

SEQ ID NO: 46744 - DNA, 323 bp, Heterodera glycines
  Genomic contig location: Contig_ID=SeqID_43597; Location=456..778; Strand=+
  SCN-specific regions: Sequence locations=1-44,66-173,195-323
  Gene Ontology: Mol. function=structural constituent of ribosome; Cellular component=cytosolic large ribosomal subunit (sensu Eukarya)
atgccaccaaagtttgacccaactgagatcaagatcggtatcctgatttggcttttttaacatttaacatgaaaatttagtttacctgcgttgtgtcggtggtgaaattggtgcaacttctgcgcttgcacccaaagttgggcccctcggattggtctgtgcattatttgaaattgtttaaaacccaatatttagtcgcccaaaaaaatcggcgaagacattgcaaaagccacccaggattggaaaggactgaaggtgacgtgcaagctgacgattcaggttcgaagaccatgccaattcaattttaactaagttaccgacgt

SEQ ID NO: 46745 - DNA, 818 bp, Heterodera glycines
  Genomic contig location: Contig_ID=SeqID_43600; Location=125..942; Strand=+
  SCN-specific regions: Sequence locations=1-325,347-360,383-772,813-818
  Gene Ontology: Mol. function=glutathione synthase activity; Cellular component=intracellular; Biological process=neurogenesis
catgctatcgccaatcccagtctttatgtgctgaaaccgcaaaatgaaggcggaggacacaattattttgatgatgaactcaaacaaaagctgctacaattcacgcgcgaagagcgagcagcacacacactgatgcaacgaatttggccggtgacagcgaaggtaataaaatggggaaacccagcagtaatcaattaatgaacaaattcgatgcttgaacgtttactcaaaacccataaaaagggctaaaccattttggaaacttaacgaaatttgttgaaattgtgtaggatggtaaataacattaaggacaacctgagaatttcttgaattaaaaattttgttgctttttagcaaagcaataaacaaaaagttttaatagttttttgcctaacatcatagcatcaatatttctatcaattattttgggacttacaaattaggattcaaactattgaaaatctgcgcaatttcattaaaatgtgcgcacattttgcagaatttcatggtccgtcccatggaggaggccgtgttggatgacacaatcgtcgagttgggtatgttcggctacctgctgggtgacaaacgtgacagaagcattgtgcgcaacaaacagcgcggctacctcgtccgcactaaaccggcgtcgtcagcggagggcggaattagcgccggaggcgtttacgactcgctgaatttgttctgagggagagtaaccaaactaatcattattttggatacctacagtattatatgatatgatgcgatatatgtttgtcattatgtctcttggtaaatatggtttataataccaacaa

SEQ ID NO: 46746 - DNA, 1608 bp, Heterodera glycines; identical to SEQ ID NO: 43627
  misc_feature (40)..(40): n is a, c, g, or t
  misc_feature (91)..(91): n is a, c, g, or t
  misc_feature (1434)..(1435): n is a, c, g, or t
  Genomic contig location: Contig_ID=SeqID_43627; Location=1..1608; Strand=+
  SCN-specific regions: Sequence locations=1-340,362-495,518-756,784 -1537,1560-1608
  Gene Ontology: Mol. function=helicase activity; Cellular component =nucleus; Biological process=chromatin modeling

SEQ ID NO: 46747 - DNA, 384 bp, Heterodera glycines
  Genomic contig location: Contig_ID=SeqID_43628; Location=72..455; Strand=-
  SCN-specific regions: Sequence locations=1-85,162-208,337-384
  Gene Ontology: Mol. function=transmembrane receptor activity; Cellular component=cytoplasm; Biological process=Rho protein signal transduction
atgacacgttttgcattattattggcttgtgcattagacaagcttggccacagaacgctgaagaagggccaagcgctttcggcgtccgcagccgcaaccgcagccaccgccgccgccaccaccgcacccaccgccacaaccaccgccgccgccaccaccgctggggcctccgcaactgacaccaagcgtgatgcttccgcctccacttccaccaccgcaaccgcctccgccaccaccgcatcctccaccgcctccgcagccgccgccacatcctccaccgcatccgcccccgcaaccgcctcctccaccgccacatcccccgccgcaacctccgccagaacctcctccgcctccacatcctccaccactgggagctgcgcttga

SEQ ID NO: 46748 - DNA, 1645 bp, Heterodera glycines
  Genomic contig location: Contig_ID=SeqID_9402; Location=322..1966; Strand=+
  SCN-specific regions: Sequence locations=1-50,72-122,145-616,638 -974,1000-1645
atgtttgacagagcgaatgcttttgttatttatcatacagtttcaactgctttggaaagggaagtggaaaagaaacgtcgaaatgaggcactttctgaggcctgcaaagacgaggagattgttttgctggagggcagcacttctaaagaagagaaagctgaggcgtcaaagtctcctaacaacacagaattgcgctcaaattttaaagcattggtccacaattttgaggtaagtaatattccctgaattcgtcccatattattgcattctctatgatttagcctttcattgcgtttgcccactttgatataaacatttgcgggtttgtaaattatacacaaaataacatttatgggtttgtagattatacaccttatatgctgtttttttaagatatattattgacaaagacttggaggacataattttctcaattgggcttgatgtttcaagatgggatgtgcaacgcctggtaaaaaagttactgtccaaggaacgcatcaattatcgtgacctcaccgacaaatgggtggacaaggaggtttttggtagcaaaatggcaaattaaaatcattcattcttacagggaaaagtgcgatatgttccacttccttcgtatgaaaatattttccaaagtttttccgaacacgcaaaaggtgggattaagaaatcgcacttaaaaattttattaattgtcaggtcacaaaacatctggcgatctttttaacagttcttcgcagaatattaatgaaatgtccgatccaaaactcattagcgaatcggaatttgcttatttcgaaggtgtttttggagtttgtatttgttacgaaaaacattttaggctcgttgattaacattaaacagagtattgagcgacaatacgcactggaaaaagagcgacaagaaacagtggaccaaaacgagaagctgaccctccaacttagtgagtttctaagcagatggtcaaaatgttcagaaaatttattttttgaacttttctgggcataacttttttgatacacaatgaatttctgaaattttgcaagctaataaaggacatttgggttatcgaatagaaaaagatatagcgcattaaagttgtcaaattattttatggtcatgttaactgtaatagagtccaaataatttgtttgttaaacgggtacttatcttattttttttagacaacattaatgagcagcgagaacatctggaaaagaaaaagcgacgactcgaagatgacgttgatcgttacaaaaagaaattatacgacagtgaaaagctgctgaaggttcgataaatcttagtcgcccattcctagaaaaaaactcgaggggggggagtcttaagagcgcatgccaagtcgggaatacaattcatgtaattttaatttaagaaggagcaggaggacaattcgtccatgaagacttctttattggattgtaagcgctacggggagagaatggtcgccgttgttgagaaagtattgcccccgccatcgaaaaaggaagaaaaagaaaagtcgtcgggatcggacaaaaatggaacgagcggaaaagaaaaggacaacgaagttgcgaatttgaataccgaagacggtgtggagaagggagacgaacaacaacaaaaggtggcattggcatag

SEQ ID NO: 46749 - DNA, 1513 bp, Heterodera glycines
  Genomic contig location: Contig_ID=SeqID_9403; Location=2371..3883; Strand=+
  SCN-specific regions: Sequence locations=1-244,266-335,357-534,573 -801,823-1105,1127-1513
gcggctgcttgtggcactgaacatgttcttctgttgaccgatgacggccgtcttttcagttgggggattaaccgatttggacagtgcggaaacggcacggaagagccgatccatgcgccaattgtatgcctcttggaaaaagaccgaatttgaaaattgccaggaaataattggcaaatggggccgcattgtcagcatttgcgcgggtcattaccattcgggatttatctctgaaaaggacgagatttacctttggggctggggactgtacggacagctcggaaatggcagaaccgccaatctgaaacgacccgcgaagagtcgtccattcagtgctttgaattgtgtcaagaagctttggtacaaaaaacatttccattgcttcaatgtgccattctcccccccccccccctctcagtctcggctattcccactctttggcactcctcgccgatgggcgtgtctttggctgcggtgcgttctctcatggccaactcggcatcgaccctcacaatttggaagggtgcccaacgaaggccttggcccccgtccaattgccatttccaatgccaatttctctgatcgcttcaagtagtatctttactaaccatgactgatgaggacttgttttagaatatttccatggtattgctttgggcgtggaccatttgaggagaaaagtgctgtttgagtggggcgactccccccaatctttgaaaatgaacgcatttctgcaaaagcgtctcaaattgaaacagaaaagtaaacatttgtttaaaaaagtgccgaacaaaaataaatttagaagcaaaagacaaaaatttgaaaatggatggacaagaaaatccgccgacggcggagagaaaaggcgaagcgaaagtggcgaccattgcgatagacgaattggaacgagtccatttcaacattcggacagtttgcgaatggaatggcgcggcagtgaaggcgcttagtgccgggtaaaaaacaaaggcccggggtattctccgattggccattgcttcagattcaaccactccgctctgctgacttcggatggccaactgttcacttggggaaagtccttggaaatgcaattgggccatcagaacagaaaggaaaagggcacaccgaccaaagtcgatgtgcccgaaactgttcggtggtccgaagtcgtttgtggttggtccgcatggacttccccccccccaaaaaaaaggcccttttcagcccgcaatttcaccactgccatttcggtcgaaggcaaagtttttgtttggggtcgaaacgacaaattccaattgggacttgggaaaacaacgaagaaagggacggcatgccaaattcggacgattgcgcttaaatcggacaagggaaatgcgcaacggagcgtggagttgccggtggacaattgcgtcgagagtccgacgatttacacggactgcgggcatttgtggaaagcgaaacgcaacgtgaagggaagtgctgacgagggactgaagacattgatggttta

SEQ ID NO: 46750 - DNA, 438 bp, Heterodera glycines
  Genomic contig location: Contig_ID=SeqID_43673; Location=176..613; Strand=-
  SCN-specific regions: Sequence locations=1-438
atggggcaacatccagaagacatcgcaacaattccagcacgtgagctgcacctcaacgcgccattcaacatccggaccatctacaacttccgcgtacgtttgtcggtttgggaggctttctctgctaattgatcaatcattgtgcaatttcagctgatcaacacgggctcaaagcgcattgggttcgccttcaagacgacgaagccgaagcgcatcttcctgaacccgccgtgcggcaccgtgggcgtcggcgacaccgtgaacgtgatcatcaccgtggcaaccttcgacccgaataacgaggacatcaagaacgaccgcgtgatcgtggaatggtgcaacacgcccggcccgtctgacaccgtgttcaagctggagtggttcggcgaggatggaatggtgcgccgcaagaatctgccggtcatctacaacctgtag

SEQ ID NO: 46751 - DNA, 1144 bp, Heterodera glycines
  Genomic contig location: Contig_ID=SeqID_9407; Location=2091..3234; Strand=-
  SCN-specific regions: Sequence locations=1-50,72-667,689-1144
atgatcagcaatgttgagattgacattgagctcgccctgcagtcggacgattttatgatacatcaggaagccgcaaatagggacaagtacacgcttgaagttgtcgactgcaggctgatagtgaagacggttgatctgatggacggactcagccttgacattgcaaagaagttggacctggagcccgccagatacggcatccggaatacgctgatgaagtcgctgttcattaccggtggacgatacgatttttctgccaatctgttcaccgaggaagtgccacggagggtcatcattgggctggtgcccaaccaaaattacattggacacaatcagaagaaccccttttacttcaaccaccacaacgtaagtgccgctttgacatgtatttctggcagaaaaaatgttcaggtgcgggatattgaactgaccgcctctggcaggacgtacccacagtttccgtacaacttggactacaagaacaacaggtacgcaagggcgtaccatgacacccaggagcaccttggcatggcctgtacaactgagagcaacgggatcagctacagcatgttcaagactgcctactgcctctatgtcttccaaatgaccaatgcgcaggaggactcgccgggctttgagctgatcaaggagggctgtacagcggtgaacattcggttttccgaagcggttccgaacgagggggtcactttaatagcctatgccgaggctgacgggctcattctgattgaccggaacagatcaatcactagtgaccttacagtatgaatggtgagaattattcctccgattttgttcaaatgccctcctccaatgctgcacacgaagggattgtactgtgttttccggatgtgatcgagaagtcgccaatcaacttttttctctgcctcatctacctgtttggtgcagcaggtactgcggctgcgggattttacctgtttttgagggagaggcggattcgtcgcaggaatggacaatcggttcatcgacagagctctctttgagaaccgggcgacgagaaaatattttgttggcacttttccggccgaccgattgccaaagtgcacgaaatttccctgcagtctaattgtcaatttggtgagtgccaaaaaatagattaaataaa

SEQ ID NO: 46752 - DNA, 428 bp, Heterodera glycines
  Genomic contig location: Contig_ID=SeqID_43736; Location=1126..1553; Strand=+
  SCN-specific regions: Sequence locations=1-105,128-185,209-428
aacgaaatgcctttggctgaagatttgttgtatcctgatccgcaaaaggaacgtcaaaagcacaagctcaaaagactcgtgcaacatccaaattctttcgtatgcattattataaataaattaaatactgtcatcccttttttaagtttatggacgtcaaatgccctggttgctataagattactacagtgttcagccatgctcaaactgttgtggtatcgatttattcttgccaaataatttagtgatttaatgagctaagcaaatgaatagtgcacactaagaccggtcataaatgagctgtgttttgtagaaatttgcatacatttctaatttaggtctgtgttggttgcagtacagttttgtgtcagccgaccggcgggaaggcgcgacttgtcgaagggtgttcgttccgaacggaagggcac

SEQ ID NO: 46753 - DNA, 1892 bp, Heterodera glycines
  Genomic contig location: Contig_ID=SeqID_9420; Location=518..2409; Strand=-
  SCN-specific regions: Sequence locations=27-589,639-671,693-1311,1335- 1432,1455-1519,1541-1732,1755-1892
  Gene Ontology: Biological process=embryogenesis and morphogenesis
aaatactacccgccggactttgacccggccaaaattccaaaggccaaacagccacggaaccgtcagttcatccaacgtgtgatgacaccgttcaacatgcggtgcaacacttgcaatgagtacatttacaagggcaagaagttcaacatgcgacgcgagacagccgagggagagaactatttgggcttgaagatcttccgcttctatttcaggtttatttttacaatttttaactgtatttctggcttggagtcattttgtggtcttacaatgaatcacaatcattaaattacagcgtttttcacggattttgtataccaaattttgtacacaaaagttgtttggtcataagacgaatccgtgtgtcgtgttttaaggtgtcagaattggtcctgttttatgcaatttgcaatcttcgagtacatgaaacaacaattaaaatcataaaattacgttccttttgactcatccaactgttttagatgtccgaattgcttagccgaaataactttcaagacggacattgaaaatgtcgactaccaagcggaacatggcgcaacacggctctttgatgcattcaagttctaccaggagcaggaaaggcgggaggaagtgaaggaagaggaggagaaggcggacgcaatgaaaatgttggagaagcggaccaaaatgagcaaaattgaaatggaggcattaggttagggtttttgaattttttaggtttcccagaaaccgttcccagccaccaaaaatgtcaaaggcatcacaaaagtatatgcaattggtttttaaatcgggaattttcatttgatttgtctgaaattccggatccaatgcttaaaagtgacacaattcaaacccggaaactcgagaaaaattgtttagtcacaccttggtattcaattggttattaaaacgggggattgtcatttaattagtctgatattccgagtccaataaaaataacatcggaacccgaatttttctctaaatttaggacacattgaggagttgcaggagtcgaaccgtcgctatgagaagattgacgcaattgcatacatcaacgagacggagcagcaacgggcgatgtcatttgcggaccaaattcgtgtgcaggaggaggaggacgagcgtgaagtggaacgactggttgggcgggcaaacggtggtaaaattgagcgccgattaaacgatgacgaggcggtggagcaggaaaaggcggagaattgtccaactacatcgtcaagaaaaaataggcaggcggcgattttaagcggaattattttgaagaaaaaaaagtgattcgtccggatttttttttaatttttttatttgatgcataaattgatcattttttcctacaatcgtttttcatccattgtttttacagtctgatgctgtgtcattaatattttgcatatttgatttatgtttttattttcaaactgtttttgcagccatttgcgaatttattcaaaataagggaaaatggtcgaagccgccgaacaatcgcaacaacagcccatccgtcgccgtgccggaccgaagtcggcacgtcgcctttatgtgaaggcggtgtttaccgggtacaaacgcggacaccgttctcagcacgagaacacgtccctgctgaagcttgacggggtcaatgacaaggtttctgtttgcattaatttggaattgctatgcttgtagttttagtagtagtgagtgaaagttatttcattttgtgttttattttatttatttattttggtccctgaatacaaatgttaattttcatgttggaccgaaatccgcgaaagattagccccctttcttgactattttctgttcacgcatttattccaaatttttcggcgcttcaattagatagttgtaagtgcaataaa

SEQ ID NO: 46754 - DNA, 3774 bp, Heterodera glycines
  Genomic contig location: Contig_ID=SeqID_113; Location=1487..5260; Strand=-
  SCN-specific regions: Sequence locations=1-418,440-1316,1339 -1668,1690-1757,1783-1791,1815-2184,2208-2212,2234-2353,2375 -2859,2882-3337,3360-3774
atgccacccatttcatcaaattccttttatgttgttgtcccttccaacactaacgttgatggaaatcgaaccaactccttccgtgtgcgtctgccgcgaaaattacaatttaatgcggaatgggatgtggggctagcaaccatcatatatccccactcatggccatccttgggcaccactgaggaacaattcatagaactggaatggcaaactgaaaatattgttcgcattccggtcccttcttccaacattatacgcccttatgagttgagcaaaagtttgtacagtctcctggatattagcagtgagcatctgtcaaaccaggttcacgacgctcagcaaagctataaagaagcgatgaacgcagcacgtaaactggcacagaaagaatatgtaaaaatgaaaagtgacgataaaaagaggagaccgaagagaaaaataattgaccagaatgaagctcttccactcttgtccgcacttctgattgctattgacactattgacgatgctcttattagtaatgaggacggtactataaaccctgaaatggttgccggtgctttgcttgatcgcgagaagcgagcagcaaccagcaatgtgcctttgcgagaagagagtgatagcgaagaagaatatcaaagaaaattggataacttttttttgaaaatgagagattcagatgatcttctacttttccaaaacctaattgccaaacatttggaggtggagctgaacaaactgagcaaagatgagcagtcgcttaacaaatctattaaggaccttggaatggaagcatggatacaggcttacaagaaagtgagtagtgtagtgcaattcatttttgatgtccgtcataatcgttttactttggcaatcaacacaaaattcattaaacgggttaaactttcagaacaattagcatatatccttggttttgcgccccaaactcagttcaaaaaagataaaaatccagcaaaattcatgccggatatgagtgggggagtgtccacacttcatgtctacatacccgatttgattgagccaatgatgattggaaatgtcatcgcccccatactgcgcattacaataatccgtggtaaccccgatgaggtgattgaggaacaattttactcagttcaatatcatcgtgttttgctcaaagaagtttcagaaattttcgtagaaataagaacgtcaagcggagcactaatgccatttcaatacggaacgtgtacattaacactacactttcgaaagtcttcatatttttgaaaaatcctggtaaaaaaaacaataatgaacagtattgatctgaataaaattctgtcaagaaatccggtcacaaaatatgcatatctcggttgttttccggctgataaaatagttttcaatccaagtgtgggtttgttcccccgctgttttgttgccaacattgatcccagtgatttaattgggtcacactgggtagcattctattgtgaatcggtcggaactgtagactattatgattccagtggtgtttggcccccgagcagcgaacatattagaacttttctgtcaaaattctcatctattcgctatagccgtgccccattacaatcaccttacgctcgctcttgtggtaaacatgccatatttttcctacaccatagatgccttcactactcatttgaagaaatcttgcaatatttagttcaatcaaaacaaccccctgacacaattgtcaacacatttacccgagagagaatttttttagaatataaataaactaaaaaacaaagaatttagttactgcaatatttagaataataatgataatgcatattgattttgaccctttaaaggttgaatggtcatcctttccacttaacaattccgcgtcatcactagaattgtcgtcggctcttaatcaatggggaggaggagtaggaagttataatatttttcgtggccaaccataccaacgtgggaatggaattggagcggtgttccgcagtctaatgcgttatttggttccaattgggagggaaattggttcaacaattggtcgtcaaggactagagtcgggcaatcgtgttttatcaaatgttttagagggcaaggacctcaaagaatcattgataagtgagggaaaggttggattgaaaaatttattggaaaaggcggccactaatattaacacccaaaagggaaagggttttgattttaaacgttacaaaacgaaggaagcagaccaaaactctaacagcaataaatttggtgcgataaaattaggtggggaaacgcccaaaaaaggtataaataaactaaaatcaaacattggacctccacaatttctccccaccacacttggtggaaaacaaaagaacaaatcgagcaaaaaaaagaaacgaacgcaaaaagacatttttggtacttattaaccaccattataacattatcgcataaatgagttgctcgcaaaaaataagtgaacaaagcgcattagcagtcaacagtgctctgaatattttttcgactcctccgacaaacgtgtcggttgttcgttcatttttccgtgaagttcttccactcgttaccattacccaagaatcaccatatttgttcaggctatacagcgataacttgtggtgtgacctctgccgtatttaccttcaccttgagctgtcgattgaaaaaaataaagatgacaattgggtagatattagcaatgctgatgaagagaatgtgggtgtaatacagggcgttggtcaaacctttattcaacagcttaaagtttcagtaggtaatacagaaatatatgacagcggtaacttgtatccctacaggacatatctaacaaatgcgttgtctttttcgaaaaatgtgaaaaatagttttttaacctccaccggcttttaccatagcgagaaacatgatagtgataaggacaaaggtttcaaagagcgttgtaaacagtttgagggtgggaaaaaggctcaatttctctcgcgtttggattttgatcttggaaatcaggaattgtatctgctcaacaatcttgacctattgttttcaatttataaggcaaaagataattttctcattcaaacgcttaaagcaaatgacactcaagaatacagactgcgtgttcacgatgttaagatttatgccaaaatggtggaagttcaaccatcgttgaacctaaacatttacaagatgcttgaaaaacaaccagcaacctatgctgtgcgtaaaacggaagtaaaatccacttttattagtgccgggcggtatgaggtagaatacaacgcgttcagtgcaacaattcctcgacgattaacaattggaatggtggagaatggggcatttaacggaaactcaaaattggaccctttcaatttcaaacattttgatataagagatattgcggtgcacgcgggcggtttcatatacccaatggtaccgtataagttggctttcaaaaaagatgcatttgtcagagcgtatgttgacttctacgaggcgctaggcatggctaactctgatcgctcatgtgacatcacccgacaacaattcaaaaatggctggacattgtttgtcattccacttacatcaactctggatgacagcgttgggtatgaattgcttagaagtggaacaacaacaatccgtgcaaccttcaactctgcaattccggccggaggggttgaaatgatagtgcttggcgagtttgatcaaatgataatgattgactacaacaggcatatagtttcggactcaaaacttggttga

SEQ ID NO: 46755 - DNA, 1858 bp, Heterodera glycines
  Genomic contig location: Contig_ID=SeqID_1279; Location=6292..8149; Strand=-
  SCN-specific regions: Sequence locations=1-135,157-706,728-1665,1713 -1858
  Gene Ontology: Mol. function=sodium-dependent phosphate transporter activity; Cellular component=integral to membrane; Biological process=phosphate transport
atggcagcgcaaaatgatcattctaatgccatctttggaaatgcttcgttttctttcccttcgccggtgcatttggccgaatgcgcgcatttgacagaactgacaaacggaacgaaattgggggaccccaaaatcgtgaattttaattatttatttcttcgagtggataaatattttttagtttgaaggcggtgacttgattatcagcaaaaagatgcagtcgctgatattcacttccttttaccttggcggtttgctgatcattttgcccggcagttttttgtgcgattggttgggccccgctcatttggtcttttacggtgcattactcaacgtttttggtccgtttttacattattcgagctatgaattcatgtctaaaggatacttttcatgcgtcatttctgtccgattaaggcacttttttcacccctttcgttgttcgacatttgggctccgtcgctttgatcgtcgtccgttttctgatgggttgtggccaagtaaataaatcatcggcattatttctcttttgtatcactttctttgtttttgggcattttggtgccgtgtgtcaatgtgctcattgcccattggttccctttgtccgaaaaaagcacgggtaacttaacttatcaagggttttcttgtaactttttttcagcaattgcaatttcgacgaccggcaatcaaatttccgttgtgctcgcaatgtttgtaactgctgaactttgtgtcgtccgatggatcggcggatggacggcttctttttacatttatggtactgccttttaactgccgtatttcttcgattcaacccctaaggggttatttctgaccaacatttcctattttacttacgctttccaagacgtcccttaaacaaatttctaaacaaatcgatattttttccaaaaatacataaaaccgcaacaaaaaaaaaaggtacaaaagcagaaaaaaggtcgtcgcttagggcggtggtacctcctctaaagcaagttcctgggaccgttcctggtctaatcatttcattttaagggctaattggcgtcgctttttgtgctgtttggatgcttttggttcgtgattatccctcccagtccaaatacattcggtccgacgaacttcgactcatcgaattgaatggaggacatgctaacgtttcccaaaaagtccgactgtttgtggacttcatttacttttttaattttctcttgttcagataagtccaaacgaagtgccatggcgtcgcattctatgttcaatggtcgtttggtccaccgggttcagctcgttcagtgagtttacataatacagttggatgaattaattgtgttttattaataatttgaggccaaaactttatgaatgttggcattgtggtgtatttgccgacgtattatcacaatgtccttggcatggatttgacttcagttggtttttctcattttattcactttaaaacggctgactcacaatcagaatgggctgatgtcggcacttcctttcattgttcaactgttcactaagattttgtttgccgctattgctgattggctaaaggtaacaaatttgtgggaaatccgcatttgtttcatcaaattgaccgttcttcaaggaccgtcgtctgatgtcatccacatcagtcaccaaactgtttaatctcatcgccagcttcggttccggcctttgttttgtgttgttgtcgttgtgtgactgtcggacgccctatttggccatctcattagccgtgtgtgcaattggcatcagttctggctttatccccggatacaacacctccgtggttcgaaaaacaagatggagatggcataatcatgaattaccggcccaagactga

SEQ ID NO: 46756 - DNA, 2725 bp, Heterodera glycines
  Genomic contig location: Contig_ID=SeqID_1280; Location=1206..3930; Strand=-
  SCN-specific regions: Sequence locations=171-211,338-433,455-613,670 -670,748-1039,1077-1077,1099-1126,1148-1292,1318-1769,1798-1957,1981 -2228,2251-2528,2555-2725
  Gene Ontology: Mol. function=oligosaccharyl transferase activity; Cellular component=membrane; Biological process=protein modification
acaattttgccggctgcatccaatgacatttattatcgagatgagatcggcaacatctccacctcaaatgtttatccccgtgccgatcgtgttgaggttgagctccgcccgcgtttcccattgtatggcgggtggcgtacaaattacattttgggttacaacgttccaaggtacgatttttatctggaaagcttaaattttgattatattcagtacgtcctttctccgtcattccggctcgaattttgcgatcaaaatgaaactgatggatcgtctctacgataatgctgttgtggaaaaactgtgtgtcaaaatcatattgcctgaaacgagcaagtacgaaacgagaccagttgtattttcatatttcttggtgaactgaacattgttcatatacacacaagggttgctcacaatcagattgacgaccctacaaatatgaactttattggaaatttttggttttttcttcttaatttataaaggaattgacaatttcccccatttacaacccccccccccttacgacgaattgatgggcttacgacatggggagcgggtgttctgactttccttatgctaatgcttcgtttaacgattaattttcttttaggaacattaagctggtcaccccttactctgtgaagcgtcttcccgacgaggtgcacaaaacgtacttggacacttttggtcgccctgtgattgttcttgaaaaggagaatcttatcaacaaccatatccagcccttcactgtgcgaaatattaacccaaccaatttttatagtcttttaagctttactacgaattcgaccgcttttccatgctgtacgaacctttgcttattgtggtggcatttggcgcattgtttttggctgctgttattcttttccgtcttgactttagcatcgccggcaaggtgggcaaatgagagaaaagaaacaaatgttaaaatacgataatataacctaaatctcaaggacgaaaaggaagccgcaagtggacaccagaaaaaggaatgagcaatttgaactaccttttgttaatttgatataaatattaatttaattatttattttgtttattcttttttgggttttataagtagtgaaataaagattacctattaccaagtttgaatgtggcactggcgaatttacttattacttttgttagtcttatttatgaaggatatgataactctgtttaacttttttattcttcctttttgtagtttttccttttcaggtcaattcgctttcttttcctggatgattcctctttttcccctccggggtcctttctcttcttttccccgcactttccactcaaaatctccgcttcatcagacaaaaacttcgcttttggttggaccggctgttcgccttctgctcggtcattacgacatcaaaacgagcgtgctcagagcatcggggccaaagaaaaacattctcaaaaggtgacttgttttacctaatttgaaccccaattcgcccaaaattgcaatatgtttctattttaatttagcgatgtgctgagtcacataaatgacaaaaaactgtctccgattaaagcattttcggctaagccaccatcaaaaatgtctcttgaaaacgaagtgatctccgcgtcatcacatccgatcattccgctaaaatcatcgggtcggtccgagccgactcatcgccatgtccatgtggacattcaattgtcggaaatgcgtcagaatcaaacaaaacaatttgtgcagtcaagggtacaactttctttgcttattttatttctcatttttaaaattaatgttttcttcagaattcaattccccatgcttatgcgtcggcccaaatttctgccaacaaaatattggaattgctcaataggctttctgaaagggtcgattttaagctgtcgttaaatgattttatcataaaagcgtgctccttgtccctgcgggtattatttgttttgttaaatatttaatttgttaatttcggttttggtctgtccccgagttaaacgtccattggcatggtacttccatccatcgcctttcttccgtggacatttccgttgctttggccaccccaaatggatttgtcactcccgttctgaccaatgttgaccaattgtcgcttcttcaaatttctgctcgacttcgcgaattgacggctcaggcgcgcgatggtcagcttcgcccggaggaatcccaagagggcacatttacgtgagaatatgatgctcaataataataatacatttttaaaaaaagaatttcgagccttgacatattcgattcggtgtccgactttaccgctgtcattaattcgcctcaggcagcaaagtgccattgattacccttttaaattcgaaagtttattttcagcctgacaatcggtgctttaagaaggcactttgaaccagatgaaactacgaaaaagccaaaattggttactaaatttggggccactctttgctacgatgcgcgaacaatcgaaggacaaacggcgcggcgattccttgacagttttaagtataaaaaattatttattaattatatgatgactttttaagaaccgcactgatttctcccgagtctttatttgcggaattggactatttaattgaagacgaagtcgatattagtgaaatggacgatggttcagcgattgaagaaaaaattgacattgggaaagaagacgaggaattggctaaactattgcttagataa

SEQ ID NO: 46757 - DNA, 754 bp, Heterodera glycines
  Genomic contig location: Contig_ID=SeqID_43886; Location=181..934; Strand=+
  SCN-specific regions: Sequence locations=1-372,408-754
  Gene Ontology: Biological process=negative regulation of FGF receptor signaling pathway
atgaacatgaatcaacttttggttggccgttcgctgttcccaaaaatcatccgccctttctcgcacaccaaaccccttgccaagtctgaggctgacccggatgattacggctacttcccggacccaattgaacactcgtggggtttggagaggaaaatgctcatcgctcgtctgaagggtgacgacgtgagcaaatttttgatttttactattttttgtaaattttaactttttagcgctatgagccgaaggtatatttccgcgctgaacataccacccgggactatccgaatttggtgccggtccatttgcaggacaaagtcgtcgggtgcctttgtaagacagatttaaggcgtaacttttttattacgcattattagtatttattttattaaaattataattatggcgaaggagatcaaagaaagaaggaaacgaactggaagtcatcaatgcttaaaaaagagcatgtaaaccatttttagactaaaaagtgaaaatcggaaaatttgagcttcagattttgttcgaattcggacccggggttcggaattgttcgaaaaggatgccagatacgtgatcagcaaccccgaaaactccggaaaattttcgtggcttttgaaaacaaaaaaatttttttcgaaaaatgggcgggggaccagccttaaactattaccaaatcttttcatcaattattaaatagagtgaaatacgtaccattattaaaaaagcaatctacttccaaagggttaaa

SEQ ID NO: 46758 - DNA, 1389 bp, Heterodera glycines
  Genomic contig location: Contig_ID=SeqID_1283; Location=3042..4430; Strand=-
  SCN-specific regions: Sequence locations=1-169,191-653,675-1389
atgttgtataaaaaagtggatgtgtcaagtgctgaggtggcaaatgcggggctggacttcttcaccatacccccaacgagctgcgctgtgtccaactctagctacagggagtacctgacgctgaacccaataagctctaggccctttcattttaaggtaggtggttttcacatacaatagcagacaaatccgttggttcagatccacccaatcaccagctatgtagaccttagcaaggtgtttgtgtgcacagagttcaagctcaaaaaagtggcagatgacggggttgtggttgatgtgccggcaaacgcagcggtcggccttatccaaatgcccggcgcaacgttcatccggaacctgaaagtgcacatcaaccagcgggaggtgtacgactcaaaccagctgtacagctacaaggtgttcctggacaccgagctcagctaccctgtaacggcaaaggattcatactttggcgtggctggctatttccgtgacagtgacccgaccaaagtaaacgatcgaaggaaaaaggcggtggaggagagcaagggctttcaagcgataagcaagctgagcgccgacatattcaaccaggacttgtacatgatcagcaatgttgagattgacattgagctcgccctgcagtcggacgattttatgatacatcaggaagccgcaaatagggacaagtacacgcttgagattatcgactgcaggctgatagtgaagacggttgatctgatggacggactcagcctagacattgcaaagaagttggacctggagcccgccagatacggcatccggaaaacgctgatgaagtcgctgttcattaccggtggacgatacgatttttctgccaatctgttcaccgaggaagtgccacggagggtcatcattgggctggtgcccaaccaaaattacattgggcacaatcagaagaaccccttttacttcaaccaccacaacgtaagtgccgctttgacatgtatttctggcagaaaaaatgttcaggtgcgggatattgaactgaccgcctctggcaggacatacccacagtttccgtacaacttggactacaagaacaacaggtacgcaagggcgtaccatgacacccaggagcaccttggcatggcctgtacaactgagagcaacgggatcagctacagcatgttcaagactgcctactgcctctatgtcttccaaatgaccaatgcgcaggaggactcgccgggctttgagctgatcaaggagggctgtacagcggtgaacattcggtttgccgaagcggttccgaacgagggggtcactttaatagcctatgccgaggctgacgggctcattctgattgaccggaacagatcaatcactagtgaccttacagtatga

SEQ ID NO: 46759 - DNA, 880 bp, Heterodera glycines
  Genomic contig location: Contig_ID=SeqID_43928; Location=226..1105; Strand=-
  SCN-specific regions: Sequence locations=1-9,83-388,412-500,522 -597,619-880
  Gene Ontology: Biological process=growth
atgacaaagcaatcgaatcaaacgatcaatcatttggccaaccaactgatcaatcacaataatcaatcaatcggtcgatcaaatcctcacaaatctgccgatcaatcaaaactgttcaattcaatcaaagcaaactgtgtggtggcacgaggaaatcgccaaaaaagcaaaaaaggctcccaaacaatgatgaaaaagagggaaagaaaggaaaaggaggaggtggttttctctcagccggttgtttgggtgaaacagaaaaaacgtaattttttgtgtaaaattatgggattgccgggtcgacggtggtacagaattttggccatttctaatttgaatccgtctccatttttcagtcgttctcgctcgcgtgatttgccctcctcacgcggtggtggtggcggcggcggttactacggctcgcgtcgtttccatgacggacgcgacaacccaaatccgaacccatgcttgggcgtgtttggcatgagtttggtcagttgtgtgtgttcaatatttgtgtcagttaattgtgactgattgtgagtctcggggatggggaaacatattgagggaggggcgcaaaattttcttagaaattcattaaaagttgcaaaaacattttttgtgggttggtggcatgcatttttacagcgaacccgaagtttactttttgaagtaaatgcgaattgtttgttggagtgggcgagcgataggccccttaaaatttatttgctttcagcataccacggagcgcgacctgaagcatttgtttggccgttatggcgaggttgattcggtgcaaattgtgtacgaccgtctctcgggacgctcgcggggctttggctttgtctacttcacacacaccaaagacgctgcgagg

SEQ ID NO: 46760 - DNA, 2340 bp, Heterodera glycines
  misc_feature (996)..(996): n is a, c, g, or t
  misc_feature (1136)..(1136): n is a, c, g, or t
  Genomic contig location: Contig_ID=SeqID_9463; Location=361..2700; Strand=-
  SCN-specific regions: Sequence locations=1-139,161-168,190-240,262 -270,295-810,832-867,889-1091,1125-1692,1731-2340
  Gene Ontology: Mol. function=laminin receptor activity; Cellular component=integral to plasma membrane; Biological process=cell adhesion
atgtcaagcagtcttgacgtcttcaaactgacggacgatgacgcaatgaaatttttggtgtgcgaatcgcacatcggcaccaaaaagatggacttccaaatggagcattatttgtggaagcgtcgatcagacggtttatcttttcacttttcacacattaaccttaaaactataatgcaaaagcaataccggccgtatgttttatattcaaaattcggatatttttgcatttttacccatgatttttgaaaccttttttatcatgcctatcgtgatttttgaaaccttttttatcatgcctatcgaatcatgcctaaaacaaaaatcttacaaatatgtaagaaacaatcccccttccccgcgttaaggcattcacatcatcaacattcgcaaaacgtgggagaaactgttgttcgccgcccgtgccatcgcggccattgaaaatccgtccgatgttgtggtcgtctctgctcagccgtacgcccaacgcgctgtgctcaaggtttttgcttattccatgctctcagggtcgggctgattgtgattttttatttatttcggtcccttaatacggagcggtaaacccgttacaaatgcattgcatggaaaagtttagtttggttttccaaggtaaaagaaagcacagttgaaacggatccctctttttctccaaaatcgatgccaataatctttctataataactttttcgtcttttttcagttcgccgctcacatcggtgccactccaatcgttggccgttttacgcccggctctttgaccaaccaaatccaaaagaatttcaaggtttacaaattcttttaaaaaccaccaaagaatagggaatgggaagaatcgctgctctgaagttggtttcagaactcatttttataaaagaaaatagccattgtcggtgtcccttccccatttttgaagaaattaatttttgtacgaatatacgcgacagatttataactgatagctcttaatatccatgngtcaatttgttatcttttttaacatatttggcacttcctagggacctttgtttacaacattaaaaaaaattcaattcgtactgccccaaatcgtattattttattatcataatttttctaaagtcaaccaaaataaaatntggtaccatttgatagcctagcccctaaggttcttttttaagggtttttgcggtttctactcacgaatccgggatccatttcgaacaattccaaactccgggtccgaattcgaacaaaaagtcgaaactttacatttttaaactttgtttaagtacatggaagacgaaactcaacattttgttgttttgcaggaaccgcgtctgctcgtggtgtccgacccgtagttggaccaccaggcggtccgtgaggcgtcctacgtgaacacgccggtgattgcggtggccaacacggactcgccgttgaaatttgtggacattgccatcccggcaaacaacaaggttttgtttttttagcaaaactatcccgaaggttgtattgaatttgtgtctttcaaagagttgatagtggccggatgcccgaataatgagcccatacccaaccaaaattgctaaaagctatctcaattatatgtcactgattggattggtaaatttctgataccaccgggccatgaaaacttggtacatatacggtcttggtattactcgaatcggatctatagaacaaaaaatgttttggtaccatattgattgatcgttttaatacctaaatactgtcccaattccaaccccctcccctcacagcaaaagcactccgtcggactgatttggtggctgttggctcgtgaagttttgctgttgcgcggcaaaatcagtcgtcagacgggctttgtggtggacgacaagctgatcatgcccgacctgtacttcttccgtgacccgcaagagcaggagaaggagggcaccgagggtgaggccgaggcggacatcaccgtcaaggagggcggttggggtgcgaccggaggcatggagaccataggcggcgactttccgagttgttccgatttcatgtggcgcgcttgctgcgatctcttcccattctaattggttatcgaccgacaggactaacgtcttcattctttttgcttttgctgcgcgaattttgaacagcaaacttccgactccaaatagttggccacgctcgagtgttgcactgacgacggtgtctgatgagcagaggcgattgcaagccaatccaaatacagcgcaaaacacggccgctgaaccagacggtccatgaacaatgtcgtcgttaggcggttcgattcgcagtgtcacgcggttgttcacaaaaaattggtct

SEQ ID NO: 46761 - DNA, 1223 bp, Heterodera glycines
  misc_feature (11)..(11): n is a, c, g, or t
  misc_feature (35)..(35): n is a, c, g, or t
  misc_feature (64)..(64): n is a, c, g, or t
  Genomic contig location: Contig_ID=SeqID_44004; Location=70..1292; Strand=+
  SCN-specific regions: Sequence locations=1-75,98-558,582-889,925-1223
taaaacaattntaattgcctgtctctgtgttcttngcgaattcgggtcccgactcgggactctntgaaatataccctggaccaccaggcatttatctcatccgtgttgggtttgagatttttcacaattatcaagccctttttacttggtcctaatttcgttcgtctccttatttttttgattctgccaattgttaggctgttgttgtacctctccaatttgacaggtgacagtcgacgcgatggagcgcctgttgaagagttgccatggctcgccgtcgctgaaccaattcattgagggctatttgctgatggtgcaaaggctgctcgagacgaataatgcacatatggaaaagctggcaaccggtcggtgtgtaatttgggcgaaaaattgaaaattcatttctctctcaacaaatttaatttcataatcaaacacaacttctatagtttttcctcggggtcttatccgcttttctccgtcggcacaacgcgggaaattttgattgcaatttaaccaaattcttttaaaaaaaattaaaaagttttgccaccgaaaaattttaaataggttttacaactgaaaattacatctttattaaatttgagaaaatagtaaattattagaaaattgacggttctatgtcagttactcaaaccccaacaaaaagggcgttactcaaaaatacatttgacacttttttaaaatctgtctttttttgcttagatttgtttgagcgcttctccaccattgaggaggactcgccgtcctaccatcgccaatacgactttttcatctccaaattctccgcaatgtgtcatgcacaaaacgatgtgtacgtgagctcacagcgctacaacggattgcgcgggttgagaggtggcctaacaaaaaaaaattctaaaaaattttttgaaaaaatttccaattttttactatttgaaccattcatttttaggtgtcatttggaagtcggcgtccgatgatttgcaggccaacatctgggagaagcagcacatgaacaaaattgtgccctccattctgttcaactttcaacatgacgacgaaagcggtgggcaatataaatcatttaaatgccgtgcagaaaaagttttaactgttttgaaatgtccatgctgcacattccatccttcgcatcatcattttctccctaccaattaaaaaaaaccaagcggtttctagtaaaaaaattgaaaattttt

SEQ ID NO: 46762 - DNA, 2543 bp, Heterodera glycines
  Genomic contig location: Contig_ID=SeqID_9478; Location=3677..6219; Strand=-
  SCN-specific regions: Sequence locations=1-116,138-166,188-228,251 -442,474-653,695-833,855-911,933-1244,1307-1558,1603-1628,1650 -1765,1828-1832,1939-2092,2114-2131,2153-2215,2256-2386,2411-2543
atgcctgagcttgtcaggaaaacagtgattttttgctccgtggtgttcactttgatcggcatgggcttatcaattgctgccattttaaccccgtcgtggcaggttgggtttggcgcaatttttaattcaataaattttcattttggtcacttttttcaaaaaaatttccatttttaccccataattctcaggttgtcaatctgcaagagtacaactcggtgcatgagcatggcctttggttggattgcattcggcacatccgggacggaggcggcgttctcctcagacggtcggtcgtcaattttgattaaatgcgctagaaaaactggtctcgagactcttgactgagaaaagtgccgagttccggcattggaaaatttaagctatgcacataataattgtgccatatgaggacaaagtgatccatgccgaaaattttctgataatttaaaaatttatttgaattaaattttgtcaatgcatttagttatgcaacactgaccgagcctctgcattgtgtctacaaatttgattatgacaagtaaattaatcaattttttcggcgtttttgactgcactaaataattctcattttatgttcaaattaaaaataggttaattagtttttttggcgcttttgattggcactaattaattattcatttcacacaaaatgaaaatttattaattttttcggcgcttttcatggtactaattgatatgccaatttaaggtattccggcactttcgacgtggaggatgacaattcgccggttggtgaagtgaaccggcaccgcttctacggatggcacagcgccacactgataatgctggtgaaaaatggaaaattttatcgaaaaatttgaaatttttcaaggccctcgctctgatcaccagcttctgctccatttgtcttggtgcttgtggctgttgttacgcttcaatgtcgttggtgttcacagccactgcactgcttaccagtgatgtttttaaagcagtcccctattttaattagggcctggaataatgaaaaagtcgggattcgggattagaattggcacggataggattactgggattgaaatctctgctttgccgggatttcaagacgcaagacggcataataatgcattgatcacgggtcaatgataaaatgatgcttccgattttggcaaaaaaagtgacacgatcctttggcttatattattacgctccagtcaatttcaaattacttataaaatgagataattataattctaatatttaaatttaaaaatgaatattaaaataaaataaaataatttatcttgcagctttcctttcttctgttgccgaaggcgtgttcttcttcttctcccatcgtgccgacaatcgtttcatcaagggcattgttggcacttatgaggtattaactaatataatacaatatcaaattaaatttgaatttagcaacgtgttggactggccttttttcttcaaatggccgcttgtttcttccattttattgcctttttgatcgccatggtggccacttagtaattaattggatatgcaatacaattataatttattttatttaaatttagaattaaaatttaattacctaattaactgttgttcaaatggccaataaaataaatttataaaatgagaacattcttcagttttgccttcacacgaaaaggcgtcgcattggacagagaacgatattccttgcaaacatcgtcaaaaactaacatgaccaatgtgggaaggtaagagtttgtattttaaataatttttatttaaacaaatatgtttatttaaattaaatatatatttataattcataatttttttacgcaacttttttttgttttatattttcccattttatattttaattttattgtagcctgatatttttctttatttcatttgtttgtatattatgttgttgtcatgccggcgattaccaaaaagtccctgattccaagtgccaattctcgacccttttttgatgggttgaatcccgatcaccgaatgataatacctattatattttctttatttatttgtgtaatatgtttggtgtgcaatattatgtttatcttttctctctttttcattctttgtcacctcaaaatggaacaattttcaaatttccgttttccgtagcaattgtttagtttattattgccgtagaatgaaatagtttgccgaacgcacttttcagttaatattttttaatttatttcaataatttgttataaattgcacaaatttgttttttgcactttttgaccaacaacttttcgtcctaatttggcaacaaaaaaaaaaattgcgaagatggcaatgagttttaataaatttttgagttacacattttattgctccggaaaacgccaaaattgaaaaaattgtttcattttaggccaatggatcggatgccattgcttgaccaacttcagcctccaccatcattccattccagctcacaatcagccgatcgtattgatagaggttttttgaggaccgaccttccttttctgaatttttaa

SEQ ID NO: 46763 - DNA, 806 bp, Heterodera glycines
  Genomic contig location: Contig_ID=SeqID_1286; Location=345..1150; Strand=-
  SCN-specific regions: Sequence locations=1-241,276-426,450-466,538-806
atggccgacgaaatattcgcagctttacatgctaatgggaaaaattatttaattttgttaaattcagttcatgtaagaaaaaaaaccaattcccataaggagttaaaattttagctgttctcctcccccaaccaaagtgccgagggcgcaattatttgtgtggcccatcagcgcctcgggcccaacaatggtctgatgggactcattacgctgccgtggccatttcctcatctagccaaattttcttcaccgccctcccccgccccctctccttgcacgagtaaactccgaaattacagcggacaaagacggcaaaaattacttacgaaagattggcacaattcggagaatgatggcactaaatgagtgtcggggaataggtgaaaaaatgcaaggaattgaggaaagaatgcaaaaactcacttaaaatcttttggtatttgaaaaaatgccaaaagagagcgtctaataaatgttaatttaataaaaaataaaatgcaaaaaataataaaataaggaaaagtaagggaataaattcagttgcaaatacaaccgaaaacatccaacaaattgaacgccccgaggggaaaggtttcagccgcagaagtgcatttccccgtcccccctgcgatcgagtgaggcaaatcatgtaccattgaactcggaattctatcttgattgccttgctgtgtctgacggtgaaaatttggtcatcggcacaattgacgacattcggaagctgcactttcgaacggttccattgggagaaagcgcctctatttcggctggaatcgaaagcgactgtc

SEQ ID NO: 46764 - DNA, 913 bp, Heterodera glycines
  misc_feature (284)..(284): n is a, c, g, or t
  Genomic contig location: Contig_ID=SeqID_44023; Location=54..966; Strand=-
  SCN-specific regions: Sequence locations=1-134,156-378,401-428,450 -462,485-515,537-542,564-628,651-913
  Gene Ontology: Mol. function=protein tagging activity; Cellular component=chromosome; Biological process=cell organization and biogenesis
atggccgacgaaagtggaacaaacgcaggaggaaccggtgcagctggaggcgctcagcctgctgagtacatcaaactgaaggtcgttggccaggtctgttttctttgtgttatggcgagaccaaaccttttaattgttcattttaggactcaaatgaagtgcatttccgggtcaaatacggcacatccatgggcaagctgaaaaaggcgtacgccgagcggactggcgtccaggtttgccagacttgggatctttaaagtttaaacaggggtgtccacccaccnccatccataaattaccaatacactgattgtgtccacatttttaggtgacttctttgcgctttttgttcgatggccgccgcgtcaatgacgacgacacccccaaatcacttgaaatggaggaggacgacgtcattgaagtatgtggggtgatggataggtggatgacgaggccgtccttactgtttttcattaattgtttaggtgtaccaagaacagctcggaggctacattgtggaggaataatgaagattgtgaacatttctccgtgtttctttctctgacgatgatcttttgcggatgttatatttatacttcgctttgtttctttttttgtttctttgaaagaattggattccaaacttttgttgtttaatttatcacacttgtggtgttaacattgggatttttctaaattccggttttgctgttccaattttgcatgcgtagtccgtatttgattttttgctaatctttggtacatacagtatgaagaaatttggagagagcgagttgattgctggcttttaggttggctttctcagtatcatttactagcacacaaaattttaaattcattgtttcaaaaaattaggcaaaggtgtagaattgcggtcccgacgggaaataaa

SEQ ID NO: 46765 - DNA, 1518 bp, Heterodera glycines; identical to SEQ ID NO: 44027
  misc_feature (1365)..(1365): n is a, c, g, or t
  Genomic contig location: Contig_ID=SeqID_44027; Location=1..1518; Strand=+
  SCN-specific regions: Sequence locations=1-25,47-126,167-171,200 -695,726-809,898-1488,1511-1518
  Gene Ontology: Mol. function=ATP dependent helicase activity; Biological process=ribosome biogenesis

SEQ ID NO: 46766 - DNA, 3236 bp, Heterodera glycines
  Genomic contig location: Contig_ID=SeqID_9484; Location=12..3247; Strand=-
  SCN-specific regions: Sequence locations=1-14,37-2729,2751-3236
  Gene Ontology: Mol. function=structural constituent of muscle; Cellular component=extracellular space; Biological process=striated muscle contraction
atgagtgtggtggtggaggatggcaagccggaaccgaaaattgactggttcaaggacggacacccgctgcacatcgacggacagcacatcatgcgcagggacgagcccgacggacggcactcgctgaccataaacaacgcacgggcggaggatgccggcacgtacacgtgcaaagcgttcaacaaggcgggacagtcggtatccgaagccaacttcggcgtccaacagcgcgttgaagagcctgctcagcagcaggccgagccgatgttcctcgtgccgctcgagccacagacagtccgcgagggcgaaacggcggagatgtgctgcaaggtgaacgcggaagagtccaagccggacattcgctggtaccacgacgaaaagctcgttgtgccgggccaacagccgaacgttgtcattgaacaccttgcggatgggacattaaatttgcgcgtgcagtccgccaccaagtccgacattggcatgtaccgctgcgaggcggtcaacgcggcaggccgtgcgcagaccagcgcgccgttgaaatacgcggaagagatggaggtggaccacaagttcgagctggctgagcccatgttcgtgcgtcctctggagccgaggacggtgcgtgagggtgaaccggcggagatgagctgtaaggtgaacgtggccgaatcgcaacccgacattcgctggtaccgcgacgacaaacccatcttgcctggccaagagccgaacgtcgtcattgaacagcttgcggatggcacacaaaagttgcgcgtcctgcacgcgtctgcctcggatttgggcgtgtaccgttgcgaggcgatcaatcctacgggccgtgcgcaaacgcaggcaccgctgcggtacgcggaggagcggctaattgagcagccggaagaggagcacgcgccgttgttgagctggcgtcgaaccctacgcgaccagcagatgtccaagggaacgcgtggcgtcgtgttcgaatgccagctggagccgtcgtcactcagcgcagtgaaacgcgtggactggctgaaggacggctccatcctggccaacaagatggagctgtactcgttacgagtggagcaactgcaggacggcacccaacggttgctgttcgatcgcgaagcgcacttcgaccacattggcgtctatcgctgcgtggccaccgatgccagcggcaaccaaatttggacagaggcgcggctcggcgtcattggtaatatattcttagaaaattttgggattattaggatattttgtctgctttaagcacctcgcgacgcggaagagatggcgcccggaccgcccgagtttgtggagttgctcaagtcgtgcaccaccacaattggcggcacggcggtgctgcgctgcaaagtgaagggcaacccgcggcctaccatcgcatggtcgcgccagggctatgggccattgtcggagtcggatcggattagcacggagtaccacgaggacggcacaatcattttgacgctaaccaatgcggacatggacgacacgggggaatacaggtggggaacaggacaacagcaacaagcagtagcaggaacacatggggatgaacaatgcggacatctatcccttcacagatgcgatgccgaaaatgattatggcacggcatggactgaaggtccgattatcgtcgctgccgagggcagtttgccgaccgaaggcgaagcgcccgattttattgagcccgtccgaccgattacagtcaaagtggtaggcacagagaaatatgtgaatttgtggcaaaattgtttgctatttcgagacttacccaatttatcgagaatcactttaaatttctgacacaaatttttagggcgacaccggcattttggagggccgaatcaccggtttgccattccccgaggtcaaatggtacaagggcgagcagctgataacgcccggcctcaacccgcgctatcgcctcgagaatttgccggacggcacgcaacggctaattattacgaacgcacaaatgggcgacatggacgactaccggtgtgaggcgacaaacaaatacggcgacgtgtggagcgacgtcacattgaccgtacaaggtggacagtgggggagggggtacggtatttgctagggctgcccagaattctcgagacagaatctcgaaaatcgaattgagtaccaccagaccaaagagccgagacgagacttactcgagaccgagactcttgagcatcattagcattttggtggatttaatgaagagtaattaatttttcaatttccatttgtgcatttagagcctgagccggaagaggagccatcgtcgccatattttgtcagagggcttcaagaagtgcgagtgaccgaaggagaacaagcggatttggaatgtgtggtgaagggatggccaacgcccgaggtcaaatggtacaaggtactgtatgagtatggtaatgtttcataaaaaattcgctaatttttaggatgacgatgagattcggcccgaggatgtcaatttccgcgccactcagtcgccggacggcacgtgccacctgacgttacccgccgcgcgcatcaccgacgcaggagtgttccgttgcagcgccacaaacccgtccggcactgcgcacacagaagcgccactgcgcgtattgctcgaggaagaggcgccgatgccagccgaagtggcacccgaatttgtacaagggttgaagccagttcaggtgggaaaactcaaaaaaccagagaaataatggcatcatcgactgttcgaaaatatcaggccacggaaggagacgaggccatgttcgagtgccaagtcagcggtgtgccgcagccacaggtcaaatggtacaaggatgacgtgccgttgggtccggcggacgcggtcaaattcgaggcattgctggacggcacgcaacgactgataatccccaagtcgcgcatggacgaccagggcaattattgttgcgaagcgacaaatccagcaggaaccgccacgacaaaagcaccgctgagaattatccgtaactaaaaaacaaccgatcgctaattagaaaattttattaattacagcgatagaagcaaagccagcggttgtggaggaaaggccgaaggaagaagaagcaaagccaatggaagacgaaaagccgttggaggaagaaaccaaaatggaatgggaagaagccaaaccaaaggaggaagaagccgttaagccctttgaagaagcaaagccaatgggactctag

SEQ ID NO: 46767 - DNA, 994 bp, Heterodera glycines
  Genomic contig location: Contig_ID=SeqID_9487; Location=288..1281; Strand=+
  SCN-specific regions: Sequence locations=1-122,146-678,700-994
aagttccttcgccttgtgaatttttgctttgacttttttatggagagattgttcaataccccgatttcctccctttctacgaacacatcaaattgcacacgaaacaccatttgtcttggctttttggatgggtccatccaatgtttttcctttgacacacagcgagggatcactccatcgatggaaagttcggtaaaactcggtggaatgtggcgcaaacggatgaaacggtccgtcagggcaatgcaaatttctgaggatggcacttcgctttatgcgaccagttcgaacaggttgcccattccccctcgccccctccccaattgtcagttttgaagggccgtctgtttgtatgacgttgagacggggaagagagtgcgctgtattcgcgaagggcacaaaagtcggcccagtgcgatggcactgctgccgggcgaaagacggcattttgcaacgggtgccgaaaacggcgaagtctgtcgggaagaagtccaatgagacaatgtcacattttaacatagataaaagcatgggactttggacagcccaagccgaacgtgcacacatttggcgagcaggcggacataatcagttgggtgtgccccttttttgtcccctccccagcggaatttagcgaagtttcttaatctggcccattgaatttcctcagatgcgttgcacatttggcgcaataatttgctggccgcgagtggcgacggcactttggccgtttacgacacgcacaaaggcaaagtgcgaattcagtcggagacaatgcacagcgaattgctcagtttggcggtgactgaaaggtttcgtcggttttcaatttgcgaaaaggcatttctgtccatcactgattgtcagattcacttacgtcggagcggccgatggacacattgaagtgttcagcaatggccaatttgggaacatccgcgaacgtatggagacgccctttctgatgggcgtcgagcaaatggtcgtcttgcgcaac

SEQ ID NO: 46768 - DNA, 727 bp, Heterodera glycines
  Genomic contig location: Contig_ID=SeqID_44106; Location=446..1172; Strand=+
  SCN-specific regions: Sequence locations=1-310,333-335,359-727
  Gene Ontology: Biological process=positive regulation of body size
tttgtgccggaaaaacgagtcgacgaagctgggcatattttaaatgatccgaggttatcttcctattttacttatcgcattttttccatgtttattttcttcagtaaaagtttggccgatcgtttccgtgcgcttttccttctcagaagcgtaaaaagcgacagggctgtccattggatttgcaaatgcttctccgacccatcggctcttcttaagcacgaacttgcgtattgtcttggtcagatgcaaaaccccgcggcgattcaaaaattaatcttcgttttgcaagacactgaacaaggcgagtaaatttctttttgtttaacattttcctttgtctttatttatatttttgtatatagaaattcaacttatgtaataatacatttgcttttttcattaattccacttaattcagaaccaatggtccgtcatgaagcggccgaagcgctcggagccatcggcgacccgtcgaatgagcacggactcagcaaactgttcgagcagtacagcggtgacgcagtccgagaagtggcggagacatgccttttggcactgcgacggacgcaatgggttaaagagaagggaaaggacgacacggaaagtcggagcatttacgattccattggcaaggaaatttgtggaaaatttggttttttaattgtgccacattaagcgtttgtcagaccacgagccagcagcggacggagggaaaggagcagccgaa

SEQ ID NO: 46769 - DNA, 693 bp, Heterodera glycines
  Genomic contig location: Contig_ID=SeqID_44113; Location=246..938; Strand=+
  SCN-specific regions: Sequence locations=1-241,263-269,292-693
  Gene Ontology: Mol. function=serine-tRNA ligase activity; Cellular component=cytoplasm; Biological process=tRNA processing
gtgaccaccgcaaaaaagacggacgcagccaatgaagacggctctcccgacgagaaatatctaatcgcaacttctgagcagccaatcaccgcctttcatcgtacatttttatccatttattctgctcccctcaactttgccatttgtaaggtgacgaatggcttaacccatcggatttgccaatcaaatatgccggaatgtccacctgttttcggcaggaggtttgtatattctgccaatatttgtttctttaatcccatggcatcgtcaccttttattttcacttttttaaggtcggaagccatgggagagacacccgcgggattttccgtgtgcaccaattcgagaagatggaacaatttgtcatctgttccccatttgacaacgaatcgtggaagcacatggacgaagttagtggacttttgaaaatatagtccattaaatttaattctttttaaaattcagatgattgacaatgctgaagagttttgcaaagtgctcggccttccctaccgaattgtggccattgtttcggccgaactgaacaacgcggcggcaaagaaattggacctcgaggcgtggttcccgggcagcggtgcatttcgggagctggtttcatgctccaactgtacagattaccagtcgagacggttacgaatacggtacggacagacgaagaaaatggacggaaag

SEQ ID NO: 46770 - DNA, 925 bp, Heterodera glycines
  Genomic contig location: Contig_ID=SeqID_9506; Location=1933..2857; Strand=-
  SCN-specific regions: Sequence locations=1-561,583-685,719-822,845-903
  Gene Ontology: Mol. function=trypsin inhibitor activity; Cellular component=extracellular space
atgggattcgcgacgccaatgtcggcggaggacaaagtgacgattgtccagtgccacaacaattaccggtcgcaattggccttgggcaaagtggcgaacaaaacgggacagacaatgccaaccgcggccaacatggcgaagatggtgtgggacgacggactgggcaaatcggcccaggattgggccagcaaatgccaaattcaacactcgggcacagactttggcgagaatctgtacttctccagctggcgcgactttcccaacagtaagtcaaattgggagccaattaaagtagaaaattgtgacaatttaagaggaagtgctggaaaagtcatgcaacgcgtggtggtccgagttggcagagttcggcatcaacaaggacatgtggttggacgacgacaacctgtccaaagttggccattggactcaggtaatttagcctctcattatctcgacaaccaattctcattgatacaatgaccaaattgacattctttgggcacaattttttttaccccttttgagcgttaaaatttaaattctcaatcgcaaaattctgtgttttatacatattaaaattcagatggcatggtttaattcggtgcaaattggctgtgccgtggccaactgtgacggcgactggcaaacttatgtggtgtgccattacaatccagggtaagctgtgaataataaattataaaattaattatttataaatgccttttaggggcaattatgtgtggatgagcacttacaagtcgggcccaatttgcagtgaatgcgaagcgccgagaaaatgcaacaattcgtcgggactttgtgaataaacaaaacatagaagaaagtggaggaaaaagaaagaaattcacaaattgaacatagaatgggaatagttttatttacatattttaaatggtataataaa

SEQ ID NO: 46771 - DNA, 2139 bp, Heterodera glycines
  Genomic contig location: Contig_ID=SeqID_9514; Location=223..2361; Strand=+
  SCN-specific regions: Sequence locations=1-102,126-230,252-468,490 -689,715-720,742-1085,1107-1374,1396-1539,1567-1633,1655-1886,1917 -2139
  Gene Ontology: Mol. function=RNA binding; Cellular component=nucleus; Biological process=embryogenesis and morphogenesis
atgcaaaatcaacagaatatggacaattcagcaaggtcaattttcgttggcaatatttcttacgatgtgagcgaagacgaattgcggaagcttctctcagcagtaaataaatatgctaactttgacatttttcagactttttacatatttctctcttttttattggtaattcgtttttagtgtggtcaaattgttagctttcgccttgtccatgaccgcgagacggggcgccccaaagggtttggtttttgtgaatttgccgatgtgcctcaagcggaggcagcaattcgcaatttcaatgggttcgagtttcggggacgtccacttcgtgtcgactcggctacgggcaatgatcggagtgctgatgaggtgatcggcggatatgccgtatttactgtacaattatccccggcagcctcgtagccggggggagggaatttccccaaccctcgaaaatggcaaaaattagtcctttttggcaaaagaaagctacaaatcactccggcgtttaaattttaaaataactggagaaattggcccgaagagcacaaaattacaattagatgtgttaattttctgtttttttttctttacttttctatgagaatgatattacacttaaaataaagcaattaaaatatgacttttatacataattttaaatttttctgggagaataggtaaattggaaagttcttgtttaaattagcattttcataattttctatttttactttagatgcaacacttccaaatgactttgactcgtccgcaaaatcccaccgacgaattgagtccttatgggcccgaattggagccgggaaaagcaccggaagtaattgcccgcacagtcgcgtcaatgcctcccgaaaaaatgttcgaattgatgcgatccatgaaggaaacggtgaacaacaatccgcaaatggcgcgccaacttttgatggaaaatccgcagctgtcgtatgcattgctgcaggtgcaaattcccaatttttaagtgttgaaattctcaattttaaaagtaaaagtagacctaacttttgtcggaaatgggaagatattaatttacttaaaaacaactcttttttgtccttattttttatggtaaatgtattgtcgataggtttttgtgtcgtcgctgatcacgaaattatattattttgattcgggactatgcatacacatttaacacataaattggtttgaaaaagcgagtttggtgttgacaattagattaatcaattctcctttttatattgtttttttccaccggaaggctcaagttgtgatgcgagtggtggacccgaagattgcctaccaaatgcttcatcgtgaacatgctcagccgcttgtaccgccgacttccatccccactcatatccctcaacaatttgctggcaaaccccctcaattgcctccccaattcaacatacctccgccctccgtcccctctcatcagtttcaaatgcaacctcctccattggtgccaggccaatttcaccacggatttccatccatgggcatggctccgccttcgctactgcaacagcagcagcaacagacgccttttacacaacaaaagccgacacccatcgctcctttggcagtgcctccggcagcgaccgctccgcaacagcagcaggtggtggacaggccgactgaatgccttcctcccgccagaattggtctttacgtatcatttaggctgttactccgcctccgcttagccaacaagcacagcaaagcaacagcgacaatttggacgaggagcagcaggcgcaaatgcttgtgagtgttcaaatgaaagatgtccttttatataatagtggcaaattacccctcaaactaaaaaacgatcaaaaaacagtaatttcggttatgtgtaaacggattttatttaaaaaagcaacaaaggccaaaggaattcacacaaataggggcccaacatttggcggttgcctcttttaaatttcgcgctgttttcacataaaccgaaaagtaccaaaaaactcaatcgaatctcaaaaattcaagatccgcgtgctgcaactcaccgatgagcaaattcgtatgttaccacccactgaacgtgcccaagttatcgaattgcgtaaccaactgagaagtgcggatgca

SEQ ID NO: 46772 - DNA, 579 bp, Heterodera glycines
  Genomic contig location: Contig_ID=SeqID_44192; Location=382..960; Strand=-
  SCN-specific regions: Sequence locations=1-303,325-579
aaaaaattggtataaaggggcaaaatttttatgggggataaagggctttttgagtaataggacttttcgagttaaaattggggattccttatcctcaagtaaaaaagttacttctggcgtcccccagggctctgtcctggccctttactatttttgatttatattaacgatcttcctgatgctttgccatcaggagtgaaaataaaattatatgctgatgatgttaaaatatatatatgctataaagcaagatctgacacagaaattatgcataaagcattgcataacttattcgaatgggcaaataaatggcaaataaaagtttcaattcaaaaaacttttgtattatatttgggttcaaaaaacccaaaagaaacatacaaatttgatggaaatacaataaatgctgtggatacaattagggatttaggaataaacattgataacaaattccaattttccggtcatgttaaccaaataacaaggaatgcgtatttacgtatgcgttccttgtttagaataattaaatccaaatcgtctaagatttggattacgttatataaaacttatattaggcct

SEQ ID NO: 46773 - DNA, 1049 bp, Heterodera glycines
  Genomic contig location: Contig_ID=SeqID_1290; Location=432..1480; Strand=+
  SCN-specific regions: Sequence locations=1-22,45-340,362-1049
atgagcataaatggacgtgaagttttcaactccaattcactaatggcctacaaaacatacttctcacatgagctgtcctattccaatacggcaaaggactcgcatttgaatgcggcgggctattaccgtgacatcggcggctcgcttgagacaggggacggatgcattgcgcgacgcaacctgtttgcgagaagcagaacagcgcaattcattgccaaaattgacgccgatttgttcaaccaacctctctacttgatcaacttctgtgagttggacattgaaattttacccaacgacaacgagtttgtcctaatcactacgcccattgttgcccagggtgctgcagctgctcctcgttatcgcttcgaggttgtcggcttgaaaatgtatgtgaaaaaagtctcattgatggatggactggcgttggacattgcgcgaaaacttgaagtaaaaccagcacgatatgctgtgaggaaaacgctgatgaaatcaatgttcattagtcatggacgtttcgagtttacagccaatttgttcatggaccaaattccccgtcgtatcacaatggggttagtggctaattctgactatattggaacaatttcgcgcagtccgttcaattttcaaccgttcaatgtgcgcgaaatctcaattattgctaatggacgctcctttccccaagcgccatacgacttggactaccctaattggaaatatgttcgccctttcaatgacatgaacgaagcagtgggattcgccaactcattggaaagcaatggaattagctatgaacagttcggaaaaacccactgcatttatgtgttcaatttgaccaacagtggagatgatcaagctgcgctgtttgacctgataaagaacgggacaacagcggtgagcattaaattcaaccaggcagtgcccgccggagggataatgctggtggtgatgggcgaatgcgactctcttgtgatgttagacaaaaatcgatcaattagcacagacattactatttaaggctgtcatttttttcgtatgccactatcatttga

SEQ ID NO: 46774 - DNA, 759 bp, Heterodera glycines
  Genomic contig location: Contig_ID=SeqID_9525; Location=278..1036; Strand=-
  SCN-specific regions: Sequence locations=1-433,458-759
  Gene Ontology: Cellular component=nucleoplasm; Biological process =mRNA splicing
cgtgatgccaagctgcaggagatgggcaaagtgttggacgagggatttgcgcgttacgcggacgacgaggcaatgaacgcgcggttgaaggaacagttgcacgaggaggacccaatggcggagtatttccgcgtcaaatcccacaaagtccaaatgcgcaccggtgttggtatgcttggaattggcaccacttaaaatggcacattcgtaaccctaggcccgtagccaaaaaaatttcgggagggggaaaccgaatacccctttttttgctcttcgagtctcaaattttttgtccaaatgttcatcgccagggagaaaagcaaaacttttgtacccctttttgccaaaaaaaaaaaattttttttgccatttttggttaaattttcaaaaatatgagatttgggggtccgtgatgccgagattaggcgcctccggggaaaatttttggaatttttaatgcaattttttcttaaaattcggaaaaataattctctaaatggttacctaataaactcattcattttgacgacaaaatctgtttgagcaatgcttttgccaattcaaaatgccttcatttctcccgcttcagtgtacccctcctacaaaggccaatttccccccaatcgcttttcaattgcgcccggctaccggtgggacggcgtgaaccgctccaatggctttgagtcgaaattgcaattggagaaaaacaaacggaaggcgcgcgagacggacacttaccgatccatcgcggaatgcgaa

SEQ ID NO: 46775 - DNA, 736 bp, Heterodera glycines
  Genomic contig location: Contig_ID=SeqID_44308; Location=359..1094; Strand=-
  SCN-specific regions: Sequence locations=1-255,278-497,520-736
gtctacaacaagtcaactaataacagttgtagaagcttctacgaggcaattattaatggaaaaagtgttgattgtatttatattgattttcaaaaagcatttgactcagtgccccataatttacttttatataaattggaaaaaattggtataaagggcaaacttttattgtggataaaggactttttaagtaataggacttttcgagttaaaattggggattctttatcctcaagtaaaaaagttggctctggcgttccccagggctctgtcctgggccctttattatttttgatctatattaacgatcttcctgatgctttgccctctggagtaagaattaaattatatgctgatgatgttaaattatatatgctataaagcaagagcagatacagaaactatgcataaagcattgcacaatttattcgaatgggcaaataaaagtttcaattcaaaaaacttttatattatacatatttgggttccaaaaacccaaaagaaacatataaatttgatgggaatacaataaatgctgtggatacaattagggatttaggagtaaacattgataataaattacaattttccgttcatgtaaaccaaataacaaggaatgcgtatttacgtatgcgttccttgtttagaataattaaatccaaatcgtctaagatttggattacgttatataaaacttatattaggcctttattggaatatgctccggaggtttgga

SEQ ID NO: 46776 - DNA, 1782 bp, Heterodera glycines
  Genomic contig location: Contig_ID=SeqID_9544; Location=799..2580; Strand=-
  SCN-specific regions: Sequence locations=1-130,153-501,537-565,587 -924,950-1242,1264-1643,1665-1782
  Gene Ontology: Biological process=synaptic vesicle endocytosis
atggatacgatttttttggtttgtaagtccaactccattaaaagtaacaaaaatacaaaaaaatacttgaaaaagaatccgataatacattttgaatgatattaatttgtttaacttttttcctttttaaattgtttttaaaaaataaggaaaattggttttttttttatcgacctatttatcatatttcaattggctactaatctttgtgccatctttcagttgctgaaaacaatgccaattcttcagtcccaaattgactctctgctcgactttcaggcattccttctccgctccccctttttttcttttaatttcgatgccttttcaggtcagcagttccgagttgaacaacggcgtcatcaattgctctttcattttgcttttccgcgatttgatccgtttgttcgcctgttacaacgacggaatgatcaatttattagagaaattcttcgacatgaacaaaaaacagtgccgcgaggcgttggaccaatacaaagcatttttggtgagtttatactcattgaattgaattttgggtatttttttatgacgagtgtatttgaattaaataaaattcaattttgactcccttattttgttagtctcgcctcgaccgcgtgtccgcctttttgaccgttgccgagtccgttggcattgaccgtggcgaagtgcccgatttgacgcgggcgccagcctcccttttggaggcgttggaagcgcatctgttccaattggagggcggccggggcgcgccgagcggacagtcggcacagtccgtccaacaagttcacacaaaatttgaataaaattcaattttatgggtttaattttcagatggtctcccagcaaatcaattcggcccgtcaggaacagttatttcaatcgaacagcagcgtagacgaaatggcaaagcagcgctatttggaggaggagaaggagagactgcgccaatttgaggagcaacgccgacgccaaatccaacaacagccggggggaggaggtgggaaaatgggggaaagggggcaagtggaaactttaaattcataagggacaaaaactgttatttgaaatattttttttacaaaaattcatttaatttccaatgaattttcggacaatacttttttctcaacaaaatcaagcattcttggtaatggttttgttcatatataaaaagaccaagaccaaaaaatttcaaaaatccaggtttttgagttgttctggccatatttttttgaaacttaatgaataataatatatattccaaaccctaaacaaataagaaccacaaattattggcaatgttattatttaatttttccctaaaatacgtcttttgtctttctccaaatgtttctccgccctttcagtgccgacttcttccgtgccctccccgtcgtccatccccccgccctccaccaatccgttcgccctcgcttccgaccttatctgtttcgacactccgccaaaagatgggaattctgtcgccgtcggtcaaattgagccgaccaatcccttcgccattgtcgccgagctgaacaaccgaccatcccaacaaggcaatttcagttgatttttgtttacatttaacaaaatgcgcattttgttaaagcaaacaaaaatcttttttatatcaactaaaagaattttaaaaaggcagcgggagtgccccattagctcagtcggttagagcgctgtacttataagtgatgggatatgcagaagtcggcggttcgagcccgccatggggcagttattttttacattttttaaattaaa

SEQ ID NO: 46777 - DNA, 826 bp, Heterodera glycines
  Genomic contig location: Contig_ID=SeqID_44386; Location=136..961; Strand=-
  SCN-specific regions: Sequence locations=1-152,175-288,315-411,434 -449,491-826
  Gene Ontology: Cellular component=cytoplasm; Biological process =regulation of protein activity, epigenetic
atggaaagtggcgggggctcgtcgacggacgcggagaactcgcgacgcgaaaacgacgagacggctgacgacggtcgggcggaatctgttggtttcgccggtctccccgccggtgcagaacgactcgacgcagcggagctaagcagacttcgtcagcatgaacttttcctctcgcgcattgtcgaaaccctaccagccacacaaattcgtggcaaatgttcggttgtgattctgaacgaggtggagacgtgcgacatgtatttggaccaagaggcaaccattctcgagacaccaacaaaacaaaaataatacaatttttaccccttaaaggactctttcttctattctttggtttacgacccgaccaatcaaacgcttctcgcggacaaaggacgaattgaaatcggagaacgataccaagcgcaaattcccgaattgactgttagccaagaagaagtgaataaagtgaagagagaaggggaggaagagaccaccggacggacggaagtgcgatgtacggacaaagagttcgtcgtgtaccacccgcaccaccggctcagtgaccgcgacatcgatcagtttctgatcatcgctcggtccgtgaacactttcgctcctatttataacaagttcaatcccttttagcgctgtcggaatattttctcgcgctttggacggctcttcctccaccaaattgaccactctccaccaaacggcgtcggccgcctcgcgcgacatcactttgctacacgcaatggcacttcttcaccaagccgactactccctaggacaagtcttttgccgtgttcaattgctgttttgtaaa

SEQ ID NO: 46778 - DNA, 648 bp, Heterodera glycines
  Genomic contig location: Contig_ID=SeqID_9559; Location=488..1135; Strand=-
  SCN-specific regions: Sequence locations=1-648
atgtggttgcaagcgttcatcgcttattggggatacactgccgattatgacggtaatccttcaattgttgcgatattggaacgttcgttcccattagtctacgaatatggcgaagacatcaggaagtacggtgaaaaagatcgcgtccttgtcattgtgaaccatcagagcaccgccgatgtgcccactttgttcactgtccttcaaacaaaaggcgtggccactcgaaaggtaattgggtcagctgaaagttcaaatggggcgcaatattcagacgatttggttgatggatgtgatgtttcgttggacaccttttgggattatcggacgaatgcatggcgattatttcattcagcagggcaaagcgacgcgagacaaagaactgatcagactgaagggacacctccaaaaggtgggcactcattgtcagtcatgtaaacactgggcataattatacgatactttcaggtgttttgggacagagaccgacgttgggtcattcttttcccggagggcggcttctactacaaaagaaaagaaaccagccaaaagtgcttttactcaattttcactgtgaactttttgttttcagatatgccaaggagaacaactttccccacttggagcattgcactttgccgcgaatgg

SEQ ID NO: 46779 - DNA, 715 bp, Heterodera glycines
  Genomic contig location: Contig_ID=SeqID_9559; Location=457..1171; Strand=+
  SCN-specific regions: Sequence locations=1-715
agaataattttgtaattaatctgctgctcacccattcgcggcaaagtgcaatgctccaagtggggaaagttgttctccttggcatatctgaaaacaaaaagttcacagtgaaaattgagtaaaagcacttttggctggtttcttttcttttgtagtagaagccgccctccgggaaaagaatgacccaacgtcggtctctgtcccaaaacacctgaaagtatcgtataattatgcccagtgtttacatgactgacaatgagtgcccaccttttggaggtgtcccttcagtctgatcagttctttgtctcgcgtcgctttgccctgctgaatgaaataatcgccatgcattcgtccgataatcccaaaaggtgtccaacgaaacatcacatccatcaaccaaatcgtctgaatattgcgccccatttgaactttcagctgacccaattacctttcgagtggccacgccttttgtttgaaggacagtgaacaaagtgggcacatcggcggtgctctgatggttcacaatgacaaggacgcgatctttttcaccgtacttcctgatgtcttcgccatattcgtagactaatgggaacgaacgttccaatatcgcaacaattgaaggattaccgtcataatcggcagtgtatccccaataagcgatgaacgcttgcaaccacatgtacaattttccctcgtaaaaccaataaaatcgtgg

SEQ ID NO: 46780 - DNA, 479 bp, Heterodera glycines
  Genomic contig location: Contig_ID=SeqID_44509; Location=17..495; Strand=+
  SCN-specific regions: Sequence locations=1-101,123-124,147-479
  Gene Ontology: Mol. function=signal transducer activity; Cellular component=cytoplasm; Biological process=embryogenesis and morphogenesis
atgcgcgggggtggcataacgcagcaacaacaagcgattggcaatcatccacagcaaatgctctgcgcgggcagcggcggtggacagccgcaggaatcggtgaagcgcaagctgatccagcaacagttggtgctgctgctgcacgcacacaagtgtcagcagatcgaacgggtcggtttttatcctaatttccattggtttcattcatacattagtagtgtctttttttatgttcgtgagaactgcaatagagccgtcgggtcgatccccccccccccccacatttctaaaatctctattttcagtctgaactgcgacaaaaccgtgcgccctgcacattgccctactgctcggtgatgaaggccgttttggagcatatggtcggctgttcggccgggcggcagtgtcagtacgcgcactgcgcctcctcccgggaaatcattgcgcattggaaggactgtcacaaggacgactgtccg

SEQ ID NO: 46781 - DNA, 472 bp, Heterodera glycines
  misc_feature (60)..(60): n is a, c, g, or t
  Genomic contig location: Contig_ID=SeqID_44582; Location=1033..1504; Strand=-
  SCN-specific regions: Sequence locations=1-227,251-472
  Gene Ontology: Mol. function=7-alpha-hydroxysteroid dehydrogenase activity; Cellular component=mitochondrion; Biological process=lipid metabolism
gcgtgatggcattgctcccggcttaatggacacgccattgctttcctcgttgccaccaanagtttcttcaataatattttctgggtttttcgcaatatcgtttttgcacaggtcaaaaagttcctttctggcactgttccgtttccgaaccgattggggaagccggaagaatttgccgcattggtggagcatatcatcgacaaccattacttaaacggcgaaatcatccgattgggtgggtttattggatgactttgattaaagtttatgcaaagtttaattgattggatgtgtttagatggtgggattcggatgaatgcttgagaaggacagcagcagaagggcaccattggctctttgatcacttttgttgactttttatctttgcattgttttttgttgtgcgtccattcccacgaccctttggattttataaattgccaaaagcaatcggtggtcatttgtcttttat

SEQ ID NO: 46782 - DNA, 664 bp, Heterodera glycines
  Genomic contig location: Contig_ID=SeqID_44590; Location=154..817; Strand=+
  SCN-specific regions: Sequence locations=1-53,75-369,392-664
  Gene Ontology: Mol. function=calcium ion binding; Cellular component =translocon; Biological process=intracellular protein transport
ctgctgcctgcgagtcgcccaaatactccgccaacggttactccacgcaagacggatttttccactacaaaacttcttacattgttgaatttgcgatccaatgctctaacaattacaaggtttgcccatctttcgtaaatcgagaatctctcatttttattgttttcattttgagcattatttttgcttttttcaggacgcgccattctacgcactggtcggtgaaaaaacgctccaattggctgtgtctgaggagaccaacaagtaccaggtgtcctggcaattggaacatgccgattctggtgcacaaacattcgatattcgcgtttatgacgaagacaaattcgcggagcacaaaaaggtttcacttactttcaaatttaaaaatttacattagtcctacgaaaattttaaaatcttgttttttttaatttgtgtcaatttaaaaaaaaattctgaaaactctaaaaccactggatttttttctttctaggccgatgagtccggctcaagttctgtccaaccattgttcactgtccagcattaccacggcggcacctctcacaaaacgtggatttcctcagagtccgtcttccttttgttgggcgtcgtggcgctgtactttacgatgaatttacgccaattgttggccaaaagagactga

SEQ ID NO: 46783 - DNA, 1786 bp, Heterodera glycines
  Genomic contig location: Contig_ID=SeqID_1302; Location=9607..11392; Strand=+
  SCN-specific regions: Sequence locations=1-168,190-397,423-689,711 -831,854-1167,1189-1344,1366-1371,1393-1438,1460-1466,1488-1647,1670 -1786
atggttcatcaaatatttgaccccaattctgttgattttgatgattttatgctagtagagcaggttggatcgggagaaacctataattattttcgtgggattcccccataccaacgagggtacggaaggcagcgtgggggaggagtaggagatattctaaggttattatggagaacaattctaccaaaattaaaatccgctggcacggtattgggtagagaagcactagacaccggaacacgtgtattggacactatagagaaatctgaagcaccaaataaaccatcaataatcgccgaagtgaagaagggagtggataatattctcgaaaagggaggagttggtcgtcaattcggaacgggaagacgaagaaagagtattaaaaggaacgcgataattggaaaaactgtacctaaaacagtgataaacaagagaaaaagatcggacgtatttggaaaactattttaaaatggtctttaagaaaatagacaaagagtcggtaaactctataacttcagctttatcaatattcagccttccaccaactaatgtgtctgtgagtagttcttcagtgcgcgaatatttaccccttaaccccttaacggacattcctttccactttaaaattcaccctagcgccagtttcatagacctaaacaaatgttacatcttaaccgaaatgtccattaaaaggttcgacaccgacaccaataaatatgttaatttgaaagtgaatgagcaagtggcgacaatcaacatgatcggtgtgacatggataaagaatataaaaatcacggtccaggggcgtgagatttatgactcaaattcactttatgcttataaagcatacttagacaccgagctttcttattccaaaaacgtaaaggaatcagacatgcaggcaagcgggtattacgtggatagcgagaatcaggacggtacggatctttcccaaccgggtttcgaactgagaagaaaattgttttcacaaagtcaaactgcacaatttattacaaagttggatgcagatgtgttcaaccaggacagatatatggtgaatggtgttgagattgatatacaacttacccctaatgataatgagtttatgatcatggcggcgtcaaacgataaatatagaatagaaattaccgcttgcaagctttacgtaaagaatcttgaagtcgttgatggtctcgcactggacattcagaaaatattggaaaacaaagaggcaaaatatgcacaccgtaaaacattgatcaaatccatatttataagtgagaatcggactgaatataatggaacgctatttacgggtcaattgcctaaacgggtcattctcggaatggttgagaactctgcgtatgtaggcaaccaaaagaaaagcccatttaactttaggccgtttgatgttcgatccgttacattgacggccaatggaaaacaatggcccgcagcaccatttgagcttaatttcagcaaaaacttatatacccgggcattccacgaaatgaacgaggcgctgggtatggccagttcaaccgacagtaacggaattactctcgagaagtacagaaaggggtggacaattttcgctttcaatatgacgaatagcatggaggagaacgaatgcatagatcttatcacagagggcacaacgacagtgtccatactatttaggtcaccggtcccagcgggtgggatctcactaatcgctatgagtgaaatggactcaattttgatcttggataaaaaccgaactgttatgactgatacaaccgtttga

SEQ ID NO: 46784 - DNA, 259 bp, Heterodera glycines
  Genomic contig location: Contig_ID=SeqID_44627; Location=1112..1370; Strand=-
  SCN-specific regions: Sequence locations=1-48,70-259
  Gene Ontology: Mol. function=adhesive extracellular matrix constituent activity; Cellular component=collagen type XI; Biological process=morphogenesis of an epithelium
ttcctggcccgaagggatcgccccggcgcgcctggacaacccggaaaaccccggcagccaaggccaaccaggacagcccggcggccaaggaccgcccggaccccagggtgcgcctggccagcccggtctgcctggaaactctggtcagcctggacagcccggagcgcctggccaacccggcaaggacagcggctactgtccgtgcccgccccgctcctccgtgctggcggtcaagaagaagatggcagccgcggtggtt

SEQ ID NO: 46785 - DNA, 924 bp, Heterodera glycines
  Genomic contig location: Contig_ID=SeqID_44639; Location=1..924; Strand=-
  SCN-specific regions: Sequence locations=1-61,83-129,151-331,353-924
  Gene Ontology: Cellular component=nucleus; Biological process=N signaling pathway
actccgatggtcactttggaatcgcatcgcgagcctgtggtcggctgcgcgtggcatccgtccaacttgagccaggcgatcactgcttcatgggaccatcagctgatgctgtgggacctccaattggcaggtgatttttgggaagggaatggatgcgcaaaatgaaatttgtccacttaatttggaatttttggtctaaccctcgcgcaacaaataaatctcgaattgggtcggcattcaaaatgtccctttttctgcctttttaggccccatctccacgctgacttcgaataaagccttttccgcactttccgtctgtccggccaatggccttgtgctgacctcctctgtcgattcgttggttcggctttgggattttcgttccaggggttggtgacccaactaaatgcccctccccttttttctaattaatttcgccattagatggctcaatggtcaaggcatcgttccatggtcatgttggcgttgtgtccgatgtctgttggcactcaaccgaccagcatttgtttgtttcggccagctttgacaacacagttaaaatgtgggacgtccggtgagtttctggcacaagcgtcgagtaggtatttagcgaatgattaaaacaaatttatatttagaatgccattattagtactaaatattgtcttcataaatttttgactgtggaggggggggggggggggggttgtatttcgaggatttgaattttaagaaattctttttttctgttgctctaatgttttttgtgtccaattttagcagccccagggcggctctatatgatttgatgggccattcggaccgcgtgctgtgcgttgattggacagtgccgagccgtatttgcagcggttcggtggactcgacggtgaaagtgttctcacatgggaccaaagaaaatatcta

SEQ ID NO: 46786 - DNA, 1204 bp, Heterodera glycines
  Genomic contig location: Contig_ID=SeqID_9645; Location=570..1773; Strand=+
  SCN-specific regions: Sequence locations=1-485,509-798,822-972,994 -1204
  Gene Ontology: Mol. function=ubiquitin-specific protease activity; Cellular component=endoplasmic reticulum; Biological process =skeletal development
attctgttgccaaattcgtgtctcgacaatttgatgcgtcgcaacattcagtacccgatgctcttcaaattgactaatgtcggcccggcccttcagaggggcacccatgccggtgtgctggagtttctggcggaagaaggccgctgctatttaccttcctgggtgagttctcggaacagaaacaattaaaatttcctgttttaattgcattggatcaatttctctattcagatgatggcccaactcgctctgagggagggcgacctcatcaccgtggagtacaaagcgctcccgaatgccacttacgccaagttcaagccgatgtccaccgacttttacaacatttcaaatccccgtgccatgctcgaggtttgactaacatttatcgagcggttgataaatcctttttccacaggtcgaactgcgcaagttttcctgtctgaccaaaggcgatgtcatcgcagtgcaggcaagcaatcacgagaattgttttttaaattgttttttgatgtcctgccattccctcccacaattgttcatttgttcatttcagtacaacgaacaagtgtacgaattccaagtgaaggcactgaagccggaaaatgcggtgaccatcgtcgagtgtgacataaacattgaatttgacgctgcggaaggctacgtggagccgaacagaacgcatcaacaacggaatgagatggtcgcagcggaggaagaggtgaacaattagcgtaccaaaagaaaaggcaaataaattgactaattttgtagcagcagtcgcatccacccaacgtgttcaaaccgttctccgggtcagggtttcgtgtcgatgggaagaagccgcgatcggtctcaacaagttcacagcaggaggcgacgagcagctcatcctcttcggcatcttccgggcgacaggtaaatggcatcggcatttcagaaatggttgccttgccttcatccaagtctaatcacttcctttaagccttcctctgggattgcttcgactgcgtccactgcgcgtgacgctttggaggcaattgctgtggacgaaaattacatccctggggagttgcgttttgtgcgtcgtccgtacaaaagcaaggcacaaagggacaaagaggcgcgcgaaaaggacaacggagggacgatgaagccattcggaggcgaagggaacacaatccgaccgacgcgaggcggacaatga

SEQ ID NO: 46787 - DNA, 1341 bp, Heterodera glycines; identical to SEQ ID NO: 44752
  misc_feature (1215)..(1215): n is a, c, g, or t
  Genomic contig location: Contig_ID=SeqID_44752; Location=1..1341; Strand=+
  SCN-specific regions: Sequence locations=1-138,160-290,312-368,409 -615,640-657,769-856,903-1063,1085-1150,1173-1224,1253-1273,1301 -1310,1338-1341
  Gene Ontology: Mol. function=protein binding; Cellular component =nucleus; Biological process=wing morphogenesis

SEQ ID NO: 46788 - DNA, 1654 bp, Heterodera glycines; identical to SEQ ID NO: 44767
  misc_feature (72)..(72): n is a, c, g, or t
  misc_feature (115)..(115): n is a, c, g, or t
  misc_feature (1625)..(1625): n is a, c, g, or t
  Genomic contig location: Contig_ID=SeqID_44767; Location=1..1654; Strand=+
  SCN-specific regions: Sequence locations=1-212,242-371,395-426,448 -680,702-877,899-1113,1135-1654
  Gene Ontology: Mol. function=ubiquitin-protein ligase activity; Cellular component=plasma membrane; Biological process=sensory organ precursor cell fate determination

SEQ ID NO: 46789 - DNA, 1221 bp, Heterodera glycines
  Genomic contig location: Contig_ID=SeqID_44782; Location=1..1221; Strand=-
  SCN-specific regions: Sequence locations=1-470,525-602,626-1221
atgctccccacggcgctgttgttgtgcgcatcgatcgtttttatgacgaatccatcggttgacgccgaaatttctatcaaaattgaacgccatttcccatgttccgccgcttctggtgcttcgctatttttttaagcaatttgaaaacatttcaggtccaaaaaaggagaatctgatcatcaaattccccagctacaaatccacgggtgtcgccttcaaagaagagaaggacgacgcgggccacaaatgctttcaaatgggcggagggaaagtggaggtccaagggacggaggagaacggcacaatgccaaaagctaatggcattttttgaaggtgtatgctccaggattggacggcaacaagaaatattacgtacacgtggagacaaggattggcatccacgggaagccagagagatgtgtgaaccctgacaaggagggatgtggcggcatagggtcgtggtaagacaagaggagaaaggcggatggggaggggggaggaagaaggagggaacggggggagggatgacagtgtaatcgagagtctcgcccttgagggcttctcaaaatgtcaggtcatcggaacaattgccaacaaactctaaaaaatactaaaactaaaactttcagtttttctgtatatatctttttgattttttcggattctccgtttttcttgaaattctcgagcatcaaaatgataattcgttacttttgtgtgtggtaagtgcggtggcgaagggcttttgaatctgtcaatttgtgagtttctgtctgttgtgatgctccccgccccaattctgtccctctgactttcccattttcttttaagtgtccactgcgacatttgccaaacgattggcggttttcgccagttcatccaaatcttcaaaggggataagccggcggaatgcagcgccaaaggccttccccccggcacttatgacaatttgtcgctcaaagtgtgccttcccagcaaagacgagctgttgcccttcctcgaccaagtcactcccccccccctctcatttggttcacttttcctctcagaattcgagtcgggctgaacaactttgggatgttttcgtgagcagtcgcgctcgttctggcggagtaaatttcgaattagccgcttaaagcgaatcttttcttaggaaatccctttggtaatcgccgcccgcaatgtcgaccgcccaatcaacaaactttccatcaaagaact

SEQ ID NO: 46790 - DNA, 1767 bp, Heterodera glycines
  Genomic contig location: Contig_ID=SeqID_117; Location=757..2523; Strand=+
  SCN-specific regions: Sequence locations=1-358,381-1453,1475 -1533,1555-1767
atgacacatgtgtttttcgatcccgagtcggtcgattggtcatcttttatcactccccaacatggaagaggacagaaacaatattttgtcggaagcaagtatcaacggggattcggtttcctcggtaatgtggcacgtttcttgacccctattgcgaggaatattgcctcgagtgcaggacatgaggggctcgccgctgggcagagagttctgagtgacatcgcccagggtcgtgatttaagggatgccgtcagggaacattcaagacaggggttgactaaccttaccgacaagttacaacaatgtgggaaaggaaaaaggtctctgatcactaataagaaccggaaacaagtatatgatcagttaagtttcatctaaaggtataaatggaataaataatacaaaaagttaaaaatgacaactctcaagaaaatcgacacggcgagtgaggacggtctcgaggggggcctttcacttttcgacatccctccgacgaacgttgcaattaataaatccagtattcgggaattgctgccactttcagcaataaatcaatctggaccatatatctttagacttttttcagataatcagttttgtgatctcaataaaacttttctttatttgtcaacttcaattgagagaaaagacaaaagcaattggattccgattaccaaggacagtgaagctgaccaacacgtcggtgtcattcaaaattttgggcacagctttgtcaaaaccttaaaggtgtcaatttcaggtgttgagtcttatgattccggcatttactatgcgtttagggcatatatgatgaatgaattgggattttcagaagatgtcaaaaagggtctctgtgaagcgtcctgctattatgtcgacgatgtcgaccaggatgattacacaaatagcggctttaaaaacagagcgtcacgttttgctgatggtgccaaatgtgaaaccatggtgaaacttaattttgatctcgctcgtcagcccaatctattgcttaataactcggatgtcatttttagcatacaccgtaacaccgatgattttctaattatggcaccgccatatgtttcaggaaatgcagtcatagcgaacccgcacacatatcgtattaacatacatgatattagaatttatgtaaaaacagtcgacattacccagtcattaaataacgtaataagcaatcagctacaaaccaccccggccaaatacccggttagaaaaattgagatcaggagtcttttcatcccacggggcacttctgatctctcacacaatgtttttaccagcattgttccgagacgtttaatcgtcgggtttgtttcaaccggtgcgtataccggaaatcctaaagagtcacccttcgtctttgaacatgccaaaatacgctctatcagtgtcgaagcgaatggaaacattttccccgggtccccctattctcttaattttgatagaaacaaatacattcgagcatttgttgacatgtatacggggctcgggatggacgacggagaaaggacaatgtcgatcaatatacaaaaatttgtaaacgggtggtgtttcttcgtcatcccgatgacctctactctagaggacacccccggttttgaattgattcgaaacggaacgaccagcatcaaggtgcaatttaatgagcctataaaggacggcgggtatgagatgatcgttctgggggaatttgattcgattttgtctattaatgctaatcgtgtgctcagtagtgacggaagcatatga

SEQ ID NO: 46791 - DNA, 1842 bp, Heterodera glycines
  Genomic contig location: Contig_ID=SeqID_9667; Location=1..1842; Strand=-
  SCN-specific regions: Sequence locations=1-952,974-1094,1116 -1132,1155-1377,1400-1842
cagaccaagagaatggcaatccaattctcccgaccatttttggcccaattggaagtgacgttggcatgaagagtttgttcggctttgattcttacagcgatgtaccttttttttaaattttgcttttgtaactcttccatttcaggtgttggctgatgttgtttgtgacccaaatttgccattgccattgaccattggactttacgccaaatggggttcaggaaaggtgggctaaccattttcatgacttgtctcattgcttccttccgtttctataaaatttgctaatatccctctccaacttctctttaagtcgctgcttttgcctcggattcgcgattcgatgagcgccttctcccgcacttggctggacggggtcgagctgtactggtcctggtccctcgtgctgtccgtcctcctttcctccgtctctctttcgttgttcatctccgcactttcggcacttattcttcaaaattcacattttctcatttcccttggcgtcggagttggcatttttttgctctttcttcttctctacggatttatttactacggcagtgaggtgatatcataattttaaaaatgtttagcgatacctttctgttttaattgcctattttatagcagttttcctttaaattgccctcgtttaggtcaaattttggaacgggtcaatcgccaccgctcgactgattggtcgttcaattgcccgtttcaaattgatgctcaatgttttgtttctgaatgcgcccgtcagaagggaaaagagtcgaaagtgatgaaattggcactctgtcccttaacgaagcaaacctaaaaaaattcagaattatttcgccggtgagttttctctttgccgatgaccaccgcctttctttcattggcggcgaacactctttggccaacattatccaatcgtttttcaccgctgccgaaggtgtacaaatttattattataaatcaaataaaagggaaatgccctcagagcatttcggcactttggctgtccatctgttcaccactctccgttcgtcctcgccttcccttctcgccgatcgttcctccaaattgaagagttactgcggtgtgcccgtgttggtgctgactttggcatttccctgctcactggtctccgcttctttgctgttcatccaaactcggcattggctcgcctccgtttttctcgccttggcactcgtctcgggcgccttcattctttacattttcagtgctcgcattttcgtcaatttggttggggttccggaagttgtataagtcttcgaagttatcccttatttttaagccaaaaagacgaattacgcgaatttctgatcggttgcatttgatgccattcgaacgaatgatccaaaagctgcagaaggaggtcgaccttcttgtctcattggtgattttttcgccattattttccccattttttgtttgatcttttgttcatcaatttaggtgttcgctttggatgaattcacttcgagtcagacacggctggtcataatggtggatggacttgacagttgcgaatcgaacaaaatggtccaaatgttggacgtaagtcagtttggatattaaaattaccaaattccatgggtaatttatttcctttttaaggcactttcgttgtttttctgttcacgtcaaaatgcgccgttcattgttctgctcgccatcgacccgaacattgtcgtgtcgaccattcagcagaatttgcggacaaatgcgggcccggagggaggcggaatcacaggaagagactatctgaaaaacatcgtgacaatgtatgtatctgccctttctcaattctttgaattattaggacaaaag

SEQ ID NO: 46792 - DNA, 736 bp, Heterodera glycines
  Genomic contig location: Contig_ID=SeqID_44857; Location=606..1341; Strand=+
  SCN-specific regions: Sequence locations=1-49,72-736
  Gene Ontology: Mol. function=damaged DNA binding; Cellular component =nucleus; Biological process=meiotic recombination
atgtcctattacaaaacgaatcgaatgcgtttgttggatgagaacattggtgacattaaaatgcaaattgtggacgcggaaacgaacattgtgcttaagtgggtcaattaaaatgcaaaattgtctaaattcttcttcgttttcagtttacaaaaacgtattttggacagcaaagaggcggtgctcagtgccgtcgaattggccgccactttggactgtctaatctcactgttcgttttctcgcatttcttttttaaatttcaatttcagttccgttgttgcccggaaatacaattggacacggcccaaatttgtggaggagtcaattgtggccattgagcaggcccggcatccaattgctgaacacatttgcaaggatggaaaatatgtgcccaacccagtgcagtgagtgatgcactttttcaccaattcgcttcaattttttatttcttcagtagttccaccgaagtcggcaaagtcaaagtgctttcggggccaaatgcatcgggcaaaagcatttacttgaaaatggtgccatttcgtctgcttttgtctccactttttttgttttgcttaggtcggctccatcgtctatttggcttgttgcggttcctttgtacccgcccaacgtgccaccattggtccgatcagccgcattttgtcccgtctttacaccattgactcggtgttggacggaatgtcttcgtttgccaacgatcttaaacaagtactgtaa

SEQ ID NO: 46793 - DNA, 1142 bp, Heterodera glycines
  Genomic contig location: Contig_ID=SeqID_44903; Location=30..1171; Strand=+
  SCN-specific regions: Sequence locations=1-66,88-348,371-399,423 -829,860-966,988-1055,1077-1142
atgaatttcctttaatccaatggaaaaaattgggataaggggcaaacttttaattgggataaagggctttttgagtaataggccttttcgtgttaaaattggggatgatttatcctccagtaaaaaagttggctctggcgtcccccagggctctgtccttggacctttattatttttgatttatattaacgatcttcctgatgctttgccatcaggagtaagaattaaattatatgctgatgatgttaaattgtatatttgttataaagcaagaaccgaaacagaaattatgcataaagcattgcataatttatcggaatgggcaaataaatggcagatcagaatctcaattaaaaacacttttgtacttcatttggggaataaaaaccccaaagaaatatataaaattggtggaaatataataaatgtcgtggatacaattagggatttgggcataaatattgataataaattgcaattttccaatcatgtcacacaaataataaagaatgcatattacgaatgcgttctttatttcggattattaagtcaaagtcttctaggatttggattattttgtacaaaacttatgttagaccgttattggaatatgctcctgaggtttggaatctatctattcaaaaaaatattaaaaaaattgaaaaatgtcaaaaatatttcaccaaaaaaatcatacaactttgaaccctagttataatcatttttatgagattttattttttcgacttaattattttattccttttaaattcacaaaaattctaagattcaatttttctcattttattttttctgaatttccagtggaggggggggggggggggggtggccccgggcgttgccgatagagcgcagtcgggaaaaaaaactttcattgcaatttttaacagaatttgttaaaaattgctaatttttgaaaaattcaaaaaaatcgactctttatcaaaaattttggaaatcggaattccgacgtccaaaaacgtctgaaattggaattccgtaccatcccctggtaagcatactataataaagttctttatgtttctttccatgccaaatcagggggttttaaatactgatgatcgatcattaattacctaattgcatgaaataaaattact

SEQ ID NO: 46794 - DNA, 1156 bp, Heterodera glycines
  Genomic contig location: Contig_ID=SeqID_9682; Location=177..1332; Strand=+
  SCN-specific regions: Sequence locations=1-1156
  Gene Ontology: Mol. function=electron transporter activity; Cellular component=mitochondrion; Biological process=aerobic respiration
atgttttcaattgttggaaaaaaggtcttcaacactacctcgtgcaattttctttcgaaggcattttacgctcatatgagcaaagatgaaataatgtggcattggcctgcgcagagtaaattttgttgtttttttcaattttgaatgtttgtctaaatgttacaaattctcagaatttgaccaacatttcatcgattacttgaacaagccggacattgacgggtgggaaatccgaaaaggtacaaaaccaattttgaataaattacacattttattgtacgctgattccttcttgcataatcgaataaggtcttcatcctaacttttccttttttagctctcactgaactcgggaactttgacgtggtgccagaccccaaagttgttgaagcagcgctcagagctattcgccgtgtcaatgactttgcgcttgccatccgttttctggagcagattaaatacaaatgtggtggacccaaaagccgatccattgtgtatccgtatatcattcaagaggtaatttgtgacgggcattaccgcccggtatagaacgggatcccgcgcggtttgtgggatcgggatcccattccgcattttttggaaaatgtgggattagtctcagcggtatgccattctgcaaaattttgagttccaatcccgagcgggattcgcggtttttagttcagattgcattgcatttaaaaaaaggacattgacaaatatttttctgaataaactttgaataaatccaattacaagatttctgtaaaatttcccggcggtgccttcggctcgccgaatcagcctaacggacggcgtttaccggcactgcaggactatttatttttttttgaaaaagcgtgccgcaaaaaacaacataaaatcgtcaaattttatgagttaatcccattaacaaactcacgacttctctccaaccctcggagcccttaggaaaatctaggtctattttctacacgaaaagtgattttattttttaacaattaacttgtccgaaaaataattaatcgaaacgactcattgtcaggtcaaaccggtgatggatgagttgggcattccgacgctcgaggaacttggctacgacgagcccgaattcttcactcccgaccccgagtggtactgggagaagtcctggtaa

SEQ ID NO: 46795 - DNA, 1251 bp, Heterodera glycines
  Genomic contig location: Contig_ID=SeqID_9683; Location=1173..2423; Strand=+
  SCN-specific regions: Sequence locations=1-110,143-207,235-255,294 -454,476-549,585-591,616-700,726-773,796-820,860-1051,1073-1251
  Gene Ontology: Mol. function=structural constituent of muscle; Cellular component=muscle myosin; Biological process=regulation of muscle contraction
atgggcggaccagttgggctactgctgaacgcccaaccaatggcagagatcctttgtgtttggatttggggctttggagtatccgtccggtccgatagggacaaacacaagtgatgaggaggggggaggggtaaaggagagatcaaagcgaccgcaaacacaaatcatttttgttttcgaaaaatcaaattttaacactaatattaaattgattagaaaagaaataaaatggtaaaacttataaaattaatgaggtaattaataaattttcacaaataattataatttaaaaagaacgggaccattagcctttgcccatagcacaacatcgccatcattttcattaacgtaaaaattcattcatcgacttttcattcccaggaatgctttgcagcattagtcattcactccgattacgatcgcattcaaccgtcagtcttttccttcaccgtttttatttataaaaatgacattttctaacgttcgtttgtttgtccactttgtacctttgaacacatacctctctaaatattcatacttttctcattttacattctttgaaaagctttttgcaagtgttttggatttgcctatttttaaaaaattatttttaaaggcaaatcactttttattgtctctgttattcaatggctgcgcgaaagactgttgcacgccgtgcccgaccgcaacgggcgaccagcaatgttttcgccatgttcgaccagccacaaattcaggtggtgaataaaaaaacagtttatcggtaaataaattgaataattttgtgaaaaatttcctttattaacaaaaagacttgttaaggagttcaaagaggcgttcaacatgatcgaccaaaaccacgacggatttatcgatgagcacgacctgaaggacatgttcgcttctcttgggaaggaagtctcggaaaagttcattgaaaatatggtcaacgatgcatcgggttctatcaatttcacaatgtttttaacgctttttggggagaaattgactggcactgaccctgaagaggtgaggcaagcaaagtatgggaaagaaagttttaatttttgccgtttttatgtgcacaattttaagggatttaacaaaaatttataataatgggtcaaatccagaggggatggattgaaaattgagccattttgaatacccttaaaaatttaggtgatcaaaaacgcattccaatgttttgatgaggacaacagcggaacaattgcagagggttggacttaa

SEQ ID NO: 46796 - DNA, 686 bp, Heterodera glycines
  Genomic contig location: Contig_ID=SeqID_44934; Location=1..686; Strand=-
  SCN-specific regions: Sequence locations=1-38,60-686
tgagattgtgtcgcttcgtccattctctttaatattacaaattatttcattgccatttcctcaggtggtgaaatccagcacacttctcagcttgttgaacaaattgcgagtttgcatctgaacgacgaattcagtgattttgtgttggtcgtcgatgatcaacgttttcccgtccatcgagtggttttggccgcacggagttcatatttcaagtaggggaggggtttagatgataaccaaccgaatgccaacttaaaagggcaatgctttacggtggcatgcgcgagtcatcggaaagcgaagtcattctgcacgatacgcccgtccaggctttccaagttggtccagttttatctgattaatgtttttttgctgatgattttctgttttttaggcccttctcaaatacatttacactggcaaattgcaactcaaatcgttcgagctcagttttgtgttggatatgctcgccctggtccataagtacggcttttccgaactcgaagctgcaattccggaatatttaaaggtaacaaaccatacattctttctaaaaaaattctctatcgatttagaccattttgaaagttcgaaatgtttgctccatttttacggtcgcgcatttgtactcaatcgaaggactttctgccgcctgtttggattttatcgataattacgcttccgat

SEQ ID NO: 46797 - DNA, 1399 bp, Heterodera glycines
  Genomic contig location: Contig_ID=SeqID_44979; Location=1..1399; Strand=-
  SCN-specific regions: Sequence locations=1-74,111-243,265-606,628-1399
  Gene Ontology: Mol. function=calcium ion binding; Cellular component =intracellular; Biological process=digestion
atcgacgaccgattgccctgctcaatggagggcgagttgctttacatgcactcgcaagaactgtcagttggaataacatttcaaaaacatttttaatttcattgttttttggttttagaaacgaattttggagcgctttgttggaaaaagcatacgcaaagtaagcgaaacaattggaaaaaagcattatttttttagaaatgttttcgtatttcaaaaatcgcatttaaatttgaattcccattcgacctcttcaggctgtacggctcgtacgaagcgctgaagggcgggacgaccagcgaagcattggaggacatgacggggggactgaccgaattcttcgacttgcagcagccatcggagaatttgatgcaggcgaggcaattgggaaaaggatttaacaaagggagacaaattgttggcagagaattaaatagttgctttcaatttcgacctcacggagtttaattccgaaattccgtcgctaattgcattttccaagtcaataatccttttggcgtcgtcccaatttatcgcaaaatccctcccctctgcagatgatggcccgtggctttgagatgggctctctgttcggctgttccatcgaagcggacccccaagtttgggaggcgcgactgcccaacggattggtcaaagtgcgaaaagcgcagaatgagaaatttaccgggttctccctttttgttttcagggccacgcctactcaatcaccggcatgcgaattgtgccgaccccgcggggcgaagtgccgttgttgcgaattcgcaacccttggggcaacgaccaggaatggaacgggccctggtcggacaattcgtcggagtggcgacagttgtccaacgaactcaaaacggacatggggcctcacatttgcccacgacggcgaattttggttggtcaatttttccatttcactcattttgttttgggttccttttaaggatgtccttcagcgactttttgtccaattttgaaaagatggaaatttgcaatttggggcccgaagttatggaggagatttacgaaatgaccggcgtcaaggcgactccgcacaacgcgtgggccaccgtcgcccacgacggctcgtggcgtgcggggcgaacggccggcggatgccgcaacaatttgcgtacgtttcttttgggttaattgactcttatatcgcttttaaggcacttttgcgctgaatccgcagttccgcatgaaattgaccgactcggaccccaacgacgacgacaaactgtgcaccgtaatcatcgcggtgatgcaaaagtatcgacgcgagttgaagaacaccggcgtcgagaatttagccatcggatttgctgtttatgaggcaacacttttttgggtgcccaggggggggggggggggggaaact

SEQ ID NO: 46798 - DNA, 2289 bp, Heterodera glycines
  Genomic contig location: Contig_ID=SeqID_1318; Location=174..2462; Strand=-
  SCN-specific regions: Sequence locations=1-166,188-286,310-1468,1490 -1515,1538-2289
atgacaaatgagcgtgatttttctcacgatgaccacattaacaacgctattgggaccaatggcgacagtaaagacgcagccaaaagaaaggacatctgccgtgattttctgaataatatttgcagcagggtatgttctctctcacttttattttattacaaatcaaacactaaatatttgaggggaatcgatgcaaattttatcatccggaagacagtgtcgaaaagaatcaaaactcggcggatgagccttatcagttctgcattgattttcaggtttgttatgcttctttctcttaattgcttttgcgcaaaactttatagtcgattagcgataatttgtactcgttttcctgtcatcccagcaacctcaatttttgccataacgttggttgccataacaaagtgttgggagggtgggaaggttcgtatttatggcaatcctggagaatgggtgtccctaatttaacttttttttattttgagctcaaaatcagttttcgaggatgctgattacgaatctgaactctgatttgccttattccgaaccccgggtccgaattcgaacaaaaagttgaaaattttttttccaaaatatacgttaaaatcggtcaaatttttagcgcaaattgcatatttttccaattaacaattgaagcattgttttacatcaaaataaatagtttttaatgtattagaagcttttacccaaaaaatacattattgaaaaaaacattcatttttttgttcgaattagggttcggaattgggaaaatccgagttaagatccgtaatcagcaccctttaaaaccccttccgtaatcagcaccctttaaaacccctatctggttttgagcccaaaataaaaaagttaaattaggaacacccattcttcaggattgccgtattggcattaaagttcgattaactcaaaccaagactaaataattgtatcacttattttatttattactatctgtctattatgttcgctcaagatttttccttaaatggacaggcgcataaataggaatatttgctttcactttctgcggtggcggctaaaagtccatttatgctgcaatttcagaaccagggctgttaccgcgaaaattgtcgttatgttcacgcgtttcgcgaggatgtcgatcgttacaagcgcagcggcgacgtgacgcttgggttggcgcgagctttggcagcgctgttgaaaggcgatacgataaatggaattccgctttgcaaagagttccaaaatggacactgcgcgcgcggcccgcaatgtcgctattggcatatcaatcgcgacgaagagcgacgcaaacgctttggcggcggcaggaactgcggcggttcgccttcgtcgcttgcgttcggcgcttacccggcggtgcctccggcaggaggtcgaacctttaacagtgaaaacagcgcattttaacccaaattaatgccactggaagatgcccttaataaaattattttaaaaaggaaatgtgtctgtagcaatgctcaatctattgtcaaaacttcatttatttagcgcaactcagcagacgaagaggtgacgagttcgtcagtgaagattttgcaccgccctccaaacgatcttttgctcacaatcagccgtttgcaacgattcccggacagatggctccaacgtcagcaccaaccgcaccgtctcacccgtcccctcaattagtcattgagttggaacgtcgaaacgcggaattaacgtaaaaatggattagtacatggcattgctagtggataccccccacttgcgtcccgaatatttgcggctttgttaaaattcattagctctttattcatttaaactcgcaaatgtccgaaaatataaccatacgaaatcgggcgcaaaatcccaaatgtctgcttttgcaagcaaatatctgaacaccttgttagttcttaaaaaaagtattttttgaatacgcattcaaaaaaaattcgatttttagtgttaatttaaatcctaaaaattgcctaatttctttgttcattggcagcactgaagtggaaagtctgaagagggagcttaaccgggaaaaggagcgttacgatgaccttatgtcgctttttcgagccgcccaaggccaaccgacggttcaacgttcggtgatttcgactccgtctttggtacccgccaatttgcagccaaacatttcttcactaagcgcgcttcaacaacaacatcagccgcagtctctgcagcagtggagcgcaacgtcaacatcgcaacagccaaattggacaaaattcgattggg

SEQ ID NO: 46799 - DNA, 416 bp, Heterodera glycines
  Genomic contig location: Contig_ID=SeqID_1319; Location=18..433; Strand=+
  SCN-specific regions: Sequence locations=1-60,95-221,254-339,361-416
  Gene Ontology: Mol. function=structural constituent of ribosome; Cellular component=cytosolic large ribosomal subunit (sensu Eukarya); Biological process=protein biosynthesis
tcaaggaatatgagcttaccgcgagaattttcggacactggcattttgggttcggcattcaggagcacatcgatttgggcataaagtacgacccgtcgattggtatctacggaatggacttttatgtggtgctcggtcgtgctggtttgcgggtggcaaaacgtcgacgaatccaaggacgaattggcgcatcgcatcgtgtgcaaaaggaggaagcggtcaaatggttccaacaaaaggcaattattttgggttaagtgggactaaattgcgtattttttacttgacttaaacttacccatctaatggaaattaatttttgttgtaaatctcacccttttcagtatgacggtgttattttgccacccaaaccgaaggaatcccgtaagggtggtcaccgcggacgtaagcgctaa

SEQ ID NO: 46800 - DNA, 1577 bp, Heterodera glycines; identical to SEQ ID NO: 45058
  misc_feature (43)..(43): n is a, c, g, or t
  misc_feature (113)..(113): n is a, c, g, or t
  misc_feature (1424)..(1424): n is a, c, g, or t
  Genomic contig location: Contig_ID=SeqID_45058; Location=1..1577; Strand=+
  SCN-specific regions: Sequence locations=1-52,74-540,579-935,962-1577
  Gene Ontology: Mol. function=co-chaperone activity; Cellular component=vesicle membrane; Biological process=receptor mediated endocytosis

SEQ ID NO: 46801 - DNA, 201 bp, Heterodera glycines
  Genomic contig location: Contig_ID=SeqID_9717; Location=407..607; Strand=+
  SCN-specific regions: Sequence locations=1-98,120-201
ctgctctcaaccaacgaggacgggttcatttcgctgatggatttggagacttgcgacaccaaggacgacctgcgtctgccggtttgtttgttgtgccattttatctgttaaaaattatattattttcccgtcccactttaggaaggcgaaattggtgaccaaatcaaacaggcctacgaaaaggacgataacggcattctt

SEQ ID NO: 46802 - DNA, 1167 bp, Heterodera glycines
  Genomic contig location: Contig_ID=SeqID_9718; Location=1178..2344; Strand=+
  SCN-specific regions: Sequence locations=1-62,88-166,211-338,369 -671,693-858,881-989,1011-1167
  Gene Ontology: Mol. function=GTPase activity; Cellular component =Golgi apparatus; Biological process=signal transduction
catactatcggggcgccgtcggcgcactgctcgtctacgacattgccaagcatttgacgtacgaaaatgtggaacgatggctgaaaggttttcaatttttccccaataaatggcgccaatttaaggggcttttttcttgtacaggaattatgacggatatggccgcaattaaaaaaataatgaaattttcaaaaactttttatttttttagttggacggttaattgtccatttcggcacctttcccatttggttttacgcccgggccaattttacatttaaaggcacggcaaacattttttttttgtttccagaacttcgtgaccactccgaccagaacattgtgatcatgttggtgggcaacaaaagcgacttgcgccatctccgagcagtgccggtatgcacttttgcaaaactatgtaaaaagcgcccctaaactgcataaaaaacaagtatttataattcgaatgtgcaataattttctaatttacaattttaaacaaaatatttccctgccagaccgacgaggccaaggcgtacgcggagcgtaaccaactgtcattcattgagaccagcgcgttggacgccaccaatgtggaggcggcgttcaccaacattttggccgaaatttaccgtgccgttagcacccggtgggcattttaattttcgctgagtttttacaaattttcaatatctggaaggccggaattaggcccccgaaatgaaaaattttcgaaaaatgaattacaaattttacccaattttctcgctaaatttgaccttaagtttccgggattcccataatttttccaagattagtctcaaaagacaaaaaccccatttttgcaaaaagctctcaaaattaccaaaatcacccttttttctacggcgctaaaattggacctaaaggaccaacttttgaggttttgggtaaaattacggaaaaaaactcaggcgcgccgtcaacagagagataaatgttcacagcaaattttttaagaaaatttcattagtaaatttttgtataaaaacgcagacaagtgccgcccgaccgaatggtgccgatcagcagccagaacaacatcacgctgtcctccaccacggccaacaaggagaagaaggcgtgctgttcctccacctaattgtttgtgatgatggaaggatggtg

SEQ ID NO: 46803 - DNA, 569 bp, Heterodera glycines
  Genomic contig location: Contig_ID=SeqID_45101; Location=646..1214; Strand=-
  SCN-specific regions: Sequence locations=1-523,545-569
  Gene Ontology: Biological process=positive regulation of growth rate
atggaaattggcaaaggaagggccgagccgacggaggacattttggtggacagtgcgaagagaagccgctgggattgcgagtccattctctccatgcattccaccgtaaacaaaacatttgccaatcatccgacattcccccacttttcaaattcattcagctttacaatcatccgactgaaattagggagccgatgaaaggcattgggaggcgaagggggaggacgaccaaagagaagggcatggccaatttggaggtgacggacaaaatgaccaccaaaaacaccggacaattcattcactcccaactttaggaaatggaagttgacggagaccaaagagacgggccaccggcgccgtccgtccgcacgcgcacttcgatggttagcgtaattcgaccgaagggggagacgacggaagagcggcgaattcgtaaaattgcggtgaaggaagaacggagagagcggcggaaggaaaagaaggcgaacaaacaattatttcgagtggagagactgaaattggatgagcagcaaagaacgaatcagccgaagacgcgacaaattcattga

SEQ ID NO: 46804 - DNA, 1917 bp, Heterodera glycines
  Genomic contig location: Contig_ID=SeqID_9720; Location=1041..2957; Strand=-
  SCN-specific regions: Sequence locations=1-285,307-483,505-691,733 -822,847-1076,1106-1200,1238-1692,1714-1917
atggccactttgctgcaagacaatgaatacgcccatttcgctctcatcggtagtggtgtccagcggaaggtcgaccgtttgactttgggttagtaattctcttgttttttgaattttataatttccatttttaggcgtacaaactgtttctaaggtaaatttttttttattctttcgccataaatcatttattattgacagcacgtagatgttgcactgtctcagaaataccaaaacgaagtcattcagctggtgcaaagagttgacccgaattcgcaagttgacttttcaacaatgtcttgaaataaattccaaatttagtttctgcactttgcgccgtcgaatggatgcgaagtcgaagtgatggtgcacgaacaaggaaagggtgcgtggatttgaatgccttttttatgggacggaaaatgcatttttcagtttggaccaaagctaaaggaatggcgaaaatagttggaacgctcggcgaatccctggaaaaagggacggtgcttatttgtggggacacgcattctgacttaccgatggtggaatttggcaagtcgaaaaactcgacggtaattggattcaaatacctgttttgggtttgggcctgatttgaatttaaaaataagtgacaaagaagtacaaaaattattctgcattttttgggcaattgtgaagatcataggtcccgaaattttttaattaattttttttttctaaaaattttttaaacgcttttctagggggggttttaaggcgctgagcacgaatccggactccatttcgaccaattccgaatctctaacccgaacatttttcgagatttaaatttaaattttttttaaagtttctcttaaaacattgtttttagtgttttcgggattgctgatcacgaatctgccattcattttgaccaatttctaatgccggatccgaactcgaacaaaaaatcgaaaattcaaaattatcaaaattctttttttgttcgtatctttacagaatgaccattttttggttttgaaacggcgtttatctaaagttgacaaccccgaaaacacaaaacaatgttttaagagaaattttttaaaaaatttaaaatttaattctcgaaaaatgttcgagttcgggttagggattcggaattggttgaaatggagtccggattcgtgctcagcgcctcaaaacacccctagaaaattgtttaaaaaatttttagaaaaaaaaaatttaaaaatttcgggacctatgatcttcacaattgcccgttttttgtttctttttttatatacattcaaatccgtgcaacaagcccgaaaagtacccaaaacccatttaaaacagtttcacgggttaagggtgtgatggcgctgtttgtcacttgcgacaaagggttgcaggaaagcgtgagggaaattgtggaggacagtgaccgctgctgtttcgtttcgactcccgacgttattcatgctgcggtcatttcgtctaattagcattaattagcacaataatttcttttctttctgtttcagatgatgactgttcttttgaaggcgaagaaaatggcagaagttgacagcgaattgggagggaaaaattgaaggagacgaagagaatccgatggaatggaagtgaagggaatctgtgtggtctcataaagtcgtagaaatccgaattgacttctaaacataatgctatatttttgtttgtttaattggtttaagattcttcgttcgtttgttcttttcttttgacgattggttgttatgacatttctgttcgggaacaatttcatgattacggtttaatcgagttattcttgtcttttcatgtttttttctaattgaaattaaaaagttcgaaccacaatttaagaaaaaccagttattttactatctaatgaacttatttataaataaa

SEQ ID NO: 46805 - DNA, 1507 bp, Heterodera glycines
  misc_feature (1432)..(1432): n is a, c, g, or t
  Genomic contig location: Contig_ID=SeqID_9732; Location=781..2287; Strand=-
  SCN-specific regions: Sequence locations=1-87,109-619,641-655,677 -1024,1047-1112,1135-1507
  Gene Ontology: Mol. function=glycyl-peptide N -tetradecanoyltransferase activity; Cellular component=cytoplasm; Biological process=protein-lipoylation
atggcagacgacgacaaaacattggaacaaaaagaggatgagactcaaaatgatttatcagatgaaaagccccaaatgaatgatgatgaaaaacaacaaattgcgaaaagtttagcagcaaaaggcaaaccaaagcgaaaaaatgttaagaacgacgtcgaacccatacaaattaattccgacatggcagcagcggaatttgctcgtaagcttcagctcatccaggcggcatcgaccagttcatcggctgtaagagatccattcgaagcaaagcatcacaaataccaattttggaacacacaacccgtcccaaaattaagtaggcggattgcattgtgccttttttcattgcacttaattaagatacaacaacaaccgaaaacaattacattgatcctccgcttgatgtttcgaccataaaaaaagatccgtattcattgttggaaaagtttatttggtctgacattgatctcaacgcggatgaacaattggatgagctgtacattcttttgaccgagaattatgttgaggacgacgcgaatatgtttcgcttcgattatgggaaaaattttctgaaatggtaggacaaccaaaattggtaatattcgatggtagggcatctttttcaacgttttttacatcatgaaaatataataatatttctgcaaattcaaaatcgataggttttagcatatggtaatttagaaaagactaatttccaatttttgtacggattcagtcggaataaataaatgactgccagcagagataatcccgcatttctcaaatttgctcaattttgtcttcagggcactgatgccacacggttggcagcaacaatggcattgtggggtaagggccgttacttccggaaaattggtggcatttatcgctgctgttcctgccacaattcgaatttatgacaaaaccgtcaaatctgtcgaaataaatttcctttgtgtgcacaaaaagctgcgaaccaaaagactggcgccagtgctaatcaaagaaatcacccgacgagtcaatttgtttgggatttttcaagcgactttcaccgctgggattttcattcctaagccagtgggcatttgccggtagcaatttttttgaatcataatagtcatacatattacttttttaggtattggcaccggtcattgaacccgaaaaagctcgtcgagtcaagtttttcgcatattggcaaaaatatgacgcttcctcgtatgataaaattgtataaactgcccgaagtgagtcttcgaacattttcagcctttgtaaattgcattttcagaacaccgagtctcaattgacgctactcaacagagattctgccaaaagcgccttcgaattgctcagcggatatttgaccaaattcgacttggtccccatcttcaccatcgaagagttcgaacatttcttcctgccncgcgatgatgtcatttacacttatatgattcaggtgggaaaaccgactgataagtcgcgagacgggggacaataa

SEQ ID NO: 46806 - DNA, 676 bp, Heterodera glycines
  Genomic contig location: Contig_ID=SeqID_45217; Location=373..1048; Strand=+
  SCN-specific regions: Sequence locations=1-164,186-213,236-334,356 -378,423-623,646-676
gcgttcagtgatcgacgcggatgagagggaacgcgtggtgggcgcggtggcgcggacattcgtcgaaatgttggacctgcgcgaagtgagtgtggtggaaagacagacactattttagggaattttaatggccggatatccgattctggcattcgtattgactttgtagtcctggctgatcctggcaatccatcaccattaattattgcattgacatttcatttaaacttttaaacataatcacgcttaaaacaattttctaaaaaagtattacatattttgctgttctttggtctcatcaaatttttaaataggcaacagaaagcggcgagattaattaatacacaatttaaaataaagaattttgggatgccattcaattttatttatttgaaattaaatttttttaaatttaaaaataaggacacaaacagcgaagtacccccaaaaagggatgattaattcaccattgatcatgattcatgacccaatgatcagattcaaaatcggccccacccttacgcttcatccctcgcccgtttcaacccaattcggctgatgaatggccatttggtctgttccctgtatttgttcaccaaagtgtgctattccgtcaacattatgctccaatttgctcttctcaatgccgcactgacctcaaaagaccattttctgt

SEQ ID NO: 46807 - DNA, 1110 bp, Heterodera glycines
  Genomic contig location: Contig_ID=SeqID_1326; Location=5838..6947; Strand=-
  SCN-specific regions: Sequence locations=1-1110
atgcgaaaattgacacccccaaatggtgaatggggacatttggatgctactgatcaggttgttccaatacaattgatcaggcacaccttcatgcgggacctgaaaattgcaataaacggtcgtgaaattttcaattctaattcactgatggcatacaaaacttatctttctcatgaactttcgcaatcacttgaagctaaagtttcgcatttaactgctgctggatacgaccgtgaagatgctagcaatctacaaaacgcaaattccgaagggttcaaaagtagaagacaacggtatttgggaggtcgaacagcacaatacattgcaaaaattgatgccgatcttttcaatgtaccccaatatttgattaatcattgtgaaattgatataacgatacaaccccatgacgacaattttttgttaattgacaccttagacccccctggtcaaccatatagccttgagcttgttggattgaaactctactgtaaaaaagtcagtcttatggatggtttggctcttgagttggcgaaaaaattggaaatgaaaccagcacggtatgctgtacgaaagacaatgatgaaagcattgttcataagcccaggacgctatgaatttaatgcaaacttgttcatggaccaagttccacgccgcgtgacaatgggacttgtcgcaaattcagattatgtggggaacatcaaaaggagcccattcaactttcagcactttaatgtacgggagttaagtgttgtggccaatggtcgctcctatccccaggcaccgtatgacattgactatgaaaattggaaatttgttcgtccctacaatgacacgcaggaggcgcttggttttgccaactctacatatggaaatggaattgattacttttcttttttgcacactcactgtatttatgtgtttaatatgacaaacagcggcgacgatcatggcggtttatttgatctaatcaaaaaaggctgtacagcagtgaacattaaattcaaaaaaccagtacccgatggtggaataacacttattgtgatgggtgaagcggactctatttactttttggataaaaaccgaacgattgcaaccgatacaaccatttga

SEQ ID NO: 46808 - DNA, 712 bp, Heterodera glycines
  Genomic contig location: Contig_ID=SeqID_9753; Location=273..984; Strand=+
  SCN-specific regions: Sequence locations=1-145,169-687,709-712
  Gene Ontology: Cellular component=COPI-coated vesicle; Biological process=intracellular protein transport
atggtggatttcgacacatcgtctttatacagtgtcaaggccattcttatccttgaccaggacgggaagaggataatggcaaaatattacgacaaacagctttttccactcgaaaaggagcagaatgtctttgaaaagaatgtttttcagaaaacccacaaagctaatggtattttttcattaatttaataaaatttgacaccgaacatttagcggatataatccttttggatggcctcgtttgtctttatcggtataacgtcgatttgtttttttacgtggtcggaagtgcaaatgaaaatgaattgattctgcaaagtgtgctcaattgcctttacgaagcgttttcgacaattcttcgaaaaaatgttgagaaaaaggctctgttcgagcacattgacacgtcttttctcattatggatgaaatttgcgatgatgggttcgtttccaattcacttttttaaaactttctgctatttcagcattattctggagaccgatccccaggcagtggtcgcccgttgtgcggtcaaagcggacgaattggcatttggcgagcaaagcatttcccaagttggcatgtcgctgttgggctctgcgaaggaccaattgaaatggtctcttctgaagtgaccgaaggataaaccaattttgtgattaatttttgttgtgggaaaataacaaaagtgttttatttgtattttttctataa

SEQ ID NO: 46809 - DNA, 454 bp, Heterodera glycines
  Genomic contig location: Contig_ID=SeqID_9755; Location=800..1253; Strand=+
  SCN-specific regions: Sequence locations=1-454
  Gene Ontology: Biological process=growth
atgggcaagggattccaaaattttatgtccaagaaggacttccatccaagtgcatggtggaacttaaaaagggtaattcctcacaatcagttatatttggctattattttaaaaatttacagaaatgggaagctgagcaaaagaatgacttggagaaaagaagacaggatgaattgcgtgtccaatatgagaaggagcaagaaattctcaacaataagtttgtttaagaaaacattttgcagcttacctaaattaatttttctttagggcacttcttggtgacgaaaaagcgaggttgggcctttctttcatgtacgatgcgcccgctggcattaacaaaaagaaggaggaagggccggaaccgaaattcgaatggcaaaggaaatacaatgcaccgcgtgaagaatgggcgaaaggaaatgaactcatccaggaccaacctttcggaattcag

SEQ ID NO: 46810 - DNA, 1066 bp, Heterodera glycines
  Genomic contig location: Contig_ID=SeqID_9756; Location=103..1168; Strand=-
  SCN-specific regions: Sequence locations=1-375,397-595,617-861,910 -1066
atgtcagcacccgctgcaaagttaccccgccctccagagcacatgctgcgttatatggctcacatccgggccaagtctcttgttttctgtgcgatgggggtcagtggtctcattggcctttccttttacttcttttacgtcgaagttcgtcgcaaggcatatatggaatttgggaagtatgttttgttttgtttacatttacaatgattttgttttatttttatagaaattacaacccataccagagaatgcgtgaaatttgcgagtatcccgtcaagtacatgcattcctgcccttctgagctagccaagcgcctcgaagagaaggtttgaattgttaatataataaactgctgcatttcctacaatttattctagaatttttacacaattagaatgccctaaatctatcaaaattaatctaaactaaagcttttgcctcattttgatgttttcattgaaaattattgcttgccaaaaagtcacagctattataaaaccatagattagacaatttcttaggacaaatgcatttttgctgcaattttcatttcttgtaaaaatcctattcccggccgggatcccgcccctaaaataacacccggtatttggattcctacaaattgggatttgaatccaggggtcggaacccaaaccttggaaaaaccggaatctgaaaatatccttaattttttagttgtcactgaattccaatatgacatccattttgacaaattctggagcccggacccgaattcgaactaaaaaatttttcgaagttttcctttcttgagttttaatttaacttaattttcctgcgggactgcaattctaccgaattttaccaaacctgaaaacccatgaaataaatgacttttatttttattctaaatttagggagtgctcattggtgaccgcgactattccatcccattggacgacgttgtgcctgaaagccggaagaaggagttcatgatggcgaatgcgttcgaacgttttatgaaccgttaggcaattaagtcaggtgatcggactgttgacattaggatggatttagcacaattaaa

SEQ ID NO: 46811 - DNA, 1077 bp, Heterodera glycines
  Genomic contig location: Contig_ID=SeqID_9769; Location=671..1747; Strand=+
  SCN-specific regions: Sequence locations=1-572,604-1077
  Gene Ontology: Mol. function=threonine-tRNA ligase activity; Cellular component=cytoplasm; Biological process=tRNA modification
atggcgcatttggcaggaggaggcggccaagcgggaccaccgcaaattgggccgcgaccaggaactgttcatgttccacccgctgagtccgggcactgccttttggtacccgaaggggacgcacatttacaacacactgctcgagttcatgcgacgcgaataccgacgccggggtttccaggaggtcagaacattcaatagtcgaatgttgccttactaccaaaaacaaatgaatgagttgacagaggttttcgattgagcctttcccttgttccaggtaatttctccgaatatttataacgcaaagctgtgggagcagtccgggcattggcaccattatgcggagaatatgttccggtaagtcttttgggagagttaatgtaatttatggagcatgattagagtggaaaagtcggcattccctttaatcatttttaggttcgaaattgagaaggagcagttcggactgaagccgatgaactgtcctggacactgtctgatgttcgactacaaaccgcacgcctacaacgaattacccatccgttatgccgacttcggtgtactccaccggtaaatttaaattttatttttgttcattttcctgtccgttttaagcaacgaaatgagcggcgctttgtccggtctgacgcgcgtccgtcgctttcagcaggacgacgcccatattttttgccggaaggaccaaatattgtcggagatttcgggctgtttggattttctgaattttgtctacgtggaagtgttcggcttttccttccgtctccatctgagcacgcggcctgaagagggctatttgggcgacttggccacttgggaggcggcagagacacagctgaagcaggcattggacaacagcggactcaaatgggagctgaacccgggcgacggagcattctatgggccaaaggttggcaagcggaaactgattgatttatttgcttttagaaatgccaaaaaatcaactaaccaaaaaaaagatttctccgttgttcttttcttttccagtccaagggatggaatacatttacatacattagtagttacacgatgaacaattaa

SEQ ID NO: 46812 - DNA, 821 bp, Heterodera glycines
  Genomic contig location: Contig_ID=SeqID_9772; Location=364..1184; Strand=+
  SCN-specific regions: Sequence locations=1-355,378-624,654-821
  Gene Ontology: Mol. function=L-malate dehydrogenase activity; Cellular component=mitochondrion; Biological process=malate metabolism
gtaactttaatcggcgcaagtggaggcatcggccaaccgctcggattacttttgaagaagaacccttccattgcacacttggcactttacggtgattaaatgtccattatattaattttcgactcattttgtattatagatcttgtcggcacccccggagttgcggccgacctttcccatataaacacccaggcaaaagtgactggccatttgggaccagaccaacttgttgcagcgttggagggtgctgacgttgtcattattcctgccggtgtgccacggaagcccggttggtggcattaatattctgctcacaacaaaatgattaatttcctttgttttgcgaattttaggtatgactcgtgacgaccttttcaccacaaatgccggcattgtgcgggacatggccgaagcagccgcaaaaacttgtcccaaagccttcatgggcattataaccaatccggtgaactcgacccttcccatcgcctgcgaagtctacaaaaacaatgactgtttcgacccgcgacgcattttcggcgtcactcttcttgacattgttcgagcacaggcattcgtttcagaactaaaagtgagtgaacatcattaaaatgagtcaaagttcttcatttcccttctttttaaaggggttggatgtttcccaaacaaaagtgtcggtggtcggtggccattccggagtgaccattgtcccacttctgtccagatgtacgcccaaagtcagtctgagtgacagtgagacgaaggcactcaccgaacgcatccaagaagcagggacggaagttgtgaaagccaaggctggcgcg

SEQ ID NO: 46813 - DNA, 770 bp, Heterodera glycines
  Genomic contig location: Contig_ID=SeqID_9782; Location=185..954; Strand=-
  SCN-specific regions: Sequence locations=1-104,174-256,278-391,422 -599,626-770
  Gene Ontology: Biological process=cell cycle
atgcaaattttcgtcaaaactttgaccggaaaaacaattactttggaagtcgaggtatcaacttaacagtttaagaaaagattgtatatttgcattctaaggcgagtgacactatcgaaaatgtcaaagccaaaatccaggacaaagaaggaatccctccggaccagcaacgtttggtgagtcaattaaaatagagcgaatctatttaaaaaatggtctttgcagatttttgccgggaaacaattggaggatggacgtaaaattcctcaattactataaatattttaatttttgctcaaactttaaggcactttggctgattacaacattcaggtatgtctcaaattcagatgtttttttatgttttaccagtttgcttaatctttgttttagaaagagtccactcttcacttggttcttcgccttcgtggtggaaaggtttgccgtctcaagggttcttttataggaattaatgaactatacttaaaattagctttggagatttgacattcatttcttggtctaaaaagtaaatgctgacaggtccacggatcattggcgcgtgcagggaaagttcgtgctcaaacacctaaagtggagaaacaggagaaaaagaagaagaagcgtggccgtgccttccgtcgcattcagtacaaacgtaagtttatttgagtcacttaaaatgaatgacaatgttataaggtcgttacgtcaacgtcgctgcagcgggaccgggccgccgtcgtgggccaaactcgaatgctgcataa

SEQ ID NO: 46814 - DNA, 1687 bp, Heterodera glycines
  Genomic contig location: Contig_ID=SeqID_9784; Location=1286..2972; Strand=+
  SCN-specific regions: Sequence locations=1-2,26-324,360-422,445 -1384,1406-1687
  Gene Ontology: Mol. function=tRNA binding; Cellular component =mitochondrion; Biological process=reproduction
atggaacaagaacaacaacaaaatgttcatcacagtgggcgcgaagtgcgtcagatgttcatcgactttttcgtcaaggaaaaggcccacaaatattaccattcctcttccgtggtatgcaacggtcgtttccgctctccctttgaccattggcattttcagattccccacgaggatccgactctgttgttcaccaatgccgggatgaatcaatttaagcccattttccaagagactgtcgacccgaacagtgacatggccaagctgaagcgtgcggtcaacacacagaaatgcataagggcgggtgggaagcacaacgacttggacgacgtggggaaggacgtgtaccaccacacctttttcgaaatgctcggcaattggtccttcggcgattatttcaaggtcagtcgtctcctttttttgctattctgtttttaaatgttttagagggaaatttgtacatgggcttaccagttcctaacagaatggttgcatatttcgtccgaacgcctttacgtctctttttttggcggcgatttggccaataatttgttgccggacgaagagtgtcggtaaattgtaactgtcaaatttaattttattcctgttattcaagccaaatatggttggacatcggtgttcctagtgaacacattcttccctttggaatgaaagacaacttttgggagatgggcgagacgggcccttgcggtccgtgttccgaaattcattatgaccgaattggtggcagagatgcggcccatctggtgaacgccgatgacccaatggtggtggaaatttggaatttggtcttcattcagttcaaccggtgtcttgtgagattggcagccattagcatgactttttaactttagggaggagggcggagtgttgaaatcgttgcccaacaaacacatcgattgtggtctcggctttgaacgtctcgtcgctgtggcgcagcaaaagacttccaactacgacaccgatttgttcaccccaatttttagcgcaattcaggaggttgtaggtggtgaaattttgctattgtaagtttggagcttcaggggaccggagcccgcgagtacactggcaaagttggttccgaggacgtcgacggtgtggacatggcttaccgggtggtcgcagatcacattcgcactttgaccatcgcactgagtgacggggggtcgcctgactcgaccggaagggggtactcacttgggagtttaaaaatcactgatgatgatatgcaatgcttgctttgtttttagttatgtccttcgtcgcattttgcgccgcggagttcgctacgcaactgagaaattgggggccaagcccggcttcttcgcctcgcttgttcccgtggtcatcgacattttagtactttgtttttgtggtctggtgtatgggggtctcttgaaaaccaatttcttaagggcgacacttttcccgagcttcgaaaggacccaagctcagccatggaaattatcaatgaggaggaggcacaatttctgaagacgcttcgtcggggccacgttctgtttgagaaagcggtcaatgctttgccttcgggcaataaaactttccccgggagcatcgcgtggcgcctctacgacacttacggatttccgattgatctcacccaacttatggccgaagagaagggactcactgttcagatggacga

SEQ ID NO: 46815 - DNA, 845 bp, Heterodera glycines
  Genomic contig location: Contig_ID=SeqID_45373; Location=1..845; Strand=+
  SCN-specific regions: Sequence locations=1-377,399-449,471-696,718-845
cgagtacacgccatggtattcgggccaaacaatttgccagccaaaagggcagcggagggttcatgaaggtaagtaagcggatgagtgtccgtcagggatgtcgggggatcgaggatgcgggaattcgtggtccgaagatgtcggtggatttcgggatttcaagaattgtctctaaaatggcgggaattcggctccgtgcatgtcgaggggtcgggatttcggatattctctaaaatgacgggaatttggggtccaggaaggggcatttgagggtgaagggagatatggtttagactcgaaaaaagaagcgggattctagaccggggaggacacaaaataaaagatttcgggatttgcggaggtaggtccagattattttgttttgttgaagatattagaagtttgaatgcagatcatatggtgcctcgagagcggagccaattaattaaccaatcaaaaataaaactaattgagggataattagtgcctcaactgggcaaactgagagaaatttgagcgactctaatgaccgctttttaaaggtgcgcgacgttttaccgcacagccaagggggcaaggatattccggaagatgacaagctcaaatccgaaggcattgtccgactacaggtgtcccccgagagaatttttaaatacctttaattaccgtaaaattttcattagtcgggcaccaacaaattggcatcccaacggggcatgaccggctttggcacaccgcggaacacgatgagcaagatgggctggaagaaggaatgggtggaggagtacgaggcggcaatgcgcgaatttgaggagcaacgaccgcccgggtcggcatcgtcggat

SEQ ID NO: 46816 - DNA, 1093 bp, Heterodera glycines; identical to SEQ ID NO: 45385
  Genomic contig location: Contig_ID=SeqID_45385; Location=1..1093; Strand=+
  SCN-specific regions: Sequence locations=1-24,47-581,603-1093
  Gene Ontology: Biological process=reproduction

SEQ ID NO: 46817 - DNA, 2705 bp, Heterodera glycines
  Genomic contig location: Contig_ID=SeqID_1328; Location=1..2705; Strand=+
  SCN-specific regions: Sequence locations=1-42,64-126,148-180,207 -306,328-963,985-1079,1101-1367,1389-1599,1622-1637,1659-1800,1822 -2530,2557-2641,2663-2705
  Gene Ontology: Mol. function=pre-mRNA splicing factor activity; Cellular component=spliceosome complex; Biological process=mRNA splicing
gggaccctttttgtttgcacaattttctaatatatagtcatgaaaatttattccctggaattcttggggtctataaccttgaattagatgtcagattcgtgatcagcgccctttcaaacccccggataataaaattttatggttttttatcacaaaaaaatttgcaaaacaaacgggtcgccctttttgtttttaataaaattcaaaatcgcccttctttaaagtagcgccaaaaaccccattattactttactggatccacaaatctataattacaagcaccaccttataattagtatttttacttgattttgaactccacaggtgcctatttgggttgtctgctgctgccattgctggatgctgtgcatcctctgcagatgcttggcatgtactgtttgatcatgatgaagcgaagctgactgagggttggccatgttttgttgggcatgtgcagtggtcgtagcaacagcagcggtgaactgctgttgtgttctgacggaaatgttcccattgttgctgctgctactgtttggcgaagggttcatttgttgctgacggaatgcgtttgaaggtctcccggggccacgcgcagcagaaaaagacgcactagcggaattctgattgtgagcacttttggacaaagacatcgctggaggatgaccaatggtaggggaaacaatttcagaggtttgcgatggactgaaactggtcattctttgggtaacaaaaaaaaaacactgtatcacatacaaaaaaataattgaatttgcggtccggacatttgcggtccggacaattgcggcctgctgaaaatcggacatttgcggcccgacaaatgcggtcggacatttgcgcctcggacatttgcggccaatttcttaagggccattttcggacatttgcggcccgacatttgcggcctgctggaaatcggacatttgcggtcaacggaacgccaaataattattttttaattccaaaaacaatgttttcttcccgactttttcgaccccaatcaaaataggttcatttatcggaaattcttttactcttaaaatttacgccgaactttaactaatctagtaattcttttcaaaaattgggcttgtcaaaaccccatcagtttgaaaattgctagtcagtttaccaactcttgcaccgaccagttgatattgtagagatctgagattttctactaatgttcgtacttcttttgccatcatttgggaattgtttcgctgatattcttttcctcctcttcgttgcttctagttgggtaggtttacgatttttttttcgagaagacttgaatcggcggcttattagagagcattaaattcggttaaaatggatggaaaataattttctgaggtttttattttgttggagtcgaaaaagttgaaccgcaaatgtcgtatttggctgtggccgcaaatgtccgaggcgcaaaagtccgaccgcatttgtcgggccgcaaatgtccgattttcagcaggccgcacatgtccgggccgcaaatgtcctacaacccttaaaagtaacttcttttctaaacaaattcgctgtttttgaaaaaaatcttaggaattcttcattttttaaatgaaaaataataatagttttgaaaattttcaagcaaaaacatacatggttttttattcacatacggcactcattgtaaagttcgattgtcatgttttgaatttcgcttttgtcagatgatggcacctttgcttggcagtggaaatgaccaggccgactgcgacctcatccgggcttttctttcctacattttgaaacgctggggcaaagagctgaacgcacgggaagagagcataaagcgaagtgcaacaggcaaaatgcaagcggggatgcacaaacaaacggtggaacatctctccccgctgatgaaatccctggaaaagtacacagtgaacaacgacatccgactgtacttgaccaacattaccaagtgggataaacagacccttgacaaagacaagtgactaaaaatgacacgggatagagaccaaacaaaacaattacttgttttcgttttggatttggcatatcttttaccattataatcctctaacactgagtctcatcttttgctcactttgcatttgttgacacaaagggaggaaaaagtgaatgattgtagcaatgcaacttgagttttcagtcttgcatatataagagacttgaaaatgacaaaattgttgcacattttgcggcccatcattgacatttctttattttaattcacaaattttcagactttgtgttgtcgaacgcaattacatcgtcgcaagcactgcttacatggaaatgtcattactttttttagctaaactttctatttgtccctgcaatgttttcttttctcaggtcaattggcaatgctccgtggcccgtcggagtgactcggtcgggcatccatcaacgccccggctcatcaaaggcgtacgtgtccaatgtggcacatgtgatgaatgacgaaacgcagagaaagtagccgagtttcaattatttaattattatatattttaagatacatccacggtcttaaaaggtattttcgttaaagcgcaagatttcaaagtcttatttctaatcgcttttttaggataatgtcaaaatgccaagaatttttccccaccgatcccagcaaatgtatggaatttgtgaagaataaaagc

SEQ ID NO: 46818 - DNA, 1635 bp, Heterodera glycines
  Genomic contig location: Contig_ID=SeqID_1329; Location=5603..7237; Strand=+
  SCN-specific regions: Sequence locations=1-373,396-773,797-886,908 -1214,1238-1635
atgcatttctaccagataaaattggtcgacaaattgtccaccgttttgctgaacaccgtccaaaagggtctccactcggacgacaaatgcaaagtgatgcgatccatggaaattgtggctggtttatgcgcaacgccaaccaacgagtcaattgtttgtgaattcttcgaagaatcggttccacgcttttaactgtgtttttagagtaattattaatttttagcaaatcataccgcggattttcgctcttttgtcactgaaggatattttgatgtgtatgtgtgccatggagtccgtgttggccatttccgagttgggacgggtcgcgtgcgaagccgtcgcccgctgtgaccgcgccgttcaaagtcagtggcaaattaatgctttttcattttataataattagtttataatcatttctgctgtattttagtgctcgtcggctttttgaccaccgatgccctttcttttggcaccgtcggtttggcggggatgcacgtggttgaggtgcacggacaccaaaccaggccttatgttgcggttagtttccgtcttgaaaatcacaattagaagatttaaaacttcgcaaaatgaatcaatttttagccaaacaaaaagaatcctcccccgccgcttaaacttcaacccgtacaacctcccgttcaatatgcgcaacaacggcaccaaacgccggcgagcagtacaacaacaacggcaccaccatttggtgaagcgatggaatttgcaataaatgctcgcacagatactcttgaaacatgcccaggtaattgatattaattaattaattatccctccgaatgctttcgtctccttcagatgcctttcaacgtcgtgcaaccgatggcaatgactctgctcaatttgcctctcatcagcgtcatccaccgactcgcaaaaaagtttatctgaaatcttcgcgcctgccttttctcaaccaccgacaacaattggccaccgatgctccgcctttacaaaatggcctttcgtcaattgctgccgcggttccgtcgtccattgaatctgtggcgaatgaacgcgactttatgtgcgaatggctgatgcagtcggagggggacgacgattggtcggacgaggagggcacagcagcggggccaattgagccgtgcgcgaggtgtgccgggggttgtagttcttatacaaaaattccagactttcccggcggccggaccccattgatttttgaaaattttatcccaaaacagcaaaaattgaattgttcaatttttatgcgcaaaaccgctgaattactacttttttggcctgaagagcaaaaaaaaaaaactctccggtgccctccccaaaatgttttatggatactggcatagtctacggtctcactggccatttctcagggcattgttttgttttttctctttttgttccccacttaattctttcgtctgaaatttcaggttttttgcttccgcctcacaaatgcttttccacgtgtacaacgaacatttggtgccgcttgtccaacagcacagcgacggcgaaccgccgaggattcgctgtcgttggcccatttgcgacaacactccgcgcactctgtggtccatcacaactcatttgcaagtaaacaatgatgagtaa

SEQ ID NO: 46819 - DNA, 1270 bp, Heterodera glycines
  Genomic contig location: Contig_ID=SeqID_1330; Location=1473..2742; Strand=-
  SCN-specific regions: Sequence locations=1-75,113-211,234-472,494 -561,583-611,633-843,865-1270
  Gene Ontology: Mol. function=DNA topoisomerase type I activity; Cellular component=nucleus; Biological process=chromatin assembly/disassembly
atggacgacctgaagtatgtgtgggaattcgacttctcggcaaaagactccatccgctattacaaccgtgtgccggtggaaaagcaagtgtttaaaaatctgaagctttttatggaggagaaagatccgggggacgatttgttcgaccgattggatgtgagagagcaaaaaggaaacattgcttatttactcgcttgtttagacgagttcgttgaaccaatacctgaaggaactgatggacggactgaccgcgaaagtgtttcgtacgtataacgcgtcgatcactctccaagaacagctggacaaactgacaaatcgtatccatctcatttttaattgccaaattaattccgaaatttcagcttccgattccgtccacgagaaaatgctttcctacaatcgtaaagccactggttcagaggcatttcacttatattgcctacattcaggtgcaaatcgtcaggtggccatcctttgtaaccatcaaagggcagtgccaaaaacgcacgaaaagtcgatggaaaatttggagaataaagtgaatatgacatgaaacggaaaagcaaatcctaagcaaaattcagataaaagagaagaagcaggagtacaaggagttgaaggatcagctgaagaagagcaaatcggtggacgagaaaatggcaaaaaaatacgaaagattgaaggaacagatcgccaaactgaacacacagcgcacggacaaggcatgggggaggaagggttggccaaaaagtccgagacaaatttggaatttgattttttttggggaaataagtcacccttcaaatcaacgaatcgggaacagcaaagattggtcatttttgatttcaggatgaaaacaaacaaattgcactgggaacctcaaaactgaactacttggatccgaggttggttctatcgaatattccaatttactatgtccaaaaaaatttcaggatttcggttgcatggtgcaaaaagaatgacgtgcccgttgagaaaatattcagcaaaacgcaacgcgacaaattccgctgggctctcgacatggcgaaggaggacttcattttctgacacttcctcgcaaccctttccgatttcccttcacccccttttactcgctgttccttacttttggagagtgcccctttcctctcaatcactctcttctgctggacctaaactagtagttgtttatatcttgtcatgcctattgtttgtgtgagcgtttgttttcatatgtctgatgattggttcgtattttattaataaa

SEQ ID NO: 46820 - DNA, 453 bp, Heterodera glycines
  Genomic contig location: Contig_ID=SeqID_45446; Location=100..552; Strand=+
  SCN-specific regions: Sequence locations=1-280,303-453
  Gene Ontology: Mol. function=protein phosphatase type 1 intrinsic catalyst activity; Cellular component=chromosome; Biological process= cell cycle
atgcacggcggcatctccgatcagatccaaagcctggaccagctcagcaacttgcttcgcccgcaaaccgacccaccacttcgttcgctggaaattgatctcctctgggctgacccgtcgaagagcatcacaggcgtcgccccgaacagcagaggagccggcgtcatgttcggcgcggacgttgtggagagcgtgcgcaacctgctcggcatcgactacatcgttcgagcgcatcaagtgagtttttttttggcttttcatttcacttgctttcaataattttccccttcccttctttttcagctcgtcatggacggcgtggaatacttcgcggaccgccacctgatcaccttgttctcggccccccgctacaccggcaagaacaacacgggcgccacgctgctgatcgcgccggacctgagccacacaatcacgcgcttcccgccggcctga

SEQ ID NO: 46821 - DNA, 374 bp, Heterodera glycines
  misc_feature (360)..(360): n is a, c, g, or t
  Genomic contig location: Contig_ID=SeqID_45455; Location=140..513; Strand=+
  SCN-specific regions: Sequence locations=1-91,113-374
  Gene Ontology: Biological process=cell cycle
gttgccagcttgtggatggaactctgctcaggacttatggagttgatgctgattcaaccatccaccttgacctcaggttaacttaaggtttacaatgtgtgcaaaaatatttttagattgcttggtggtgggaaaaagcgtaagaagaagcaatacactggcccgaagaagcagaagcatgttcgcaagaaggtaatttgggtttttaggtctatggacgaacaattccaaacttaggtcaaactcgccgtgttgaaactttacaaggttgttagacattacaattgagagaataggtaaaattttgaagattgatgacaatggaaagattcatcgacagcgtttggaatgcaatttcgncagctgtggagccg

SEQ ID NO: 46822 - DNA, 278 bp, Heterodera glycines
  Genomic contig location: Contig_ID=SeqID_45520; Location=568..845; Strand=-
  SCN-specific regions: Sequence locations=1-185,207-278
tcgaccgagcaggaggcgcatcgcgagttggtcaaggcgatcaaagagggcattgttcgtgctcagttggtcgccggcgacccgttggcgggcgggcggcactacgtcaaatttgggaccaccgatgaccaatatcgcggggttgagccccgcagggaattcgacgcgcgggtcaacgaactgttggagctgtaccaccaggcggtgaaggcactgcggtacccggacatgcgcaacccggaggtggagaccattgacgagcagcgcaggcgtgaaca

SEQ ID NO: 46823 - DNA, 672 bp, Heterodera glycines
  Genomic contig location: Contig_ID=SeqID_45552; Location=17..688; Strand=-
  SCN-specific regions: Sequence locations=1-96,118-672
  Gene Ontology: Mol. function=ubiquitin activating enzyme activity; Cellular component=cytoplasm; Biological process=reproduction
atgacgacactcgaaggcgcatttcaccagttggaggacggggaccacgttgtgttcaccgactttgagcacgccgaactgaacgaacttccaccagtgccagtcactttgaagggaagtgagtgccaccactgatcatttgttggttcatctacagtcctcccatttttaggcaaagtcttcaacattggaaatgctctcgcggccttttctggcgcagttcaaggccccgtttcgcgtggacgtgttcagcaagtcaaagtgcccaagaaaatgtccttcaagccattgtctcgcgcactcgccgagcccgactttatgatttgggactttgccaagttcgacgaacctgcgcaacttcacgccctttggcaggctttgtacagttttgaggagatggttcgtcatcttgcgactttccatttggttgggttttcctttcagaaaaactacagccctttgccccgttccgatgccgacgcaaaattgttaaaggaaatgctgccaaaagatgcgcccgaaatgccggactcactgctcttcaacttctcttaccaggtcccttgtgccactttcaacttcgaattcctccccgtctttaaggcgtgtggaaatctccaacccatcgcttcgctcatcggcggtttggtggcccaagaggcgatgaaggca

SEQ ID NO: 46824 - DNA, 1011 bp, Heterodera glycines
  Genomic contig location: Contig_ID=SeqID_45568; Location=3..1013; Strand=-
  SCN-specific regions: Sequence locations=1-325,347-394,416-1011
atgattggtcagactttcatccgaaacatcaaaatgagcataaatggacgtgaagttttcaactcaaattctctgatggcctacaaaacatacttctcccatgagttgtcctattccactacggcaaaggactctcatttgaatgcagcgggctattatagggacacgggcggcacgcttgagacaggggacggctgcattgcgcgacgtaacttgtttgcaggaagcagaacagctcaattcattgccaaaattgacgccgatttgttcaaccagccactctatttgatcaacttctgtgagctggacattgaagttttacccaatgacaacaactttttgttaattacgactcttgcggctgcccctcgctaccactttgaggttgtcggtttgaaaatgtatgtgaagaagatttcattgatggatggactggcgttggacattgcgcgaaaacttgaagtgaaaccggcacgatacgccgtgaggaaaacgttgatgaagtcaatgttcatcagtccaggtcgttttgagtttactgccaatttgttcatggaccaaattcctcgccgtatcacaatgggattggtggctaactctgactatattggaacaatttcgcgtagtccgttcaactttcaaccgtttaatgtgcgcgaaatctcaattgttgctaatggccgctcctttccccaagcgccttacgacttggactaccctaatttgaaatatgttcgccctttcaatgacatgaacgaagcggtgggattcgccaattcattggaaagcaatgggattagctatgaacagttcgggaaaacccattgcatttatgtgttcaatttgactaacagcggggatgatcaagctgcgctgtttgacctgataaaaaatggaactacagcggtgagcatcaaattcaaacaaccagtgcccgccggagggataatgctggtggttatgggtgaatgcgactctctggtgatgttggacaagaatcgatctaattag

SEQ ID NO: 46825 - DNA, 2243 bp, Heterodera glycines
  Genomic contig location: Contig_ID=SeqID_1338; Location=1647..3889; Strand=+
  SCN-specific regions: Sequence locations=1-138,160-639,661-1523,1545 -1811,1833-2024,2067-2141,2163-2243
atggttcatattgtgtttgatccaagtaatgcgggttatgatgaatatgtgcaatatggtagtggcgtagagattgaagactatttcaaaggatccagcccattccaacgaggatacggtgctcaacacggtgctggggttggggacgtgtttcgagggatttggcgctttttcttgcctattcttcgccgtgtgggcactacagtaggatcggaggcgctgagcactggtcagcgggtattggatagagtcggaaatgagggattgcctataaaggaggcgctcgtgagtgaggggaagcgaggcattgataatgtgttggataaaggcggattaccaaaacaatttggcacaggcaaaaagagtataaaaagaaagcaaaatagccatcaaacaataattggacgaagaattgcgaaaccagtgaggaaacgtgtacgctcagacgcatttggtctttattaaatggcttttcataaaattgataatgatagtgtaaactcaataacgaatgcattggacttttttcgtattcctccaacaaatgtgagcgtctcatcctcaaaagtatttgagcttcttcccagcaatccactggccgacacaccttatcactttaaactacattcaagtcaaaatttcattgacctttcaaaatgttatttgctcactgaatttcgcattcgtaaggaaaatgaaaacggtcagttggtgaacattaccgcagcggacgaggaagtggcgccaattcaaatgcttggccacaccttcattaaaaatatgcgaatgagcatcaatgggcgtgaaatcttcaactcaaactcactaatggcttacaagacatatttctcacacgaactttcatattcaactgccgccaaggactcgcatttgaatgctgccgggtattataaggacacctctttggttctcgagacaaactcaggctgtgctttaagaagaaatttgtttactgaaagcaaaacagcccaatttgttgcaaaaattgatgcggatttattcaaccagccgatgtatctaattaatttttgtgagcttgacgtggaaattctaccaaatgacaccaactttttgttaatttcacccacttatgccgggacgcgctttcatcttgaactcgtgggattgaaaatgtatgtgaaaaaggtatcactgatggatggattggctttggacattgcgcgaaaattggaggcgaaacccgctcgctatgcggtaagaaagacattaatgaagtcaatgttcatcagtccgggtcgttttgagtttaatgcaaatttgttcatggaccaaattccacgccgcatcacaatggggttagtgggaaatgctgattatgttgggaatattatgcgcagtccattcaactttcaaccttttaatgtgcgggaaatctcaattattgctaatggacgctcatttccgcaagcaccctatgatttggactatcccaatggtaaatatgtgcgcgcttttaatgacatgaacgaagcagtgggcttcagcaactcaaatgaaagcaacggaataacttttgcacagttcggaaagacccattgcatttacgtgttcaatatgacaaacagtggtgatgatcaggcggcactatttgatttaataaaaaatggaacaacggctgtgagtataaagttcaatgaggctgtgccagttggtggggttatgcttgttgtgatgggggaatgcgattcgctggtgatgttggataaaaatcgctcaattagcactgatgtgactatttaaatcgatttgtaattgtgctttggccagttaataaaatgaaaagaatttctatcatttttctattggttcgtatttttcttcctgtcgtgagtgaggtgaattccttacctttttttaccaatattgatcatttgaaaagattagataatgcgaccataacaccacacaatacaactaaagtttccaaactacctgaaccgcataaattgattgatgagcctgtcgcagcccttctcccaccattaattcaattgtgtaaaaataagccagaggaagataatttttatcaacaaactgtgtgctgggctctttttcttctctatttaatgctaattttgagccttgttctgcatcaactctattcaatttgctggtttaagcgaaatggacagcaaacaaattacgaggattttgatggaaaatcgattcaccgcaccggtctttcgggggtgcttcgctag

SEQ ID NO: 46826 - DNA, 2441 bp, Heterodera glycines
  Genomic contig location: Contig_ID=SeqID_9859; Location=145..2585; Strand=-
  SCN-specific regions: Sequence locations=74-158,215-446,469-509,552 -672,694-748,799-1021,1043-1184,1206-1242,1287-1308,1331-1361,1383 -1542,1604-1617,1640-1767,1800-1844,1868-2170,2192-2319,2341 -2384,2406-2441
  Gene Ontology: Mol. function=sodium:hydrogen antiporter activity; Cellular component=integral to membrane; Biological process=sodium ion transport
tatattaattacatttttatttaaataaaaaaattttaaaataaaattgaattaatttatttttatataaaaagcacgtttcagttgttgatttttgactggaatgaagtgtcgacagcttattccattagtgcctggcttctgttagccagcatgtcaaaattatgtaaaaataatttatttttttaatttatatttttaatttttttttttagtttttcatgtaaacaaacgaattgccgaagcattgcctgattcggcactgctgattgcgttgggctttgttctcggcttcattttacgcttgtgccaaattgatcaccgaatttatatgctccaatcgcctatattttttctgtaccttctccctccaatcatttttgatgctggtaaatttagttaaaaatcaggcaatattaaaaggagtggttgacaaaaaaaaaatcagggtaagggttgaaaaattaaaattttttgttgcaaaatcaaggattgtataaaaaaattttgaaaatcaaaagggtcccccttttagttttgtaataaaattgttcgattcttagtcagactttttgactccataaagtgccaaaaatcctttaatttaatttattcaacaattaattgtcccaaatttctaacattgaactttaggctttttcatgccaaatcgacaactgtttgaaaattttgactcaattctgttgtttgcttttgttggcacaatttggaacacaattgcaattggtaaaaaaaataataaatttttattaatttggtaaataattaattaaattagtttttcaaaggttactcattgaattggatgggccaagtcggctttttttctgtccccttcacaacctttcaaattttgttatttgcttcactgatttcatctgttgacccggtggctgtcattggcatttttgaagaaattcgtgtcaacgagtttctgttcatcaacgtttttggcgaggcattgttcaatgacggggcagcagtggtctaatttttttgctttttaattccattttaatttaaattatttcctgaaaaaaaagtcgttgacctgggcctgaaccaacattccatgttgcacatgaacctgcattttctaaacaaaatccatgtcctggaaaaatacaggcttgtcatggcctggatgtttttttctttgaaattggttttaaaaagcaaacaaatgaattgcttaggaatatttaaaaatagctaattgacaaaaaataatatatgattaaatatatttaatcattttttaataacttgaaataaaacatcggaacttgaaacaacaaaatttcaaatatgacgcaggaaatttaggttctaattaatttattcaaatatttgatgacttttcgtctttctaattggtttcataatcctgttaaaacaggacatggttttagtcgatagtgctgtccgggtacgactcggaaatgcgtgacatggtcggacatttttttcgttgattttttaaaatttttatggggcgaccccaaaaaacgaggaaatagcttaaaaaattaagaacaataaataatagctaattatttattgttattattattatttttttgtttacagacactttacaaaatgttccaagaatttaccaatattggcccttacaatttacatgcaatggattacattgaaggcattttgtccttttttgtcatttccattggtggttgcattcttggactattttttgctgcactaacatgcatagcgacaaagttttttttttatagaattttttaataaattaacgaattattatttcttattgacaccatttttcggcaaagcacaactaaaattgtgaatttatttttaaggtatacccatgtgcgtctgatagcaccaatatttgtgtttgttgtaccatatatgtcctatttgactgctgaaatgtttggcatttcctcaatcttggcgtaatgtttattttttcattgaataattaaatttcgatattaaaaaaaaaatgttttttttgcagtttattctcttgaaaatacagtatcaccagcaattttttgcacgaataaatactgtttttttctctcaaaaattagtgcgtgcacaattgtaagaaactttttacagtaatgcattagaacatacagtatcatcagcattttttgggcaaaaatgaaaacgatatcaattgttttctttctttagaattactgcgtgcacaattgcgatgaagcaatttgtgaagggcaatttgagtcatgatgcgtacagttccgtcaaatattttaccaaaatgttggcacaatgcagtgagacggtgattttcttgttccttggcttttccctggtgtcacgggagtacacatgggattggacatttgtgtgcagcacaattgcattctgtttgatacatcggactgtcggtaaaa

SEQ ID NO: 46827 - DNA, 461 bp, Heterodera glycines
  Genomic contig location: Contig_ID=SeqID_119; Location=1470..1930; Strand=-
  SCN-specific regions: Sequence locations=1-15,43-461
  Gene Ontology: Cellular component=integral to membrane; Biological process=proton transport
atggccggcattgtggccatctacgggctggtggtggcggtgatcatttccggccggctggaggcggccgggcccggctacaccatcgaccgcgggttcagccagttcgctgcaggcctcgtgtgcggtctgtgtggactgggcgccggctatgccattggcgtggtgggcgacgcgggcgtgcgcggcctgtcgcagcagccgcgcctgtaaaaagcggtgttgaaagcaaaaaaggtcattgatttacattaatttacatggccggagaccccttcgtaaaattggaaaattggccgctgatcccttgttttgcaataatctgaattttgaggtctacatctgaattttagtgttctttatcctgaatttgaaaaaaaaacttggtcaccctcaatatacatatacttctgaacaattctaatgctaaaaaacaggcactcgcgcgaaaactgaataaa

SEQ ID NO: 46828 - DNA, 3909 bp, Heterodera glycines
  Genomic contig location: Contig_ID=SeqID_9916; Location=92..4000; Strand=+
  SCN-specific regions: Sequence locations=1-239,261-390,412-429,466 -521,544-668,690-865,887-955,977-1251,1273-1654,1681-1876,1898 -2414,2436-2843,2866-3145,3189-3201,3223-3292,3316-3413,3435 -3542,3564-3909
  Gene Ontology: Mol. function=DNA binding; Cellular component=nucleus; Biological process=hindgut morphogenesis
catcataaaatcgaaaagccccattcccccctccccccgtttttcgcctcctttttctttctctgccgttttgccgcgctaaattttaaacctttggcgtcagaagagcggcacaaaaaaatatatttgttgccaatttttgataaaccgaatttctaaccctgcaattgccaattgtttcttttaaaataatgccattatttcgacccgtcttaaaataagaaaaaaaacacaattcaatcaaagaattacatatgaaggcactttttaacttaaggtggcccaaattcttataaaaggaaaagaaaataaaaatgggcatcattctgacaagctttttttctttccaaacattgttctgtttggcactcctttttcgaaaaaaaacattttaaaaaggaggcaaaaagatatttccggtcgctgaacaaattgtgactttttaaaacaaaaatattttaaaaaggcgagaactacattaaaaaattctatgtgaagtgcgaatttcccattatttttgattttgattattttcttcaaaaacctttcattaatcaatttggtgacctttacagagatttttaaccacatattctattgaaatgcacgagttccatgcttacaacccggaccttccacaaattatcacttcttttaaaggtgttcaaatttattgccaatgatttaaaattttatcgtaattaatccctctttgtgctttcaggcaatcagaagctgatacttggcggctttcgctacaatatccaccacatcaaagagggcgtgaaaacgtggcgttgcgtttgtgccaaaaaattgaccggcacgcgcagttggtgcaaaggtgggacggataattagtttagttattactggggaccagcagcagtcagtagaacaggaccggaggctcctgcaaaaaattaatagtatacagtacccgtccatgatttcataaaaacaaagtcttactatacttttcaggattggaaatgtaaattttgtccatttgaatttgggaatgttaaagcattagttattccgaaaaatgaattagtcccagcgaattgtttcgtttatttgtaattttgatcaatttgaaggccgtgccgaaacatgggacaacgacagcaaaggcattccgaagggcgaacacaatcactcgacggagcacgaattggccgagttggaattctttaaggtgctgctgctaatcttttaccaattttggcgaattttcaatttaaattgttttcttttttcagagtcaaatgattttggcggcaatttctgaaccaaccgccgatttgagcacactaattgatgaggcggccaaatttctgagcgaaggcctcaactttgggaatagggaatcgatgaaaaagtgagtgccatggcatttgctaagaaacgaatttgaacttggctaaaagaattgcattgcttttctggcgttttctctattcttttttccggattttatctttttggcgttctgtattctgtttttattcaaaatgttcaccttcatccatccatccccaggtctttgcttgtggcgcgcaaatcggtggagagcggcgagttcaatttgggcaaacaccggacaatttcatcgggcggtcagcagcggagtttgagcagttcgactggcaaaaagaaaggggcgggcggcggaggaacgacggcacaccaaagcggcaaatcggcagcagcgatttcagcccctaagggtacagtggcgagcaaaagtgtgagtggtttgtccattgttttgtgggattatttttgtggcggtgaaaccatggcttatctgactgtgactttgtccaaatgcgtgttaaatgttttgtttctcgtccattgtttgttggtcccccttttaattgcttttaaatttgcttttatcttttaattggctccgttattaatcccattttgccattgtcaggtgcccgtttcgtcccttctctccgtttccgctgtgccaatgccttcctcgtccaaatttccctctccgtcatcgtttaaacgtagtgccgcctcttccgccgatggcatcgcaacttccttcgacacgtcgggtgctgcgagttgtagcaacaccagcggttacggcacattgtccacttccggcctcgcagacgaagactccgccacccatggcatcggatggatggatttgtctggcgaaagtggcaactttctcacttcgacggaacaccacagccatgcaaacaacgcgccgatgggaatgaacggcgggagtgccaatgccaatcttctcggagttgaaggtgggatcagatcacttgctgatcattgaactcagggtctaatcagtcagtcacgtttgttcaggtaatccgtcctcctcaaccgatcaacaacagttgttggctgcagcattgtttgctgctgccttgctgggcaatccgtccccaacgccgtcgaccacaatcgctgagacattctccaggacgttggcgaacagtaacagcaacacaactggcagtttccagcagcaccagcacacggtcggcgaaatgatgatgtcaatgatgatgccatcgagcaacaacaacaaaagcaccaaacgggggttggcacggtcttcggcaacggcaccagcggtggctggggttggagcagttcaagcaaaacaacagagggaatcatcacaaacgagaacagcaaatggcactttggataacagccgaaatgcggcgattaatgcgcgaaaaaagacggcacgcgtcaattgcattttgaataagtgagtcccaaaagggaaagtgccattgaaattttgaaaaaaatgcaatcacttttccgactctcgacaaaagctgcggagaagagtgtgtcgccatctccgtcctccaataactccgagtcaagttcagtcgccaaagtcgcggactcagttgacagcgaacagaaggacactgaaacccaacgtgagaagcaattggttacggtagcgacacagacggaccgggatacggtagtcaatgaagacgaagagctgaaagggacgcgaaagcgaaaatctgacgaaaacgcgccgtttggtcgagcgaagcaacagaacaggaacgaaaaagaggggacagagaagcgaaaggttcgcatgaagtcaaatgagaaagagaaaacgaagatagagagagagagagagaggaaaatattattgacaaaagagaaaaaagtaattaactaattaattaccctgagaatgatagaggggaaaagcattgaagaaaacgatttattatggcaattttaggtggtgtgttgctgctgttgcgaggagagtgaattgaacggatgggaaatgccgttgggatgcaaacggagggtgctgaagaccgaacaaaacggcacaacgacgaaacagcaacaaatgccgaaacaggaggaggaggaaatggcggagcaagagagcgatttggaggaggaatttttcgagaatgaccacgagatcaaattggaaattgcggaagaggaggaagagcatccgcaaaagaaggaggggagcaaaggcgaggacctttgagaagttgaagcaaaaacagatgaaagtgtggcagaaagaataaaactcaattgatcattccggtatcgaacatgtgcgaaaagaattggaaaaaacaattcgaaatcgaatggaattgaacaacaacaattttgatcgaatgcacgggtgttttgccaatgcttttccttttcttttttgctgctgaaagcctatttttgtcattttcagccaacgtttttctagtctcgggaagcccttctctctctgataaaattgttttttaattgcattcatttgattgattgtcccttcttttttcaattgtttctttcggacttgatttggctatttctcttcttcattaacca

SEQ ID NO: 46829 - DNA, 1449 bp, Heterodera glycines
  Genomic contig location: Contig_ID=SeqID_1349; Location=589..2037; Strand=-
  SCN-specific regions: Sequence locations=1-10,32-144,166-622,651 -667,733-1309,1331-1449
  Gene Ontology: Mol. function=MP kinase activity; Cellular component =nucleus; Biological process=protein kinase cascade
atgggcgccgatctgtccaacattctcaaaattcaacggctcagcgacgagcacatccaatttttggtgtaccaaattttgcgggcattgaaatacattcactcggccggcattatccatcgggatttgaaaccgtcaaacattgcggtgaacgaggactgcgagttgaaagtgtgttgtgtgttcaagattggttaaattcagcagaatgatcagtttaaaagtatttttttgtcggaatttccgcccaaatttttttcaacaattacagtatgaccattatttggtttcaagtaatactgtatttccttgcatttttttagtttttgaattaaaatccaggttcaatccaggggataagccgatcccgaatcaaatccccgacatttttaggtcatcatcgtacaccgatttgcgattcacaaattttgaaatttcgggatttttgaattttcccctaatcggatccaaaaattaaaaaaaaatgtataacaaacaatatgataccggcacgaaatggctggcaattttattacttttcaagattctcgacttcggactggctcgtcatgctgaccaagaaatgaccggctacgtggccacccgatggtaccgagcgccggaaatcatgctgaattggatgcactacacacagacgggtgaatgcttttttatacttttttaaataaataaattaattattaaatattttttgatttattttttattttagactattaattgctcttttgattattttttgctaaattaattaattatcaactacaaattgcttttttaatcatttatcaaatattgtgacctgcaaattgttttttatttgggttttactaattaattaattactaattgctttttttgcaaattaagtggacatttggtcggtcggctgcataatggccgaactgatcactggtcgtacactttttcctggagcggaccgtaaaaaacaaaataaaatttgaaaaaaattccaatttgaagatattgatcagttgacccggattatgtccgtctgtggcactccaaacgacgaatttttgaaagtcataggcaaaaaacggcatttttcatttacctcttatgccattttcgtttttccagaaaatctcgtcggaagaggcacgaaattacattcggaatatgccaagaatggagcgcaaagatttcaaaaaattttttgccaacgcaacgcccgaggcggtggactttttggagaaaacactcaatttggaccctgattatcggtaaaattggatggcataattagcaaattgaccgattttcgaataaataattttttgttgcacagtccaaccgctgaacaagcgatggaacacgtgtacttcaagcagtaccacgacccaaacgacgagccaacggcggacggacacatcgaagtggacattgaacaggagctgagcattg

SEQ ID NO: 46830 - DNA, 1781 bp, Heterodera glycines
  misc_feature (44)..(45): n is a, c, g, or t
  Genomic contig location: Contig_ID=SeqID_9926; Location=4834..6614; Strand=-
  SCN-specific regions: Sequence locations=1-513,536-795,817-1192,1214 -1284,1306-1698,1775-1781
  Gene Ontology: Mol. function=ATPase activity; Cellular component =endosome; Biological process=endosome transport
gcatttgcacacacttttaaaaaatgacaaccgcactgcaaagnnccatgaattggtgaccaaagcgactgaagaggacaaaaccaaaaattacgaggaggcacttcgattatacaccggatcatgcgaatattttatgcacgccttgaaatgtgagtgggcgaaaaagtgattttcttaattgtgagacggttgggggtgaaagtacggcactttgcatagatttggttaaaaatgtcaactcgaaaactgtagggagttggctatacttttctattgtaaatttatgacagaaaaatatctgtgaagtttgtcccgaaaaaacgagaaaggtgtcaggaactgtactttcgaaggtaaactcaaaaaatgtcgtcctttgtttattaagtgccaaaaaccgaaattttcaattttgcgaattcactgcttggtagttcctgtttgaagccaacgaatattttttcaattaatatacactggaataatccttacttaaacccatttgaaaagataaatgaacaaaatggacaaacccttcggcatttcaacagcctattccaaaaatgggcatttctataacataggggaagctaaaaacaacgggtttgagaaaaaagtcctaaaaatttaagaaatttgtatccgtttgtccatggagtttttttttgatagggagtgttcattacgaaatgataaatttctaattccaatccaaaagtaatttcttaggacacaatttttttcaaaatacggttccccttcacctttggcttttattggctcatttttgctgttcattcatttgcagacgaatgccaagccgaccgacagaaagagaccattcggctcaaaatcacggagtacatgaaccgtgccgaaaatttgaaggcatttttgcgcgacggcggcgagcggacgaaaagggcacggccggtgaaggaaaatgagaaggactcgagcggagacgaggcggacgcatcggacgagaacaaaaagttccaaaaggcggtaggtaccattttcaatttttttcaatttcatttaattttttcaccaaattgtgcttttgcaaaattaattccggggtaaagcgtggaacaggaccggatcatgaatggttttctcgggaaacgttcccctcatgtcattccatcccaaaattttccaaactactagtattttgtgcaaatttccttttggacagcttcttaagcttggaaatttttttaaaatttttcggggacgggaaacgttgtgcacccggtttttcactgggtcctcctgtccgtgtttctgttcctgatccgagtaatgttgccaagatcatccgatttatttctccagattaatattattgttagttttctaacctctttaccggaaaaaaacaacataaaacttttgccaatttcgtaaaaaattgtataaaatttaaaaaatcgcaaattcttcagatgagcaaggcgatcattgtggagaagccgaacgttgtgtgggaggacattgccgggttggaagacgcgaaaagggcgctgaaggaggccgtcattttgcccatcaaatttccgcacattttcaaaggtacggtgatgaaatttaattttctgtttctgtaagaaatttggcatttcttaattggggaccaaattgtgccataaaaaagagggcaaggagtggaccaaattttctcgaccgaaaaataaaaacaattgaaataaatttacaaaatgcttattaaaatgaataaatattaaaaaaaagaaaatataaagcattga

SEQ ID NO: 46831 - DNA, 852 bp, Heterodera glycines; identical to SEQ ID NO: 9955
  Genomic contig location: Contig_ID=SeqID_9955; Location=1..852; Strand=+
  SCN-specific regions: Sequence locations=1-162,184-548,570-852
  Gene Ontology: Mol. function=UDP-galactose beta-N-acetylglucosamine beta-13-galactosyltransferase activity; Cellular component=Golgi medial cisterna; Biological process=embryogenesis and morphogenesis

SEQ ID NO: 46832 - DNA, 2272 bp, Heterodera glycines
  Genomic contig location: Contig_ID=SeqID_9978; Location=520..2791; Strand=-
  SCN-specific regions: Sequence locations=1-629,652-684,706-793,815 -877,927-1065,1105-1213,1236-1244,1290-1566,1588-1639,1683-1715,1770 -1790,1830-1878,1928-1947,1986-2032,2083-2119,2141-2272
  Gene Ontology: Mol. function=glutathione synthase activity; Cellular component=intracellular; Biological process=neurogenesis
atgggaggcccagcaattgcaaaccgtacaacaatcattcaccgtgaaatgtttgcaaaggtgggatacgaagcggccaatttgccggacaatgatgcggaaggcattgtggccaaggggctgtatcaggcttggtaataccaattctagtaccaattaaaaaatagccaatttttatcgcttcaataatttgccaaaaacaataattttgtttaggtttactaatctgattgccctaccattttaaattgccaatatccaagacaacattccaggcccggctcctaaatcctggttctattcccgaattttaaaaaaacatataaggatcacagatacccaggacatcttttccaggcctgacctaatcatggtcctgccttttcaagtatcctttccagtagtcccttctaatcctggtcatgctcccgattttttttttatctccttctctcaataaaatacaatttaaggcttgcatttggcgttaatgacgcaattgttgttgtcgtctctggtcacgctgatcgcaacattgaacagttccaattggaactgcggctggaacaattgtcgggaaacaaaatccaaattgtcaaactttcaattttcgaatgcgatgatcagtgaatttttttatttaaatttaatccaaataatagcgataaacattttagatttgggaattaaataaataaattatttcccccaaattatttaattattcaatattttagattatttcttgatccagaagacaattcattgcgatacaatggtcacttggtcgctgttgtgtattacaaaacaattattgtgaacccaatacaaaagtcatataatgcacggctcaaaatcgaaaaatcgacggcaattgtattaataaaatacataaataataatattattataatattaaaattaaacgaattatttcacctttaaatgaaacgtaaatataaattttcatcaattaaattcttaagaaaagcccgactattagtctcgagttgacatgtgccaaaaaagttcaacaggtgacgttcaaaaaatgatcgttttttcataaatttgtttaaattaattatagaaattaattttttaggccctttctgaaccaggtatgttggaacactttttccctgaaccagaatatgcacaaatggtcaacgatatacgaaaaacatttgcaaaaatgtggagccttgagcaagatgatgatgaaaccatgaaaatcattagcgtaattaatataataaccattaattaataagtttaaaataatttttgaaatcccatggacaaaaagattttttccatttcacatatcttactgtaatgcttaaatccaattttaaatcgcttaagctgcaaatccctaaatttaaaggatgccattgaaaatcctggtaattacgtgctaaaaccaagccaagaaggaggcggcaacaatttttggaatgaagaaattgctgaaaaattacgcactttcaaacccaataagcgagcagcacacattttaatggaaagattaaggccacttgttgtgaaggtgcgcggtacaattaattaataattatccaattaacagtggtcggtgataaaggaaaaaaaagaggggtgtgcgagacagtgtgtgaaaatttaatttaattaattttaaatattattatataatttttgatctattttccactttactttcccctccaaagtaatatattaaatttattgaattaaatttcaaatttatgatatcatattattaacgggtgggggatggagaagcgaaaaaattttaataaatattaaatgttattttaatttttcatcaaatatccacttcaccctcacccttaatgggctggtactaataagtttaaaatttaatttattaattttaatactattttaattgttttattatcctccatttccgctggtgccaatatttttacattttaatttaaaaaatataaaatattggttcaattttatcgatctccagttcccctccccgttaatgggaaagtattaataattttaaaaattaatttaatttattgaaaattttatttattagaatttcatggtccgcccatacgtaaaagaggttcctcaactgtccaacattgtcagtgagctgagcatctacggctatttgttgggcaacgccagcaacatgcgtgtgttgcgcaacgaacgtgacgggtgcatgttgcgcagcaagcgcgaggatgccaccgaaggcggcattcactcgggcggaggc

SEQ ID NO: 46833 - DNA, 946 bp, Heterodera glycines
  Genomic contig location: Contig_ID=SeqID_9986; Location=339..1284; Strand=-
  SCN-specific regions: Sequence locations=1-36,58-229,251-715,737-946
  Gene Ontology: Mol. function=monooxygenase activity; Cellular component=integral to membrane; Biological process=gametogenesis
atgctttgcactggccatcactgctccgaacggtggccaaacccccctttccccgggcagtctgtcttccgtggccaagtcattcactcgcgcgcctttcacaccgcaaaaccattcgaagaccaaactgttgtggtggtgggcattggcaatgtaaatttcccggatataatgaataaattcaatggactaattaacatactttcagtccgggggcgatattgcggtggaactgagcaaagttgccaaaaaggtgggcccatggattaagatcggtcgaattgtgtccctaaaggtgtatttgtcgacccggaccggctcgtgggtgatcaacagagtgtgggagaagggccaccccactgacgcggtactgctcaaccgattcgcatttgccctgcgggcgatcactccgcgcagcgtccaaaacaggcaaaggatggcattaattgggccggggcgggcacttcacagttccttcccctcggccttcagattgatagagcgcaagttgaaccttcgctttgaccacgaacggtacggccttcgcccgtcgcatcgctttttggaggcgcacgtcacagtgaacgacgaactgcccaatcgaatcgcgagcggaacggtggtgatgaagccgaacattcagaagttggcggagaaggacgtggtgagaaacggaagggaccgacgggacgaacttcggcagacaaatcgaacccaacaaaaaacaaaatacgaccccccggggacaccattttgtagttttggatgaccaaacaaagtttcagacttttgacgatggtacgactgtgtacggtgtggatacagtaatcttcgccaccggctacaactttttctttcctcagctggagaatggcagattgatttctgtgcaggacaacaaaacacttttgtacaaattgatgtttccgcacgacttatcgcctaa

SEQ ID NO: 46834 - DNA, 1951 bp, Heterodera glycines
  Genomic contig location: Contig_ID=SeqID_1368; Location=3843..5793; Strand=-
  SCN-specific regions: Sequence locations=1-471,496-748,770-901,923 -1161,1198-1320,1342-1560,1596-1783,1805-1805,1832-1867,1889-1951
  Gene Ontology: Mol. function=cytokine activity; Cellular component =soluble fraction; Biological process=cell-cell signaling
atgaataacgatgattttcgaaaacttttggctgttccggcctcggtccgcagttcgcactcttcaagtgacagagtatctgtcaattcgtcttccgtggccaccttcacccatcgtcaagttgtgtccgttgctgcttcgactgggaatgtggcgaacaaaaaagcgccaaaaaaacggaattttgccaattttcaccgggaaaagcccgtcgagggcaaggaggaagacgacctcttcgacgagtcacaggccagactgaatgaaataatgaagaattatcgggaccgggcggcggaacgaaggaaaggcgtcagttcgacggacgacgaaatcagacaacggctgatagcaggcgcatacaaagcggtgccaggcaatttccttgccaacagttcgctggaggagacacgacgaattgaaattcaggtcttgtttggtttggggtggacaatcccagtcgaagaaaaacccattttagaattattttttatacgtttagaagtcgaaatatttgggcggagacatggagcacactcatttggtcaagggtttggattattcgctgctgaacaaagtgaggacggaaatattggagcgcgatgtgacggacaaagaccaggagcaacaagtgggtgatagaatcacttttaaccgtctttaaatcgttgggagccatgcgatgggataaacaaaacccaaccattgaattaaggacaacggacaccaaaaggattttagaaagaccgaaatttaatttaaaatgaatgagacaatccttatattttcttacaattagtcaataaatttaatcaatgttattctcgtaacgattaaacgtaataaattgtttcaggattctcaagcgaatgcgccgttgtcggagagcagtaaagcggccaactccaaattggcggcaaacatttgcaaattgctttttgagagtaaaccgcccaaacgcaatgagctttttgcgcgtggacgtatggcttatgtggtggagttggaggacgaggagacggacgtgcccagcactttgctccgttcggtggtcgactgcccactggaccaatccagcgagaacatcaacgcggacaatctgctgatcaatgtttgtgtgggacattcactgacattggaactcattctgaacaaaacgcgaaaataatttatattctgaaattattatttttatttctttgaccaaaaatagtcggaaactgctgaataagggaatttagtttatttcatcataataaatttctggggaatttgattttatataaattggatatcttttttaatttgcaatttttgtgttaagaaactcactcaagtgctcgcttatcttcggacggacgtcaaaaaaagacggaagggcgctggtgatggcacgacagaagcggcaaaaggggaggctgaaacgagcatttttgaggggttggaagagtacgagccgagcaaggaaaggcagcaggagacgagacgaggacgggaagaaggacagcagaagaggacgacggcctcttcctattttgacactgacaacagggacaggtaatatttttggaaaatttgaaaaatatttaaaatggaaggtatttttccggtatacgggtctgatcaagaccaaatttccatactaatatccaaattttaacgatgggagtccgcggtgccgataggcgccccaaggaaacatttgcaaattgtcagacagttgcctaattactcccagttttccagcagaagcggcagagacgagagggacaagcggggacaccgcgagacaaaagacagagagcggaagagggagagggaaaaggacgaaccgacgaacgcagcgaacaacgcggacacagcggaagagcagcacctggagaagctgaagaagcgtcgtttggagcaggaggacgcctacgccgaattctatcctggtacagagttttaa

SEQ ID NO: 46835 - DNA, 2586 bp, Heterodera glycines
  Genomic contig location: Contig_ID=SeqID_1370; Location=7..2592; Strand=-
  SCN-specific regions: Sequence locations=1-370,392-565,587-710,736 -806,828-1171,1194-1225,1247-1294,1316-1947,1990-2548,2570-2586
  Gene Ontology: Mol. function=guanyl-nucleotide exchange factor activity; Cellular component=mitochondrion; Biological process =exocytosis
atggacagcgcaaccggtgaaggaggcggcaatgctctaactttggactgggaaaacggagtaaaattacctaaatgccataaaatatataataatgccatttggctcaatcaaaaggttgtccgtgaggttgtggattccctggtctaccgagtttctgcttccactgaacacgaaaagccaaaccagaaaaaagtatgccattttgaccgatgcatttattccttatcattgcttattcctcccctccctttcttcaggacgttcctccccgttcaaggcacacttcgaccgatgagcggctgagtgtgaacgggttgtacagcccaacggtgcccaatggttcggctactcattcatttgaccaaacgacagcggaagacgaccacagttcggcgggaatgggcggcggacagaacacgccgcagcaaccgtcaaaattggagtttcacagtttggaggagaaagacgcctttctcatcttccgcgcattgtgcaaattgtccatcaaacagacaccggacgaccaggatacgaggtgggggaaacggagtaatgagtggggaattttatttctaggaatctaattgtacgggtttggctgaatgcattttgaatgacaattttttactccatggtctcggataatatatttgctatcttatgcaaaagtaatgtggaaaatgacagtcagcggcaacagatgctccaataaaattaaatattttatttaaagccgctgtgtttagaatcaatccaattttcgagtcggacccgctaggaacagctttggattggctaacaatcagccagcccttttccccagcggaattttctctcatctccccaaggagtcacgaattgcgttcgaagctgttgtcgctggacatgattttgctgattgtgcgcaacttcaacgctgcactgcccgacacgcacagtttcgtctacgccattcggcactttctgtgcgtggctttgactcacaatgccgtctctccgaacatcagcgtgttcagcaaagcactggacatttttgttcatttggtcgacaagtataaggtagttgtaaatagagaccattttataatttcatattttaatatcgacaaaaatgattgacaatacgaaaatacataaaactcttaaaattatgaaaattttagacgtaaaaaatttaaatgttttgaaaagataacgaaatatagctatgatttttagcacataaactgttttctattttttacatattcaaatctttcatataatggaattgtcttcggactgattaaagtatttattttctttgtttttcaagatccatctgaagaagcaaatcgaagtgttcttcaaggagatcatcatttccattttggacagcagctccagttcatttgaacacaaatgggtggtgctcacgacaattgccaaaatttgtgacagtccgcagagtgtggtggacatttacgtcaactacgactgtcacatgacatccgccaacattttcgaagaattggtcacgcatctgtccaaaatagctgtactgtcttcatacatgtacatttatgtcatgccattctgtgccttttccagtccggttactccgccgattcgtcctctccgtcccatggccaaattgcgttgaaagagcgcgagaggcgaatgcgcgagttggcattggactgtctggtgaaggtgctccaatgcttggtttactggtacgaggagatgaacctcggcaaggagcagtccattcatggcggtgacgaaactgcgaacgcggcgccctccgcgtgcaatgggaatgggtcggacgtgaacgtaacagcacaggtcattcattaatcactaatcacccctcaaaatggagccgtttcctgagcttattacaggccaaacaacaaaaaggcattgtggagagtggcattgagctgtttgccaagaaacccaagcagggcttgtcatttctgagtgagaagggcttcgtcggggcggagccgacggacattgccaaatttttccacgcggaagagcgattggacaagtcggtgatcggcgactatttgggcgacggcgacgagttcaaccagcgcgtgatgtactcctacgtggacaactttgacttcaccggcgtgagcattgtgcaggcgttgcgcactttgctcagcaaatttcggttgcccggcgaggcacagaaaatcgatcgaataatggagaagtttgcgagcaggtcagaatcttcggtttttgtttcatttaatgttttttttgttgcagatattgtgcttgtaacccgcagcttaaccacatttttgcctctgcggacactgcttatgtgctcagctattcgattattatgctgaccacggacctgcacaacccacaagtcggagctttatgaaaataacattttggttcattttgttcaggtgaaacggaaaatgacaaaggatgaatacattcggatgaatcggggtatcaacgaccaatcggatttgccggacgattttttgtctcaaatttacgatgacattgccaccaatgaaatcaaaacgaagccgggaaatttaaaacggccgaaattga

SEQ ID NO: 46836 - DNA, 1860 bp, Heterodera glycines
  misc_feature (960)..(960): n is a, c, g, or t
  Genomic contig location: Contig_ID=SeqID_10047; Location=1416..3275; Strand=+
  SCN-specific regions: Sequence locations=1-36,60-72,108-111,139 -228,274-277,300-336,360-456,484-714,739-744,766-830,853-919,943 -1169,1215-1238,1263-1274,1298-1443,1479-1737,1759-1770,1793 -1823,1846-1860
  Gene Ontology: Mol. function=translation factor activity, nucleic acid binding; Biological process=protein biosynthesis
atgggcaaggaaaagatccatatcaatattgtggtgatcggtcacgtcgattccggcaaatcgactaccactggccatctcatctacaaatgtggtggaattgacaaacgtaccatcgagaaattcgagaaggaggctcaggaaatgggcaagggatcatttaagtacgcttgggtaagtcgtaatccaaatcatgttcatgttaaaatatattttttttaggtgcttgacaagctgaaagccgaacgcgagcgtggtatcactatcgacatcgctttgtggaaattcgagacaagcaagtactatgtcaccattattgacgctcctggccatcgcgacttcattaaaaacatgatcacaggttctgttttgcaatacctttgtaagccattgtcgttataaccatgataattttcattgtgcaaattaaaatttaacaaccaatgatttgcagggacttctcaagctgactgcgctgtgctggtggttgcttgtggaacgggagagtttgaagctggaatttcgaaaaacggccaaacgcgtgagcacgctttgcttgcgcagactttgggggtcaagcagctcatcgtcgcttgcaacaaggttttgcttttgtattgtttcctgaaatagttctcctttccagatggacaccactgaaccgccattcgccgaggcccgttacacggaagtgatgactgaagtgtccaacttcatcaagaagatcggttacaacccagccaccgttccattcgtcccaatctctggcttcaatggcgacaacatgttggagccgtctgacaggatgccgtggtttaaggggtgggcgatcgagcgcaaagatggcaatgcatctggcaaaactctgctcgaggctcttgactccattcttccgccgcaaagaccaactgacaagccattgcgtttgcctctccaggatgtgtataagaattggaggtnttgtttgtttgacacatggctatttcatttgttgcatgtcatggcagttcgtataacagttcgtgcaataggcaatgcgggaaacggctcataataagcttggcttaattttgggttgcttggacttggacttaagtttatttatggtgctaactgctattgaccccatttgttgtttaggtattgggacagtgccggttggccgtgtcgagactggtgttctcaagcctggaatggtggtcacttttgctccgcaaggcatttccactgaagtcaaatcagtggaaatgcaccacgagtccttgccagaagcgcttccaggagacaatgtgggcttcaacgtgaaaaacatctctgtgaaggacattcgccgtggttcggtcgcgtccgactcgaagaacgacccggcaaaggagaccaagagcttcacagctcaaggtttaacattataatcttatagcagttgtaacacctatgcacttttagtcatcatcatgaaccacccgggtcagatcgctgctggttatactcccgtgttggactgtcacaccgcgcacatcgcgtgcaaattcgccgaactcaaggagaaggttgaccgtcggtctggaaagaaagtggaggacaacccgaaggcgctgaaaaccggcgatgctggtagaacaactctatataatcagaaatcagtctttaatttttctagggatcgtcgatttgattccaaccaagccgatgtgtgtggaggcattcacggactacgctccgcttggtcgtttcgccgttcgtgacatgaggcaaaccgtcgctgtcggtgtgatcaaggcggtggagaagactgaaggcggtggaaaggttaccaagtcggcgcagaaggctgctgcccctggtgggaagaagaaatga

SEQ ID NO: 46837 - DNA, 889 bp, Heterodera glycines
  Genomic contig location: Contig_ID=SeqID_10071; Location=698..1586; Strand=-
  SCN-specific regions: Sequence locations=1-574,607-638,660-889
  Gene Ontology: Mol. function=adenylosuccinate lyase activity; Biological process=oviposition
gcccttctgtggcgccagctttggatttggctggccgaatccgaacgcgaattgggccttgaggcgcaaatcagtgccgaaatggtggccgagctgaaagcccaaaagcacaacatcaactgggacaaaatccgagcaaatgaacggacgatgaagcatgaagtcgtggcacatatccacgcctacggcgaagtttggcaacaaaaaatgggcgagggcaaaaaaatgagccatttaacagaagagtcgttagtttgacagctttatttcgggttcaaatttgcaaattttaagcgttcgaaatacaaaaaaaaatcatttgacttaaaaaagtacggatgttgtgccgaatttcggcacaaattgtcaatgaattcgaaaatgatacattcaaaattgcccgaatgattgcaaatgggaccatttaaaggggcaatggcagtgagtgatgaattcccggctctattccattttttactcgtccaatcagtgacaatcatcagttttattgaatatacgcgaaaataaatgaatttcgggttttctcgttgttttttcttaatgaaagtatttattcttttcttgtatttataaattccttaaaactttaagctttcgattggtaccaaaaatgtaagcatttaccaaataagaaaaaagtcatggcctaagaaactgagaaaggtcactgattggacccataaattggaatataaccgggaatcccttccccaattcctgagtaaatgttaccaaatctaaaaactgatgcttttgaggtgtgcccgttggccaaagggatcatccatttgggtgccacttcgtgtttcgtgcaggacaacacttgtctgatactccaacgggaggcgatcgaccatttgcttgaacg

SEQ ID NO: 46838 - DNA, 693 bp, Heterodera glycines
  Genomic contig location: Contig_ID=SeqID_1386; Location=1127..1819; Strand=+
  SCN-specific regions: Sequence locations=1-606,628-646
  Gene Ontology: Mol. function=protein phosphatase type 1 intrinsic catalyst activity; Cellular component=chromosome; Biological process= cell cycle
atgcacggcggcatctccgataagatccgcagcctggaccagctcagcaacttgcttcgctcgcagatcgacccgccgctccgttcgctggaaattgacctcctctgggccgacccatcgacgagcatcacaggcgtcaggccaaatgtgcagcgcaaggctggcgtcctgttcggcgcggacgtggtcgagagcgtgcgcaacctgctcggcatcgactacatcgttcgggcgcatcaggtgagtttttttcgcttttcatttcacattgatttctttcattaatttttcccattcccttttttccagctcgtcatggacggcgtggaatacttcgcggatcgccacctgatcaccgtgttctcggccccccgctacaccggcaagaacaacacgggcgccacgctgctgatcgcgccggacctgagccacacaatcacgcgcttcccgccggcctgaggacgacgagacgaacggacagaacgcgcgcacacacacacactaactgcacacagagggatggcggaactgcccgaagaacgatgcgtgtggagaaatcggatcgtctgccccccattgttgtattgtattgtaaacccccattcacatgatcaaccccccaaaaactgttgtcatttcaattatttgcgtgtttgaatgtatgtatttgtatgtatatgtatgtgtgtgtga

SEQ ID NO: 46839 - DNA, 628 bp, Heterodera glycines
  Genomic contig location: Contig_ID=SeqID_1386; Location=2326..2953; Strand=+
  SCN-specific regions: Sequence locations=1-628
  Gene Ontology: Mol. function=protein phosphatase type 1 intrinsic catalyst activity; Cellular component=chromosome; Biological process= cell cycle
atgcacggtggcatctccgacaagatccgcagcctggaccagctcagcaacttgcttcgcccgcagaccgagccactgctccgttcgctggaaactgacctcctctgggccgacccgtcgacgagcatcacaggcgtcaggccgaacgcccggcgcaaggccggcgtcctgtttggcgcggacgtggtcgagaagcatcaagtgagttttttttttttgcttttcatttcacattgctttcatttcaataattctccccttccccttttttcagctcgtcatggacggtgtggaatacttcgcggatcaccacctgatcaccgtgttctcggccccccgctacaccggcaagaacaacacgggcgccacgctgctgatcgcgccggacctgagccacacaatcacgcgcttcccgccggcctgaggacgacgagacgaacggacagaacgcgcgcacacactaactgcacacagaaggatggtggaactgcactgagaacgatgcgtgtggagaaatcggatcgtctgaccccccattgttgtattgttctcattttgcatgataaactactcaaaaattgcactaaacgatggggctagctcttttggagcaaaacaaattgtagca

SEQ ID NO: 46840 - DNA, 899 bp, Heterodera glycines
  Genomic contig location: Contig_ID=SeqID_10134; Location=1910..2808; Strand=+
  SCN-specific regions: Sequence locations=1-899
atggagcgtcgtgcggcaaaccgacgtgcgtctcctctggctccattgcggcgccgcgttgtgcttacgggtggcaacggaggtggttcgatgcgcatctcatcttcaactcgccttatggtcgaccgagaacgggaacgacaccaccggggagggaccagcgcaggagggagcggtcgaggaacaattgtcgggagaagtcggtctaagagtagatctccgcacaggtataggtcaagtaccgtctaaaaacaaaaaaaaaattttacaaaggaaggaaaaacgtaatatggtgggagttgaactcgagccgcgcatttcttcgcgcagacaccgctgccgtgactttcatggtaacaaattgtatagcactgtagtgtaacaacagattttagaaaaagggttttgtatgcgtggtgataactgcccatttgaccatggaccggaccctgttgtagtggagaatagtgctttgaaagacatcgttcgcgacaccactatttttgatacttccaccacttacggggtgaatccacctccgcctggtttggaaagcacggttacaccaagtgctatttgtgtcaacaaactttctggtggtgtcactgaaggtgggcactttaaaaatgacgggccgtaagacgtgaattcatttattttgttgttcaggctacaacccagaagctccatccatggataattcggcagcaattcctcaaatagatttttcggttccacctccgccccttccgcagcatttcctacaacaacagcgccaaatcctttatccacctgcaccaacagcttccggcattattccaacatttggtgctgctactgctacgacggctcctacaaatgcctccggtggtggcgttcttccgcttcgttcagcagtt

SEQ ID NO: 46841 - DNA, 1446 bp, Heterodera glycines
  Genomic contig location: Contig_ID=SeqID_10146; Location=986..2431; Strand=-
  SCN-specific regions: Sequence locations=1-153,176-624,648-799,821 -1116,1139-1246,1272-1371,1393-1446
  Gene Ontology: Mol. function=protein tyrosine kinase activity; Cellular component=cytoplasm; Biological process=mesoderm development
atgccaacacggtggtcggcgccagaatgttttactaagaacaaattcacgcacaaatcggacatttggtaggccaacgtttaccatcgaaaccaatagatgtacggttttctgcctctttaccccgaaaattggctcatgccttttggcaccatatatattttttattctaattaatagtataagggattgctaatcgcaaatccggcttgcatttcaaacactgacttgctttcgacaaaaaattagccggattcgtgctcacaatcagcgacccccaaaacctataaatttgcatattttaagaaatgtgatgattttcaggtacctaaatagcatcctttttctagtgcgaatctaaaagtgttaaacaagcaaaaagttcacaaatcattgaaacatcaaaaaaggatatttttgttcagattctaatacaaaagcaagtttttaaaagttcgactttttgttcgaatttgggttcggggttcggaataggcgaaaataagtatcgtattcgtgataagcgactttgaaaaatcccgggttcttgttttcaggacttattaatccaaaaaaaaattgaaaaaagttgaccaaaaaataggacccaaactcgagtaatactatttttattatctgcattttaaggtcttacggtgtgctactcttcgaaatattctcgtttggtgaaattccatttgacaactatacaaatgacaatgatgtgatcgatgccgtcaaaacaggtgcggatccgggtgtgccgaaagactgccaagaagaaatcgctgttattatgccaaaatgttgggatcaaacgccggaaaaacggatcagtgccgaaaacataaagtgcgcgttggactgcataattcttgcggatgttatgcaaaaatgttggacaccggaaaaaaggatcagtgccgaaaatgtaaagcgcgagttgggcaacatcggtcgaatggagcaagaggcgaagtagcgtaactgacttggcacacaatgcccaccctttctgaagccattcacaagcgataagaggcacaagcctcgtaacactatgtatttcgattcatttctataatttattatttctcactatttcaataacaaaatgaaaaagaagtgtaaaattaatagtgtattatatatatgtggaaaattgattactaatgactagagaccggcgcaggacagggtcctgcgcaggattttgcaggatcccagtccgcaatcctgcatattttggaaaatacaggatttgcaggattaatcctgccggatcctgtcctgtaaaaaattttgaattccaatcctgcaacagggcacgcaaatttgattttttgcaggattcagcaggatcctgcattgattttttgaaaatttttaaaaatagaatgccaaatattcagaaactttctttttcaaaatttttttcttaataaa

SEQ ID NO: 46842 - DNA, 820 bp, Heterodera glycines
  misc_feature (77)..(77): n is a, c, g, or t
  Genomic contig location: Contig_ID=SeqID_10165; Location=2..821; Strand=+
  SCN-specific regions: Sequence locations=1-399,428-546,568-820
  Gene Ontology: Biological process=positive regulation of growth rate
atgagcattttaactgcttcgaaagtgtgcactttgccacggctttcttccgctcgctctatgacttggtggtgggncccggagaaaaacaatgggcgcgaagttgttggccccactttccacggggatgaagtgtgttgacttggcaattgtcaaattattatttgtaataatttggttccgatagttttaccaagatcgtcttgaccgttggtacccgtccattcgatttcgcaaaaatgacgaagtgatcacgcccattcgccacaaggaattgggagattggaagaagttgagcattgaggagaagaagcttatctaccgctactccttccgtcaaactttggtcacatttcgtcgtacattttctttggcattagcattatttggattcgatagattattattattttttctgtttaggccgagtttgaggcactgacgccttatggctatctcacagtcactttgttcttttctatgcttgggcttactattctgtacgcttcgtttgttaggacttacggtattcagttataggtactttgactcttatttatattttttgaacagtgacaaaattcaatgaccgattgcctgacactttcgatgatgaatataaagtttgttttgaagttttaagtaattttcaaagcaaacaaaagtattttaggaaagtcaggccgagcgccgtgtggtactggaaagggtaagcaaattgcgatgccatttgagtcctttgagaattattcgccaaaaaattcagggccatctttatgggccggcctactattacgattacgataaaaatcgctggaag

SEQ ID NO: 46843 - DNA, 435 bp, Heterodera glycines
  Genomic contig location: Contig_ID=SeqID_10182; Location=86..520; Strand=+
  SCN-specific regions: Sequence locations=1-91,113-269,291-291,313-435
  Gene Ontology: Mol. function=pre-mRNA splicing factor activity; Cellular component=small nucleolar ribonucleoprotein complex; Biological process=morphogenesis of an epithelium
atgaacataattctggccgactgtgaagagatgcgccgcattaagcccaaacaaggagctaagaagtcaaacgtcgaggaggaaaagcgcattcttggcctggtgttgctgcgaggggacaaaatcatctccatttcggtggaaggaccgcctcaaaaggaggattctggtgtgcagttgccaaaggctggcggactcggtgggcctggacaaggacgaggtgccggtcgaggaatgccgatgggtgtggtgccgccaatgggagctgttcctccgggttcgcatctcatattatttcaatttgtttacactgcctttgttttttcaggtttgcagggcgccgttcgtggaattggtggtcctggaatgggtgggcccatgcagcccggatacatgcaagggatgccgcagggaatgccgccacgtccattttga

SEQ ID NO: 46844 - DNA, 1807 bp, Heterodera glycines
  misc_feature (1283)..(1283): n is a, c, g, or t
  misc_feature (1315)..(1315): n is a, c, g, or t
  Genomic contig location: Contig_ID=SeqID_10185; Location=800..2606; Strand=-
  SCN-specific regions: Sequence locations=1-331,366-759,781-801,823 -837,862-902,925-1250,1272-1364,1386-1807
  Gene Ontology: Biological process=embryogenesis and morphogenesis
ttctcattaatttggtggacacttaccgcactctcaacaaacccatcgtgctgacgtcgctgaaaattctcgctaattctgtcgcgtcttcaaaggaattggctcaaactgtcgccaattccggtgaccctttgcgttttatattcggaagatcaaatggacggaattgaaacttggcatttataagatggacggcccaaaaagggttgggcacggattgactgattttttcgctctctaacagagctccctccccccccccccgcgtcgttctccttcaaaaattttttttgaaaatttttcagcgattttttcaaatttatggtgaactaataagttatttcaaaagaaatttacaaaaaatcgctgaaatttttaaacttttttttcttgaaatttcttactaaaaaatttcctcgttaactttttttgtcaaattttctacatttggaatttttttttcaaaacgtttttcggggggggggaacgacggggggatagaaaaccaaggaaaaggttatttgtattattaaggttaagcgaagagaaaacgcacaattaattccgatggctttcttcagattggattccgcttctttcgtcaatgctcaaaaatccttcacacgacgaagaacgaattttatcacacaaaattctgtccaacattcttttcgcctttggacgcgagaaaaatgaattgccggcgcacctttacgaattgcataagccaatgagcaacaaaatgccacaaattgacattgtaaatttaattaccaaaaaccaaggtgcagtgacaaagggcccacggacaaaggacccacaaaataatacgggccctaataataaaattatatattaaaacttacaaaaagctatcaaaacagtcctattttccttacacaaagccaattggtttttcaaatttatcaggtgtttgtccacggactgcgcggaagtgcgtttcggacatggcgccaaaaagacagaccgaacgaaaggaccacacttttttggccaaaagttcgttttgtcagcgtgccaaatggcctcgcttttcttaggattggttggccgtcgacctaaaggaatccgtccgaatgatcgccgtcgattattcttcgcgtttttttcaactgagcaaatcaatggaaacgtttgaagcacgcgctcaactttttgctgaagagtttaagagaaacggaattggagaaagaccaatcgtattcatttgccacagtatgggcggactgctggccaaacagttgcttttaggtacacctcanaaagtgtctaatttcggtccacttttacattnaatggtcaataatactatttatcattttgttttacattaggtccttgatttttggacttaaaatagcaatttggttcagaaaatgagcagctcctctcgaagactgtcggtgtgcttttcatggccaccccccatttgggcactcccgtggcctctcaactccgcccctatttcatcagaccgtctagcgacgttttgcttcttcagcccaaaagtgaacagaacaacaaattggccaaccgtttcaacaaagcagcggaacaaatcccattcattgcgaccgtattggagtgcaagaagacaagggttttcggaagagaagtgatgctcgtgcccgtggagtcgggcataatgggcaaaggaccggtgtaccaccttgacgaaggacaccataatgtgtgcaaacccgagtcaaaagaatcgattgcgtaccaaattgtgtttaattttattaatgatgtgttagaatatgttaaaccgtttaacggtaaa

SEQ ID NO: 46845 - DNA, 5253 bp, Heterodera glycines
  Genomic contig location: Contig_ID=SeqID_10189; Location=1..5253; Strand=+
  SCN-specific regions: Sequence locations=1-135,157-511,533-779,801 -910,940-1400,1422-1422,1445-1481,1503-1679,1701-1712,1737-1808,1830 -2221,2255-3235,3258-3315,3337-3449,3471-3656,3697-4282,4304 -4356,4382-4679,4771-4778,4801-4887,4940-5253
caagtacaactacacgggccaggagaaagcagccatccccttagtgagggagagcaaggccttattgttagccagaaaacattttggaggggaaagcccggacttttttttgttcttcgggtcaacaatttcttctcaagtcttattttaaaaatcgcagtgctggagagcaaaaaacaggaatttatattaattttcgccaaaaaacaggactaatttttgccattttggggtcaaaattgttaatgtacctttttctttaggtcatttcaatggccaagggcgtccagtcgcttatggtcaacatggacacggactttgccgtcgccatccgacagcacatttacgctgagctgcaggactttgtcggcggaccgttgcgcgaccttttggccaaagccgtgaagcacaaaaaggacattttgacggggtatcaaatctttttttttttaatttttcatcaattgccataatcatttgctatatgatattcatttaaaactaatggaagaataattttttcaaagatttcgttagtttttttgggctaaccgttcattttcgaaaaattcaaataaattatcagccaaacaccggaggatggataataattctctacaatctggcgcattgcactttccatcacttcgatttcagtgtgatcagctcaatcatggagacgtgctctgatcagtcggccaacagcggaggaattgcagaccatcggccgttgaacaaattcaattcccgctcctccgacctttcgtcatcgatgcgttcgttgggcggcggtggcggcaaaaagtccaaaaagggcggcgccgacacgggctcaatgcccgacttgcgcggccgaaggcgcagcgtggtgccaagcagcactcaggtgccatcaaaacagtcaaaacccattttttaaatttaattaaaaataaatttggaggaaaactttttcgagttttccattgcttgccagtcaaaatgttgttttttcgtagctttatttggctcggacgatgctggaatcgctggtgcatgagaagtcgtcctcgacgggccgacgaatttatcggaaggatttggacgaaaaatatcgcgagaaaatggtaatgaataagaacgggatggatctatggaaatgccaagaaatggcactccaaatttgcgttttcaggtgcatttccttcgccagtcgtatttttggcccgcactgctcgacctgaagcagtcgctggacgaaagtgtgaatttgtcccagctgtggttccgcgagttttacttggagatggcaatgggcaatcgcattcaggtggcaaaaaaagatggataaattaaaacattggcagtgagtgccagggatggaaaaatgaagcaaatttataaaaattggtgcggaacgcaaaataaatgaaaaatcaacacacaacagttagtgcagatggaaattagagctttaaatttcaaatgttcgggagcgaaactcaatttttaattttcaattaatttccccctcatttttgtatgattctcccctctcatcagttcccaattgacatgtccatgccgtggatgctcaccgaccacattctgaccacgttggacccctccctgctggagtgtgtgttgcatcagctcgacctgtacaacgacgcggccgccttcgcactgggccatttccgcaagcagttcctctacgacgaggtggaggccgaggtgaacctgtgctttgatcagttcgtctacaaactgtccgaggcggtgttcgcccattacaaacagcgggcggcgacgtaattcgggaaaacacagaaaatgttaaaaaggcccctgcatgacaaattgttattgttattcagaaaatgaattgaaattgattttcatcatcattttttggtcctctaatccctaaaactaaatgattttttttaattcgggtgcattatgaacactttaccgtacagaatgctgctcgacaagggcttcaaggaggactgtgcccgttatggaattgccatttttatgcccaattcggtacgctttgaaactctgcttcgacagcgtcatgtccaagtaagccgcagcaaatttccgactgtcttttagctttatcgtctcaatttgctttctaattctgttttatcttcagttgttgggccgttccatcgatttgaatcgccttatttcgcaacgaatcaacgcggtacatttttccaccgggggttatgtaaattttgcattttataggctttattgcgctcattggacgtggccatctccaaatttgaagcggacggtctcaactgtattatggtgagttttttttggtggtctgtttttgaaaccccttagaatcgattcacaattccaactttaaatgaattttaattcattttgccgtggtcattaggtgctggacaatctgatcgaggtgaaccgtttgtgccatcggctgctctccgaccatttgggctctttggccgactttaacgaccttttgctggaggcaaatcgccaagtgtccgcccccaacggacgcatcactttgcacgcgtttgcccagctgacggacgacgtgttggtcaacttctgcttcaacacggccacgcgccgatttgttcgcggaaaggtgattgagcttaataaacgattgtcatattgcactgcaaattcgactattaatttcgttttggtggctcagttggttatttgctgtccattcgcttattatggcgttggatcgcttcccgccacgtcccgtgtttttaaaaatttaaccggaaatgatgataaatacagacctgtatggaaatgcaccatgtcgaattaaacctctaagaagttctgatccggttaatcctttttaaattagccattgtttttttaatgttccctgttcagttgaactatcgtaagccgtcccgtggtcgtccgcccgctgttgcggcccagtatgaattcggttccaaatcgttgaactcctccttctccaacttgtcgatgatgtacggcggtttcgttggtgtgccccattttcgtgtggtggccaaattggttggctatcaggtgtttaaaacataaaaactaagaaaataaataaaatattaacgaaggccaatgaatttaacatttagtttattacaatttccagggcatttctgccattctgttcgatttgttgggcctggcccaacggctattgaacgatcagataaagacgcactttcggtcactgctcggacttatgcccaaaatgtgcaaattgcaacgcttcgaatacggcgttgaaggtgaacaagaaggaaattgggtggcactaaattgttattttttccacttgccataatccgcgcattcatttggcattccggtgcgcttgtcggattcccaaattaaattattacttaaaatttgcgtttcaatcttgaaaatcccgttttgaattaggcaatctccaatatttcatccaccaattgcgcgacttttccgcctacggcccgctgagacgcgaatgttgccaaagtttgcgtgaattgggcaacgttttggcggtcgctttgctgatggagttgggcatggcgcaggaggaaatgttcgatgtgtttgccgctgccgcgttcaccaaccaaattccgaaaccttacgcaaaaagttcggtcaattaattaaaaaggaataaaaatattatttttttttattgggggcaatttgttttttcaattaaatttcataaaaaatcacaaattttatcagacttggaggatcaagcgataaaaatgcacaaattggagagcaaatattcgcgtcttcaaattggcaaaattgtccatcagtttggcactgaaacggtcagtttgcggccacaattcagcagaaacccaattattttccattttctgccatcttcggttcagcaagccaaaatcgcgctggacagtgcagtgcttaccagtgaacggctcagttgcggactgaggatcttcgacatggtgctgatccgactgcacgacactttgctgaccgaccccatttggcgtggcccggtgccgaccaacggagtgatgtgggtggacgagtgccacgagttccaccggatttggtgcgtttttaatgggagggaatgcaattgaggctgccaactaatcatggatgttgttgatcaggtccgccttccaactcgccctttcgcttgcccacgtgcaaacccacggactgtcccatcagacgtccgccattggcagtgcgtcgtcgtcgttgtcgtcgatggaaaatgtttatggaacgctgaaaaagggcggcggaccaccggcaccaatcggtgccaatgtgacattggacagcggtgtggcatcgacggctgcacaacagcagcagcaacaaggaacgaccattgagtgagccaatttgggggaggatgggggatacacgactgaataaacgaaagggggggggggaatccgcggaggaagtatttggagtgcttctcgtggcgtgggacacactgatccgttcgttcatccacacaaatccctgtgagtgcttaaagggagctgttcggcgatggcatttattgggcgggctgtgccatcgttcgtctgctgggccaacatcggcgctttgaagtgctcgacttctcctaccatttgttgcgcgtgaatcgggcggttgggtcggcgcctaatcagcagcagcagcaacaacacggcacaacggcagggccaaaggaagggggaagcggcaacaaagcgcagcaacagcagcagcaacaacagcgaaatgtgagcaaatggaaaagggaaatctttagccatttccgccaaattttggcctttttcagacaaatttttttgcaaaaatatacgaaaataaggatccgccgggaaaatttggaataaatttattttttaaaaattagttaaattttaaaaaaaaactattttttctgatacaaatttcgggagaggggcctctcgcggggcttaacccaccctttattgtcacatttgtagactttcccattttaataattgtggaaatattatgcacaatgggaatatctcaggctaacagcaaaatgtatcctttccgcagattgtgcggctcatcgaacgaatccgtcgagttcaggcgcaacacaaacaggtgttcgccctgctcggcaatttctgcgttcacgtggaggaacaggagcagaaaattcggcattttgcaccgcccgtctatcagccgctgcaaaatccgtacgcaaatggccgc

SEQ ID NO: 46846 - DNA, 1317 bp, Heterodera glycines
  Genomic contig location: Contig_ID=SeqID_10192; Location=2030..3346; Strand=+
  SCN-specific regions: Sequence locations=1-38,61-497,519-1317
atgacatttcataaaatcgacaatgactccgtgaactcaaccaccaatgcgctggactttttccgcattccgccgacaaatgtcagcgtctcttcatcaaaggtgtttgaactgcttcccagcaaccctctgacggacacacctaccatttcaaacttcattcaagtcaaaattacattgacctctccaaatgctatttgctcaccgagttccgaatccggaaggaaaatgcgaatggtcaacttatggacctgaccattgacgacgaaaacattgcgccaatccagatgattgggcaaacattcatccgaaacatcaaaatgagcatcaaagggcgtgaagtgttcaacgcaaatgcactgatggcctacaaaacctatttttcacatgaactctcctactcaacaacagcaaaggactcgcacttgaatgctgcaggctattaccgggatacgggcgagacattggagacggggccgggatgcattcaacgcagggatttgtttgccgaaagcaaaacagcccaatttattgccaaaattgataccgacctattcaatcagccgctgtacttgattaacttttgtgaattggatgtcgattgccaaatgacaacgattttgtgctaattgcacccgccatcggcggtgtttttcctcgttaccgtttcgaggtgatgggactcaaaatgtatgtgaagaaggtgtcattaatgacggattagcgctggacattgcgcgaaagcttgagataaagcctgcacgttatgcagtaaggaaaactatgatgaaatcgatggtcatcagtcagggtcggttcgagtttaccgccaatctgttcatggaccaaattacccgtcgcatcacaatggggcttgtttcaaatgccgactactcgggcacaatcacgcggagcccgttcaattttcaaccgtttaatgtgcgggaaattgggatcatcgccaacggccgttcctaccccgaggccccttacgatttggactacccgcatggtaaatatgtgcgcgctttcaacgatatgaatgaggcggtcgggttcgcaaactcgtcggaaagcaacggaataacctttccccaatttgggaaaacgcattgtatctacgtgttcaacatgacaagcagcggtgacgaccaagccgcgctctttgacctgataaagaatggaacaaccgcggtgagcataaaattcaatcgtgcggtaccagtggggggactgatgctggtcgtaatgggcgaatgcgactcgctggtaatgctggacaagaaccgatcgataagcaccgataccactatataa

SEQ ID NO: 46847 - DNA, 988 bp, Heterodera glycines
  Genomic contig location: Contig_ID=SeqID_10205; Location=18..1005; Strand=+
  SCN-specific regions: Sequence locations=1-234,257-389,411-792,816-988
  Gene Ontology: Mol. function=proteasome endopeptidase activity; Cellular component=proteasome regulatory particle (sensu Eukarya); Biological process=proteolysis and peptidolysis
atgcaaatggccatgatgctcggacggcaacaaattttcctcgagctgccggatggtgaagacggactgctgggggagctgaacgcgaactcgcacctgcacaaacacttcctggcgttggcccgcgagttggacataatgacgcccaaatcgccggacgatgtgtacaaaatgcacttggagcaggcgcgtccgttcacgcaccaggtgggcaccacagcacgggtaaatactcatccatttttaacacatttttggaaaatttttcgcgattatcgggttcaaacatagattttttcaattttagatggcctaaacaactttaaataagtgatcgaaagtgattgtgtccaatagtttaatcgtcagcgaatttgaaaaaataatcatttatccagccaacagaaagttatacagaatgagtcaaaaaaccaaatttaaatccgattttggacatgcgcttaaagatctcaatgcgaatgcaactgaaaaattgctgtttcatatgtcaataatgcttttcccttcgcttccaggccgtcaagacgactacgacgacaccatttgcgcagtttgtcgaagtgtgcgcatatgcgggcaccggaaatgtgctgaaggtgcagaaaatgttgcacatttgcacggaacacaccgacaaaaaggaggtgagccgaccaacaacaataaaaatggaggattttaatgcaaaataaatcccaaaagtggaacgggaacactagcgaaagaccatcagctgatttgtttttgcctcataacgtttgttttttttttgtcaaaaaagtttttaaaaaatcggtaaattcaaatagctctctcattttagtaccgaaaaaaactagctgaatgaataacttgcaaaaaagtgccgtcgggaagacatttatgcttatgcctaaaattttgtttgttttcattccccgaaaaatgccaaaccccccaaaatacttattttatcggtatttttgta

SEQ ID NO: 46848 - DNA, 539 bp, Heterodera glycines
  Genomic contig location: Contig_ID=SeqID_10210; Location=2747..3285; Strand=-
  SCN-specific regions: Sequence locations=1-53,78-90,135-146,179 -233,268-341,366-539
  Gene Ontology: Mol. function=non-chaperonin molecular chaperone ATPase activity; Cellular component=intracellular; Biological process=reproduction
gccacacggttacgttgcacctcgtcctcttggaaaacttctccgcctcctgtaccatgcgctcaatctcctccttggacaggcggcctctgtcgttggtgatggtgatcttgttctgcttcccggtagacttgtcctgcgccgacacgttcagaatgccgttggcgtcgatgtcgaaagtgacttcgatttgaggcacaccacgtggcgccagcggaatgccgctgatcttgaacttgcccagcaggttgttgtccttggtcatcgcgcgctcgccttcgtagacctcaaattgaacagttttcacacagaaacaatcaaaaggggaaatgccgttgctttacctgaatcagcacaccaggctgattgtccgaacaggtggtgaatgtctgcgaagtctttgtcggaatggtcgtgttgcgcttgatgagtgaagtcatcacaccgccggccgtctcaatgcccagggagagaggggcaacgtcaagcagcagcaagtcctaaaaagaaaggaatacacacacaacagtgtcaaaaaa

SEQ ID NO: 46849 - DNA, 819 bp, Heterodera glycines
  Genomic contig location: Contig_ID=SeqID_10210; Location=2514..3332; Strand=+
  SCN-specific regions: Sequence locations=1-58,101-128,181-407,432 -505,540-594,627-638,683-695,720-819
  Gene Ontology: Mol. function=non-chaperonin molecular chaperone ATPase activity; Cellular component=intracellular; Biological process=reproduction
atggcggaacgcttccatgccccacagccgccaccgcccggcttgccggaggaggcggtaatttttattattaatgaaaggatttatttttatttttttaggtgtgggtcccgccgcagggcgctgatggtggcggcggcgaggacggtgctggcggcggggacggcggcggcggcggcgccaatttgtttggcggcgaggtttttagtttatactttataaataacatgatattttttgacactgttgtgtgtgtattcctttctttttaggacttgctgctgcttgacgttgcccctctctccctgggcattgagacggccggcggtgtgatgacttcactcatcaagcgcaacacgaccattccgacaaagacttcgcagacattcaccacctgttcggacaatcagcctggtgtgctgattcaggtaaagcaacggcatttccccttttgattgtttctgtgtgaaaactgttcaatttgaggtctacgaaggcgagcgcgcgatgaccaaggacaacaacctgctgggcaagttcaagatcagcggcattccgctggcgccacgtggtgtgcctcaaatcgaagtcactttcgacatcgacgccaacggcattctgaacgtgtcggcgcaggacaagtctaccgggaagcagaacaagatcaccatcaccaacgacagaggccgcctgtccaaggaggagattgagcgcatggtacaggaggcggagaagttttccaagaggacgaggtgcaacgtaaccgtgtggcgccgccgggaaagattttggaaatttcattctgatttgttcatttaa

SEQ ID NO: 46850 - DNA, 1632 bp, Heterodera glycines
  misc_feature (263)..(263): n is a, c, g, or t
  misc_feature (368)..(368): n is a, c, g, or t
  misc_feature (585)..(585): n is a, c, g, or t
  Genomic contig location: Contig_ID=SeqID_10211; Location=3517..5148; Strand=+
  SCN-specific regions: Sequence locations=1-418,467-585,608-821,845 -852,875-1007,1044-1420,1442-1502
ggcggtgttgcgggcattgaacagttggaccccacccaatggacgggcaatcaacgaattgtccattttggtccaatggcacagcgcgacccgttcttctatttctatccgaaaggctgggatttgctttatcccgctcagttcggcttcttcccttatcggactaagtttgtgccgaccgaccaaataaaacgaatatttcgtcaagaaaaaatatcgaaaaatgtaaattttttgcaccccaaacattttttcagcaaatntcttggcagttctgcggtcgtttgtgtgtgggctttcggcatttttttgttcctcggcggcattctgatgatttatttgggctattttattgaatacaaaaaacncgttttggcgttggactgttgaagagcggcaaaacactgtattttcatggatttattttttacaattaaatttaatgatataaaatttaaaattaaatgtgccaaatataaattgtagatggttccgcccgttcaaattgctggcccattgttggccggcaccggccattttgctgctggtggttggcatggtttgctcagtcagcaattctcaggntgtgtatgtgtgtggtgttgtgccgcggcaatttggaaaagcccggtggactttaaaattgccgatggccgattactagagccttaaatttgaaaaaaaaacggggtcgggataatcccgagtttgtcgggatcccgatcccttccgggctctatcgattaccacaaaaaaaacgtttttatccaaaaaattttgaacaacaaatccttgataaaattggtggactttaacagttcaagaaatgatgatttgaattggtaaaaagcgctgggctttcatttttaaaaatgatcggccctcaaatagccgacttttttaagtgcccaaatgtttgcctatgccattggtattaaaatgactaatgttttacaaaatcagtctaaatgttaaagattttgcatatcttggccatttaaaatgggaaattttttttttaaattacaaaaaattataaaaatgccattgtccattgaatttctttcaaattttgcagtttctcagtgataaactgcgccatcaccaccaccgtgatcagccagcctcggtcactgtgtacacaacccattacaaagtcaaaaaaaaactatgaaatttccaccaaaaaaaattccggttttagcagccccgtgccacctacgaagtcagtccttatcagccgttgccaccgccggccaacccagtctatgtgaatccaaatgcacgaactcatctgttagacccgaacaaggagctcaaactgttcccaccggtgtatgagaatttttgggattttttttttatataaagggctcaaatggactaattgaggtggttggaccccatttcggcattggacacttgggtatcaaacaaaaaatacactgtttggggtttaaagagtcactgatcagtgatcaagagggataggtatgtctgatagagagagagagagagaatggagagagagagtcatgggggagagagagagaatgagagaggatatggcagagagagagagagagagaggcccttaaagggaaggagagagagagagagagagagaaagag

SEQ ID NO: 46851 - DNA, 3199 bp, Heterodera glycines
  Genomic contig location: Contig_ID=SeqID_10220; Location=40..3238; Strand=+
  SCN-specific regions: Sequence locations=1-143,165-797,819-926,973 -1021,1055-1933,1956-2394,2416-2577,2600-2635,2657-3034,3056-3199
  Gene Ontology: Mol. function=microtubule binding; Cellular component =microtubule cytoskeleton; Biological process=gametogenesis
gagtccgttgcgaatgttcgacgtccccggcattgacgcgccggtgatgtcattggtgtacaaagagcgatttccaaaggccaagcagcaattggagagtcgaatcctccaattcctgcagcagaatgcacccctaagcggcttcagctctcagctgcttcagccgaccatcgcttcttcaacgccgttggtgggtcctttttgagggtatatctcttcaatttcttccgattcagcgtgccacttctccccagcccggtcagccccccggtgccatctctgaccattcgtccgtctgtcggcctcagtcgccgctgcccgtgcgccctctgtcgccactcgtcaccgaatcggccactgcaattggcgacgcggtcattcgttcatcggctcatttctcctcccagggattgctctcaccgcaacagcaacgaccttttgtggaagaagcagaaagaattgaaggtttgccttgtcatcattcaatctatgcaacacaattcggaacaggaggagaacgggacggtcgtcaatcgtcgctcgccaaacattcgtcgcctgtttgttctccgtcctccaccacggttctgaccaccaccgaccagaacattcttcggctcatttccgacggggccactcgctttttgcaccaccaattgtgcgaaattgcatccgactgtctgcagaagagcaaagacggaatgctcagctgtgcctacttttgcaatatgtccgtcagattggacgaaacgttggcggaggtcagttgaaaacagtcaaatttaggacaaacatctgaaattatagaattaagcaactcaaataatgtgttttgttcaggctgaagtgaaaatcggacccgattcttacagctatttgactcggttggtcaagcaacttttgatgatcgtctcaaggtctggagatctttaaatactttaaatcctttaaatttgctttttagggccgcccgtttgttggaatgtttggtaagaaattagttacgcaactaaataattttgaaaggaaaaagaggagagaagggaaaagcggccgattgtgtagctcattggttaaaacaccattttggttgagttcaatgcccccatccgatgttttgttaaagtgccactcaaatgagacaatgattaaattaattggtcaagtaaatttatgatctctgtgattttgtcactttatgagtctcacaaaaaaaatcaaaactcagcggggatagtctttttattgtgttctttccactttcaggagtttgaccccgacgagttttatcagctgttggaggaggcggagggcgccgtgcgagttcagctcggcgccggctcggcccgagtgccggacttaccgcaatacatcgtttccaaattgggcctgaacaaaaacatccacctgctgatggaggacgaccaaacggcgatggatttgggagaagaggcagaagaaacaagcgacaaaaggatgacagaaataatggggacgaatgaactgatgaaaaagagggcggctgaagtgttggcacagggagtgccaaaagaggaggattttgagacagtgcgggtgagtgaagaggcaaaacgaattcactcttttttccatggcacattcaatctattcgtttgggtcaatttatggatttgacgatttggtatacaatcaaacaatgctttcagttgattagcaatggtgcatacggcgccgtttatttggtcaaacatcggcggagtcggctgagatacgcactgaagaaaatgaaaaagcaaacactgctgatgcgcaaccaaattgagcaagtttatgcggagagggacatcctcactttcacggacaatgtgagttgacaaagccatgggacggaaaaatgttactgtttcagcctttcgtggtgtgtttttacggttccttcgagaccaagcagcacctttgcatgctcatggaatacgttgagggcggtgactgcgcttcattgttaaaagtccctaaaatttgttttcaattgtaccaattcatttcagtccgccggaactttgcccatcgaattggcccgcctttatgtggcggaaacggtgttggccatcgaatatttgcactcgtgtggcattgtgcacagggatttaaagccggacaatttgctaatcacttccatgggacacataaaactgacggatttcggcctctccaaaattgggcttatgaatcggactactttggtgtcggaaggttatctgctacaggacgacacgcagcagttcaaggacaaccaactttgcggaacgcccgaatacatcgcaccggaagtgattttacgacagggatacggtaatgaatgtgaataaattatggccctaaaaaatattggtagaccagcaaattcactatttttgcttatttaaggaaaaccggtggattggtgggcacttggcgtcattctctacgagtttttggttggaattgtgccttttatgggagatacgccggaggcgttatttgccaacataattaatgaagacgtggaatacccggagggggacgaggtgctttactacaagctgaaatgttaattagccttttatttctttctttaggcattggattcggatgctgagtcgttgattcatcttttgctggagaaaaatccgctggaccgactcggaaccgtcggcggtgctccccaagtgtccgcgcatccgttctttacaccactcgactttgacacaatcttgcggcagaaggccgagtttgtaccccaactcgagaatgacgaagacacttcctacttcgactcgcgctccgaccgttacaaccacgacgccaatgagtcagcggaggacgacgacgcggcggcggtgccaatgttttggtgcgtctgtcgttccttccagtgattcatctcttgcctttctttctgtgaaggtccttctcgacggcatcgcctcggcatagcattgtcgggttggaattgcccgccgggggaatggcaatgcttcaggccgcccatgcagcagcaattgaacggagtgggcagccgctgcagcaacaagaccgaattgtggacgatgaccgggtcgagagccgcagacgactcctttcctcggcaaccaccgcttcttccggcattggcagcgggccaaactcggcattcggtccattgtcctctacacttttaacgcgtaagatagcatag

SEQ ID NO: 46852 - DNA, 1144 bp, Heterodera glycines
  Genomic contig location: Contig_ID=SeqID_10237; Location=135..1278; Strand=-
  SCN-specific regions: Sequence locations=1-15,50-393,423-666,691 -752,774-1043,1070-1144
atggtaagttgtttgttttgaaggattaaaatttattggtcaaaagggacgtcattgaggatgactcaccaagggccgattaaatgcgaaggaattttcatctcaaggcttgtcgaagggggactggccgaatcgacgggcttactgagtgttggcgacgaagtggttgaagtcaatgggattgaggcaatgggtcttttgctatccttactaaaatcaatcttttgaaggtgaatggaaaaaagttggaccaagtcgctgatatgatggttgctaatgtacgttttcatggtccattgatttttttattctggtttattctgtagaaattcaaaaaacgattgtgttaaatacgcttttggagctaatagtcataattcatacaattagcagactttaccaaaaataaataaataacatcactgttttgattcaatttttatattttaaaatgaaattgaagaatttaggctaggtctccggcctggactgggttggcatttttttttaaaaagaacggttcccaggccctgtaaaaaccgggcccagtccagtctccaattgaacatgatgccatagaaacctctgacgatattcattaaatttttagtcaaagattttttcaatttaaggtgtattatcgaattaaaagtcactgcgaagagcacaaaaaatattcagaaaatttttggagttcatttttcataaagggaaatttctgaccccacccccttttttttgttcatgtgtagtaaataaaatttattaaatttcaggcacacaatttgattgtcaccataaaaccggctaaccaacgcaattccctgcagcgtaaaggaaaagccgaccaattcgcagttcaaagccaataccatcaatatttcaccggagatggttcttcatcatcagccgttgggaaaattggcactttcggaagcggtggaggaggaaaagtttacccgactgggcacgggtcgtctctgtatcatctgggaacggacagacaccaccaccaccaaatggatgaattttttgatgattacgctgaggatgaagatgaggatgaaatagtggaccacacaaagacagcgttaaaaatccattgaaaattatgcaagtttttctatatataatgacaaataaa

SEQ ID NO: 46853 - DNA, 826 bp, Heterodera glycines
  Genomic contig location: Contig_ID=SeqID_10261; Location=315..1140; Strand=-
  SCN-specific regions: Sequence locations=1-793,815-826
atggctttttgcctcgtccccggcgttcatctgcacaaaaaatttatgccggagatgttggcatcgcgaattgatgttcacgaagcgtgagttggagcgctaccagtgggaacacaatttgctgaccattcaggtttgtgcattggattgacatttgtgaaaccatccctgccagtgggctagaaaacccccaccccacgaaattaaaaactaaaaaatttacggagttttgcataaattttgtgtttttttgtaaataatttttgaagattattgcaatcaaatgaattggacaatattggtatcatcgaaaagcttttgatgatgagaaacttttccggcgaattctaagcaatttgtggatagaaaattttttttcgggttttctctatttgcagagataaagaaatagtcgctaaaatcttaaatccctatgtcagtatgccccccaaaagtgccgagtttgccatatttttcaattaatttctcagatcgtcggcactcaaagtgatgatgaatggcgattttcttggcaaaaattttgcgcttgcctacccggaggagcgcgagtgtttcctggacagcaacggggcggcagcgacgtgttggtgcgtggaattttcaaaatttttcgaaaaattttagttttttcagcaaattaaaacgctttggcactctgatcgcggtgggcagcacggacggacgcctgttcatctacgaccttatcaccaaaagtgcggtcaaggtcggagaagttgttcattcccttctaaattttaggccctgtttttactatatattttttgcactttttagtggggattag

SEQ ID NO: 46854 - DNA, 462 bp, Heterodera glycines
  Genomic contig location: Contig_ID=SeqID_10306; Location=1..462; Strand=+
  SCN-specific regions: Sequence locations=1-256,278-373,413-462
  Gene Ontology: Mol. function=chitinase activity; Cellular component =extracellular space; Biological process=response to bacteria
cctttttggtggcggacaacgaccagtggttcagctacgacgacgtggagagcatcagaaacaaagtgaatgaaagcccatttcgaatttcaatttgaaatgcttttgcctcattcagctcagttggattcgccaaaactctttcggcggcgctttcgtgtggactttggactttgacgatttcaacggacaatgccccggcagccaactcggtaccgtacctttatttgcaacaataatgcagaatatttgattcaaaattgaatttaaattatgttttgtccaggccgttacccgctgatccgcacaattgcccaagaattgggcggcatccaactctcacagacacccgtctcggcactttcgaatgtagaatttaatttaattaaaaataaatattatatatatttttgttgacagtcgccttcgccgtctacgggcgcagctttgccggctgtcaca

SEQ ID NO: 46855 - DNA, 3410 bp, Heterodera glycines
  Genomic contig location: Contig_ID=SeqID_126; Location=2173..5582; Strand=-
  SCN-specific regions: Sequence locations=1-285,307-365,387-493,515 -1090,1112-1735,1757-1862,1898-1922,1944-2018,2040-2212,2234 -2609,2631-2814,2836-3194,3245-3410
atgagtattatcaaaaaaattgacaaagatagtgttgaaggtcttgaaggtagtctatcattgtttaaccttccaccgacaaatgtggctattaataaaacgagcgttcgggagcttttaccattgtccgctctcaaccagacaggaccctatctttttcgtctgttttccgatagtcaatattgtgatcttagcaaaacgtacatgtatctgctaacttcgatagagcgtaagaatgccgccggagaatgggtgccgaccgacgatgcgattgaagaggacaaacatgtaggtgttattcaaaattttggaagcagttttgttcgatcattgaaagtcaacatttctggtgtcgaagtgtttgatagctcaatatactatcactatcgtgcgtacataatgcaggagcttggctattcacatgagattcgcaaagcatttcacgaggctggctgctattatccggatgaaaacagtcaggatagctactcaaacaaaggttttaccagccgagcacagcgattctcaaacggaaaacagtgcgaaacaatggtaaaactcaactttgatttggctcgtcaaaacacacttttgctgaacaatcaggatgttgtgttcacaatccatcggaacagcgatcctttccttctgcttacaccaaaatggaaaaccgttacagatgcggtcaaagatgcacaaggtaatataattacagcagcgcgtgtgacatggcatgataacacagccgaataccgtatccgtctacatgatataagactttacgtacgcactgtagacgtaacttcaagccttaatattgcgattagtagacagttggaaagcacgccggccaaatatgcgcttcgtaaggtagagatgcgttccatcttcttaggcatgggtcgtactgagctatcacacaacgtgttcacctcaactctaccacgtcgtctaatatgtgcgtttgtgtctacggacgcatattcaggcgcccggcatttgtcgccgttcaattttgagcacgcgaatgtacgttcaatcagcgccgaagcaaatgggctgacatttccaagcacgccttatctattctcgtttggcaatcagaaaaggtttgtacgagcatttgtagacatgtatgcaggccttggccttgacgattcggacaacaaaacagtgtccatttcgatggcacgattcctcagtggctgggcatttttcgtaatcccaatgacatccacgttggatgatacgcctggttttgagttaatcagacaaggtacttgcaccgtaaaagtgcaatttgagcagcctataaaggcggacggttatgaaatgcttatattaggtgaattcgactcagtcctttccattaacgccgaccgcgtgttgagcactgacggaagtgtgtaataatgaattcggttcagctaacagcaattctcaaaggcgtacattcaaccaagaataaattcattggcgtcttcccatctgataaaattccacatccaaagtggagaagaaaatacccccattgtatgataataaatacagacaaagagggaacacagggcgaacattgggtcgcctgcttcgctcttaacgctacaagggttgagtattttgacagcttaggcaatgcaccgaacgaggatttgggagcgtatttaaaaaattttaggcacattcaaattaataagcgtcaaattcaatcatcaacagcagacacttgcgggcatttttgcatttattttttagtcgctcgttgctctggcgtcccgtattgtgaggtgatggtcaatctttatcgtacacgtactattgcagatttactagtaaaggggtttgttcaggcgcttttacgtgtataaaaggcactcaaagttgaataaatttgtttccagccatgagtatattttttctcctgcttttcaccatttgttgttataacaacggcgcgaaaggggaattttttacagttgaagtgacggttgatcatcctaattattttgacaacaattttaggactttttccaaaaacacaggtgatcagctagtttttggatacagcaaaaaaaaacgcatgtcttgcaagtaaaaataacaacagccaatggagaataagttttcagaactttaacaaactagttcgttctagtccagtacatttcgaaagcattcgaaaacttgaaccaatggcatgctttgagtataatggcaagagctatgtgttttttgaggaccgtgaggcggacgaaatgcacctttatcgtgggcatgagcaaaaaattgttaagaaatttttggccaacgcaaacagaccaatgtttgactatatgaccgagcgtttatacatatctgataagtacgaacgtcagatcagtgaaattgaactaagctatctcgagcggttgtggacaaataagaatccgacaaattttacgctgctaaagctgaattttgtatgcatgttaccacaggataaaactgatttcataataatagataacaaggtgtatctgattcgatcggaccgtcgtatttacaaatatggaattaatgacggtcaaatcaacccaaaatttgtgtccaacatcagtgacacgaaatttaactttttattatttaaagaatatcgcgacgatgtaattaatatacttcaagccagctcgccaacgcctcaaatcaaattattgttatggtctgcttatacatttgacgtactgctggtcgtcatttgcgcatatgtaataagacaaattcgtcgtaccagcagcagcagtaaaacttcatccgaagatgttggcatgtttgaccaaatggaactggaaatcttttcggataatccgaaagatttagtgtacaggccaacaacggtcagagaaaggagtatttaaggcgactattctatccatctgactttatttctacccgaaacgtatatgcagcgtgcaataaaatattttattgactattatgcgttagatgatatagctcagctttatgctctgttcaaatccgaaatagactctgaaccgtccaactattttccaaatcccttgcaatcagttccttgtgtgcaccttgtgaacgaagagtacgaaaatcagcctgttgttgtagaaggaacacttgatctgataggagatctgttcttttcaacatgttatcccaagaagagacaggggatcgattggtaaaaattttaattattattcaaatgtcaatttaatcatttttatttattcaggagcgaacctctgtatgtggaattgaaggatctgatggtttgtccgggcgatttgcggaaatgtctgtcacacttcggacatcggaaggatcagcgcaacttggtcgtcgacgagctggattggcacgacgaagacgacgacatcgcagaaggagcttggtga

SEQ ID NO: 46856 - DNA, 2841 bp, Heterodera glycines
  misc_feature (12)..(12): n is a, c, g, or t
  Genomic contig location: Contig_ID=SeqID_10313; Location=1..2841; Strand=-
  SCN-specific regions: Sequence locations=1-98,120-266,288-339,369 -379,402-537,566-743,765-888,910-973,995-1214,1241-1258,1280 -1582,1656-1698,1722-2090,2112-2534,2556-2841
ctgacatttaanttgaatgggcgggaataatttggaatatctttagaagacttccccggcgtaattccacttcaccggataatgttccttacattttattaaaaaattgtgcagaaccaattacaaaaatattagcagatatatttaggctaattttggattacggtcaaattccggaaatatggcgaacatcattggtggtaccaattttcaaaaaaggcgaaaaaactgatccattaaattacaggccggtttcattaaccagcactgtctgtagagtttttgaacgaattttgagtagcaaaattttagaatttctgaacagtacaagattctttgataaagaacaatttgggtttttaaaaaatagatcgactacaacccaaatattaaaaatgatggacgatatatataattctatacaaaagaatcaacaaattgacataatctatattgattttgtcaaggcgtttgattctgttccaattgatttattacttcaaaaaatcaaaaagattggaattgaaggaaaaattcataattttttaactaactttttaaaaaatcggagttttaaggttaaaattggcgaagaattgtcagaaagtttcagaatattttcaggagtgccccagggaagtgtcttagggccattactctttttaatttttataaatgatctgccgtcctttattacaaatgaagcggcatcggttgatataaaaatgtatgccgatgatgttaaattatattatacacatgaaaacgatgaccattcaaatcagttggataaagcaattgaggctttggaaaaatggtcaaaaataaatgggttagaaatttcaactgaaaaatgttttgttttatatttagggaaaaataatatgaaaaaagaatattttattaactcaaaaaagatttctgagtcggataatgttcgtgacttgggcattataattgactcgaaacttaatttttcagaacacataagcaaaattatacgaaacgcatatcttagaagctttcagattttgagagtgttgaaaagcagggaaataaagactctaacagcagcttataaaacttttgtacgacctcaattagaatacgctaccgaagtttggaaccctaatttaaaaaaagatatagacaaaattgagcgggtacaaaaatttttcacaataaaagtttttcgaaaatgtggacttgtgtacaaaaaatatgtggaaagacttaaaatcgcgggtttacataaattagaagaaagaagaaaaattaatgatttgacaacagcttttaaaattattaaagggttcaccagcctagaggctgaacaaaatttctttttctcagaaaggcccaggaggcctttacttttacgagtaaagcgccacacggccaaaacacaaaataatttttttcataggatagtaagaaactggaataaccttccagttttagcggtgcaaattaataaggcaaaggaattcaggggtttactaaaagcaattagttctgagtaggaaatttctgtgccacatatacactatattttaatcacctgtgaatttttaacatttgatttatttttattcatttttattacggtattcattttgtattttttatttgatcatttttatttgtttgtttttggcaccatataagagcactaatgtgcctttggtttgctcgataaaattaaattaaattaaattaaactttacattttggtgcaaaattaattaaaaatttcattttccggtttttttctccggcgttgcctaacggaaccgtcgacctatgaatcttcatatttttttaaatcgagacaagatctcggtcccatttttacatcccgcccatttctattgctaccaaaaatacgaacaatttaaaaaaatcgggatgtttaaatgagcattgttcggccaatcactttccgtttgacggtaaatactgtaaataccgtaattaccgtaatcattgtgactgtttcgagcattcggcgcgtttgggaacatcgtccgtccgtttggcgtttgttcgttggcattttttgtggccaaattagtgacggatgagcagagcaaaaaggcaaagtttaggaagaaaactgcaaaagaagcagcagtgccgactgtaaaatgccatagtccctttttgaattttaaaaatggcacttttccccactaactttttggcattttgtctccctccaccgtttctccattatttttcgacattttactcagttgcgacttgccaatgttctttttgtgcatattcactggtgccgcttcgctgctgctgaacctcggctttctcaactcgtgccgcctcagtaacattttggtcacttggtgcgctgtcaattctgagctttgttcggccgattactttccgttttgacggtaaataccgtaatcattgtgaatgtttcgagcattcggcgcgtttgggaacatcgcccgtccgtttggcgtttgttcgttggcattttttgtggccaaattagtgacggatgagcagagcaaaaaggcaaagtttaggaagaaaaaatgtgcgaagttaaaagccattttataaatcataaatttttatgaatcgtaaaagtaaaatatattttttcgattatgctaaatgacaaaatcatatgctaataaagcatcgattgccaagtcattgaattagccaaaatttaaaaaatattattcacacaaatttatgcgtagaaaatgaacagaaaaaacgctaatttagaaataaataggaactaaaaaaggaagtgtgtttgatcccgaaagtcaattaaattccccaacaaaaatgccttctttc

SEQ ID NO: 46857 - DNA, 1279 bp, Heterodera glycines
  Genomic contig location: Contig_ID=SeqID_10342; Location=161..1439; Strand=+
  SCN-specific regions: Sequence locations=1-1,29-36,63-78,101-119,141 -244,266-377,402-462,486-1039,1061-1119,1141-1279
  Gene Ontology: Mol. function=protein phosphatase type 2B, intrinsic catalyst activity; Cellular component=calcineurin complex; Biological process=protein amino acid dephosphorylation
gtttgtggtgacatccatggccaattttatgacctcatgaaactgttcgaggtcggcggttcgccttcgtctacaaaatatttggtaaatttattttgtgccaattaatttggctggcattttgccattaatttaatttttgaaaatagcaatgttccattcaatttttggcattttgcccgtgccattatgtgttggtacatattcagattccatggattatcatcggcgaaattctatgataaacagctttctttttactaattcccgatcccgaattttaaagaatctaaaccctttaaaaatcccctcagggtgccaaaaccaaaatttgtgccaaattcagcaatttaatggcattttttcagttcctcggcgactacgtggacaggggctacttctccattgaatgtgtgctttatctgtgggccctcaaaatttgccatcccgccacgctgtttttgctgcgcgggaaccacgagtgccgacacctgacggaatatttcacattcaagcaagaatgtatgtttggatggcatggcatggcacaccgctaaacttgacgagactctcgagcagggaaagccctgaccttttggggtcccgaattcagaacacacagactctcgagtagagcttttcaatcttagcatccatgacaatctcctgagtctcgaccggagagagccgagcccggcacttttgagtatcgaattcggaacaaaatctagaatctcggcccaagcgatcgattgagtacccaagcaaaagcgacaatctcgggcggagataggcttggcctttttaagttcaaattgttggggtgttgccctgctggttctcgtccgagaatatttgaataataagcatatcaaaaatcccgtctttgccaactgatgagtgccaaccggattattttttgggatttttagaaccgggattttgttaatgcttgtatactctgtacgtggatcataaaatgggaatatttttccccattgatcacaacaatcagcacacactgattttgccccgggcaaattggcccccattatcacccactaattagtgggataatagtcaacaattaacaactaattgctgtttcctcccgcgcccatccaggcaaaatcaaatattccgagcgtgtgtacgacgcgtgcatggaatcgtttgacgcactgccacttgccgcgctaatgaaccaacagtttttgtgtgtccacggcggactgtcgcccgaaattcaaacgctggacgacatcaaaaaggcgagcag

SEQ ID NO: 46858 - DNA, 544 bp, Heterodera glycines
  Genomic contig location: Contig_ID=SeqID_1435; Location=80..623; Strand=-
  SCN-specific regions: Sequence locations=1-75,97-544
atgcgcgactgggtaatgccgttgaactttgaccatgccgacgcggaagccaaacatttaattcatattgctgacgaaaacaaagatggcaaattgtcaccggaagaaatactcacccattacgacacattgtgagcaggaataattaaaaaaatcagaatatttcagcacagaatttgtacttatgagcttaatgatttttgcttaaaaaatttatataccctcgggtttttctaatttaatatgaaaaaacgattcagaaaaaggggaaaacatttatttttttcgtttatcagtcttgattctttttttttgctaaggcgcccacagaaaaaccattttaattctcgtttgccataacttgccataaccatttctgaacaggcttttataaacagggggcggtgttgtttgaagatttgaatgtttattgtttagcgtccgctcacaggccaccgactacggcgaacagtttgcaaaaacctggacccggccgaacccccgatcagggggcgatcattcctaatccctccttttcattaaa

SEQ ID NO: 46859 - DNA, 2017 bp, Heterodera glycines
  Genomic contig location: Contig_ID=SeqID_1435; Location=1386..3402; Strand=+
  SCN-specific regions: Sequence locations=1-39,61-444,468-491,528 -537,560-597,638-791,822-858,882-1004,1026-1362,1384-1448,1479 -1594,1616-1919,1941-2017
  Gene Ontology: Mol. function=calcium ion binding; Cellular component =endoplasmic reticulum lumen
aacaatgatgttgagcggacatggaaaaattacaaggaggagcagctgaagaatggcttgctcgattggcaagactacaggtgaagaaaatctaacagagggcgagaagggtggaaaattctaaaaaaattaagaaatttgatttacggaaaaccgcaggagggccaggagatttcaccggaatacgtcaaaatgattgagcgagacgaacgtcggtggaaggtcagaagcaggccaaaaagacctgctaatttatattaaatcgagaggctaacggccaaattttaatatttttaaatgctttccatacagtaaactcaaaaattgatttacaggtggctgactacaattcggacggtaaaatggaccgcacggaatacggctgtttcatgcacccggaggactgtgaccatatgagagacattgtggtgcaggtggattagcaaatttatttattaaaaaaaaatcaaattagattattgcttattaaagtccctttttcaatgattttcattttatatatttttcacttgtcttaacttggaacgggaaaaattcacctcaccctaattctcatatttacccagtattgttgcctaattatttaaaatgatttattattaataaatctttaattgctattggagcaaaccctcaccataattctcatatttatctcaaaccctcgccataattctcatattatctatgtattttcctaattaatcccgaagtattgctaattaataaatcttttaattgttattgatgtcctttccttaaaaatccttaaaaatttctgtacaggaaaccgtcgaagacattgacaaggacaaggacggtttcgtggacatggccgagtacatcggtgacatgtacagaccagacgattatccggaactgaagggcaaagagccggaatgggtggagtcggaacgggaaatgttcagggagcaccgggacaaggacaaggacggcaaattaaacaaggcacgttgaaggggaagaaaaaagtgccacgaaaatgccaatattggctacaaaattggcaattctgccacaattaattaacagaattttgaattttaaaacttttcggctttaatgcaaaaatcgccaaaatttattgtattttcaagaataattaacttcttataaaattgaaaaaggaattaaattatctttaggaattttttcattaattttaattttttggttgcaaataattatgtctttttcaactttttttttttgtccattaaagcaaaaaaaggaattttaaatactttctttggcataaaaagagaaatacattttacgatatacatacttatgtctagggatgcaatttatagttgctaaaaactgccatccccaaaataggtgccaaaaatttcaaattagtggtgttaaatcgtaaaattttatccaaaaatggaaacattgccaaaaaaatttcaaaattattttataattttcattcaaccgttcaaatttggcgttttgctttaaggacgaaatgcgcgactgggtaatgccgttgaactttgaccatgccgacgcggaagccaaacatttaattcatattgctgacgaaaacaaagatggcaaattgtcaccggaagaaatactcacccattacgacacattgtgagcaggaataattaaaaaaatcagaatatttcagcacagaatttgtacttatgagcttaatgatttttgcttaaaaaatttatataccctcgggtttttctaatttaatatgaaaaaacgattcagaaaaaggggaaaacatttatttttttcgtttatcagtcttgattctttttttttgctaaggcgcccacagaaaaaccattttaattctcgtttgccataacttgccataaccatttctgaacaggctttattagagggggtcggtgttgtttgatgatttgaatgtttattgtttagcgtcggctcacaggccaccgactacggcgaacagttgcaaaagcatgacccggccgacctc

SEQ ID NO: 46860 - DNA, 3030 bp, Heterodera glycines
  Genomic contig location: Contig_ID=SeqID_10350; Location=573..3602; Strand=-
  SCN-specific regions: Sequence locations=1-148,197-358,420-492,514 -538,560-772,816-837,903-1057,1087-1349,1371-1422,1452-2803,2825 -2919,2952-3030
  Gene Ontology: Mol. function=DNA-directed RNA polymerase activity; Cellular component=DNA-directed RNA polymerase III complex; Biological process=growth
atgaacctgcacttgccccagacgtacgaggccaaggcggaggcgtcgctgctgatgggcctcaagtacaacctggtcagcccccgggcgggccagccgctgatcgccgcaattcaaggtgaattttggacggaggaaagaaaatgtcaattaaaaataatttttttaataaaatttctgaatttaaaaaaaaattcggccggcggagagggaataatctgctccattcttttttgctttgtcttacaccttggggttttttttttgacaagaatgattgagttcaatagtcgggagttcgtttttgggttactttcttcaatccttgtaatggaccctgcctaatcaaaatttttgcaaaaaaaaaaataaaatttttaaatgaaccttttttaataaaaaaatttaaaattttttatgaaccttttccgaatttgtaaaatttaaaaaaatgccttccaatttttttttgtcgtttttgtgattaaatggttaaaattccttttgaatttttgtccattaatttgcgtctcaacctaaatttgttttggtcctttatattttttttaccatcctcagatttcatcacctcgggctatttgctcacccacaaggacacctttctgccccggtccgaagtgcaacggattgcggccgccgttgtggaggcgaacaccggtgccaaacgcattcgtctgccgccgccggcactgctcaggcccaaggagttgtggactggaaaacaggtgggatcctttttgggcggatttaatggggaaaaatgaaaattttgcattttaactttaaaaaatatgaaaatttttcaaattcttcataatttatttttttatattttattctttaattttcttttgataattctttttttaattattattttttcaaaattcatttgactagtttctttaataattccagcttatcgaactgctcattgcgccctacaaaggcacggaagtgtgtctgaatttgtccaccaaaaaccgaatgcacaacccggacgagggcgaattcacaccaaatgtacggaaaattgcaaagatacaaacataaaaattgaaaaattttggtaaaattttaagtgtgttggggaaaccggtttgatgaaaaataaaattgttcattgaaatcgcaaattgacaattttcccgtcctgtccttaacacatttacaaaaccgagttttaaaaattttgcccataagtgttacggaatttttgaaaaatggcgtggtcaaattcgcagcgggattatacctcgccggaaaaccaaaaattttttcaatttctaacgagttttttttaacaatttgtaaatattttcatgagttcttattttctaaagaaaaaggaattttttttttattttttccaacgacttaaaacgattctgcaaaaactctttaaaaattaaaaatttctttgtttcaattatcactcacaatcaggacacctttgtgatcatccgaaataatcagttgctgtgcggttcgcttgacaaagcattgctcggctctgaaagcaaatgttcaattttctaccgtttgttgcgcgattggggcgagggccatgccatcgaggcgatgtggcggttggcacgcatttccgccgtctatttgtccaaccggggcttctcaatcggtcagttttcagcttgagcctgacttccatccccacccttccagacataaattttacaaaaaaaacttagaatacttttttgaaaatgtcgtgaaaaaaaaagatgttgaaaaattgataattttgctggccgaaattacgccgggacaaaattttaccgccaaaattttgaaaaaaaattgaaatttttttagctatttttttaattacaggggaaaatttggagtgcacccaaaaattcttattttgcaacgacgcctgccatactctcagaaataattttgtttttttttctccatcctcaggcattggcgatgtgaagcccaatgtcaacctgttgcaagagaaaagtgtgctgctgaacaccggctacaaaatttgtgaccagctgaacaaaagcatgcgcttggagcgccaaaaggacaagccggacttgggcctggtggaggagttggagtccaaaattctgaaggagctgtccagcatccgtgaccaggcgggcaaggcgtgcaagcagtacctgaggtgggtgtaccgtgcaatgccagaatttgggtggttcatgtgctcggttggggcgggggagaccgtcactgggtcccggacaattttttggtacaaattttttcacaattgccagaaacgaacaaattttgtattaaaaaagttgttgtttttttgccatttttcgccaggttcaattcggacaactatgaaagtaattatacaccaaaaacaggtccaaggacccaattaatcgaggcccaattattgtaaaatcatataaaacttccgaaaaaaaggccgtctaaaattggccaaattttatgcaatttttttagtcgaaagaatgcgccgctgacgatggcccagtgcggttccaagggatccttcatcaacattgcgcagatgatcgccctggtcggccaacagtccatctccggcaaacggccttctgacggatttgaggtcggttggtttttggtagttccgttgtattggatcaaaaattaaatcgtcttcttccatcttagttaaaaaacagacgacattaaccatgcccaaattttgccattttggggtctaattttcaaaaaataatggtacaatacagttcggcggtgccaatggcgccgctgggaaattttttcttggaaatttttgattcgcagaaccgctccctgccgcactttgagcgcaacgaccgggcgccggacgcgaagggttttgtggagaattcgttctattccggcctgacgcccacggagttcttcttccacacaatgggcggaagggagggcctcgtggacacggcggtgaaaacggcggagaccggatacatgcagcgacggctggtcaagtgcttggaa

SEQ ID NO: 46861 - DNA, 345 bp, Heterodera glycines
  Genomic contig location: Contig_ID=SeqID_10352; Location=148..492; Strand=-
  SCN-specific regions: Sequence locations=1-6,29-182,212-308
  Gene Ontology: Mol. function=glutathione transferase activity; Biological process=glutathione conjugation reaction
atggtccaatacaaattatattattttgatgggcgcggtttgggtgaatcaatccgtctgttgcttcactatgttggccaaccgtttgaggacatccgaattaaagacatggaagaatgggagaaaacgtacaagccgagtgagtaaataatgggtggcataacgccagagaaatgaatgccaaattaaaaaaaaataaacaaatttttttcagaatttttttacggaaaggtcccagttttggaggttgacgggaagccattgggacaaagtgctacgattttgcgctaccttgccgaaaaatttggtaaattaattataataattaattttatttgtttttaa

SEQ ID NO: 46862 - DNA, 1841 bp, Heterodera glycines; identical to SEQ ID NO: 10355
  misc_feature (9)..(9): n is a, c, g, or t
  Genomic contig location: Contig_ID=SeqID_10355; Location=1..1841; Strand=+
  SCN-specific regions: Sequence locations=1-175,198-367,389-444,468 -846,868-985,1021-1124,1164-1180,1211-1684,1706-1728,1751-1841

SEQ ID NO: 46863 - DNA, 2691 bp, Heterodera glycines
  Genomic contig location: Contig_ID=SeqID_10358; Location=1..2691; Strand=-
  SCN-specific regions: Sequence locations=1-70,92-366,389-755,777 -906,928-1061,1097-1638,1660-1741,1790-1918,1940-2093,2135-2166,2189 -2302,2324-2346,2369-2433,2456-2643,2665-2691
  Gene Ontology: Mol. function=protein methyltransferase activity; Cellular component=nucleus; Biological process=histone methylation
aaatgtttgcatggtaaaacaggcctgtcaagcgcttttgaggcaccaaatttgtaaaaattaatttcaaatttgatttaaaaacaaaattgatgtccatttattagtagtctgaataggcttgggacaattttcaaagtcctacttattttttcaattcattttttaaaaattttcttaggcctaaccgacgcatcaccggcccgcaatgaacaacagcaactatccggtgccaaaacttcgtccatcttccagtttagaccaaatgactacgagcgcatgccgatcactgaggttttgtgagagggagggatggcattttttttataagttgattaaaaaactgcccaacgaacaattcataacaaaacaaacaggaaatctaattgctttttgacactaaatgccgttttttgaaatttgattttataaaattttcatttttttagaaatcaatcgcattccgtcgacggaattcgacgccgcctgccgagcccaacaatggcacactgtgttcactcaatgcgtttgtcatctgtttcagcactgaaaaaggttttcatttcctgtaaaatgttaattaatttccacgaatgcatatatctggcaccgtcggatttttaattttttttttcctaaaattcttaatttagtaaatttgttgcatggttcgtcctcttgcctcttcactaaattgctgaccaaaaaaactaaaaaactgcctttctgaacattttgttaacttttctgaggactaacaaattttttacaaattttacaggcaatagacgaaagcctagggctatcaaatgataatgattggttattgtcaaaatactcgaaaacccagttgttgttgtttttttttaagttttttggtcataattttttttttttgttatacaacgaaattttttggaaatttttgcattcctaatagagataatttagagttaccaaatgataatagattggttcaattcgcacaaatatgaaatgagttatactcaaaaaccaggaaactgttgccaatttgtctctttccatattccacttcccacttatatttattattaatttaaaaataaatattttacccagaactcggcacatttcgcaccaatttggacacattttgtcgtcgtcaaccaatcgcagccgccccgggcactggcgacgggaccgatgccggcaaaaagacggactgtgccggtgccagcaacaacaaaaagcgcaaatgtgacggaattaacggcaacaatgccgacgacgacatcggcacaaccgctgcggacacagcggcaaatgggatgaaaaatgatggcattggcggtgaacatgagcaaaacacgacgcactcggagtttgactcgagaaccgaacaaggttttcacatttatcgtttaatgacataattttttgttgtttgggtctttcaattctgacccaacgactgtccaaaaatgccatttttggggtaaaaatttattatttttagctttcatgattttttggagttttttctagttgaaaaaatgaattgggctaatagacaaattatcggtggccgatggtgttaattctgataaatttttctacagaaaatgcaataattttctctgttttctcaccctttcctaatttttgaaaacttaattttcacgtttttcttcaattttaatgcatcatgtgctgacaaaaacgaaattacgaattcttaattcaaaaaaaaaatcccaattaaaattaatttttccattccttcctttttctccccacaggttccgccgtccaatatttccaattttatggctcgctgttccagcagcagaacatgctgcaggacttcacccgaaccgccacctatcagcgggcaatttttgacaattggcacgattttaggggaaaggtatggtgttgcagaaaaaattaaataaaagaatttttcatctaccaaaaaaaaaagtttattttttttttgggtttcctagggaaattcaattaatttctaatttcacttttttccgctttttcaggttgtgttggacgtcggcgctggcacaggcattgtatggaatttttgaacaaatttcaattttttttttattatttatatcataaatcttttttaaatgggaaattttcgtttgttcaacttcagaattctaatttttaaaaaataataattgatgactcctaaaatatttttcattttgattctctttagttgtccttctttgccgcacaagtcggagcaaagcgtgtttatgctgttggtttaactataatttttttttctccaaatttgatttttcatttttcaaggtcgaggcctcttcaatgtctgcacattgtaaagtataaaaataaactttttttttttgaaatttcaaattcttttctaaggaattggttgacgcgaatgggttcagctcagtgattgtggtgttgagtgccaaaattgaggaggtggaattgccagagcaggtaaattaattagtggactctaattaaataaatgagtaatttttttttggatttaattttgcgaaaaaaaacgcattgaaattctgtggcaatttttgaaaatttgtaaattgaataaatagttaataaaaaaacccaaattgaaaaataaaggcgatttttatgtaatttattcttcgagaattctcgttaaataaatttccc

SEQ ID NO: 46864 - DNA, 263 bp, Heterodera glycines
  Genomic contig location: Contig_ID=SeqID_10394; Location=129..391; Strand=-
  SCN-specific regions: Sequence locations=1-263
agcgcattgggtacgccttcaagacgaccaagccgaagcgcatcttcctgaaccctccgtgcggcacgctcggcgttggcgacgccgtgaacgtgatcatcaccgtcacgaccttcgacccgaacaacgacgacatcaagaacgaccgcgtgatcgtggagtggtgcaacacgcccgacccggccgccaccgttttcaagctggagtggttcgccgaggatggaatggtgcgccgcaagaatctgccggtcatttacaacctg

SEQ ID NO: 46865 - DNA, 932 bp, Heterodera glycines
  Genomic contig location: Contig_ID=SeqID_10404; Location=2541..3472; Strand=+
  SCN-specific regions: Sequence locations=1-58,99-461,483-739,782-932
  Gene Ontology: Biological process=positive regulation of growth rate
atggaatcgtccaatgaggagcagcagcttcaggaaattgaggctttggaggtgtaactattttttataatagataattttgtttaaaattttatttagtcaatgtattccaacgaactgagggttttgtgccgggactttccgaatatcagtgtcgaattggatgtccgccccgatttggtttgctcgttcaatggataattaactattagaatttactgattaaggacgaattcactgaactcttcggcaagagtgtcatttctctgcgcgcaacttttccctcggactatccgaattgtttccctgtcatcgatttgccagattttgatggggacgacgatgaaaacacacttcagaagactcagttttgggatgaatgtgaacggagagtgaggtcggaattggacaaagtgatggaggattgtgtcgggatgccaatgcttttcacactgctcggcgctttgcaggttcaaaagctgtacgtttcagataaccaatccaacaaaacaggaattctttgtccaaatggcagatgattaccttaaaaaccgtgatgaattggagaggataaaagcggataaaattgaacgcgaggaacgggccaaattcgaaggtaattgtttaaccaaagcgagtaggacagataattttataattcatttagggacgagagtgacggtcgaatcattcaaaaaatggaacgatgcctttttgaagtctgtcagagtgccacaggaaaaaataaaagtttaaaatgttgaatttttaatataataatcatctttcacctacaggacaatcagacgacaaagagaatgaccggaaaacagctgttcctttcggacaaatcacttaacatttccgatttgcaatttattggaaatgccaaagacgaaaatgtagttgaaattgaccagtctctttttgag

SEQ ID NO: 46866 - DNA, 813 bp, Heterodera glycines
  Genomic contig location: Contig_ID=SeqID_10411; Location=501..1313; Strand=-
  SCN-specific regions: Sequence locations=1-105,128-362,394-546,571-813
  Gene Ontology: Cellular component=mitochondrion
atggacgacgacagtgacagcaacaacaacgacgaggaactgtcgctgggcgtcttcgagacgtacgcggtgttggtcaaaattttgtgcctcaaaccgatgctgatcatggtcattgtgctgctcacgggaaaggtccaacatgggagattgaatttggatttgactgacagtttttttccgtttttcagatagcttttgccgccacagatggcatgacggaccttaaggtggcctacaaaatttataaacaaaaactttatttgtttttttctgggtccactattaccaccaccactccctcccccgtttatttcccgctgaaaaatttttttaaacacaattcttggaacttttacaagaaaaattttataaaattttttgaaaatttatggtgaattactccaaaaaatcgttgaaaaaatttttatcttttgaattttcttacattttctaacaataaaatttttttaacttttcgtttcaatttttttttttgatttctgggggaaaaagtacgggggggggacgaactctcgctataaattttcttaaattttccaaaaataaacactttatttttgcgaatttaacttctcttttctgctgttcagttgatcaacgaggggctgaccacggacaaaattgcgtcccgctccatcttcctcactccgctgcaaatcattctgccgtgggtgctcggcaaacagacggccgggccgaagccgttgaacgtgttcttgtgggcgtacccgtaccgactggtgatgagtttggcactggcactgctcgtctactggacaccgtcatttc

SEQ ID NO: 46867 - DNA, 1982 bp, Heterodera glycines
  Genomic contig location: Contig_ID=SeqID_10418; Location=495..2476; Strand=-
  SCN-specific regions: Sequence locations=1-39,61-162,184-299,327 -717,798-800,823-827,850-860,1015-1316,1338-1434,1457-1462,1484 -1831,1857-1982
atgcacagctcgggctgctgtcgcagcatctgccaacaaagcgttccgggcttacaaggtacgggcgccggcaggcgcaaaaaattttgccgacgcattcgggcgcgtggaaaaaataattggccagatattcgagcttaagacgaaaccggaccacagtaaaatgcattttaaatgtaaaaaacacagtaatttgacacgcagaatacagtaatccctaccggcgatttttcttcccacacaaaggacggctgaaaattgaacaacaatcatattcacagttggacagagtgtagttgaataaaaatataatttttttttaattacgatttagaaaaatgttacggtatctcagtctatactgtacatctttggtaataagatggagaaaactgtcagacacagtggggaaaagaaagtgggcaaaatgtaaagagggtcccaaccccgactggtgaaaaagtaaaattttataccgtatttgcctgagacagagttcccagggtggcaattacggtacttaaaatggtcggcattttttgccattttttttgcccacctccatgcaagtgaacttatagccggcgccacaacaggttagcgcgggagcgccgaattccggaagacaagcgtactcatgatgagggcatttttgcctcgcactttcgcattcagcgagctccgtcaatgggcggggcggcagctttttttgtgggaaattaataaattaattaacaaccaatagttaattagtttcctaataaataatcaattaattaacaaatcaatagttaatttgtttcataataaataattattaatgtatcaattaacaaatcaataaataattagtttcctaataaataattaattaacaaatcaatagttaatgagtttcataataaataattaattaattaacaaatcaatagttaatttgtttcataataaataattagtttcataataaataattattaattaattaattaacaaatcaataattaattagtttcataaaacaatcaatagttattagtgtcataataaataccaatcaccttagaaagtgtacgtgacttgggaattataattgactcgaaacttaatttttcagaacatattagcaaaattatacgaaacgcatatcttagaattttccaaattttgagagtgttgaaaagcagggaaataaaaactctaacagcagcctataaaacttttgtacgacctcaattagaatacattaccgaagtttggaaccctaatttaaaaaaagatatagataaaattgagcgtgttcaaaaatttttcacaagaaaagcacttagaaaatgtggttttgtgtacaaaaaatatggggaaagactaaaaatcacgggtttacacaaattggaagaaagaagaaaaatcaatgatttgacaacagcttttaaaataatcaaagggttcaccagcctcgatgctggaaaaagtttctttttctcagaaaggctcaggaggcctttacttttacgggtaaagcgccacacggccaaaactcaaaataattttttcaatagaatagtaaaaagctggaataaccttccagtggtagcggtgcaaattaataaggcaaaggaattcaggggtttactaaaagcaatgagttctgagtaggaatattcatgtgccatattttacattccatatttaatcacctgtgaatttttaacatttgatttatttttattacggtattcattttgtattttttattttgatcaaatttatttgttttgttttctttttggcaccatgtaagagcactaatgtgcctttggtttgctcgataaattaaattaaattaaaaaaaactgattgtgagcataaaaattaccgttgttattgtctcctaaaattaaaaaaaaaaaagattaatagaaaagaaacaacaaatgtttaattatttatttctagggattcctttttatgtaaataaa

SEQ ID NO: 46868 - DNA, 2780 bp, Heterodera glycines
  Genomic contig location: Contig_ID=SeqID_1450; Location=67..2846; Strand=+
  SCN-specific regions: Sequence locations=30-36,59-153,183-191,213 -225,248-292,314-314,350-594,618-641,727-847,936-1190,1214-1241,1263 -1524,1549-1838,1860-1979,2001-2001,2024-2032,2059-2115,2141 -2225,2247-2316,2369-2374,...
  SCN-specific regions: Sequence locations=...2396-2397,2432-2669,2691 -2780
  Gene Ontology: Mol. function=protein binding; Cellular component =centrosome; Biological process=reproduction
gaaatcttcctccgtgagctgatctccaactcctctgacgctcttgacaagatccgttaccaggcgctgaccgacccgtctcagatggagagtgggaaagagctcttcatcaaaatcgtgccgaacaaagccgataagacattgaccatcatcgacactggcattggcatgaccaaagcggacctcgtcaacaaccttggcaccattgccaaatccgggacaaaagcgttcatggaggctcttcaggtacagttttctagtcgcgtcgacaacctgcaaattggcaatttgtttttaaggctggtgcagatatttcgatgattggccagttcggtgttggattttattcggctttccttgtggccgaccgtgtcacggtcacatcaaagcacaatgacgacgattgctaccaatgggagagctcagctggtggctcgttcatcattcgcaattgtgccgatcctgaagtcacccgcgggacaaagatcgtcctccacctgaaggaagaccaaacggattatttggaggtttgtttcattggtactttggttcgaaagttatgtcattgtttaggaacgtcgtgtgcgcgaagttgtgaagaaacactcgcagttcatcggttacccgatcaaattgttggtggaaaaggagcgtgacaaggaaatttcggatgatgaggcagaggaggagaagaaggaagatgaagcaaaggaggaggagaagaagccagaagatgacgtgtcaggttgtctttaatcccaagtcaacttttaaactgatcacatatttaaatatttctcgttgctttctaacaactgatacatctacgtttttagatgacgaagccgagaagagaaaagaggaaggggacaaaaagaaaaagaagaccaagaagatcaaggagaaatacacggaggatgaagagctgaacaagaccaaaccgatttggactcgcaatcccgatgacatttcaaatgaggtgtgaatttaggcttccttattcacttgctttgagctattttttttctaattccaggagtatgcggagttctacaagagcttgtcaaatgactgggaggaccatcttgctgtcaagcatttcagcgttgaaggccaactcgaattccggtcggtcttgccttacctatgtttattctattactagtaatgagaaattggtgtcccagcggaatgtaaaaaggattttttcttgagcgaagaataagctggcaaaatgaacttatttttcctagtgctctcctcttcgtcccccaacgcgctccgttcgatctctttgagaacaaaaagagcaagaatgccatcaagctttatgtccgtcgggttttcatcatggagaactgcgaggagctgatgccggagtacctgaacttcatcaaaggagttgtcgactctgaggtttgtttaaattgacattgatgaaaatttactaaaataagtatctcaacctttcttttaattaaggaccttccgctgaacatttctcgtgaaactttgcaacaatcgaagatcttgaaagtcatccgcaaaaaccttgtgaagaagtgcatggaccttttcgaggagatttctgaagacaaggacaacttcaaaaagttctacgagcaattcgcgaagaacattaaggttgcgatttttcaattacatgttcccggacgctgtctttcatttcaaattaattttagcttggtattcatgaggactcggtgaatcgtaagaagctctcagactttctgcggtactacacttcggcctccggcgaggaaccatgcagcttcaaggttatattgggctattactactgtgtctctggtttgggcttctaaaataaattttattgggtatacaaaaggctgaatgtaatttcttttttcaggactatgtttcgcgcatgaaagagaaccaaacatgtatctattacatcaccggcgagtccaaggacgttgtccaaaactcctccttcgtggagcgtgtgaagaagcgcggcttcgaggtcatctacatggtcgacccgattgacgagtactgcgtccagcagctcaaagaatacgacgggaagaagttggtcagtgtgaccaaggaaggccttgagctgccagagagtgaggaggagaagaagaaatttgaagaggacaaggtcaagttcgagaagctgtgcaaagtcattaaggtaagtactttgtttttaattttagttcggagcttaatttattttttaggacatcttggacaagaaagtccaaaaggtttctgtctcaaaccgtttggtctcttctccgtgttgcattgtgaccggagagtacggatggtctgccaacatggaacggatcatgaaggcccaggcattgcgtgactcctccacaatgggatacatggcgtccaaaaagaacctggagatcaaccctgaccattcaatcatcaagtgagcgcattcaagatgaaattgagatcatgatgtaattttttgacaatttttcgtttttaggtctttgcgcgaccgtgttgagaaggagcaggacgacaaaactgcaaaggacctcgttgtgctgctgtacgaaacttctctgctcacctccggcttttcattggaggacccgcaacagcatgcgtcgcgaatttaccgaatggtgaaacttggacttgacatccccgacgaggaggagccggccgagcaacagccgagcacttcgggcgagccgacaattgcggagaaaattgctggtgccgaagaggaggcctcgagaatggaggaagttgactga

SEQ ID NO: 46869 - DNA, 2520 bp, Heterodera glycines
  Genomic contig location: Contig_ID=SeqID_10450; Location=1..2520; Strand=+
  SCN-specific regions: Sequence locations=1-1757,1779-2037,2059 -2354,2376-2449,2471-2520
caaatttccatccaaaaatgccgtgttttatgaaaaaatgccatattttcaatgccgatttcgaaggtgcgtgaaatgaacaacaccggctacgccctgctctccaaggaccaactgcatctgctgtatgggcccgagtcgccctataacaattcggacgtaataaaattaccccaaaattacggggcaatcgaattcccgcaattcttggattgattctcgaaactaattcactgctgcttaaaaaggctctgcaacgctttgttcggttgagtgacagcgaaatccatgccggcattgagagggatgtgcacgcgttggccgagttggagtccttcaaagttcggcaaaaggacgttgtcctgtcgcccattttgttcaccacctttctcctggtaaatgtccaaggatgaatggcataatatattcctggcaccacatatatctaaatggcaccaaaaggcggcaaaaatgggtaaaaatgaaactcgttattggccattcatatcgctatgattcgggatggggtaccagtacgaattggcttagtacgagttggatttcgtccataaaaatggtaactaatgggtgcaccccctaaggcaaaaggtaaacggaaaaaagcatttggctgtgcggccaactcagtctcgactcgatctcgggtcaagaaatgtttctgtttttgccatttaaatctgagtttttgggccaatataagccgaggattttatcggcttcttctttttggctaatccccaactttctctctgttcagactttctccgccaagtccacaattcttctgtcgcccattctgttcagtccggtcattttgtcccccaatgtgcttggtcccaccattctctccccgtggctttttgtgccggtgattttgtccccgcgagcgttgtcgccggtaagtcaaattcgagtaattgtcacttttccatttggggatggatcaaactctcgagtctctatggccgggactctcgacctgcctcaagtcatattctcgccatttttttttgatttgcttcccactcaccacagactgttctgtccccttttgtgctcgaccccatcattctgtcaccgttcgcaatacatccgatcattttgtcgccgggtgttctcaacgccatcagttcgaattttttttattgggaaaattccaatcagtcctggattctgttcacagttgaaacttgtgatccggagatgtcagttttttgctcccgggaagtcacaatcgctgaataacgaacgccctttttgttttgctgactctcccctttcagtactgaactaatttcctcgccattttacccttactttcggtgccgaagccgtttccccgccatttatcccttccaattcagtactgaacccatttccccgcgattttactccttctagtttagtaccgaagccgtttccccgccatttatccctcccaattcagtactgaacccgtttcctcgcaattttacccctcccaattcagtactgaacccgtttcctcgcaattttacccctcccaattcagtactgaacccgtttcctcgcaattttacccctcccaattcagtactgaacccgtttcctcgcaattttacccctcccaattcagtactgaacccgtttcctcgcaattttacccctcccaattcagtactgaacccgtttcctcgcaattttacccctcccaattcagtacttaacccgttcgtgctgtccccgttcattttgtccccgcaagccttcaccccggttattctgtcgccaattgcgctgtcgccgttcataatgaacccgagcatgggcagtccgactattctttcgccttttgtgctcactccgtccattctgtcgccacaatttttgtccgccctcattctgtcgccgtacgcactttcgccggtcatcgcaaggtcaaaaaaaattggaaaagccaaaaaagaagaaacccaataagccatggttggtacaagatcaaatgaacttattccagggtcggatctgtccttttatcagaaatgtcctgattttaagggtccaaatctataaaatgaaaatgtcttggtttgtcagaaacgtcctgattttgaggaagcgaccaaaatttgaaaattgttaaatcgataatctgaggcgaaaaatataattatttaatacatttttgatcgataatttaaaaaataactgacttgaaacaatttcgcaaaatgttctgattttcgacccaaaatctgatttttttaggcccggtgttctgattttgaaaaaatttcgatacaagccctgacttatgctaaaaaagttctattaggatgttccatatttatatttaacaaaagtttaattgttttcaaagatattgaaaatcggtacgatccaaatgatgataaatcccaaatgtcacgccatgtatctcccatgtaattaactaattatccctacaaattcagtccattgaccgccgtttctgtgattctgtcaccgagttggctaagc

SEQ ID NO: 46870 - DNA, 2986 bp, Heterodera glycines
  Genomic contig location: Contig_ID=SeqID_10455; Location=1191..4176; Strand=-
  SCN-specific regions: Sequence locations=1-67,89-196,275-320,348 -594,622-838,906-1081,1113-1125,1162-1485,1571-2188,2210-2604,2626 -2666,2725-2931,2955-2986
  Gene Ontology: Mol. function=enoyl-CoA hydratase activity; Cellular component=mitochondrion; Biological process=growth
atcataggtgccggcctgacgggcgctggcatcgcaaatgtgagcattgacaaggatatcaaaacggtaagtcacacacagaatcaggggtgtttcgtgttacccttttttcgttttacgtgtttcgttttcgtgaaaaaaacatttttgttttcgttttcaaaaattattttttggttttcgcacacttgcacagaatttataaaaagatcaaattcatttttgaaaataatatattaaattaaccaaaaacttatttaaaatcattttttaaccaaaacaatttctcgtataatccacgtaaaattataaattgatcgtaattaataaaattttaaattataaatcatgaaaatatccataaaagaacacatcccaaatatggcacctatacgcgctgaaaattatgcaattacagattctgatcgacacaaaccaggagacattggacggcggactgaagcaaatcacctcccaaatggagggtcagataaagtgcaaattgatcaccgctgctgaaaaaaaaatttttctcgccaatctgaaaccggtaagatgaaaaaatatgacacattgtatgaatttagttttttgataccctttaaagttatttttaatatagagaaaaaacttaatttccttttattatttttggctcaattttttgtcaaattttctgaaaatttttcgttttctgatgacattttttgtcaggaattggatgattatgagaaattgcgaaatgcggattttgttgtcgagacagaatctgaggagattgaatcaaagcacgaaatcataaagaaggcaagtgttatttatttggaatgtccatgtgtttttattatttcttataaattaattttcttattctaatcaatttaccaaataaaataatttttttagtcttttttttctaccgaattgctttttcagcttgaaaaggttgtgcccaaccattgcatcatcgccacaaacacttcagtactgcccatccacgacatcgtagcggtcgcacaatgccccgagcgggtcatcggcatgaactatgtgtgtgaagcaaatcacaaatatccttttattaatttttatttgaaaaattcaaaatcaaatttagaacaactcaattaaattttctttatcttaaattttataaattttcttattcacttccatcaatttccatgcatcacagtcaatttttttacacagattattaaaatagtaattaccttatttcctaaaatagagccatgactttatttttcaacctacctcaaaggcgggctctatttaatgcgagggatatattttaggaaatagtgaattggtttccctttttcagttttcgcctgtagacaaaatgcaaatgctggaagtgatcatcgctgacaaaacatcccatgaaacgcttgccgtggccgccaaactcggtttggaccaaaagaagatgattgttgtggtcaaggcgggttgcatgatttgaaaaattattttttaaaaatagactttttacattaaatacttaatcttgaaaaaaatatgtaattttcatttttttaaaaattttcttttcaggatggccctggctttttcgttgcccgctgtcttagcccaatgcttaatgaggtagtccgtctgttccaggagggcgtgtcgccgcaacaagtggacaaaatcaccacccaattcggcttctccgtcggcatggccaccctggcggacgaggcacataccaatttgttttttgaaaaaaaaaaacaattttttttagattggacttgattatagcgaatatctgaccacctttttgggcaaagcgcttggcccccgtgtgcaaggcggctcctccgaactgcttgctgacctgacaaaggccggcttcaagggcaaaaagtcgggtgcaggtgagagctgcattttttcgatgcttgcacaatgcccttattcactgggagatatggaaaataaaaggccattcattccaccgccctccttgaaaagcttaaaaaaagcttgaattttggaacaaattcttaattttgaattttttaatttggagatttgatttatttaaaaattggatggatatttaattgctttatatagtaacactcaatttcttccttttcccactcaaagtgcttttttggatttcttgcctttatttcgcaaaacaaacaatttaaatagccaaaacaaaatcatattcactctaaaaattaagtgatcaatcaaaatattttcaatgtttcaatctcgctaagatattcaaattcatcaaatcctcattgcaaatacaaatgaaattcgaatgcattgccaataattaatttttcaatttcctcaggcatttacacctattctgccgatggtggcaaaaagtcgaagaaagtgccaaattcgaaggcgcaggaaatagtggcacgctacaaactgagctcgtccgagggcgcttcgtcggtggagtatcaacaaattcgggtggtgtcgcgtttcgtcaacgaggcgctgatttgtctggaggagggcatcatttcatcaccggtgggcaattgttaaaactacaattaaattaaaaaatggatttcaattgcagaaaatgcatttatttttattggtccaaaagtttggaattttgtgctgatcactttttaattgattgcataaaattttttagttttttaaaggaattttaaaatatttgcatttaaaaataattttcaaagcaacatttgttttagtcagacggtgatgtggccagcgtgtttggcctcggcttccccccgttttggggtggtccgttccgcttcgtcgatttgtacggggcgcaaaatttgatcaagcaaatggagcgctacgggaacatttactcgaccgtacaattcaaaccgtgccaactgttgatcggtgcgatttgtcatataaacctattttaaattttgattttttagattacgctaaatctgggaagaaattttattcg

SEQ ID NO: 46871 - DNA, 1135 bp, Heterodera glycines
  Genomic contig location: Contig_ID=SeqID_1458; Location=235..1369; Strand=-
  SCN-specific regions: Sequence locations=1-1135
  Gene Ontology: Mol. function=ATP-binding cassette (ABC) transporter activity; Biological process=RNA processing
aaatgcccttacggggccatccaaatcatcaatttgcccagcaatttggagcgcgagaccacccaccggtacagtgccaattcattcaaattgcaccgcctgcccacgccgcggctcggctcggtgctcggcctggtgggcaccaacggaattggcaaatcgaccgcgctcaacattttgtccaaccgactgaagccgaacttgggcagcttcaaggtttgagcaaactttttgcgttcaaccatttacaattcacgtcacttttttgcgatgtccatcttttcaatggccattttttatgcattttttcccggtgaagggaaaatttttttgaaatttttaatgcaaatagtcaacaaattttgtccaaaaattgacctagtttttgctattttgagaaaactgtttttcaatggccattttttatgcattttttcccggtgaagggaaaatttttttgaaatttttaatgcaaatagtcaacaaattttgtccaaaaattgacctagtttttgctattttgagaaaactgtttttcaatggccattttttatgcattttttcccggtgaagggaaaatttttttgaaatttttaatgcaaatagtcaacaaattttgtccaaaaattgacctagtttttgctattttgagaaaactgtttttcaatggccattttttatgcattttttcccggtgaagggaaaatttttttgaaatttttaatgcaaattgtcaacaaattttgtccaaaaattgacctagtttttgctattttgagaaaactgtttttcaatggccattttttatgcattttttcccggtgaagggaaaatttttttgaaatttttaatgcaaatagtcaacaaattttgtccaaaaattgacctagtttttgctattttgagaaaacttaacaatgcgcttaaaatttcaaaaattttgccggacccccctaaattttggggaaaagcacgccgcaaaaaaagaggttaaagcaaaaaagaaaagaagtcgacaatttcatggctggaccacttcgcaaaattggcgcgggccgctgccccctacccccccccccccccccctctggcattccgaggccccaaaaaattttcggaaatcggaatttttcaa

SEQ ID NO: 46872 - DNA, 679 bp, Heterodera glycines
  Genomic contig location: Contig_ID=SeqID_1459; Location=494..1172; Strand=-
  SCN-specific regions: Sequence locations=1-163,185-420,443-548,570-679
  Gene Ontology: Mol. function=ATP-binding cassette (ABC) transporter activity; Biological process=embryogenesis and morphogenesis
atgaaaaagagtgctaagcccgaaattcaaacagcacagacgcgaatcgcaattgtaaacccggacagatgcaagccggtgagtttacgcctcaatttaattaaagttaattgcttatttgatatgggttattaataatttgcttttttaagcgttaattcttttatttcaattttacagaaaaattgtgggcagccatgcaaaaagaattgtcccgtcgtccgcactggtaatttttttttttggtacttatatattttacagactataagatttcatttcgaccaatttcggactcgaattcgaacaaaaagtcgaaaattcaaattaaaaaaatcatattacggtgcagaaaaaacaaaagtttaacacaatttctgaacatctgtggcgcaagcattttgggcattatgactctgccttttttatttctggtcaagatttgcgttttcggatttttttgttcgaaattttcaccaggaattggtcgaaatgggtgtcagactttgtgtgatcagtgaccccgatttaccctcttttttgaacattaaaaatgattttttgccctctatttttaggcaaacaatgcattgtggttgagccaacatcgaaaattgctgaaatttccgagatattgtgcatcggatgcggcatttgtgttaaggtgtgcatacattaa

SEQ ID NO: 46873 - DNA, 2500 bp, Heterodera glycines
  Genomic contig location: Contig_ID=SeqID_10469; Location=1125..3624; Strand=-
  SCN-specific regions: Sequence locations=1-951,973-1475,1499 -1660,1682-1914,1947-2322,2346-2364,2401-2449,2473-2475,2497-2500
  Gene Ontology: Mol. function=protein binding; Cellular component =cytosolic large ribosomal subunit (sensu Eukarya); Biological process=mRNA processing
atgtgcgatgactgccgccgtttcgaggccaaagactattggcgcgcgtgtgtgcaggtgcggcagagatgcgactacaaaaagacacttttctatttggagcaattgttaatcaaacacaatgcgcaggtcgcgcatttttaaaacattattaggttagggatggcatagaaaagtaaaacaatttatataaatttcataaaaaaggtgaccgcttattaaaaccgactcttttaacacaattttacgcagaaaattccattaggatttttgggttaggaatttgaacgaaagaattgggctatcacttttttatattagactttaaactttctttaggcccaggcaagtggcataaagccggtgcccaccggcatcgactttttcttcgcccggcagcaagaggcacgcaaattggtggatttcatcagctcggccttgccttccaaattccatcagtcccaggttctgttgatgctgagtctaaaaaggacgttactcaaaaaacaataaaatggtgaatttttgacaaaaattaacgttgctaaataaatcaaaatttgattcttgatataattgggttgccctaattgtaagaacttcttggaaattttttttaaattggcaggtaatagagaatttttagggcttcgaatgggtcaaaataattaaaaatatgctcgagttttttagcaaaatttttattttgatggttttttgagtaacttcaaacaccgttctgtttggctttgggttttgcatttgttttattgtctccccccaattttacagcaattggttacgcatgacgtgcgcagcaatttctacgattacaagcacactttctgtgtggacattgtgccgatcacgaaggacgcgctcatttgtctgccgcgcactttggcccaatccttcgcaaacattggccaattcgtcctctgtcttcgcgtcaccgacgttgtctcactgatcaacccgcaaacattgcaattgtacgagctcaacgcgtaagtggttttttaaatataatttatcccttttttcgtttataccgttttttgtttccaatttcagtaccacctattggaagaaccctttcgacattttggttcatcctaaatcgcttgtcgagttttttgtggtcgacgtggaggaggtcgacgacccttacgccgttctcccacacggtcatgggtccgtgtccacaaagcaccgactggccgatgtttgggtggtgcgcaggtgcgcctcccgccccccccccaatttgaatctcattcgattcaatttttttaattttcctgtactttttaatgcatatttctacctactacagtgaccaagtcggacattccgatgccaaatccgtttgttgccgttctcatcttggccatctgctcaatgccggcgacaccgttttgggtgcataatgcaaaaaatattccctggctttagatttagttttttcggctttattttcaaatgggtctctaaagtctactcgttccttgatttccaacgaaataattttcttattgtttttcctttttcgggttacaatgtttgtcagacgaatttgaacaatcggacatttgacgcggtgaaagaggaaaatgtgccggatgtggtcagtcagttttacttaatgctgattcgtcatttctatttgtatttatgtttttcgcttgtttaggttttgatcagaaaagcgtacgatcggagtcgccgactgcgcaagagacagtggcgactgaagagactgctcgaccaggaagagactgccagcgtggagagggagttcaatgtgagcacagtttgaatttgaaccaaccgcttattgttttgttagccggaacgatagacccggaatttttgcaaaaattttattggtaaagggaacaatggaattttaggaatttatttaaaaaaattattacattatttaaggaattcatggacgacattgaggaggatccggcattgcgcgaacggatcaacatttacaagaagggaggcggaaagcagtcggtgaaacagacggcgacgagtgcaaaccgaacagcagcccaacaacggcaccaccgacagcgaatggcatccgccgcggctgattcagcacttagcgaaggcggggaggaggagcacattgacggagcgccgacactcgcggaaatgttggacgatttggagctggacgatgtcgaaatgcgggaggaggaagaggggtagaacagacagtaaatgaatgcgatggtacagtaaccagtggatactgtttgacgcttccctctgaccatttttgtgatgtgtgatgtcaatttgtttgtttcccttttgttattgttccgtttttgtttaatgacgaaattttaaaaataacaaaacaatattttaaatttagcgattaattatcgaacttttttgaatatgattctaaatattccctggcttatattttatataaattttattctgtatattacaagtttttacaaataaa

SEQ ID NO: 46874 - DNA, 1375 bp, Heterodera glycines
  Genomic contig location: Contig_ID=SeqID_10488; Location=333..1707; Strand=+
  SCN-specific regions: Sequence locations=1-320,342-639,661-669,691 -1375
  Gene Ontology: Cellular component=CCR4-NOT core complex; Biological process=reproduction
atgaaatatctgctctttgaggccttctacaaagggcaacaagaactgctgtacattgtgccgttcgtggtcaaatgcatcaccgccagtgccaagagtcagctgttcggtcctcactgtggttgggtgtacgccattctgaaggtgctcgccgaaatacacaacgagccggacctgaagctgaacttgcgctttgaaattgaagtgctctgcaaggagttgaacgtcgatctgcgaagcattgaagttggcagctacctgaaggagcagcgacgtttggtgagtgtgaaacaaaaaaaattttccgatgattgtgcaaaacttttttaagcccaaattggtgccgccctccaaactcggcacaaccgccgcatctccaacattggcacaatgtcagttgccgcccatccaacaaccaccacaaattggcgctgggatttcagcacaaagcacggcggattatacacccactgacatggcgaacatcctcactgaaatgagcatctccaggaaatattcgccggccagttatacgcccggcggatcgcaacaacaagttccatcaataacagcccatcaaactctgcccaccttcaactacgcggacattgctttgcaatctggtacacatttatacataaattaatttgtagcaaattttgcctgttttaaggcattttgcaaataatcgtcattcctccacatttgatgcttttccaagttcatccgcagcttaaagcgacatgcaaaattgccattaatcatgcaatcaaagatgtctatggtaatactaattcattatagttcattgaaaaatttacaaattttttgtttgtttttaggtggcgtcgccgaccgcgcaattagcgttgcaatcgccgccactgaacaaatctgtcgcaaggacttcggcctggactcggctgagcaaaatttgcgtcgtggagctcaccaaatgatgcgttcaatgactgcagctatcgcatcaattacgtgccgtgaaccgttgtcacagcaaatgaacagcattctgaaaatgtatttgaccgacgcaatgggaaatgttttgcccggaagtgaccaggccaaaatggtggaagaagcggccaccgctgtgaccgacacgaacatcaacatcgccacaaatttcgtcgtgaaaaacgcgtgcgaaaaatcggttgccgacattgagaaacggcttgagccggagtacgtggcgcgcaaaaccgcctcagacgaccgtccgttccaagttgacgccgacatggcggaaatgagtgaaaaagtgccggaaatgatcagactgaaggaggggccgatcagtgaggcgatgctgaaggtgtacgacgacttctcatcgtatgtgaaattttga

SEQ ID NO: 46875 - DNA, 1753 bp, Heterodera glycines
  Genomic contig location: Contig_ID=SeqID_129; Location=2870..4622; Strand=+
  SCN-specific regions: Sequence locations=1-213,235-360,382-1004,1027 -1421,1443-1640,1674-1753
  Gene Ontology: Mol. function=protein tyrosine kinase activity; Cellular component=plasma membrane; Biological process=intracellular signaling cascade
atggagacggacgaacagatgtgggacatgccctactaccacggactggtacgttttggtggttggcatgcaattctgaccactaatgcttttgcttgtttagctgccccgcgaggacgtcaatgatctgctggtcaaagagggcgacttcctgatccgcatgagcgaggagacttcaggacaggaccgcatctacgtgctctctgtcgtcgcgggaggccacaagcatcatctcatctttcgcaccgagcgtggaatgatcgcggtggacttcaaacacgaaagaggctacaggacaatgcggcgcttcatcgagacacatctgagcaaaaaagacacggtggttgacgtgagtttgttggggagagaggggggaaggaaggcgctaattaccccgaattcccttttcagcagaggaaggtgattctactgaaaggggtcggccggcagaaatgggagctcgcacattcgaccatcacgcagggcgctgaactgggcaagggcgcgttcggcgttgtcaagcgtggcgtcttccgcgacccgaccatcgggcagcccgtgcaagtggccatcaaggaggtgtcgcagacgagtacaaaggcacaggtaaaatggacgggcagcaaattggattttcagcctgctaatcgattcccctccccactttttcagatcaaggaattcatgaacgaagcgaggatcatgcgccacttggaccacaaaaatgtcatcagattctacggcgttgctgttggccgcgaaccgctgatggtcctcatggagctggcatccgacggctcgctcgacacgtatctcaagaagacgaaaaggagtccgcgcagcaaactcttcatgtgctacggcgccgccgcgggactggaccacgtgcactccaagggcatcctgcactgcgacatcgccgccaggaactgcctcttctcagaaaacacggtgggtttctgcttttcgcctgtgaccggcgcacaatttgccgttttctttcaggtgaaggtggcagacttcggcctcgcattcaaaggaccgtcaaagcctgtggaaacgggcaagccggtgccgatcagatggctgtcgccggagacgatgcgcgaacgcacattcacgccgaagagtgacacgtgggcctacggagtgctctgctgggagatcttcagcaacgcgcaacagccctaccagttcatatccaacaacgacgtcgccccgatggtcagtgcagtggggggaagggggttgaaaacgaatttcccattttcagaatcatctcccctctcccttttcaggttctgcgcggctcacgactccgcttcccaaatgtgacgccacctccgtttgcggaattcatcaaagcgaacgtttggactgccgacgtcggtaatgttttttgtttttgttttaacattttcaaaaataatgttttcccttccctttcagcgcgccgctatgcaatgagggatgtactcgcctggatcgagcaacacatcgatgagctgatcgacgataccacagcatcgcggcacgacacgactacagctacgactcgaaaccgcggatcccgtcaaggctctcgaactggctcatagaagatggtgatcgatgtgtcgctgatgcgtttatacgttctttatgtgtgttgtatatatgtatatgagtgtatattacgtcgctgttgtatcaatatttactgcatttgtcccgtatttcgatcaaatgactgtcatatttgtatttgtcatga

SEQ ID NO: 46876 - DNA, 1753 bp, Heterodera glycines
  Genomic contig location: Contig_ID=SeqID_129; Location=8479..10231; Strand=+
  SCN-specific regions: Sequence locations=1-213,235-360,382-652,674 -1005,1028-1229,1251-1421,1443-1640,1674-1753
  Gene Ontology: Mol. function=protein tyrosine kinase activity; Cellular component=plasma membrane; Biological process=intracellular signaling cascade
atggagacggacgaacagatgtgggacatgccctactaccacggactggtacgttttggtggttggcatgcaattctgaccactaatgcttttgcttgtttagctgccccgcgaggacgtcaatgatctgctggtcaaagagggcgacttcctgatccgcatgagcgaggagacttcaggacaggaccgcatctacgtgctctctgtcgtcgcgggaggccacaagcatcatctcatctttcgcaccgagcgtggaatgatcgcggtggacttcaaacacgaaagaggctacaggacaatgcggcgcttcatcgagacacatctgagcaaaaaagacacggtggttgacgtgagtttgttggggagagaggggggaaggaaggcgctaattaccccgaattcccttttcagcagaggaaggtgattctactgaaaggggtcggccggcagaaatgggagctcgcacattcgaccatcacgcagggcgctgaactgggcaagggcgcgttcggcgttgtcaagcgtggcgtcttccgcgacccaaccatcgggcagcccgtgcaagtggccatcaaggaggtgtcgcagacgagtacaaaggcacaggtaaaatggacggggcagcaaattggattttcagcctgctaatcgattcccttccccactttttcagatcaaggaattcatgaacgaagcgaggatcatgcgccacttggaccacaaaaatgtcatcagattctacggcgttgctgttggccgcgaaccgctgatggtcctcatggagctggcatccgacggctcgctcgacacgtatctcaagaagacgaaaaggagtccgcgcagcaaactcttcatgtgctacggcgccgccgcgggactggaccacgtgcactccaagggcatcctgcactgcgacatcgccgccaggaactgcctcttctcagaaaacacggtgggtttctgcttttcgcatgtgaccggcgcacaatttgccgttttctttcaggtgaaggtggcagacttcggcctcgcattcagaggaccgtcaaagcctgtggaaacgggcaagccggtgccgatcagatggctgtcgccggagacgatgcgcgaacgcacattcacgccgaagagtgacacgtgggcctacggagtgctctgctgggagatcttcagcaacgcgcaacagccctaccagttcatatccaacaacgacgtcgccccgatggtcagtgcagtgggggaagggggttgaaaacgaatttcccattttcagaatcatctcccctctcccttttcaggttctgcgcggctcacgactccgcttcccaaatgtgacgccacctccgtttgcggaattcatcaaagcgaacgtttggactgccgacgtcggtaatgttttttgtttttgttttaacattttcaaaaataatgttttcccttccctttcagcgcgccgctatgcaatgagggatgtactcgcctggatcgagcaacacatcgatgagctgatcgacgataccacagcatcgcggcacgacacgactacagctacgactcgaaaccgcggatcccgtcaaggctctcgaactggctcatagaagatggtgatcaatgtgtcgctgatgcgttcatatgttctttatgtgtgttgtatatatgtatatgagtgtatattacgtcgctgttgtatcaatatttactgcatttgtcccgtatttcgatcaaatgactgtcatatttgtatttgccatga

SEQ ID NO: 46877 - DNA, 1305 bp, Heterodera glycines
  Genomic contig location: Contig_ID=SeqID_129; Location=10886..12190; Strand=-
  SCN-specific regions: Sequence locations=1-318,340-347,369-798,823 -1305
  Gene Ontology: Mol. function=protein domain specific binding; Cellular component=nucleus; Biological process=protein targeting
atggcagaacagcgcaaggacaacatccaacgggccaagctggcgaggcaatgcgaacgctacgacgaaatggccaaggagatgaagcaggtgttgtgagcggcgatggatcgaatggatgctttttccggatttccctgttataattttcctccccccattcaggtggccgaaatgagcgtcgaactcaccgaagaagagcgcactttgctgtccgatgcgtaccgaagggcgatcagcactcgtcgttccgcgtggcgtgtcatcgaatcccatgtgaaaaagtcgaccatggacaaacagaagcaaggtgtcaaggagctgcagaagaaggtggagagcgaggcggaggagaagggccgtgaaattttggtcagtgcgtccgtacgaatttaactgcaaaaatttttttgaaatttttcagactctgttggacaaccagctcatcccaaaggctgccgacccggaggccaaagtgttctacatgcggatgaagggcgacttccaccgctacttggccgagatcaaaccgtcggaaacgaagggtaaaagggcttcgaaaatgctaaaattcaacaaattcccccctccccaatgttcagatcttcgcaatgcactgaaggcgtatcaggaggcgtacagcattgctcaggaaaaacttcgaccatcgcatcccatccgtcttggtgtggcgctgaacttttccgttttctacgaggaattactgaaatcgacggaggaggctcgccgaatcgcacaaaaggtgggggaaggattctatttttttagtggctgttcatttttaaattttattttttttttgcgcaggctcacgacgatgcaaatgcggtcatattggcagaatccaacaacaaaaccctgaaggaggccctcgatttgatgatcaagctcagcaacaatctgagagagtggaacaagcgcaaaggtggagctgaatagaacgccgctgctgtgaatggagatgaatcgcgcaattgatatgggtgattaaattccgatggattgactcaattgtacacatatgtatgtcatgatgttgtgtatatgtatatattgctgtattacatatattgtattgcattgtataggctgtataaaaggctctacttcagtttatgcgtccaatcgttttttatgcgtccaatcgctttttatgcgtccaatcaaagttttgtgcgtccaatcaaagttttatgcgtccaatctcatttcatgcgtccaatcgctttttatgcgtccaatcattttttatgtatcaaattatgttttttttgccaaaataaa

SEQ ID NO: 46878 - DNA, 971 bp, Heterodera glycines
  Genomic contig location: Contig_ID=SeqID_1472; Location=469..1439; Strand=-
  SCN-specific regions: Sequence locations=1-136,162-617,639-694,716 -929,951-971
  Gene Ontology: Mol. function=NADH dehydrogenase (ubiquinone) activity; Cellular component=membrane fraction; Biological process =mitochondrial electron transport, NADH to ubiquinone
atgccattttgtcccctctgttcagaatatgttggcgaaactgccgcttcggacggcactttgcaaggcgataccagtgctgcaatggcgagcgcgctttttcacgaaatgatcaaaggtttttttttgtttgcttgcactttttatttctgtggaaaaacttcaaaaacccgctttccaaatatttttggccatcatttttttttgctatttcgcatattaatagaatttttatggctgttgaatgataccaagaaattgatccaattttcggtgtttttttgggtcaatggcaactcgtacaagaaaaattctaagaaattttcaactaaaacttagaatttttagattaaaaaaagtctaaatgaattttctagcctagaaaaatttcttaaaacacttaaattttcaaataatttaagaagtttaaaaaagcagctgaaaattagtaaaaaaaactttaaagaatttttaaaatgtttttataggctagaaaatccatttagatttttttaatctaaaaattctaagttttagttgaaaattcttagaaattttttttgtacgagttgtaatgacaccgtttttattaggtgacgggtaatttttatgtgaaatttaggaaaaccaaaaacaattcaatgaaatggtacggcgctcgccgatgaattttgaaaaagcatttgatttttttaacaaatttacaaaattagttgggagatgctgcgaaattatgccaacattttcaccaaaaagtgccaattttctcaaatttcaattccctccactaatttttaggtgctgctaccattgtgggccacactttcatggagccggtcaccattaactacccgttcgagaagggtccgctgagcgcgcgttttcggggtgaacacgccctgcggcgctacccgtccggcgaggagcggtgcattgcgtgcaaactgtgcgaggcgatttgtccggcccag

SEQ ID NO: 46879 - DNA, 660 bp, Heterodera glycines
  Genomic contig location: Contig_ID=SeqID_10534; Location=3239..3898; Strand=+
  SCN-specific regions: Sequence locations=1-660
caaaatattttgactcagtgccccataatttacttttatacaaattggaaaaaattggaataaggggcaaacttttattgtggataaagtgctttttgaataataggacttttcgtgttaaaattggggatgctttatcctcaagtaaaaaagttacctctggcgttccccagggatctgtcctggggcctttactatttttgatttatattaacgatcttcctgatgctttgccatcaggagtgaaattaaaattatatgctgatgatgttaaattgtatatttgttataaagcaagagcagacacagaaattatgcataaagcattgcatatttttatccgaatgggcaaataaatggcaaataagtttcaattcaaaatacttttgtattatatttgggttcaaaaaaccaaaaagaaacatataaatttgatggaaatacaataaatgctgtggatacaattagggatttaggagtaaatattgacaacaaattacaattttacgtatgcgttctttatttcgggttattaaatcaaaatcttctaggatttggattattttgtacaaaacttatgttagaccgttattggaatatgctcctgaggtttggaatccatctcttcaaaaaaatattaaaaaaatcgaaaagttcaaa

SEQ ID NO: 46880 - DNA, 1443 bp, Heterodera glycines
  Genomic contig location: Contig_ID=SeqID_10562; Location=1625..3067; Strand=-
  SCN-specific regions: Sequence locations=1-394,424-491,513-615,646 -696,749-1020,1042-1268,1290-1329,1358-1443
  Gene Ontology: Mol. function=ubiquitin conjugating enzyme activity; Cellular component=endoplasmic reticulum; Biological process=protein ubiquitination
aaacccacagatagaattttttttttcggcatatttcgtttaaaattacttaactagtttcaattttctccaaaacagactttgggacatcgaatgcggcaactgcttgcgcgtgttggaaggccacgaggatttggtgcggtgcattcgcttcgattccaaacgcattgtgtccggcgcttccgacgggtaattttatgcatttaaaaatcggtcaaaaatatgacgtcatatcagtgatatgacgtaaattgaaataagccccagaaagcgaaaaaggggaacttatagcagttttgcgcaaaaatttcaattttttgaaccattttgaggtcaaatttcataaaataagacaaaatgggggggggggggaaggcggctacgggcctgcttaatacaaaatgtatttttatgtaaatttcattaatttctgtcattcatatacagggggtgtctcaaggtgctaccccccccccccctccgaaaattaaaaaaaacaatcaaagtttttagttttttttttgcaaaattaaaaaggtataacgaaaaccaaaaaaaatctatttatttgccattctttgaattaattacctgtctaaatgctttaacttattcaaaaaatatttaaaaattattattttttttcttgtttctttttttgaaaatggcaagaagtcttcacggatagcagaatgcttaattttcttattaatttattttttaacataatttaaaaatatttttttaacagcaaaattatgatctgggacctggcggcggcacttgacccgatgacaccgcccaactccatctgtataaagacactttcggtgagtgatcagtcggcagatcaatggcatacagactaataaccagggaaaaatgcgaatcgaatgacatatattggcgagtcgagaagcaaaattttgaatttttctgtaattgccaaccgatttagcttccaacaaagtaaattttcgagagtttgaggccgaaattcgccctgttttctccataatttttgtttaattttcggtggaagtaaattgcctcagggccaggtatgttgaaccggattttcaaaaataccaatggaattccgaccctccaaaacttacgaaatgctcgggtacgggctggtcagtggccaatgaacattcttgtttttaagtaacattttgatgttcgttcagcaacacaccggacgcgtttttcggcttcaatttgacgagttccaaatcatcagcagctcccatgacgacaccattctcatctgggacttcctcaacacgggcccgtccgccgccgttgccgcgggcgctgcggcagcagccgcgcacaaccaggcaaaagaagggcgaagcgggggcagggacggtcccgggggggggggggggatgtcattaaaaaagttttattaattgacgttctaaaggtgctatg

SEQ ID NO: 46881 - DNA, 1975 bp, Heterodera glycines
  misc_feature (1942)..(1942): n is a, c, g, or t
  Genomic contig location: Contig_ID=SeqID_10563; Location=1..1975; Strand=-
  SCN-specific regions: Sequence locations=1-200,222-666,729-754,776 -946,969-1144,1166-1384,1406-1614,1636-1803,1844-1975
  Gene Ontology: Mol. function=ubiquitin-protein ligase activity; Cellular component=cytoplasm; Biological process=negative regulation of cell proliferation
tttgccaaaatgttttcaaattttcacatttaaatcttcttccctctccctcacttcaccaggaagaagtacttcttttgctccaaggaccaggcgacacgcgcaatttctcagtcgtggagacagccgaagaacggggaggacgcgttggagttccagcacaaattctaccggtacacacacaaaaatggaggattttgtaataaaaatttaaaaaaaaacgaataattcagcgaactttacccaaaaatcactgctgacattcggcaaattgagcagaattggcgcgagggacgacatcgattggagcgcatcaattgccaatcggagaatagcaaaggcatggggcggaggaaaactattatttttttggtgtatggacatttgtcgacacaaatccggagttaaaaacctacccgattttggtttgccaattttttaatgcttggctcaatgcatttcgacgccggtcctcttcaaaaaaggctcattacattccttaccgaaaatttttttttttagaaactttttaagttttctaatttttattgagatttttttaaaagagaatccacgatattctaatcgttttgttttcaaaacatgacttaaaatgatttctatgcaaatagtataaaaaaaacattcatgaactaaattgttatgaaaaaattttaatatttaaaaaatctctaattgtaataaatttggaaaaataaaataaaattgtttcctttgcggaaacgagatgattctttaggcctatgcctccccccaccttcactctgtccaaaaaacataaattcatcgatgagcacattttcattttccaattcaggtgtctactgtctccaatacgacgacgaaaagatcatctcgggactgcgcgacaacacaatcaaagtaacccacacaacaaacaattttttggtggaaatctgttaataaaaatggtcaaaatttccattttttctgccgatagcacctctcggcacaacaggaccggagccctcatttccattttaaagttgacccaaaaattggaaaatgtaatttttggcgaaaattggctacaaatgcctgctttttatccccggcgctcaagtttctaaaataactgaagaaatttttttttaatttttgccagaagagcaacaaaaaacaaacgtctttggattcccctttccgaaaaaattttctggctacgggcctgctcccttacaaatcccaaaaaactaaatcctttgacagttgcgccgattggaggattaattgcaatggaaatggaaaatcgtgtttatttttataatttttttctgtactttttattaaaacgtctctaatctatgggttttcttcggccaaaaaatgagccaacatagctaagaaatattatgctataaattctatttaaacctctaactttaaaaattccccctcagatttggtcccggcccagcctcggctgtgtgcaaacactgagcgggcacaccggctccgtgctgtgcctgcagtacgacaaccagatgatcgccagtggcagcagtgacgcgacagtcaggtgaaggatgaaactcaattttcaatggcatgtcaaaatggtaccaaggccgtagtcgatgtgatgaaattttgcgtgcacctcatttcccccccccccccgaaaaaatttcaaacctagaaattttcataaaaaaaattcttagaaaatttcttattgttaataaggaaatttaagaaaaaaaattttgaaaaacctttcagcgatttttcgaaattttatgaagaactactaagtttttcaaattttttttttttttaagaatttttttatgaaaaatttctaggtttgaaaattttttctgggggagggcaaacgacctgctccggaaattttttcatgaaaattatcagtacagcgtgtatcccttcccttttttgngttttccattttttttttcaaaaaatactaaaa

SEQ ID NO: 46882 - DNA, 1979 bp, Heterodera glycines
  Genomic contig location: Contig_ID=SeqID_10574; Location=619..2597; Strand=-
  SCN-specific regions: Sequence locations=1-49,71-184,207-317,341 -559,584-679,702-875,899-1117,1142-1237,1260-1979
  Gene Ontology: Mol. function=protein C-terminus binding; Cellular component=nucleus; Biological process=DNA replication and chromosome cycle
atgagcgataacattgactttcaaaatgaaatccgggaaatgctcagaggaatcaaccagaaaatagacctctgcaacgagcgaattgatacactgcatcaggatatggctgtcctcaagtctgttgctgcgctgaagtcggaaaaggtttcttgggctttcttattttatgataattaaattgttttcttgggctttcttgttttatgatagttaaggttagtaagtattgtcactaattttggaaaaggccggtctgacgaggaaacattcgactttaggacctgccatgcactgccgcagtcgaaccgcttaaccaggaagagaagaaaaaggaggttcgcaattgcctatggtgtcttttgcgaaattgttgtttcttcttttaggaatcgtcgggtccttcggaggtggaacatgcgcagaatatggaaaatgtgcccgaaaagtatttacctgagactgaaataaaagttcgcatttttggaaaaggcctatctaaagcggaacgttcgacttttagggcctgacatttactgtcgcgatcgaaccgcttgaccaggaagagaagaaagatgaaagtgtgacagatgagcgtgagcccggggttgataaagaggtccgcattttaaactccatcttttgaatttttgtttggaaaggaatgtcttaaaaggaaaacggtttgctttttaggaattgtcaggtccttcggaggtggaacatgcgcaaaacgacgtggaaaatatgcccgaaaactacttgcctagcaacgagactgaaacaaaggttcgcatttctggaaaaagaccgtctaaagcgtaaacattcgactttaggacgtgccatgcactgccgcagtcgaaccgcttaaccaggaagagaagaaaaaggaggttcgcaattgcctatggtgtcttttgcgaaattgttgtttcttcttttaggaatcgtcgggtccttcggaggtggaacatgcgcagaatatggaaaatgtgcccgaaaagtatttacctgagactgaaataaaagttcgcatttttggaaaaggcctatctaaagcggaacgttcgacttttagggcctgacatttactgtcgcgatcgaaccgcttgaccaggaagagaagaaagatgaaagtgtgacagatgagcgtgagcccagggctgataaagaggtccgcattttaaactccatcttttgaatttttgtttggaaaggaatgtcttaaaaggaaaacggtttgctttttaggaattgtcaggtccttcggaggtggaacatgcgcaaaacgacgtggaaaatatgcccgaaaactgcttgcttagcgacgatactgaaacaaaggttcgcatttctggaaaaagatccgtcaacatcgacttttagggcttgaccaacagccacaagactccgttattggcaggatgcgtaagtttaacgaacatttactattcgttttttcagtgagaaatcactcaaaaatcttgataattaatattgtcgacttttacagcaaatcaccgcttccggtttcatgggcactgaccgtgttaaaattggacgtttggtcgagttgcatggcggtgttttcactgggcagatgagtcgtgccacttgcactcatttgatcgctgctgcgagttcgggcgagaagtacaggcgagcacgtgaatggggaactgtcaaagtggtcaccagtgagtggctgttcaaatgcgacgaaatggtacatcccttcattatattattattggaatgtgtgtcacaaaaaaacgcaatttcagggctatcgtttgcgtgaggaccattttctgttggacaacgacggtgagaaacgacgttcgtcagcggacatcgaatggaaaaccaccgaaggacagcagcgcaacacgacgaaggatgagagaaaggagaacatgaaaccggcgactaagaaaatgaaggtggacatgaagcttaagaagaacgaacattaa

SEQ ID NO: 46883 - DNA, 2468 bp, Heterodera glycines
  Genomic contig location: Contig_ID=SeqID_10576; Location=104..2571; Strand=-
  SCN-specific regions: Sequence locations=1-494,516-571,595-944,967 -1002,1024-1243,1270-1748,1770-2111,2134-2247,2270-2386,2408-2468
  Gene Ontology: Mol. function=transcription cofactor activity; Cellular component=transcription factor complex; Biological process =regulation of cell cycle
atgccagcgcaactccgtttccaaccgtccaatgctattggaacgcaccagcgctcaattataactgcacaacaatttcaacagcagcctttttgtgtaaaacgcgcccgttatgattatgatttatacgaagggcaatcgcatcataatttccaaagacagcgttttgatcaaacaccgccctccgctattcatccaatgcgcactttccaaattcgtcatcgttcaacggataaaacgcgcgggttgcgtcattttgctcaaaaagtttgtgagaaagtgaagcaaaaagttcaaactaattacaacgaagttgcggaagaattggtcaatgaatattttgacaatattgctgaagtcccatctgacccggttaattgatattattcgtaatgaaataatgcatttaaatttcaggaaaaattacaatatgatacaagaaacattcgccgtcgtgtttatgatgcgcttaatgttttaatggcgatgaacataattgaaaaagaaaagaaagagattcgttgggtgggcttgcccacttcgtcgttggccgagtgccgacggctcgaagaagaaaaggtttgacgccacagctaattcaacgattgttaaattttatggctttaggcacaacgtcaggaacgaatccgtcaaaaaaccgaacaacttcaggaactgatagttcaggtgattgaaccgccgttttattctctggggtttttggggtccccgatcacgaatctttcaattattttgatcaattccgatttcctaatctaaatttgaacaaaaaatcataatttgaaaaattcaaaatttcgatctttattcgggttagggattagaaattagtcaaaatacatgtcagattcgtgattagcgacctttaaaaccccggataacaaattatcatggttttttatcacaaaaaaaatttgcaaaacaaaagggtccccccttttgtttcaaaaaggcccactttccatatagcgccgttatttcatttaaattgatctttttagttagtttcttacaaatctttggtccagcgcaatagagaaaatgaacgagtaaatggcaggcctttggattcgacaattctttaccttccttatattattgtgagtacgaacaagaaaaccaacgtcgaatgtgcagttgcaccggacaagtgaattaaatgctgaattatttataaaagcccaagtttagatcagagtatttgttcaattttgatcgaccttttgagattcacgatgacattgaggtgttgaaacgacttgggcttgcatatggaattgtgagtttgtgaaatgtttaaataggaatgtaataacttttaaggaccgtggtgaagttgacccggcatatgtaccacacattaaggtaagagtaaatactagagtagagcgggaccgggaccaaaacacggacaactgagtacagaagtcccggttttgaccgggactagtccagtcccgggtttccctgccaaaaattccctgtttttcaacccgaaaaggtcccggttttgcccaaaattcccggtcccgctctactctagttttttaaataacgacttccgcccctatcaaatttgtcagatataaaaaaagtaagaaatgcaaaaaatttttcctatttttcgagtttctaaccagtttcataattgttaaagcaacaatgcaagtaactgctcataaaacaattggccaaattacttttttcaagttcttttatcgagttcaaattttgcctagaaatgatttcaaattcgtcgctgataaaattcggttggctgcagtctcgtactgaatagcagcgactcggcctggcgtgccaattcggcgtaacgaagtgtcgccgccatgttgccgtggttggtgtgcaaatggttcatcaacgtattggtgtaatgttcagacaaattgcagtgcgaggcgaccagcatcggacagaccgctaattgctgaacaatttagaaaattgacaaaaattattttactaattattattagggttataagttgtatgcactaaaaatgccaaattatgcgcataaaatatgcactaaaaatccatcaaatatgcactaaaactccgaaaaatatccaaatatgcactaaaatatgccctaaaaattacccaaaatggcttataaccgtaaaaaatgccaaaaatgcaatttcgaatttgtaaaatttttgtcaaagatatgttaaaacaaattacatttttctactattgttttcaaaagttcttataaaaaattcaaaattctcgattttcaagggtatgtttttgaaattcccaaaaaagtcgatccttaggggtgtatttttcgtttttattgcatttttcttattaaaattgccaaaaatgattgaaatatgttttaaaaatgtaaaaatggcaaaatctgtatttattctcgaaaacccccaaaatatgcttttatatgcaataaa

SEQ ID NO: 46884 - DNA, 1070 bp, Heterodera glycines
  Genomic contig location: Contig_ID=SeqID_10577; Location=3..1072; Strand=+
  SCN-specific regions: Sequence locations=1-415,437-785,807-1070
  Gene Ontology: Mol. function=NADH dehydrogenase (ubiquinone) activity; Cellular component=mitochondrion; Biological process =gametogenesis
atgaataaagcgtttgtcaagacagcactgtgctccaaatcgcggaatgcttttctcttcaaacgcctcgtcagccccgtccaaattggttgccgtccaatcaccggcggtggttttggccatccaatgaccaggcaaaagatgcaaatgtacagcccggaaatgagggcagtcaattaccaacaaaagcgcacccacatgcatgtgaggcaatttttaaattgaggggtcacaaaaaatttcaagaaattttggcacttttaaaaatttttcggaggcattttgatatttttgggaaaattacgcacaaattaccaatttgcaatgcaacatttccctgaaaatagacacctacctataactggcattgggggttattaattgaaacaataaacgggaattaaggcattcctagaaatttagacataaagaaaattttaaatttccaaaaaaaaacaaattttgaaatacctgaaaacacacaaaaaacattagagctcggcaaatttttcctcattaaacgcacatttttaggcaattctcaccaagaaaactgttgaagaccgagttatgctcaacttacatttgtttgacaaggtggacaatgacaaattgacgttcgactccgattttttcaaggatcttgggattgattcgcttgactttgttgaggtttacattcatcattttttaattttgaacacagtctggacccctaaaacatgaaattacacaaaaaaaattttggaattttaatttatagcccaaaaccgtgtagagaggaatatttatttatgtatgctattctaatgcatttaattccgaatgtttaaatggtttctaggccataaaacaaatttttgaaaaaaatttgaattttttactcgaatccagtttttgggggtttggaattggcacgaaatgaatgcattttattgctttttttgcagtttatcattgcgattgaggacgaatttgagttcgaaattccggacggtgactcggacagaatgcgaacgccacgagatgtttacaattacatttgcgacaagtgcgatgtgtacgattga

SEQ ID NO: 46885 - DNA, 2084 bp, Heterodera glycines
  Genomic contig location: Contig_ID=SeqID_10579; Location=405..2488; Strand=-
  SCN-specific regions: Sequence locations=1-844,866-915,955-1108,1130 -1212,1234-1346,1368-1557,1582-2084
  Gene Ontology: Cellular component=membrane
atgatcaggttcaacagcagcgcgttcacttggacgacgagggacaaaatggcacattggaattggacgccgaccaatttgcgcattcttcgtcgaccaacactgacacggacagtgatgaaattgtcaatgtggcacgcaaaaagccgacagtgttcgaatacttttgtatggaagtgtcaaggtacgtgtgccattcaggtctgcaaccagaaaaaccggatttcatggcgggtcagaccccacgattttttttgctgattttttttttttttgcctatttgtcaaccgattttggatcaaataaacatctgggggaaattatattttggaatcaaggcgccgaattttaagaaactcgctggtatcgttcaaagtttgccagtttttctcttaaaaactttttcaaattcgggcgctggaacatccacccaaatttttctaactaaaaaaaaaattcatttcggttacgggcctggtcccattctcattttttgtaataaattccaatctttggcttatcccctcatttttaaggcgctactcacttcagaatgagaaggaacaatatgcggagaagcggcgcaaagtctatgcatttcttcgaattccagtggaactggaaaagttcatttattacgggttccgtcagtgtttggacgccttttgccacacatttaccattctgccaatacgcgtattggtgagttattgggtcagggccaatttttcaaacactggaacattatccctgaaaccaggtaggtacctagccggaaaaaaaacatttcgtcgagaaatcccgaaaaatttgtgttttcggcacctaaaattttttccatggttaattttttaaattataaggctctattaacgaaaaatagcgttttttgtataagaaataactaattgtgcattttttgtcaaattttgaaattttcaagtgcatttattggccggtagtgtgccaatgggtaccgccttgattttttttttttgcaacttttactcaatttgttgagaaatcttaaacaaatattcaaaaaaatttctgacctttattaaactttttttatgcggtgttctcatattagaatcaaaattccgttggatagatttctccccgaaatttttttttaaatttcttggcaggcaacctgccaccgaagccttcagcagaatgggtactttttcttcaatacaaaatttctgattttataaatatttttttttggatgaatccctctgcagaatatataggtaatgtgttaattaattgccactgtgttttcagttcaatttgtttgcttgctcagttcgattgaagcggtggtcggccgccgacacctgtgacattctcaaactaatcatcattttttgcgcttcttggttcatgcaatttgttgacacttccgtggtctatcacattgttcgtggtcagggcatcatcaaattgtacattttttacaacatggtgagttattgttttatcaaggaatggacggaaaaaattttattaaaaatccaaaaaagaggggaaaaaaaaaatttttttttgtcaaaagtcgtgacaatttgttcctggcttttttgagaccgctcgctgattatgagtttgaccattccttctggtaaattccgatacttaactcgaacaaaagatcgaaaaattcaaatttctcgaactatccgaatttgtttctcgaattcggttagacatttttcagaatttgttaaatgttaaatttgtaatcagcgacccagaaaagctctggaggacgattttttaggactaaccaaaaaaaatttacaagccaaaagctcctcccaatcctttccaaaaatattacctttttaaattagcccaattttacactatttacatttagcttgaagttgccgacaaattgttcagcagttttggacaggtgcgtgcgtgttaaccgctgtttgcttataatataacggaaatttttttcaaaatttaagagaaaaaaaattttgtgttttttaatttgtttaattctccgtaggatattttcgacgcgctcctttggactgcctccgaacggggcacaaataaa

SEQ ID NO: 46886 - DNA, 1879 bp, Heterodera glycines
  Genomic contig location: Contig_ID=SeqID_1480; Location=989..2867; Strand=-
  SCN-specific regions: Sequence locations=1-505,528-736,760-1031,1053 -1322,1354-1879
atgacttgcccacaaaaaatcagcgacagcagtcccctagcaattaacagtggtctaaacattttctcagttccaccgaccaatgtgtctgttgtgcgttctttctttcgtcaggtgcttccgctagcaacaatcacgcaagaatcgccttacctatttcggctttacagtgacaatttgtggaccgatttatcgcgggtctatctttatctcgaactgtccattgaaaaaccgggagcaaacgataaatgggttgcgatagatgatgcggatactagtgtctctgccattcaagggattggtcaaacatttgtccagcaactaaaagttacggttggcaatacggaagtatacgatagcggaaatttatacccattcaaggcctatatcaccaatgagttaagctttccaataaatgccaagaaaaattttcttggttcaacagggtattatcacaccgtaaatcaagatgattcatcagacgatgggtataaagagcgttgtaaaatttttaagggtggtaaaaatgcgcaattcctctcccgtctcgactttgatttgggaaaccaagagctttatctcttaaataatttggacttgctcttcacaatttacaaggccaaagatgtctttcttttgcaaacattaaaagcaaatgattccaccaaatatcgtttgacagttcacgatgtcaagatttatgccaaaatggttgaggtacaaccttcactaaacatgagcctttacaaaacccttgaaaaacaacccgccacatacgcagtacgcaagaccgaaatcaagtcgtcattcatcagtgttggtcgatacgaatttgagtacaatgtattcagtgcaaccattcctcgacgtgtgacaatagcgttagttggaaattcagcatttcatggtgactacaaactgagtcccttcatgtttgagccgtttgatttgcgtgagatttcggtacatgctggtggcgtagtttacccagctgttccttataaactaaatttttcaaatgatcactttgtcagcgcctttgttgacatgtatgaggcactcggaatggctaactcggaacgttcatttgacatttcaatggcccagttcaaaaaagggtggaccttttttgtcattccattgacttccacgcttgacgacagctgtggatttgagctgttgagaaacggtacgacaaacgtacgagcaacattcaattcaccaattccgcttggtggtgtagagatgattgtcttgggtgaattcgaccaaatgattatggttgattataaccggcacattgtgaccgactcaaagcttggataaaatataaataaataaaaatattattatgtaatgttaaaatgaataacaccaacacaacaaaacctgacatacaaattttgaattccccagaagagcctaatgaaactcttttgcatgtactgcttttttctcattatcttcttgcatttcctgtgtttttgcttttttggttcgttttaattcggtggcttaaaagtcatggtcacctctcgcccagcgaggccgagacagtaatggaagagatgaaaaatatccctcgacaaccaccaatatttttcgcaacaaaatgatgcaaaattagagaaaactgacaatgaaatctttcttcagtatgacaaaatcgaaaaagactcaagaggatttgctcttgaattggtggcgtgaagacccgacaattgtaagcttgttttttttcaatttagcattttttaaatttcatcacattttttcagattcgtttctttttggacaccgtcgaatcgaagccgcgcttcttcagcgcgccgaacgcgaggccgaaattttgcgccaatacgcagagaatcagcaatga

SEQ ID NO: 46887 - DNA, 915 bp, Heterodera glycines
  Genomic contig location: Contig_ID=SeqID_10586; Location=98..1012; Strand=-
  SCN-specific regions: Sequence locations=1-96,124-405,429-822,847-915
  Gene Ontology: Mol. function=rRNA primary transcript binding; Cellular component=nucleolus; Biological process=ribosome biogenesis
aagacatggaaaatgatgcgatgcacattttttggagggtctgccatccgaaaggttcttatcaccacttcgccgagagcaaaactcgtaagaatgatattatttaaaaaaataaaaaattttcgtcagaaaaccttcaaactctgtttcgagttaaaaaaggtcattccgaatgcagaaattgtgtctaggaaaaacgttgccataaaacgtgttgtgcggcaggcaattgagcgtggtttttctgacctaatggtggtgcacgaagatcgcaaaaaaccaagtttgtattccttttctactttccattatttccaattattaattcagatggaatcgttttttgccatcttccgaatggtcccactgcgttttttaagataaattcgcttcaatactccaaacagatcaaagtatattttgtttttctcattttcgatattgaatttgcaggacgtcggtgaggcaacggaacattaccctgaacttattctgaccaacttcaacacaaggctggccaaaacggtgagccgaatgttcgcctgtctcttcccgcaaaaagctgattatggcggcagacgagtagtgaccttccacaatcagcgcgactacgtctttttccgtcaccatcggtaaaattgcaaaaggctccttgtaaatcactagttatcttgtaaaacgtattcgaattttgccgctttaggtacgaatttaaaaaagaaggacagaaggcagcactccatgagttgggtccccgaatgacattgagacttaaatggctccagaaaggcacattcgatacacgcggaggagagtacgaattttatgtcaaggtaaaaaatatgagcgaaagagggcttcaattccatattaaagagacacgacatggagaagagtcgcagacgttttatgctt

SEQ ID NO: 46888 - DNA, 2323 bp, Heterodera glycines
  Genomic contig location: Contig_ID=SeqID_10598; Location=2226..4548; Strand=+
  SCN-specific regions: Sequence locations=1-483,505-843,865-877,899 -972,1009-1995,2032-2323
ttttaattttctgaaacgttttcatctaattttaaccagacctctaacagatttattcaaattgtctctaaaatccggtaaactaccaaaaatttggaaaacctcaattattctaccactatttaaaaacggagataagaatctagcatcaaacttccgtcccatttccattacctgttctcctcagaaagcgctctaccaccctccaattaatttcgactcttgaggattggtataatgccatacttctcaataaaaaaatcgactgtatttatttggacataattaaagcatttgacaaagtccctcatgaattgctaatttataaaatagaaaaaattggaattaagggcaaccttctaaattggctcaaagatttcctaaccaacaggacattcaaggtcagaattaatcaacagttttccaaaaaatttcccatcaaatcaggtgttccccagggatctgtcctggggcgaattctatttttgatttttataaatgatttatccccagtaatccctgaaagaatttcgctaaaactttttgccgacgatactaaaatttacttgtgttatgacaccgaatttcaacgtaaaaaactaaacgaagccttacattgcgtctgccaatgggcccaaatgtagggtctacaattttcaccagaaaaatcagcttctctttacctcagcaaggacaattttaaggttccctaccaatttaatggaaagactattaaatagacccaaacaattcgagatcttggaatcttaattgacaacaaactgacttttaaatcccatatttcatctattcttcaaaaagcctaccttagaagcagaacgctttttcaaaaaattaaatctaaatcatcaaagacatgtattaaagtctataaaagctatattaggcccttacttgaatattcatctgaaaattggaaccctcacattaaaaaaagcaattattcgccttgaaaagtttcaaaagttttttaccaaaaaagttttcttaaagtgccatttaccggttttacaatattcagataggttaaaataccttaatatttccactttgggaaataggagaaaatatttagatctgatcacggccttcaaaattattaaacaagaaactcacctaaaccctctaaaattatacaatttatctcaaagaagaaaatcgcctttccacgaaaaggggggcaacaaccgcggcacagcagcagataagaaagaaagcccccaccccctctccctccctccctgtcggcttctcttgccttttcaaagattagatttggccgagtcgcccccccccctttcttttgctgacagccgcttaatcccccccccccttcaatgggtccgtgtcaaccgcccgccaattctctgccaaaatgtcgcaattgcggtgagtgaggcagaagaaatattgaacgaattctgactttagcgatctcaaaaccccgagggcagcagaagcaaggatcgatccctccaaatgcttttcctccctttcccttttccctttgagtgcatttgccccctccccattttttgtcccttttgacttttcccattgtttttaatgggttttcgtcgctttaaaagctgttttggtttaagtggggaggtgcttttccgctgttcaatttggccaaattggctgagttcactgaccgtgaaaatttggacacaaacggccgacactttggcacaaaggcaaaggcaatgaatgggcggagaaagaattgagccaatgccaacaactcttttaattgttcactgtcgaattttcttttccatttctcgccaatatttctttttaatttcgaaatttcttttggtcactcccattttaattttttttttagaattgaaaagtgccaatttgttcttcccaatgttccgttatgagtgcccttcccaacggcaactccctttgaaaattgtttttttcccaaatcgcctccgtctctgcccctctctttagtcgtctctctctctctcttttgtttctctttctctctcttccgatggcatttcccttccggcactttcatccccttccgatgcctacgccttcccttggcctcattctgctcgttcttttgctcaatttggctgatgacgcgtcggctggcaccaattgttctgctgcggatgccacgcgcaattgcgtggacgggtgagaaaagcattggccgattgccagtcgctgatccactgatcagtggtgattggttctgactgatcagtcaatggacgatgatcagtgtgccaatggactgtcccttctcccttaagaatgggcatacccattt

SEQ ID NO: 46889 - DNA, 929 bp, Heterodera glycines
  misc_feature (18)..(18): n is a, c, g, or t
  misc_feature (35)..(35): n is a, c, g, or t
  misc_feature (88)..(88): n is a, c, g, or t
  Genomic contig location: Contig_ID=SeqID_1483; Location=1..929; Strand=+
  SCN-specific regions: Sequence locations=1-271,337-708,732-929
ctcaattgttcgtccacntttcttcgattcggtgnaaagatgggccgaccgcgactttggagaagatctcagtgggtgtttctcgatntattgggcaatgaatttgcaaattaaggaaattttttggaagagattagttactccgatttggcaagttacgcgcagttgatccatcacaaagtgagaatataaggcaaagcaaaataaggaatcctttgtttttttactttctttttactctatcgttttcttttcatctctcctttccctttctctctttctttttcagctctctcctcactctctccctctttctcttctctcccccttctctcttgttctccttgcactcttctacctctatctgtttgtctcactttttgcctcccttcaccattttcaggatatcattatccaatgtctcctccgtcacttggccgatcggtctctctctttgcccgctttttgcgatttttgttcggctattgcgacggatttgcgtgacgattttcacacgcatttttggcagatttttgatgcaatttcaaatttggttttggcatcgaaaggtaaagagcaatgcagtgataacgaattggagtgcacatttcgcgcgatggaacaaattgtgcgaattaattttcgattcatttcagcgcggctaaaacaattgtttaggcatggcttttatgtcaattagttccctaattaccttcccctccctcccttttagccgtcttttaccgctctttgcttttccttctgatgggcgcctccgttttatctccgcccgaactttttcctttgtttttctaaaatcgcctttcccccacaaattggccaaatttcttctcgtcaaatgtttttctgattgtggccatttgcgcgacggactttcgctgtttttcttcgacgcttttttaggagtt

SEQ ID NO: 46890 - DNA, 1502 bp, Heterodera glycines
  Genomic contig location: Contig_ID=SeqID_10620; Location=600..2101; Strand=+
  SCN-specific regions: Sequence locations=1-9,31-347,369-401,432 -513,537-787,811-1013,1035-1242,1264-1326,1348-1502
  Gene Ontology: Mol. function=poly(A) binding; Cellular component =cytoplasm; Biological process=mRNA metabolism
atggcgcaggcagttgctgctgttgctcccgcaccaaatgctaacgcagcctcggctcacacaacccaaccgcaggttatggcaccatcttatccgttggcttctctctatgtcggcgatcttcatccggatgtgagaaatcaaattaaaattttttttttcaaacaccgattaatttttttggtattgccaggtcactgaggccatgctctttgagcggttcagcaatgctggtcctgtgctctccattcgtgtttgtcgtgatgcaattactcgtcgttcgcttggctatgcctatgtgaattttcaacaaccggcggatggtaagttaacacatttggactgcgtttttttaaataattttttttgcttccatcataagccccttattctgttaagctgaacgtgctttggacaccatgaactttgacatgatcctgaacaagccaattcgcattatgtggtcgcaacgtgatccaagcattcgtcgctcgggtgctgggaacattttcatcaaaaacttgggcaaggaaatcgacacgaaggccatctacgacactttttccatgtttggaagcattctgagctgcaggtgtgtttgcttaacttcaaacaatttcgtctttattgtccacaacaacttttgtagattgccactgacattgagggaggaagcaaagggtatgggttcatccattttgagactgaggaagcggcgaacagtgcaattgcgaaagtgaacgggatgcttttggatgggaagaaagtgtaaggatgatccccacctaaaattgtttttgtgctattaaatttatcccatcttttttgctgtaggtttgttggaaaatttgtgccacgcactgctcgtgagaagcaaattggtgacccgtccagtcgtttcaccaatgtttatgtgaaaaattttggcgaggcaatggattcggagaagctgagcgaagtgttctcacagtatggcgaaatcatcagtgcaaaagtgatggaggatgacagcggcaagtccaaggggttcggctttgtcgcctacaaggaccataaaagtgctgcgagggcggtggagaagatgaacgaggtttcggtgccaggcagtgagaaggtcgagcaaaagtttacggtgtgccgtgcgcagaagaagagcgagcgccaggctgagctgaagcgtcgttacgagcagtacaaagctgagcgcatccagcgttatcagggagtcaatctgtacggattttgtttggttggggggaatttttctcaaattttaggattttgttagtttggggggggagtttttctcaaattttccatggataacttttgtttattatattaatgtgccattttttgtgtaaaactgttcggaaagctctccactaattaaaaaaataatggaatccataaaggtatactaccaaattgtttactgaactggagattttaaggtacgtcatgaacctgcacgataccatccaatgatgagacactttcga

SEQ ID NO: 46891 - DNA, 485 bp, Heterodera glycines
  Genomic contig location: Contig_ID=SeqID_10621; Location=230..714; Strand=+
  SCN-specific regions: Sequence locations=1-82,104-203,225-271,293 -333,355-485
  Gene Ontology: Mol. function=poly(A) binding; Cellular component =cytoplasm; Biological process=regulation of protein activity, epigenetic
gtacgtcaagaacctgcacgataccatcaatgatgagacacttcgaagcaattttgaatcctacgttacttcacaagtgcaaaggtttgtcttcaacggattattggtatttgctataaagcggtgcttgaccagataccaaaacgaattttgcggaatcctaatccagcgaaagccgactttttttttgatttgggcattaattacaaacccggaccggcaaaaatttatgaaatccaactacacattttggctcgcaattttgattttccaatttctattttattattttccaggttatgtgtgatgagcatggtcgctccaaaggattcggttttgtgtgctttgaaaaggcggatgaagcaaccaaggctgttgtggaaatgaacaacaaaatcatcgaaaacaagccgctttacgtcgcgcttgcgcaacgtaaggaagaccgcaaagctcaactggcctcgcagtacatgcagcgctta

SEQ ID NO: 46892 - DNA, 1006 bp, Heterodera glycines
  Genomic contig location: Contig_ID=SeqID_10632; Location=222..1227; Strand=-
  SCN-specific regions: Sequence locations=1-303,327-844,870-889,912 -1006
  Gene Ontology: Mol. function=zinc ion binding; Cellular component =integral to membrane
ggaaggcgtcgtcttttccttcgcttttatccgtctctgaaagcccttctcttcctcgtcacgttgctcttccaattggccttcgtcttttccttctcttctgtccccagcctttcccttcttttggccaaatgtcgtcttgagaagttaactctctccgacgtggcgcaattcgacgctgagggccaattgccttttcatttgcggaggacaaagtgagtgatcggcggggcgcaaagagaaacacagaatacccaataccgtgctcatcgcggcacttctaaaaatggcaaagtttatccgaaataaaattagacagctatttttgcgagttttttgactcaatcgttaagtgacgcaattttgatttgatcaaattttgcgaaatatcatcgaatttatgtctcaagtcctaaagtatgccatcgcttcccttccctccctttgtcagtgttttcgcgcgtctttggcgttcgttggtttcgcttccctcgactttgggccgtctctttacttacgctcttttcctggtccaatttctcgagtatttctactcggatgaactcggccgtcgcttcgggcaatttgtggaagggcgtcggaatattcgaattccgacgcatccgttcaacgtacgctatcacttggccaatgttttgcgaattcggaatgcttttccgcctgactttgtttgactttcgtttagaatttaccgactgaacagcaaactctttgcatggaagtggacaaatgcccaatttgtcgtcggatccgcaaaaatgacaccgttctcaccgtttccggctacgtgttttgccattcctgcattttcaacttcgtacgatttattttgtttgctgacaaacaatagtcggaactgactcttttcaggtccgaattgagcactgttgtccgatcacttcgcttcccgccacttcaaatgaactcgtcaaaatatacaattgaaacatttataattaatggagtttaattgaatttatgggac

SEQ ID NO: 46893 - DNA, 2755 bp, Heterodera glycines
  Genomic contig location: Contig_ID=SeqID_10650; Location=411..3165; Strand=+
  SCN-specific regions: Sequence locations=1-114,136-226,250-887,909 -929,952-1435,1458-2074,2096-2755
atggaaaaatggggaacaacatggacaaaaaacatagcagaagaagacggtcttcttcaacttcaggcgaggagaaagaattcgacaaagtgcttggacaggaaaaggcttgaaaagattttgagagaaaaggaggagaaacagcgactcaaagagattgaaacgcccgatgagaaaaggacacgaagacttgcgaaaaagttgcaaaaggttgattttagctgtcaaaataattgttaaataaaaattgtttttttaaggaggaaagaagacgagcagaaacaattaatggctttcctgaagtcattccttatacggacttgaacaatccattcaatgacaccaatttgactgacacatttatttggaagaaaaagtgggaatccgaagggaaggcgaatgtatctgtaaaaaaggccgagaaagtgtaagaaaggcagccaaataaatctttaacttaaataattcagaaaccgcgaaactattgctaagaattttgccgaaatggaacagttaaagcgaaatagggaggcgcgggacgcagcgagggaagacatggaaatgatcacgagggaccaggagagacgccagtgcgattggagtcgtacagaggatgtttttcatctaaaacaggcgaagttgcgctcttctattcgcataaaggagggcagagcaaagccaattgatttcttggcaaagtgagctaagggacggaaaggatgggcaatttgtaaaagtctgtcaaaggtatatttcttacacggacgaagcgaaccaaggcacagcatttgaactgaacaatccgttgactttccttcccacggactccatcgaagattttgaagacctaattgccgacattcaagtaagtctgttcttgttacacagttcattaatttggttcaaggcatagtccaaaacctcctctttttaattcaaaaataacaaaattctactaccatttataggtttatcgtctaatcgatggccataagaacaaatgttattgggatgacatagaaacagtcgccaaaaatggaatgaaacgattgttagacacgcgaaaacgaacagcagacatcggaacagttcattcatcggtacaagaggaagtgcataagatatttaaggtattctaatgctttgctaatttaaatttgaccatggataattcaggggaaaacttacgacgaacttgaacagcttgagagtcaaatcactgcaagaatttcgaacgcgaacagagggaccgatgtgacatattgggagtcgttgttggattcgctaaggccgtttatggccaaacagcgcctcaaagagttgcacaccaaaatgactcaactgcgtctgaaaattattcgtcaggagcagattaatcaaatggataaaagtgatgaccgtgaccaagttgaagaagaaaccgttgaaaaggacagtggggagacagatgaggagaaaccatcagaggacgaattggagatggaaatcgaacaaaaggcgaagctggaaagggcgaaatacgaggacaaacagcaaactgtgcagcaggaaacgaagacaatgccattcacaattgagcagttcatcggggcagacgatgaacaaagggagcaaatgaatcagtaagtaacgacaatttggatccattaattggttgatatttaaggcaactcgaagccagaggcatgtcggagcaattctcaacagttctatatgagtatggtcgctacagtccggcgtacggaagcttatcacacacaatgcctggcatagaaattttggacgaagcggaagatgaaaaacggatgaatgatactcgtttagcaacacaacataaagaagatggaactggaaaactgacggtggatttgcgggaaaatcatatcttaagggggggggggggaagttcaggcattggttccctaatgtcgcctaaaagtagaaattcagaaattgtgaattttagaaggcccttttatgtgcacacaaataaaaaaagaatgtttaaaaaaatgcgtgtaaaagttatttaggaggcaaaaaatatcttaatttagccaaagtcttcaagggatttcctttattcatttaatgtcctattttgttttattgacgttttcttacaattgttagtttctggtttaatcgatatgttaaggccaaggacaaaagaatgttggagatcgcaaggcaaggaatggaccaggacgaggccgaattttctgtcgaagaaaagctcgaaaagcagaatttcctttggtctgataaataccgtccgaggaagccccgctatttcaacagagttcgtgattgacttttgttggtttaaaatttatttctgttaaggtgcacaccggatttgactggaacaaatacaaccaaacgcactacgacattgacaatccgccgcccaaaattgtgcagggataccgttttaatgtatttgcacaatttggcttactttcgtataacataaaagggtgattctgttacagatattcttcccggatttgttagacccgacacagacgcccaccttcactctgatcagatgcgatgaccccgacttttccattcttcgcttttgcgcgggaccgccctatgaagacattgccttcaaaatcgtgaaccgagaatgggaggtcaactacaagcacggatataaatgtcaatttcagaatgggatttttcaactttggttttttttcaaacgataccgttatcgtcgctgattcttttccattttaaaactgta

SEQ ID NO: 46894 - DNA, 1662 bp, Heterodera glycines
  Genomic contig location: Contig_ID=SeqID_10653; Location=1632..3293; Strand=-
  SCN-specific regions: Sequence locations=1-468,490-532,555-1017,1039 -1173,1215-1343,1365-1662
taccaatttggttttgttagaaataggtctacgacctttaaactaataacagttgtggaagattggtacgaggcaactataaatggaaaaaatgttgactgtatttatattgattttcaaaaagcatttgactcagtgccccataatttacttttatacaaattggaaaaaattggtataaagggcaaacttttaatgtgtataaagggctttttgagtaataggactttttgagttaaaattggggattctttatcctcaagtaaaaaagttacctctggcgtcccccagggctctgtcctgggccctttattatttttgatttatattaacgatcttcctgatgccttgccatcaggagtgaaaataaaattatatgctgatgatgttaaattatatatttgttataaagcaaaagccgacacagaaattatgcataatgcattgcataatttattcgaatgggcaaataaatggcaaataaaagtttcaattcaaaaaacttttgtatatatttgggttcaaaaaacccaaaagaaacatataaatttgatggaaatacaataaatgctgtggatacaattagggatttaggagtaaacattgataacaaattacaattttccgatcatattaaccaaataacaaggaatgcgtatttacgtatgcgttccttgtttcgaataattaaatccaaatcgtctaagatttggattacgttatataaaacttatattaggcctttattggaatacgctccggaggtttggaatccgtctcttcaaaaaaatattaaaaaaatcgaaaagtgtcaaaaatatttcaccaaaagggtattttttaaaggtgactggacaatcggacagtggacaatcggacagtggacaatccgacagtgaggacaatcggacagaagtggacaatccggcagtggacaatcggacagtcaaatataaaatagataagaaaataccggtcgccttgtactcaaaaccgtccgccaaaagaacagcccggcgctgtgttgtttcagcaacaaaaaacttttttttcatttggttgaaggttcgggagagggtcatgggcttgtggatttggatgcaattcttgaactgggggatttggctggggatgctcatgaatttcgccttcttcggaagatgaggaattaattttgtgaggaaacaagtgaaaatttgggaaggaaaaggaagtggtcaatttgtgcagtgcacgggaatggtcatttctacttgtaagtaatttggcaaacatttttatcagctcatattcacatcattttacattttctaggtcattcccagaacattagtttatttgcctattttgttttttcttgatatggcacaatcggtccattgcggcgaccggtattttcttatctattttatatttgactgtccgattgtccactgtccaattgtccacttctgtccgattgtcctcactgtcggattgtccactgtcggattgtccgggagccttttttaaatgcagccttccgccaattccataccaaaatcgattagaatacctgcaactgccaacacttgagaataggcgaaagctgtttgatctgttcatggcgcataaaattgcttatggccgaacagatctgaaactattttctatttttaatcc

SEQ ID NO: 46895 - DNA, 1185 bp, Heterodera glycines
  Genomic contig location: Contig_ID=SeqID_10671; Location=1247..2431; Strand=+
  SCN-specific regions: Sequence locations=1-688,715-880,903-1185
atgcgaaaattgacagcaccaaatggtgaatggggatatttggatgctactgatcaggttgtaccgatacaactgatcggacacacgttcatacgagacatgaaaattgcaataaatggtcgtgaaattttcaactctaattcactgatggcatacaaaacttatctttctcatgagctttcgcaatcacttgaagctaaagtttcgcatttaactgctgctggatatgaccgtgaagatgctaacaatttacaaaacgcaaattccgaagggttcaaaagtagaagacaacggtatttgggaggtcgaacagcacaatacattgcaaaaatcgatgccgatctgttcaatgtgccccaatatttgattaatcattgcgaaattgacataacgatacaaccccatgacggcaattttttgttaattgacacattagaccccccgggtcaaccatatagcattgagcttgttggattgaaactctactgcaaaaaagtcagtcttatggatggcttggctcttaagttggcgaaaaaattggaaatgaaaccagcacggtatgctgtacgaaaaacaatgatggaagcactgttcataagcccagggcgctatgaatttaatgcaaacttgttcatggaccaagttccacgccgcgtaacaatgggtcttgtggcaaactcagattatgtggggaacatcaaaaggagtccattcaactttcagcactttaatgtacatgagttgagtgttgtggccaatggtcgctcctatccccaggccccgatgacattgactgtgaaaattggaaatttgtccgcccctacaatgacacgcaagaggcgcttggttttgccaactctacatatggaaatggaattgattatttttctttttgcacactcattgtatttatgtgtttaacatgactaatagtggagatgatcatggcggtttgttcgacctgatcaaaaagggatgtacatcagtgaacataaaattcaaaaagccagtgcccgatgggggaattacactgatagttatgggagaagcagactccatctactttttagataaaaacagaacgattgcaactgatacaaccatttgatttcaaaaaaaatgtttcatttattctttattgtcttgttttttcaaccaattttttgtttaattgttgaagaagga

SEQ ID NO: 46896 - DNA, 152 bp, Heterodera glycines
  Genomic contig location: Contig_ID=SeqID_10672; Location=2749..2900; Strand=+
  SCN-specific regions: Sequence locations=1-152
atggctgcgcacaaaacatttatcatcaaacgaaagttggccaaggctgccaaacaaaatcgtccgcttccccactgggctcgaatgaagacgggcaatcgcattcgctacaacgcaaagcgtcgtcactggcgccgaaccaaactgaagtt

SEQ ID NO: 46897 - DNA, 3597 bp, Heterodera glycines
  Genomic contig location: Contig_ID=SeqID_1494; Location=4548..8144; Strand=+
  SCN-specific regions: Sequence locations=1-341,363-572,623-659,681 -724,748-1262,1301-1337,1392-1449,1480-1491,1528-1531,1553-1644,1671 -1903,1946-2098,2120-2244,2360-2474,2508-2532,2567-2638,2684 -2735,2758-2760,2788-3597
  Gene Ontology: Mol. function=structural constituent of cuticle; Cellular component=extracellular; Biological process=cuticle biosynthesis (sensu Nematoda)
atgtacaacgacgagaaaatggtggtgcggccgacgcaactgcgcggcttttggatgcacaattcgtttctgttggagagcggcaaacggccagtgaaactgtacaccaactactccattctgttgcatttggccaacgaggaggtgggaatagtgccatcagtggtgttgttcttgaagagtttcctgtctcggttctcgactcgagaaaagtctcggactgtactaattctaggaatattggcctagacccgataaaagtctcgggtttattttgaatattggcctagacccgataaaagtctcagatttttcaaggcaacctgaatctcgggctaaagtctcctcaaaaaccaaaaattcggaccaaaaagcgagccaatcaacgctaaaatggctttatttttttacaattatgttcttttgcgaatttgtttgatcactgatcgaaaaaaacattaagcgagtgcttccgggcgaatttcaaacgccgtttatggccaaacatgacattgatggcattcatttgcacgcctcgacattactcaagaacttggataagcaagcaaaagtaaataaatcatattaagtaatattttttgttttaatacaatatttaattctagtggataaatttttggaaaattttatgttctttgcgaattttaaacattcaaacaatgcattttctttggatagcaaattttataataaaaaaacgcactcaaattaattttggccaaattattttttaattttttccattaaatcgtcataaattcgctttttcgtcatggtctcgagtcctaggaatctcgaacatatgcttaaaaattagcaatgaagttatttttctttgacttctggatttcttggttctacatgtaatacatctttttttaatgtgtttttcctttcttcttctcaattcagtcccgtgccgcgcatcaattgccctccgcgcagccattttacgcggcattggtcgcgtgccatagccgaatttttgcctattacaaagcaccggggtgaacaagtcgcgctgtctgtcctacagtctgtgcgtgctgcccgaagtgccgcaggcgctctgtgccatcacgcgtaacactttcggcacgatgttgaccaaaggggcgaggacggcaattcacgtgagggaacagagcgaatttgggcacggccgatgcacggacgaaggcggaatttgagggggaaaatatggacaaatgaattgttggataaacaattttgaaatccagaaaaattaattatttgaattttaaattatttttaataacttttgaagatttaaatatcgaacgatacaaataaaattaaattggtttgatttgatttggtttcaattaatttatttgttggattaaattatcaaaatcaaatcacaaaatagagcaattccaaccaactgcaaattgacaagcaaaaatatccaaaatataaagaaaatcaaatctcggcatgaatttcattaattaattaaatattaattaattaagtatttttcagttcataaatttttgtacaaataaaatgtaataattttacatgtcaattcattacattcacttttgagaaaatataaccaaatggttgtactcctctcactaattggccaattacctaacattaattaattaattagtgttaattaccaatttcgccccattttcacttccattgactctgcgcaacgccaaaaaaaaagaaaacatttgcccgtcggcggagtttcgtcgcccattttctccgttttcatttacgcccattcggcccgtctctccgtttttctgttttcacttttttttgctgcgcattttacaatttttgagttccaccgctgcgtcctttgcccaacccaaaaaaatgaaaatgaaaatgcaattaattaatttaaatttttattttcttttttttaaattttcttttttcgcccatttgtttgcccctccggcgaatttccaacggccgaatgtttttttttgtgtcaccgccgcgtaacggcccaatttttggggcaccgaatcgttccactcccgcaacaaaatgacgacaaccaaaacgacgacgaaaacgcaaaagatgacattgccccgggcgatgggccccgggggaagaagcgtatttaagcggagagaagtgggggaagggcatcagttgcagttcaaccaacagcagcagaagcaaaagtgaggcaataaatattcaaaacaattaaaatatatttaaaataatattagttaaattatttcaattccaatttcagtttaatttttaatttaaaataataattatttaaattcaataattgaattaaatttcaaatcaattacaattttaatattttagatggccgacttcgacaaacacgctgcccagcgcgaggcggagtcgctccgcactttggccttcttcggcgtgtgcctgtccaccgtggccacggttatcgctgtgctttccgtgccgttcgcctaccagcacttccagcagatcggcgcccaaatgcagaacgaagtggacttctgcaaaatgcgctccggcaacatgtggcgcgaggtaaagccgaaaaggcggaagggaaaagccgggaagtttcaaaaaatttcaacaaatttccaggtcacccgcacccaggcctactccaaggtgtcgcacgacagccgtcacaagcgtcaggcaggcggttgctgtggctgcggagtgtcgcccccgggcccgcccggaccccctggcccatcgggacaacccggcggagacggacaacccggaggctcaggacagcccggagcaccaggtccacaagccgtacttggaattccatgaaatttaccttgaattcttttacaggccaggcagctcctcgcccgtacccgccaagcggcggatgcgtgccgcaatgtgaggccgcccagcccggactccccggcccgcccggaccccccggacccgagggacagaacggccaacccggacagtcggcaccgcccgcgtctcctggccgccccggaccacaggtcagcttttcctgaaaagcttgtccaagcttttacaaatcccactgtttttagggacctcctggacccgatggacagcccggcaaccccggagagtctggccaacccggccagcccggcaaactcacccagggcccgcccgtcgttggaccgcctggcccatcaggaccccctggccagcccggacagcccggcgagaacggacagcccggccagcctggaaaccccggcccgcaaggataccctggcgacggcggaagccccggccaacccggcaaccccggaggcagcggcgagcccggacagcccggagcacagggatccagcggccaatgctgtgagtggatttagcaaatccaaaatccatttttctaaaattgttcgactttcagaccattgcccaccgccccgcaccgcccccggctactgagtgtgatcagtcgaccatcgacaattggagaagaacccccactgatgatccacgaggctgctgtcctttcgtctctcaccattttcccgatcattttggcatttccaaaacgctgatcggacaattctcaat

SEQ ID NO: 46898 - DNA, 788 bp, Heterodera glycines
  misc_feature (44)..(44): n is a, c, g, or t
  Genomic contig location: Contig_ID=SeqID_10686; Location=4689..5476; Strand=-
  SCN-specific regions: Sequence locations=1-146,168-409,488-788
ctgctcagaagcaaaaggcagtggggatgcccaagcgcgtgctnttcgccgtgtaagttccttctgttaatgtaaagtcgggccaaaaggctgcttaatgtgcaggtatgaactcggcccaatgtcagcgctatcagttggccaccgtttgtgtgttgggctgttgttgccccgcacagtcggcacagacaaatctgacaagtcagtggccaattagacaattaattaattaatcatttgctattgaaatggcaattcaggcgcatgtgacggagaccccgcagttgctgcctgtctaaatggcctttgtggccaaggatacttctgcaatgcacgcaacttttgctgccgatgccagtccggcacatcgccaggttttattttccgtttctccctttacttaatgtcgctctctttgtctctctctctctctcccccactttctctcacttctctctcagtctctcccactttccgtctctctctcctctatgtcaatccaccatttcgatggcttctaaattgctgatcagtttgcttatctcctgatcacttccccaggtccctgcgtgaataacctttgtccccccggctatgcttgcaacaccaacaatttctgctgttcccttggctccggttctgtacttggtccgtgcgttaatgaagtgggtgttttgcttatctttcccaaaagcttttttgccgattgatttcgttttttggcacagcaatgccccgtgggctacgcttgcggtgccggcaatttgtgttaccccgtgacgggcagc

SEQ ID NO: 46899 - DNA, 1367 bp, Heterodera glycines
  Genomic contig location: Contig_ID=SeqID_10689; Location=1..1367; Strand=-
  SCN-specific regions: Sequence locations=1-69,91-208,243-243,273 -306,335-457,480-522,544-618,640-714,738-1018,1192-1367
  Gene Ontology: Mol. function=aspartic-type endopeptidase activity; Cellular component=lysosome; Biological process=induction of non -apoptotic programmed cell death
cggtgtcgttcccgagtcgtggtgtatttcaggaccgagcaattcaatttttttgtttttctgatctaacatgatttatttttccactctttgtagcgttccgcttcgccgcatggacaccgtccgcgcccgtctggcgctcaccggatcgcttgaacagttccgcaagcatcgcacggagtcgttgcgccgtaccgtggagcgaatgaacaacaactacaacaacaatgaagagtacagcagcgcggaatcggaccaggaacagatggaaatggcacaaaacggggccagagttggcacggaaattgacgaactgttgcgcaactacatggacgtgagcagtcgggccacatttgaaactgatatatttggatttgaaatgaaacttggctttacaaaaaatgggattatgaaagccattcctttggaattttatttaccgaacccaaaccccgatatttttaaatttttcccaaaatctctaattggcatcccaattgtttttaattgatcctgaattttaatattttcatttttgaaaaatgtaaaaatcaaaatagctgacattagagaccggaacgaccgatttaatatttatcgaagattttgatatattttttcgatatttatcaaaaaattagtcaagaattttcttatttttcgatacaggcccaatattacggtgacatttccatcggttcaccggcgcaaaatttcaccgtcatcttcgacaccggttcatcaaacctatgggtgccgtccaaaaaatgtcccatttatgacatcgcttgcagtatgtttttttttaaatttttaaaccctcataaattttttgtgaaatttgaggccttcaccacaaatatgatggcgccaaatcaacctcctatcagcccgatgggcgaaaggtggcaatacagtacggcactggctcaatgaaagggtacggtagagacagtacgcgaaccaaatgagaaaaaaaaaactgacaaaatttacaaaaagaaagtactagttggagaaatttttaaaatttaaaaaatgcataaattaagagatttattttattatttttaactaaaaaaataaaaataacaatttttattttttattataaaattcaattaaaatacaaataattataattataattttcataaaaaattttaaataaatttaatttaaaatattattgtacagatttgtttccaaagacattgtttgtatggcaaacatttgtgtacaaaaacaggaattcactgaagcgaccaggcatgtctaatgctaggcctaaaaatttcaacaaaatttcctttttaagtgagcctggcctcaccttcgtggctgcgaatttgatggcattcttggca

SEQ ID NO: 46900 - DNA, 3581 bp, Heterodera glycines
  Genomic contig location: Contig_ID=SeqID_131; Location=4460..8040; Strand=+
  SCN-specific regions: Sequence locations=1-144,177-387,427-427,449 -504,583-606,635-690,713-762,801-834,856-900,922-939,969-1174,1199 -1219,1241-1345,1372-1553,1582-1912,1935-2342,2366-2526,2548 -2943,2965-3278,3300-3304,3326-3408,3430-3581
  Gene Ontology: Mol. function=non-chaperonin molecular chaperone ATPase activity; Cellular component=intracellular; Biological process=reproduction
atgccgcgaaattcacatgcaattggcatcgatcttggcacgagcgcttctcgtgtcggcgtttttcgaaatggatacttcgcgtcgatccacaatgaccgaggtgataaaaagaccattttggccatttttgaatgttttaattgctttatattttcaaaatttctttcaataaatttctttttttttcgtttcgagggttgggagatggcctacccaatttcctaatctttttttcattacgggaggttcaggagtttctcccattcccctgaagggcctaaccaaattttttcattttgtaaattgaggaaagcgtatgatgccatcttacgttgcgttcactgacagcggacctttggtcggagaagcggcaaaagcacaggcaaaaaaataatttataaaatgattttttaatgaattaatgaaaattgggtttcaaaactaaaggaaattgaaagaaagaaagtctgatctaattcaatcaatgatcagtgctaaaaaagggagagagagcgcgaaagagagtacgagagagagagagacaaggagagtgtgtgcgatagaaaaagagagagggaggtatctttgttctagagctttttgaatttaattttttttttctaatttaaatctgtggaagcgatcggatatgaattcaaaatttttaagcgtctgtttctgaatcatagaaaaatcatgtccaaatgttataaaaagcggatttgcagaaaaagtttttgtggaattaaataacctaactttttttatacttaagtaaaatttaataaaattatattctgatatagaacaccttgagctattgaacaatactatgaaatatttatttggttgaattaagaaacgacccaacacgcggcaaaagcacaggcagaaacatttaataggaatatttttatgaattatgaaaattggtttcaaaactaaaataaattaaaagaaggaaatctggggccaatcacaattacgaacgacaaatttggcaatcgtccgaattttgattacgacaacaaattatatcgttgaataagccgttttcagtttgtctctgtcgtgtgaattgtcgtccaatcacaattaacaaaatctaccgtaaatttgtcgtcacttttcttatgaattaaccaacatttctcaggaaaatgcaaaaaaattgaaaaatggctaaagggtttttctagaggttttttggtaagtattgtagattccaaatctaatagattcgaaaaacccgaataaatttaaaaatcatcgataaaagtatagaaattaaaatctgagatctgattcatgaccaacgaactcatttacacctggaaacatgtttttaatattaaataaaaaattttagatcaaaataatttggtgaatttttgggacatttctcagacgccaaatttgaggggcgaagttgaacgccccccaaatatttggcgtttatcgtctgaaatttgtcgtttgtcgttggtttcaatcacaattacgaacaacaaacgccaaatttcagacgaaaaacgacaaatttcggtaaacaaacgacagattttttaaaattatgattggagataacgacaaacgacatattttacgacagatttggcgtttgtcgttcgtaattgtgattgacccctgctctgatccaattcaatcaatttaagtgacaagagagagtacattttcatatttatagttcgttatgttcccttgataatttgccggcatacgctaattacatattttggcatttagttggccataaatccgtctaacaccattttcgacttttttcatctcatcggacggaaattcgttgaccgagcagttcaggcgaacatcaatcgttggccatttcgcgttgtgcctggagaggacggacgccccaaaattgccgtgcaaagcaatggaaaacagcagacattcaccgtggaggtgtttcaattatgaacatttttccctcaaagtgaaattgacaacaaaaaaaggaaattgctctttaattagtcagatttgattcagctaaaataaatatttcgacaaaatgtaggaattgccctacatttgaccaacacattaagtagggccggtcaggtgtggcgctcatatttggtgtagccagtgaagtttagcgcgacattttttaacttttttttcacttgtactattttctctaattatcctccatggggcattatttttcaacctcctcagaagggggcgggataattggagaatgtgggattaatggagattagaggataattagagaaaaaacggtaattcacagatatttttcgaatccaattttccgcggctaagggatatttttaaaaatgcaataaaattattatacacactttttggaaagaatacaaatccatcaaaaaaaattacattaattatgagccttgtcctagtagtttttgagaaatgaacccccggataagaagtccggaaaaattctgaaatcttgtccataactccggattctgactccggatttaaaaagtaattaatcacaaattatttctcatcaataatcaatgtccattacgcagaccattttgtccatgctgttggccaagttgaagcattcggctgaagcatttcttggccatacggtcgccgacgctgtgctcactgtgccaacgcatttcggccattcacaacaccaatcagtaaaagattcagccaaaatcgccggcctcaatgtgttgcgtttgttgagtgcgccaacgtcggcttccattgaatacggtagggattgagtacggtttcagcataaattagtgccaaaaaatcatgcatagatttgtttttgcatattgagcggcttggtattttacatgctgtttttctcggcttataggcttataccatcaccgcataaatttaccattccatcactccactagcattttaatgagacaattaaattttgaatttgttttcttttcacagcatttaacaactattgggaaaatgttaatgtgcttatcttcgacttgggtgcgtccaatgttggcgtgacaattgtcaactgcgaagatggtatcattcgagtgaagtcatgtgtcggtgacactcgggttgggggcgatgacttcaccaatcgaatggtaattatgccggattatggcatgctttattaaatttggcatttacggtcgatcatttcgttgcggaattcatgcgtcagcacgggtacatgctcagctggagccctgaagcgctttttcgtgttcgtgccgcctgtgagaatgccaagtgcactctctctttgtacacagaagacaggtgaggggggttatttttttgggaaaagcgcgccgtaaaaaaggggtgtgaaaatataaaaatagtcatgtcaatgcgggattgcggactggaaaaaatcgcgcgcgggatcccgtcccgctcaagtctaggattccagcccctattttttggattccattttataattactattattactctccgtttcagcattgaattggactctctcctcatctcaagcaggctgagggagatgaagcacttcgttcaaaacagttagacaa

SEQ ID NO: 46901 - DNA, 879 bp, Heterodera glycines
  Genomic contig location: Contig_ID=SeqID_10728; Location=301..1179; Strand=+
  SCN-specific regions: Sequence locations=1-28,51-241,263-344,366 -638,660-777,799-879
  Gene Ontology: Cellular component=extracellular space; Biological process=aspartate catabolism
taagcaatttatcccactctttacactgtaaaaattaattttagctccgtatggttcagcaatgttgagatgggaccgccggatgcggtttttcactccttttttgtttttaaaaacccatatttaagattttgggcattaccgaggcatacaaaagggacactaacccccaaaaagtgaaccttggcgttggtgcctacagagatgaccaggtcggctgcaagtattttatcccgaaaatcatttcaataatttttctttccttagggaaagccttttgtactgccgagcgtaagacaagccgagcaagagataatcgcagcgaaaatggacaaagtcagcttttcaattgcaaattgactctcccccttcctccgtccccaggaatacgccggcatcgccggtttgcccgacttcaccgccagtgccatcgaattggcactcggcaaggacagcgaagtgctgaaggcgaagcgaaacgcgacggtgcaggcggtgtccggcacgggcgcgttgcggacgggcgccgaatttttggtggacattcatttgcagacatttaatgggatggatttaaatgaactgactttaaagtactccagggtcgctgatcacggacatgacctttcattacgaatccaaaaatcaaaaatacgatttttgctttgaattagggctccggtgctcgtaaggtgccaaaaagaaggtcatattcttgattagtaatcccgtagcaaattgttattagtgccattgtttaagtaattgcgtaataattccaatttccctccctccccaaagtccaaatggttcccgcatcgcaaagtcgtctatcagccggcgcccacttggggcaaccacgtgcccgtgttcaagtgc

SEQ ID NO: 46902 - DNA, 2213 bp, Heterodera glycines
  Genomic contig location: Contig_ID=SeqID_10742; Location=91..2303; Strand=+
  SCN-specific regions: Sequence locations=1-125,156-290,312-481,503 -800,823-1209,1231-1237,1260-1270,1292-1615,1638-1727,1749-2168,2196 -2213
  Gene Ontology: Mol. function=NADH dehydrogenase (ubiquinone) activity; Cellular component=membrane fraction; Biological process =mitochondrial electron transport, NADH to ubiquinone
aatatgctaaaaccattttcgcatcttaattccatacaatgcaccaaacatttgctggtcagcaaacggcccatgcacatttggatgccggacgcgcagtttatgcgtcagtatcaggtccttcctttggttttgcttttttattttattgcattaatcaatcacacacaaattttaacaatttcaatcaaattttgaggtggaagacagcggaaaaagacaaaacacagccggagaaacacagtcgagacataacgcagccggaatagatttttttaaatttttcaaatagaaatttttcaagaaaaaagtcttactttgttagaaaattcgatcaaaattttttttttaattttccaacgattttttcaaaattcactgataaattaccaagttttttcaaaaaaatcgctggaaaatttttagaaagttttttctatgaattttctaagaaacattttttctaagatttttctaattgaaaaattttttaaaatttattcccggttgtgttatgtctcggctgtatttcggcggctgtgttttggggtgtaccgggaagacagaataatttttacgtaccttacttaactatgatttcttcagttccaagcgccaatcactcgaaatccgtggcaatggctcaactcaaagacccaaatcgacccggaggataaagtcggactgaggaagcaaatcgctagtatggaaaagatttcgcacatcagctggaacgatttcgcctgcgaatttcgcgaagcccaaatagacagcatggtcagaatttggtgcttccaaatttgaactttcttttctgcttctccaattggacagattctcaactttggccccaatcatcccgcagctcacggagtgctccgtttggtgcttaagttggagcaagaggtcgacaaattgtcaaaaaacattacaaacgaaaatcatttatttattgacagttatccgaattttccctctaaaactccgtcatttttaaggtttgcatcaaagcatcgccgcacatcggactgctccatcgtgggactgaaaagttggtttcgctacttttccgttttgggccaacagctcaaaatttaaaaaaaaaaaagttcacattcaataatttgtgcgcgaaatcgaaaaagtcctttatcgctacgctaatttatgctatgagaaattggaaggtttaaattgtcccttaagcgcgctctttgttcattttttaattttgatgtgaaaagtgtctttttatttctatcaaagcttttgtcatttttatattgtaattccatcagatggttttgagtgccccggctttttcaaatgccattttcacttcatttttcagactgatcgagtacaaaacgtacacccaggcattgccctactttgaccgtctcgactacgtgtccatgatgaacaacgagcaggcatattcattggcggtggaaaagctgctcggcattgacatcccaccacgtgccaaatggattcgaagtgggttcataaaaagggaaggcaaaacattcatttctattgtaagatgggcattaagttgggaactgagtctttctttaccacccgtgccaaatgtgaaattgacctcaccccctaaattttattttttaaatttagtccgtctttttctgttccatgggacattaaaccccctccccccccccttctgtagcattgtttgccgaactgacgcgcatccaaaatcacataatggccatcaccacccacgcgttggacgtcggtgcgatgactccgttcttttggatgttcgaagaccgcgaaaagtgagaaaagcgccggattgaattgaaaagccattctgaacagattaatggagttttatgagcgcgtgtcgggcgcgcgaatgcacgcgaattacgttcggccgggcggtgagtggaaatgtcaaaaacccaaattaacacccatttgattcatgtttatttgaaaggcgtcgcttgggatttgcccatcggtctcatggacgacatttacgattggtgcacccaatttccccaacggattgacgaattggaagacactcttacggagaaccgaatatggaagaaacggctcatcgacgttggggtggggtcagatggtttgagaaggcaacctccccatgttcctgacttaacaccaaatctggggtggagggggggggggggggggggagtcggagagagagagcg

SEQ ID NO: 46903 - DNA, 385 bp, Heterodera glycines
  Genomic contig location: Contig_ID=SeqID_1507; Location=1..385; Strand=+
  SCN-specific regions: Sequence locations=35-49,92-285,321-385
catccaaggcatcaccaagccggccatccgccgtttggcccgtcgtggaggcgtcaagcgcatctccggcctgatctacgaggagactcgctcagtgctgaaggtgttcttggagaatgagatccgtgacgtggtaatttgcatttctcattaatgctatttggggaccaaatttagggtgcgtttttcgaattttaaaactaaaaacggaaaatttgcgtgaagtgctgaccagttaaaatcatttatgtgcctcaggtgacctattgcgagcacgcaaagaggaagactgtcaccgccatggacgttgtctacgcgctgaaacgccaaggacgcacgctgtacggatttggcggttgagcgggacggaaagaacggaggagag

SEQ ID NO: 46904 - DNA, 3122 bp, Heterodera glycines
  misc_feature (1596)..(1597): n is a, c, g, or t
  Genomic contig location: Contig_ID=SeqID_1511; Location=83..3204; Strand=+
  SCN-specific regions: Sequence locations=1-295,318-398,425-767,808 -995,1017-1267,1291-1674,1696-1729,1761-2078,2100-2127,2149-2440,2462- 2572,2594-3122
  Gene Ontology: Mol. function=metallopeptidase activity; Cellular component=integral to plasma membrane; Biological process=cell-cell signaling
caacccacggccgcgggccgaccaaacagcgggcagagcaaatcgttggatttccaacagtcagccgaccaccggcaccacaacagtagacagtcacctttctcctcctatatgaagcaccaccaaacgcagcagcaccattcgttgcggcacggggacaacgacgtcgaggacgccattgagttgctgtccttcccgcaaaggtttgtggctgggtgtatttcagtaaaaacctaggtaactcaatggtctcatcattcggccaaatttttgtaaaactccgtgaatcatggcgtttttggtttgtgaccaggggtgatacacttttaaaaagacctccgtgatcactgattgtaaaattgtccgtgattgaaatttaatccaaattacgtccagccctttacccataaataaataaactcgtgtcatgggatattgatgcttttggcggggattcttttctatacctcgtactaaaccgcactttgttgctcttccagttacttgggcaagaatcggacaaggcgtgagcagtcgctgaagccggaatggcgggagattcgcggcaagcgcatctacgaggtgcgcacctgcaccatctatttgcaggcggaccacaagctgtacatgcacatctacaacaaggagggcaaccgggaccacgccaggcaataatcaacgaatttttgattacgaaataggttgtatatgagaacaactgttgagcgaaaagttggtattagcctattattacgcatttttggcacaaatttaaaaaatctcttaaaatatatatatataaaaaaagagttcaaaaccttgtaaaacattaattttaggacacgtgaggagattgtttcgctgctgtacaatcacatcaaggcggtgaacagcatctacgaaaacaccgactttcacggaatcaacggcatcaattttgccattcaacggacaacggtttgtttttgaggtgtgggttgtaggctttttggaatttacaaaaattttataaaaatttcccaccctcagatttacacgccggacacatgcgcaggtgcgtcgtcggcgaattccgctgcgactgtcggcaacaacccgttctgtgaggagaacgtggacgtgtctcactacctgaactccaactcgcagaaggaccacagcgcattctgtttggcctattcgctcacctaccgcgactttcttggcggcacattgggcctggcatgggtggccagtcccagtcaaagtcggtgatacagtgttaaattattcatttggtctattattgcttttatatattttttatactgttttaggcactgccggcggcatttgccaacgtttccagcgctacaatgagcagcaacgcggtggggtcaaccggtcactgaacacgggcatcatcacgttggtcaactacgggaacagagtgccaccgcgcgtgtcacaactaacgttggcacacgaaattgggcacaattttggctcaccagtgagtaactttttttcgcaaattctaggaaggcttcaagactttgtctcaaaactaaatttatttccattttagcacgattttcccgccgattgccagcctgnngtgcccgacggcaacttcatcatgttcgcctcccgcacctccggggacaagccgaacaactccaagagtctccaaatgctctgtggctaacatcagcgaagtgttgtacgaagtgctcggacaggttttttgaaaaattattattttttacaattaaattttagagtcccaaaaaccagcagtttggacggaagaaaaactgcttcactgaccgtgagtttctcatgcattttaacatcttttgggtttacgagagatctgggtttcgggttcttttttcgggattttctggttacatccctacaaatcttggtacgctttctggcttcgggattttctttttttcaataaaaatcagagaaatggaatgcccaattcatttttatatatttaatcaatcgttaaatacaaacctccttttaactgtttccttggtttcacagagctcaagtcgttctgtggcaaccaaattcgggaggacggcgaggagtgcgactgcggcttcaccaagcaggactgtcacgagaaccaggaccagtgctgtgcaccacgggagaacaatgacgagcgcacaatgtgccgacggttggccggcaaaaagtgttcgccgtccgagggcatttgttgccgagcggcggactgctcatttgtgcagcgcaacgggcgcgtgtgccgggaggagtcggagtgccaacacgagcagaagtgtgacggaacgcaggccaaatgcccggacagcaggaacaagccggacggaaaggcgtgccaggagagcaccaaggcaagtcgggcgagggtgggcgttcattctgtaatgttatcagttcatggcttggcccaggcctgtcgctgtgttttttgtttataaaatagtcaatggatgtgtgccctccccccctcaaaaactaaaaaagtcatattttttgggtaccgatttttgttaattttcgttcggaatagaaatgttttatttttgaaatattttttaacaaatcgcaaaaaaacatgctagagatgccctttacaatacaaacttaattttgttttattttgtccacaggtttgtcagaacggcagttgcagtggctcaatttgtgcgcaccatggcatgcgcgactgtttcctgaccgagggcaagccggaggacttgtgccagttggcctgccaaacggaagcgggtatggacaggcatgggtgcttggcatagtatcttattataacgtcacatcgggtaacgggtgcatcccaaaatttctccgtccaaattttgccgggacaaaataccattgccaccttttgaggatgccaagcagcggccgacatcccgcggttgaccgtatacacgcaggaggggcgcaagtcgggccatttgctgttgccgcccggctcaccgtgcaacgactaccagggctactgtgacatcttccgcaagtgccgttccgtggactccaacggcccattgtcacgactgcgcacgctgctgttcaactcggaaaagatccaagagttcaaggaatgggttaag

SEQ ID NO: 46905 - DNA, 1578 bp, Heterodera glycines
  Genomic contig location: Contig_ID=SeqID_10819; Location=512..2089; Strand=+
  SCN-specific regions: Sequence locations=1-360,382-581,604-778,805 -892,926-995,1069-1123,1240-1290,1417-1480
  Gene Ontology: Cellular component=mitochondrion; Biological process =carbohydrate metabolism
atgctgaaaaataacttattaatccgtggcaaatccgtccttttctcgttgccgttgagggctttttccctgtccgctcagtgcgccaacggtgagcccattcgtcgcgtcgttctgatccccggcgatggcattgggcccgaaatttcttccgcggtgcaaaagattttcgaggcggccaaaaccccgattgactgggtttgttgttgtcacatctctcaattttaaccgcccttttgaaggatcccgtcgatgtcacaccggtgcagggccgggacggcattttccgcattccgaacaaatgcattgagctgatgcacaagaacaaagtgggactgaaggggccgctggagacgccgattggaaaggggcaccgttcactgaatttggcggtccgaaagtcagtcaatttccaattaaaaaaagctgattccgttgcccccagggagtttaatttgtacgccaatgttcggccgtgccgttcgttggagggccacaaaacgctgtacgacaatgtggacgtggtgaccattcgggagaataccgaaggcgaatattcaggcattgaacacgaggttttgaaggggagagggggaaagaaagtgccatcaatttattcgtttgaataaaatgcccattcggcaagcattcgttctatttttgtaacgttcagattgtctctggtgttgtgcagagcatcaaactgatcactgaacaggcgtcccgacgcgtcgcccgttttgcgtttgaatacgcacgacaaaacggacgaaaagaggtcaccgctgtgcacaaagccaacattatgaggtatttgtcccttatttttcgcttttctcaaattgcaaattcctttcgcagaatgtcggacggactgtttctgaaaatgtgtcgcgaacaagcgcaggaattcacggacattaaggcaattttggggacaatattagatattcgtataatccgtcgccatttcaaaattttaatacgtttttttcagttcagagaggcctatttggacacggtttgtctgaatatggtgcaggacccggggcactatgacgtgttggtcagtcaaaatgccgctttttgacgcaacatccaaaaccgagtctgtctttgtctaggtgatgcccaacctttacggtgacattctgtccgatttgtgtgccggacttatcggtggacttggtgtcaccccgtccggaaatattggcgaaggggcggcagtgtttgaaagtgaggatctttttattgttggaatgggattgatgaacataatcctgtcaaaaggtgtgcacgggacggcgccggacattgcgggacaggacaaggccaaccctaccgcccttctgctgtccggcgtgatgatgctccgctacatgggcttggagtcgtacgccaacaaaatcgagaaggtcggcactgacggggaatgcctttgctgtcgcattagcatactttcctccaatcccgttggttcaggcttgtttcgacgcgatttcgcacggggaccacaaaacgcgcgacttgggcggcacgggcacatgttcatcattcacggcggacatttgcgcgaga

SEQ ID NO: 46906 - DNA, 564 bp, Heterodera glycines
  Genomic contig location: Contig_ID=SeqID_10846; Location=773..1336; Strand=-
  SCN-specific regions: Sequence locations=1-20,42-564
atgagcaacaacgacatcatttttggaaatgaggaaggcgttaattatttggcaccatggacatattcctgtctcatcaaaacttcgatagatcggttgaaaactgctttatctgaggttaaaaagtacatacaaatgttgttcataataaaaatttaccaataatagaatcgtgaagccatacatgctttaaatgtgagttaattcttggttgaataggatctttaactgatttctttatattctaccacttaagcatttacaagaagtctttcgtcaaattgaccgtgcttctccctcctttctttatgatttctcaaaacttttgctgatcgagtcgggcgttgcaggaactaatgtgcaggaatcgtaccttcgaatgcatgcaaacgcggccacagaagagctggaactgccacaatttgcacacattgcagaatttcaatatttgtcaatgaggtttttgtaaaaatataaagcctttattgttcattttaattcagagctgtttcactgtgcaaggtgcttgccagaattccggacgaaatgactgataggttttaa

SEQ ID NO: 46907 - DNA, 565 bp, Heterodera glycines
  Genomic contig location: Contig_ID=SeqID_10860; Location=4292..4856; Strand=+
  SCN-specific regions: Sequence locations=1-335,357-527,549-565
  Gene Ontology: Mol. function=protein serine/threonine phosphatase activity; Cellular component=cytoplasm; Biological process=protein amino acid dephosphorylation
atgaacgaggaatactgcttctctacttcgactgttgttgcacagagctgggcccaaacaaactttcgaccagtggacgagcaaccgaacagccttgtggacacgctcatcgccaaactttcgtgcacgactttcgagcagttcacttccgaagtgagtgatgcgttcattttatccgtctttcatttcaactcttcaggtcagtgctcaggacattcacaagctttgcgatgtcaccgtcggtgttctccagcaacagtcaatgctcatccgtctgcagcctcctgtggtcctttgcggcgacatccatggccaatttcgggacttgctgagaatcttcaagacgatgggctttccgccggacaagaagtacctcttcctcggggattacgtcgaccgcggcacgcaaagcctggaaacaatggtcctgctcttctgctacaaagtgagtttgctgaggaggattgcgcgagaatcgttttaattgtccactttttaaggtgaaatatccggacagtgtcatccttctgcgcgggaaccacgagtgcagcaacatgaaccgagc

SEQ ID NO: 46908 - DNA, 1732 bp, Heterodera glycines
  Genomic contig location: Contig_ID=SeqID_10911; Location=1902..3633; Strand=-
  SCN-specific regions: Sequence locations=1-540,562-688,763-890,922 -1548,1593-1732
  Gene Ontology: Mol. function=molybdenum ion binding; Biological process=reproduction
aacgtgccttggcacacattgacaatgtgtacaaatttggcgctctcgacgtgtacgggtacatgtgcaagaccaacttggcctccaacaccgcttttcgtggcttcggagccccccaaggaatgtttgccaccgagaccataatgaagcatgccgcggaacaatttggcatcgacgtggacacggtgaggacgaataggcggccaataatatatggggagatgtgcgagagtctcgggaaaagtcagtttcggatggcatttgtatatttttaaacagattaaagccaattttcgctggttttattccatttttacttttgcgaaaacatatatgtataaacgggatatttattgggtacaaaacctgagcagttttgctttttgattcagcttcgggagcaaaacatgtattcggagggggacattacacattacgggatgcatttgcaccaatgcaacattcgccggtgttggacagaatgccaaaaattggcaaattatgaccagcgaaaattgaaggtattagtggaggagatatgcttttaaatttgatttttaatcaactatttcagctccaagaatgtaattccaggaataaatttttgaaacgaggcatttacatggttccgacaaagtttggcatagcttttggtttcaagcgacttaaccaggtatttcacaataagtttaaatgaattaaattttgaaattaaaaaataaaaattaaattttttagggattatttaattttaaattaattgttttgtcttaggctggagctcttgtcaatgtgtacactgatggttccgtgctaatttctcatggcggaatggaaatgggccaaggattgcacacaaaaattctccaagtaataataataaaaaggtgaataattaaatcaattaataataattaaaatccttcagattgcttcaaggtgtcttggaattgacgtttcaacgattcaaatcattgacacggccaccgacaaagtgccaaatgcgagcgcaaccgctgccaggtgggcggaccatgataaggaaaatcatcatttttgttttaatatcaatgttgttgttgttttttttgttagcgttggaagtgacgtcaatgggttggctgtgaaaaacgcatgcgaaattttattaaaacgattggagccgttgagaagcgaactgccaaaagaagccagttggaaggtaaaaataaaaccaaaaaaggaattaattatgctaaatgggtcacgccgtgttgaggattcgggattactgaggtcttggcctaattcagagactgggatggacatgtgccagggaatagaatgttttggcatgtaaatccggcatcttaacttttttgagttccatgccgtatgtttaggatttgacgatcgtttaaagataaaggccaagaatggattccatttttgaatgatttatctttttcttttattttacacctgtcattaaataaatcaaaatgccaggatttggtgatgcacgcctattccaacagagtgcaattgtctgcgactggatttgctatgtattttaatttttaaaaattcgtttttattttttcttttaatttgtatgttaagcattcattctgagcctcctgatttcgtagaaggtcgtggctccgaatcgtacagttattgtgtttatggggtcggatgtgcggaggtcgaagtcgactgtctgacaggcgaccatcgtgtacaattttaa

SEQ ID NO: 46909 - DNA, 1506 bp, Heterodera glycines
  Genomic contig location: Contig_ID=SeqID_135; Location=91..1596; Strand=-
  SCN-specific regions: Sequence locations=1-181,203-329,351-353,375 -1009,1031-1506
  Gene Ontology: Biological process=larval development (sensu Nematoda)
atgcaacttaagagttcatcgagttgtgaaacaactgacagtgagtcggacatcgaatgcgatccaaatgttctcccggaagacaaagtgcagcaaattcaattcgatttggctcgaggacaggggaacatctcttcgtcaagtgacgacgaatcatcggatgaaatgtttgaccaaaaaacgggcgaaaacaaagagggggaggaggaagacaattggggagaattggacaaagaagtgcgacgcgtggaatgggcatcatctaagttggcaatctgcaatttggactggggcaatgtgcgggctgcggatttaatgctggttggcacaaaaaatgttgattcaataaacaaagaaattgcactggtttttacaaataaattggattcagttattcaactcactaaaaccgaacgaagcgaaaattcactcggtttctgtttatttgtcggattttggagcgaaaagcatagagagagaaaagcgaaacggaccgatgttgaaagtgaagcgattcaatagaaaagcaaatgagagggaggaagaggacaaattggaagagtaagcatagaattgcattataattcatttacaaaaaaagcaaataggcaaacgaaaaaagcaatccgtgcgcatgagttggacaaattgcgttattattacgccgtttgtgtgtgtgactctgtcgacacggcgactgccatatacgaagcttgtgatggcgtggaagtaagtgattattttatttctttcattttcaatatacgaatttatctcccttaagtacgaatccagtgggctgagattcgacattcgatttatccccgaaggaatggaatttgaggtgggatgaatatacagtgaataattaatatactcctttagactgaacgaattcgggaacaaattttgtcggatcagttcagcgctgaatggtaccggccacgaaaagttggaatgcacacactcaccgcaagtaacccaaaaatcagttgggagacggacgacccggagaggagaagagcattcaagcgagcattcgacgaggaggccaaattggaggagtttaagtaccgtaccgttgataaatagtatcatcaattccgaaaatttttggggttaagcgctttcattggctccgacagcgaagaggaggaaaaggacaaacagaatcagcggaatgcaaagcgcgatatgttattggccgctgcgcgtgaaggccttttgggaaattcgaaggcacagcaaagcaaagatgaagagaaggacgacgaacagcatgaaaatgtggagaaagaaaaggcggatgagaaagagaggacaaggaacgaaagcgacggcgaagacagagaaattacagacgaagacagcgaggaggaggcggtggacatacagagaccgaagcgcaagaccaagttccagctgtatttggagcggaagaagcagctgaagcaggaacggaaacaggaagaggcgaagcgacggaaacggcggagaggggacgag

SEQ ID NO: 46910 - DNA, 856 bp, Heterodera glycines
  Genomic contig location: Contig_ID=SeqID_136; Location=305..1160; Strand=-
  SCN-specific regions: Sequence locations=1-273,298-515,537-663,685 -687,709-856
  Gene Ontology: Biological process=larval development (sensu Nematoda)
atgaatgaacgaacaaagcaaattgacgttgaagatgatagtcgttttatggatttggcgaaagccccaatgttcagagagatgcgcaagaaggagcaaaaagttcaaatcgatgatcgtttcaagaaactactggttgacaaagattttcgagaggacgctttccaattgatggacaggcgcggaaggcctacgaccaaaacgaacagagatgcgcatttgtcacacatttacgagttatatcacgatgagaagttggtataacttgtcataaaatcattattttatgacttcccctcatttaaggacggcaccgccgtctgtaagtggagaaatgcaacttaagagttcatcgagttgtgaaacaactgacagtgagtcggacatcgaatgcgatccaaatgttctcccggaagacaaagtgcagcaaattcaattcgatttggctcgaggacaggggaacatctcttcgtcaagtgacgacgaatcatcggatgaaatgtttgaccaaaaaacgggcgaaaacaaagagggggaggaggaagacaattggggagaattggacaaagaagtgcgacgcgtggaatgggcatcatctaagttggcaatctgcaatttggactggggcaatgtgcgggctgcggatttaatgctggttggcacaaaaaatgttgattcaataaacaaagaaattgcactggtttttacaaataaattggattcagttattcaactcactaaaaccgaacgaagcgaaaattcactcggtttctgtttatttgtcggattttggagcggaaagcatagagagagaaaagcgaaacggaccgatgttgaaagtgaagcgattcaatag

SEQ ID NO: 46911 - DNA, 2863 bp, Heterodera glycines
  Genomic contig location: Contig_ID=SeqID_10918; Location=1532..4394; Strand=-
  SCN-specific regions: Sequence locations=1-538,560-1000,1023 -2136,2159-2271,2293-2503,2525-2575,2605-2635,2657-2737,2759-2863
  Gene Ontology: Mol. function=cytoskeletal anchoring activity; Cellular component=cell-cell adherens junction; Biological process =locomotory behavior
atgtgcaagtggacgacatgcgacaacggatgccgtacggagaatagggcggacaatgtgagcggacggaaaagggtgaagggcacggacgaagagaaattggcaaaggggaaaaaaggggaggggggaatagggagaaaatgggaatagggagggaggggggagaatgtgatcactgatcagatggcatgctgggggatcatttcggaaaatctgttaaaattgacacttttacgaaacgacccctagcatcatctgaatggtgatcaggagggtcgactgatcaaagattgtaagaggcggacatttcatcattaaattggttgctgatcatttttttaagagtggcgttgtggtccaagccaaccgaactgtgatcgtcgggctgaacgcctcggcggctgatgtgtgcgaatgtcccgcctattctccgaagagtgagtgcgatcggactgtttgcttcaacgggggcgtctgtcacgacactcggccaggaactttgtgagtattatcctcgttaaaatgccaattataacaaatcccccctcctttttctcagctgcgaatgtcgcaatgcgcagctgaccggcttccgttgccagggaaacacgcgcagtttcgacggccgcggcttcgcatggttcaaaccgttgcccggtccgccaccccccccctttttttcacagttttcgagaccgattcgttctttcagcttgcacttcgctcaacatttctctccgcttcatgaccaagcaggacggcgtccttctgtacaacggaccgatgggcgacccgcatttggacgcattgagttacaacgactatttgctgatgtacgttgagaagggcatgctgcacgcgatgcttcaattcaatggcaaagagccggtggaccttttcgtcgagcaaatggtcgcggacggccgatttcaccgcgcaacgctcagccaacagcacaaaaagttgcgcttagtgttggacgactgcacaacgatggaggtcggtgcacagcagcagcagcaaaagccgaacacggccttctgcttgacgagtcgggacgcgccggacgacgacgagcgactgaacatcgccgccccgcttcagttgggcggactggcgccgctgtcgggagcggaggactatccgagcgcagtcagagaacacgcgttgggcaattttgtgggctgcactcgggagttggtggtcaacaacgacgtgagtgccaacacttcggcacttcccttaagcccttgcccttttagcactacgatttgtatcgtccaatccatgccgaacagagttcgcccgactgctcaatgttttggggctcttcctgtgccggcgactcggcttcctcgtcggccgatggccgcgccaatcatttgacggaaagcgcgtcagtccaattagcaagcacattttgtaatggacatggcgagtgttttgtggaatcgatggatcagcaggtggcgaagtgcgaatgcgagcccggctgggaaggggaaaggtaagcggctagtcgaaaaggctctctggctatataatattaccccgcccctaattacccacacctcaattatcccctctttaattacacacccactttattaccacctcttaaggtgcgatcgcccgatcaattgggtggagttcacttcccgcgactcctttctcaagtacattctccaagtccaacccgcttaccaagagtctcgcctgcgagtgttgtttttgcccggctctaccggaatgggacagttggcatcggcaattgggcaaaatcagcctccggcttacatgaaactagacattaaccggtacttaccgtccttttagcccttcaaactctgtttagtttcaccacccgcggctcctttgatttggtgccgtcgacaattggggcgaattcggcgccaatggaaatggaattggcggagcctcggctgaatcactccgtcccttatttggtcgactttcaccgaacccccagcaggtgaaattgagaaaggcaattgtcaaaagggcgttttttaagtgtccaacttttggtcgatggtcagtaccgactgctgagagaattggtgccggacaaagaaacggcactttttgtcgcgaggactttctttgccggcagtcagcaaggccagcagggcttccaaggctgcatcggcaaattccgctacaacagtttcgagatgggccttcgcctcgacgaaagcaccgtcgagggaactctgaacgtggcggcagggaacgaactgcagctgaacatggctccgggcgggggaccggcggcacccacgcgaccgcacagggaggaggacagcgaggggcgagtgcggaggtaccgcccgcaccagcacagacaccgcagggaaccgccaaacccggggattgtccgtttggacaccgtcaaaggcgtcgtccagggatgctcacaggtgcagtcggtgatgaacccacgcactcctcaactgctttttgtttagttggccacctgcgataaactcggcgctcagttttgtccccttgggcaaatttgcgcggacacgtggaaaggtacggacggattaacaaatattaattaattaataaataaataatcaaatgaaaggtgcgttttgtgtgtgtccggaggggaaccacgcgtctttggacgtgaatggtaggctgagcaggtgcaatcagcgcgaagccgtggccagtctgggcatcagcaactcggccatgctcatgatcttggcctctctgctgctgctcactcgtaattaatccctccccttctaattggtcattcatttcccacttcagtcattgtcatgctaatggttgtttacacgagaagacaaaagccgccatttga

SEQ ID NO: 46912 - DNA, 1150 bp, Heterodera glycines
  Genomic contig location: Contig_ID=SeqID_10925; Location=2035..3184; Strand=-
  SCN-specific regions: Sequence locations=1-79,101-1150
tcaaaattatattgatctctccaaatgctatttgttatccgagtttcgaattcgtaaggaaaatgcaaatggtcaactggttgaccttgcagctgatgaggttgctccgattcaactgattggacacacattcattcgaaacatcaaaatgagcatcaatggccgtgaagtgttcaacgcaaattctctgatggcctacaaatcgtatttttcacacgaactctcctattcaacagcggccaaggactcgcatttgaatgctgccggttactaccgtgacactggtggtgtgcttgaggtgggagacggatgcactgcacgacgcaacctgtttgtaggcagcagaacagcacaattcatggccaaaattgacgccgatttgtttaaccagcctctctacttgatcaacttttgtgagctggacattgaaattttgcccaacgacaacgactttgtcctaatcgcaccacccggtgttgctgcagccactcgctaccatttcgaagttgtcggtctgaaaatgtatgtgaagaaggtgtccctgatggacggattggcgttggacattgcacgaaaacttgagttgaagccggcacgatatgcagtgaggaaaacgctgatgaagtcgctgttcatcagtcatgggcgttttgaatttacgtctaatttgttcatggatcaaattccccggcgtatcacaatgggattggtggccaatgctgactatgttggcaccgtttcacgcagccccttcaactttcagccatttaatgtgcgtgaaatttctataattgccaatgggcgctcctaccctcaagcagcctacgacttggactacccaaacggaaagtatgtgcgccccttcaacgacatgaacgaagcggtgggattctccaactcatcggaaagcaacgggattacactagcacaattcggcactacgcattgcatttacgtgttcaacttgacgagcagtggagacgaccaagcggcgctttttgatctgataaggaacgggaccacagcagtgagcatcaaatttaatcaggcggtgcccgttggaggaataatgctggtggtgatgggcgagtgcgactcgctggtgatgttggataaaaatcgatcgatcagcactgacatcactatttaa

SEQ ID NO: 46913 - DNA, 1237 bp, Heterodera glycines
  Genomic contig location: Contig_ID=SeqID_10930; Location=1..1237; Strand=+
  SCN-specific regions: Sequence locations=1-181,203-383,406-1023,1047 -1056,1095-1109,1230-1237
  Gene Ontology: Mol. function=rRNA primary transcript binding; Cellular component=nucleolus; Biological process=ribosomal large subunit assembly and maintenance
gtcgctgatcacgaatctgatattcgttttgaccaatttcgaatcccggattcgaacaaaaagtcgaaaattcaaaattcacttatgttcgaatctgtatagaaaatttcttttggcggaatcgaaaaaaatgttattcacttccttatttgctgctcaaaataacatttctaaaataccctgatttttagtggctctcaaatgttgacggtggaccatctgcgaaatttctcgtttccaatgtgcacacgatgagcgagctgaatatggtcggaaattgcttgaaagggtcgaggccaattctctcctttgacccggaatttgatggaaaatcgcacttgaggctcattaaagaacttctcgtcaacgtaacatttcattaacaaatgcagaagtaattgctgtaatttagacattcaaaacaccgaatcatcacccgcgaagtcagccgttcattgaccatgtgattaatttcgcagtgaccgaagatggaaatatttggtaattgggctctgctacactagcagtccatccatcaattcgcttggtttcgtggaccataacttttcttcgaatgtcgagaaccattcattctaactttcatatcagaccaacactcgaatgatgtcaaaaacataagggttgtaaaaatatggtccacgaaactcagagtgcttggatgattggacagtaaactgcaatagagccggatttacttgcgatgtaaataacaagaattgattccacaggttccgaaattatcaagttgccgaaaataatgaactaatggaaattggtaatctttctattgctagaaaaaaagaaaaaaaaaatctagttgaaaaattgtgtacgaattttcatgacaccatttttaaggcccgcgatttgtgcttcaactgatccgtttgtttgacaattctttttgcggagccgtcctttatgacaacccgaattaccaaacgccaaatgcgatcagaagacaaatcaaattgcaaaaggccgctgaatttaaacaaagacaagggcaaagggaagaggggaaagtcaaagaacggatgatcaaagaagtggaaatggaagacccactgggggaagtgtttgacacggaagaaaaaatggaggaggaagagaaaacggaggaaaaagagggaagaagaagaagagggtgaacgcagcaaaagcactggagaagagaattctgaagaagaacaaaaagaaacggaaaagcacgggg

SEQ ID NO: 46914 - DNA, 1975 bp, Heterodera glycines
  Genomic contig location: Contig_ID=SeqID_10944; Location=710..2684; Strand=-
  SCN-specific regions: Sequence locations=1-176,211-289,324-684,706 -869,891-1688,1710-1856,1889-1975
  Gene Ontology: Mol. function=NEDD8 activating enzyme activity; Biological process=endomitotic cell cycle
atggctagctggacctgtatgaaaaattcaggcatgtatccatacatggacgagaggcagggggtcaaaatacgaaatacccccccccccttcctcagaggccaaaatttttagtaattgaaaaaacgctcaaaacttttctgacgactttttctttcacccactttttttgcagcacggtttttctaagggagggagcccgacggtgccgattggcccgtcaggattttcaattatgacgtaatttattagcagattttgtccaaaaaattaccatatttgctactagttttgttaacagattttcattataatgaaatctaacttctaaataaaattcgaaattgatcagatttatttagccataattgcaaaatccaggacaaatctctcgaattttatcgtaaatttttcattattatttgcggacttgactccattgaagctcgccgttggcttaatgcgactgtggttggttcttaaaacttaccaacaagtctaccatagtaatgcattaagtgttctttggttgaatttgatgacggaaataacccaaaatccaacaccatagtgccgttgatcgatggtggaacagagggattcaaaggaaattcacgggtgattattcctttcatgacgccgtgtattcagtgcacgatagatctttacactccccaggttaggttttgtttttgtgtgtttcttatcacgaaatgcaattcatataagaaatcatatattaatacgatctaaaaaaaatttatttgaatctatttcaggtcaactttccgttgtgtacaattgctcacacacctcggcttcctgagcattgtgtggaatatgtaaaagttgtgctttgggaaaaggagaagccttttgggcaaggtgaaaatggtaaataactccatcaccattttccatttccatagacgttaaattggatgctgatgaccctgctcatgtcgaatgggctttccgtgctgctcaacaacgcgcgaatgagtatgaaataaaggatgtcgatttgcgactcacccaaggcgtgctcaaacgtataatcccggcagtggcttcaaccaatgccatcatagcgggttttatttttgttttttaaagctaacgttatatatctcaggaagctgtgctcttgaggcattgaaactggcatcaaagtaagcattcagtggcagcaatttcacattagaataactgtttgactcacaattgttggtgtttatttgtttttttatactggggttcgtctactcatttccctaaaaatagtttcaaaaaccgtgaaaactaaaacgcactatcaaacttatttaagcatctcatgttctctgaacaattacttgaactttgctaacgtggaaggtatctgtttcaacgttgttgcattggaacgtgatcccgaatgtttggtctgcggtcagaaatctgtccaaatgtattccgtgcgcgaggactgtacactctcaggctttttagatgacttgaaagacaaatagtaaggctaaaaaatacttatggagaatgtgaatactgcttttgcagccaacttcagaatccttccattcgagcgggtagcactttcctgtatgaaatcaacactcttatgccagaaatggagacagcaagtcggaagaatttgtgtaagacgctcaagggttagttaaaacaatctttaaatatttttcgaataaagcgaatagttatatagcacacttaccgtctatattttttatccttaaaagtttttgttgtaattgaagcttttagaacttcatgtcaccgaggatagcgaactgcttgtagcggatgaagcattaacgagatctattgtttttcggatcaaatattccaaataaattttattcgaatgtccgataaatatctctgaaggcattttgatttaagggctcgcagatttgataagggaaaagtgcaatcggaaacaaaacacgaaaataaa

SEQ ID NO: 46915 - DNA, 3047 bp, Heterodera glycines
  Genomic contig location: Contig_ID=SeqID_1530; Location=451..3497; Strand=+
  SCN-specific regions: Sequence locations=1-357,382-411,433-697,723 -837,859-1321,1344-1556,1578-1580,1602-2009,2033-2042,2078-2712,2734 -2881,2903-3047
  Gene Ontology: Mol. function=glycogen (starch) synthase activity; Biological process=glycogen metabolism
atgaacattcccaccaacggcgatgaatatttggaccgaggcgagtcggctaaaagggagaaacgattcgtattcgaatgtgcgtgggaagtggtgaacaaaggtggggagaaccgaacccggcatcgctactctttcgagagttcttaaattaagttggaggcatttacactgtcctgcggacgaaggcgccgattagcacagacgaactaggcgaccagtattacatgatggttggtggacagcaccaaatggaaggggaatcaaatcaacaaacattacacgaacccgaagggttcatggtccattaatatatgtttcgttcgatactctttttggaattttattcccgagttcgaacaaaaaataattaaaatttaagggtccctacgtggaggaaagagttcgcctggaagtggaggtgttggagccggagactgcaaatctcaagtacacgttggaccaaatgtatgactggggtttccgcgttgtgtacgggcggtggctgattgacggatatccgaaagtgttgctgtttgatgttgggtccgccgcttggaaattggatacatggaaacatgaggtgatagataacacgccaattatttccttgctttttcctctggtaacaactttatcactaatttgtgtaattttttgtttactattttgtccaaaaaatgaccattatattactttttgtgttaaattttaaaaaatagggaattttgagtccgacgttgcggacaggcgcctcgggaaaaaggaaaattttaaagaaaaaattagccaattattccttgctacatgtcaccttttcaaatggttcgtttaacgagaaatgaccattgttggtaatttaaacaaaaatattgctttttcacgtatcttttcctattttagttgtgggaaaagtgcagtatcggtgttccgttcctcgaccgcgaggccaatgattgcatcattttcggctttttagtggcaatatttctcaaatcgtttttggactcatccgaaaatttccaaccgaatgttgctgctcattttcacgaatggcaagctggcattgggctgattatgaccaggcaattaatcattcactatttattccatcaaattccaacattttgatgtttttcagaatttggaagttgaacatcgccactttattcaccacccacgccactcttctcggccgccatttgtgcgcctccggggccgacctttacaataatttggccatggttttattcaaagtgtctcttttaattccataaagtcgcattttgcagtttgacatcgatcgagaggctggtcgtctgcagatttaccaccgttactgcttggagagggccgctgtgaacatggcgcacgtgttcaccaccgtcagcgaaatcaccggcctcgaggcggaacatttgctgaagcgaaagccggacactctgacgcccaacggactcaatgtggtcaaattcgcggcgctgcacgaatttcagaatttgcacgctcaaaacaaagagaaaatccacgactttatcaggggacacttttacgggtgcttttttccatttttaattacgttttcatttgttgtgccttttaagtcacatgaacttcgacttggacaggacactttaccttttcaccgctggtcggtatgagttctgcaataaaggcggcgatttgttcatcgattcccttgccaagctgaattacatgctcaaagttggtcccccccccccaatccttttttattgtaatttattgtttccattgcatttacttttgcaccaaatgttaatggtttcagacctctgaggacaaacgagtgaaaggtgtgactgtaattgcctttatcatttacccggccaacgccaattcgttcaatgtcgactctttgcgaggccaggcggtgtgcaaacagctgaaagaaaccatttcgaaggtgaaggatagcattgcggcgcggatgttcgactcgtgtttacggtaagttgtgatgggctgcaaaataaattttttggaggaatttcccaaaaaagaatttttcttatttatttttattaatttttaaaaagactataatttttcctcaaatgttagaaaagcaaaactatagttttttttaaatattttgtgaactgcttccctttgtaatgtgtgtgtttaagacgtatttgttttcagcggtagaatcccggacatggaggaacttttgttgccggctgaacgtgtccaattgaaacggtgcattctctcgtcaaaggtgttgtttttgttattcttactatttcctaaattcccaattttccaaaattcaaattcaccattcaatgaaacacacttgtttttgtttaagcgtgacactttgcccccgatttgtacccataacatggtggacgatgccaatgaccaagtgttgaacgctttccgtcgttgccatctgttcaatgaagagagtgaccgagtaaaggtacccattcgaatatttcatgggaatcggaatttgttataagactttccaactttcgacaggtgatcttccatcccgagtttctgagttcggtctctccgctgatcggattggattacgaggactttgtacggggctgtcacctcggcgttttcccctcttattatgagccgtggggatacactcctggtaaatattttgctgtccggacaatcagtcgatttctacttgccatggccattttttattaaaatttattagcggaatgcactgttatggggattccgtcagtgaccaccaatttgtccggcttcggctcgtttatcgagaaacaagttcctgaccacgacaactacgggctgtacatcgtggatcggaagaaccgaagcccggacgaatcaattcagcaactttcctccattctttacagctattggttggctattttgattatttgtcacttttcaactgcaaaatgttctcttttagcgcattgtcgcgccgtcaacgagtgatcattcgaaatcgggcagaacgcgtcagcgaattgttggattggaaaacattgggcgga

SEQ ID NO: 46916 - DNA, 1804 bp, Heterodera glycines
  Genomic contig location: Contig_ID=SeqID_10989; Location=1604..3407; Strand=+
  SCN-specific regions: Sequence locations=1-79,101-395,417-531,553 -871,893-1804
  Gene Ontology: Mol. function=ATP-binding cassette (ABC) transporter activity; Cellular component=integral to membrane; Biological process=transport
cataaatttggcaaaagttcggaatttgacctgacaaaatagagactgccttccccaatgctctcagatgggtctccctccccccaaaagcccttcccaattagcccttcctccgctcagtttgcttattcctcctccgttgattatgcgctgattgcttttggtacggtcgcttctgtgctccacggggccggcttccccttactttcgattgttctcggtgggatgacctcaggtagaatgttttgggttttccatagatttttcttcattttttagtttttttgagggccgaaaattccgattttgttcatggccaaacgccgcgtcaaaatgctactaattcctctgccatttcgccaatttcaaagtgaaagtgaaaaacaaattcgcaatttccttttttaaagagaggaattccaatcggaagtggccgctttctccgtgtactatttggtcttgggtttcgtcatgttcgtcacttcttacatccaggcaatctttcgatgccaaacattgccaattccctcctcattgtcagatcgcttgttgggaggcggtggcagagagagttgcccatcggcttcgtcatacttatttgaaagcgcttctccgccaggaaatcgcttggtttgacaccgttcagtccggcaatttgacggcccgcctttcggagtgaccgaccgactgatcattttttgtcaccgcttttccaatttagcgatttggagagagtgcgcgaaggcctcggggacaaagcgtcgctattcatccaaatgttctccgctttcgtcgccggcttcgtcgtcggctttttctacaattggcaaatggccctggtcatggtcagaatattccttctctttctccatttgcgttgcgtttgcccctaaaggcacttttcaccccggccattgccttcaccggcgcgtggatgggacgaatcaccgccacacggacgcaagtggagcaggagaaatacgcagtggcaggtgcaattgcggaggaaacattcagctcaatgcggacaattcatgcgctgaacgcggaacggcaggaaatggaaaggcacaaaaagggggaaaataccaaaaatggaaagggaaacgaatcaaaacgcgaatgaaaaggaacagaagaaaattaactcttttgcttaggtatgaaaaggcgttggaggacgggcggaggacggggctgctcaaatacctttacatgtccgtcggcttcggtgccacccatttgatcactcacgcgtcttacgccgtcgctttttggtccctcccccgtggtttttttttcaaattgacatcgctttaggttcgcttctcgtctcatcgtgtgggatgagcaatttgatcgcggcaccgttttcattgtttttttctccgttatgagcggctccaccgccctcggggcggcgctgccaaattttacgagcatttcaagcgcaaaaggggcggcacggcacgtgctcaaagtgatcaacagagtgagtttgatgatacatgctcaaaagtgggttcttattcatctatgaatatctatgaattcaattgcgattctttccctttttaaaatttgcttttttttgaaaggaaccgaaaatcgacgcttattccgaaggtggtcaaatgctgcgagaagtcaaaggcgaaatttgcttccgaaatgtgcgctttgcttaccctttgagaagagacatcgaagtgagtgtttttcagtgcgtccgaatgagtcccaattcccttttctttttaaggttctcaaaggcgtctctttcaaagtttgtcccggcaaaaag

SEQ ID NO: 46917 - DNA, 3659 bp, Heterodera glycines
  misc_feature (90)..(90): n is a, c, g, or t
  Genomic contig location: Contig_ID=SeqID_10998; Location=1113..4771; Strand=+
  SCN-specific regions: Sequence locations=1-178,210-314,336-381,405 -813,887-1178,1228-1356,1394-1433,1457-1461,1500-1839,1861-2021,2043 -2361,2392-2550,2579-2615,2638-2668,2690-2695,2718-2953,2989 -3007,3029-3290,3312-3521,3580-3611,3649-3659
  Gene Ontology: Mol. function=aspartic-type endopeptidase activity; Cellular component=extracellular space; Biological process=induction of non-apoptotic programmed cell death
ttggcatttctctgcctgctgttggcattattggtgggcatcgatgctcagcaaagtcaatgggagcagaagcagaacagtgcagcaccngcgagggttggcaaggtgaaaacaaaacttttgtcaaggaaaaaacaatttcaataattagcgaattctaatttcaacttctgcctcttcagatttagttttaattaaagattcaaaagttttctgttcggtgaaaaataattttgtagggaattcgaatttattatattttagcttttttgattaaagtttttcttgcttaatttagaacttaaaattgctttaaaatccaataaaaattaaaactaatactttacaacctaaaaatttctcgaaaaatctccgagaatgaaaaaaattaaaaaataataaaagagaaaagattacttaaaaacgatatccttaaaaaattttcaaaatcacctttttaaattctttttttatagtgtgacattgcgccggatggacaccgtccgctcgcggctggcagccgccggttcactcgtccaattccgtaagcatttgcgccaggcgctgcgccaacgcttggaccgtctgtacagtgacaaaatggcacgcgcagacgtggcatttgacaccgatgccgcggcaagggaaggcattgacgaagtgttgcgcaattacatggatgtgggtttcaaaactaacaatagtaatgaatttaatatattcttacaggttaaaaatggttttcaattaagggactaaaatctttaaacggcacaaaaaatttctttttcgaattgctatttaaaagaagacttttaaatttatataatgtgaaattgaaataaaaaattttaatttaatttaataaaatattaaaatttaaattcaagcgtaaataaaatttcaggctcaatattatggtgacatttctattggctctccaccgcaaaacttcaccgtgattttcgacaccggttcctcaaatctttgggtgccgtccaaaaaatgctcatttttcgacctcgcatgccgtaaatttagtttttcatgagaaattttaaaaactttaaccattcaggctaccatagtaaatatgaccacaaaaaatcgtccacctatcagccggacggacgcgaagtggcaattgaatacggtaccggatcaatgaaagggtacggtaaatttctaataaaattatttctttaatatattgatcattaaaataatgtaatgcttttttcaaattaagcttcgtctccaaggacacggtttgcattatggacggtatgtgtgtggaaggtcaggaattcgcggaggcgacaaggtcggattacatatgcataagaatatgtctaataaattaaaaacattgaaaatataaaaatcattcattgggattgataagagaaaaataggcaattaaaatatgttgcaaataatatttaaatttattggtatgggaaattttttttataatattcgaaaaatatatattttttcaaagggagtgggattttttagaattcatattttacaattagagtccgcccgttttgctcctttccttccgcgtcacttacatatgtataatgggaattggtccacagggattgaattttgcttttgatgctccataattttttgatatttgctatgagcgcgtaatagtaaaattcatagtcgaaataccaaatttatacccactttccgacttacagttcttcgcatcctttcacttgtttgagttcttaaaaattgttagacagacgattttgaagggtgcatttattgctcaatgagaagctgaaaattacaaaaaattatgccaaataattcagaaattttctctatttaaattttaagtgaaccaggcgacacttttgtaaacacaaaagctgacggcattctcggcatggcttacccggcaatttctgtgcagaaattggcaactgttttcaacaatttggttgagcagaaagaagtggaggagccggtgtttgcattttggcttaatcggtcagttaattgacaatttaaaatataagaaaagtcggtgaaataaaaaggaatttcaaaccgaagaaatgtttttagtgacccttcgtccgaatttggtggccaaatgaccgtcggtggcatggacaaacgccgttttgtggaaccaattaattatgtgccggtcactcgccaaacttattggcagttcaaagtaaggatggaataaggttttttgaaaaaaataaaacgtatgacaaatttcaaagatggactcggtcactggcggacaaaatggcaaaagcaaaattgcatgccgaaacgggtgccaagcaatcgctgacacgggttggaattgcaaaaatgttttaatatttattttgtttttaattttatgtttgtccaggcacttctctgatcactggacctcagaaggacgtggaagccatccacaaacacattggtgccaccgaacttgcgcagggcgaagtcatttaaaaaaaatttatgtctgagtgattacgggactaaatttgagattatctcaaatgggtctttattagatatttaaaaattaaaatttgattgatcattcggaagccctacacgtttagatgcataaattcaacagcttataaaaaagttgaaacatgaatactaccaaaaagtcagaatttttgcatattcttttttacatgtcggttatctttgtgttttttgggaagccgatagagcttgttaagagcatttgaatgataccaagtttattggaattggttaacaaataaaaaagttatgatgctctaaacttggctcagactataccggccagactatagtgtctcagtccgaataattttttaattgaatgcactcgtttttatgggtagaccgagttttatagaacaaaatttcgatagttttgaagacaaacttttttgttgcccaattcatattctaaatttatttatttacttttgtttaaattattttgtcaacaataacataaaaatatttttacaattttgttacagtacaccttgccctgtgacagtatcgagcaacttccccacatttcgttcaacatcggcggcaaggcgtacacattgacgggcaaagactatgtgtggaaggtcaactcacgggggaaaacaagctgcctgtaaattggaaaaaccaaatgaaaattttgaagttttccactttctcatttcagctccggcttcatgggcatggaaatgtcatcgactgctgacaaattgtggatccttggcgatgtgtttataggtgaatggatggcatgattattttttaaattatcaccaaaatttgcgtaaattcgtcaatttctgttgaaatttttgtctttaggccgctattatacagtgtttgatgcgggccaaaaccgtgtcggttttgcgcaggcaaaggacgaaaatgagtgagttcaataacaactcaaatgccaaatttaaaattttcctttttaaccttgaacatgaacaattttcaattctggaaatgtcttaaaaattaaaatttttagttttatatattttaaatatttttttaaataattaaaatgcacttttagcgagcccatagaaccaaaagtggacgacaatgatgatgctgatgatgcggatgatgatgggatgccggca

SEQ ID NO: 46918 - DNA, 1216 bp, Heterodera glycines
  Genomic contig location: Contig_ID=SeqID_11011; Location=1492..2707; Strand=+
  SCN-specific regions: Sequence locations=1-213,236-317,339-565,591 -768,791-834,857-1216
  Gene Ontology: Mol. function=rRNA binding; Cellular component =ribosome; Biological process=protein biosynthesis
atgcttcacctaaaaacaaaaccacaggttggactgacaaactatgccgcagcttacgctaccggacttttgttggcacgtcgccacctgaacaaattgaaattggacagcgtttataaaggcaaagaaaatgtggacggagaggactttgacgttgagcaggtttgttaacacagcaaacttttcaacactgctttttattgaaactttgattttcctcaatgtcttttcatttaggaaggggacaatccgaacccgttcacatgtgtgctggacactgggctcgcccgcacaaccaccggcgcaaaactgttcggagtcatgaaaggagttgcggacggtggcattcacgtgcctcataggtgagcaatgggaagaaacgtggaccgactgttgccgaaattttggcttcttttctttaaatccagcctgagttcacttatttgttcccttttccattcaagtgagactcgtttctttggctatgacccggaagagaaaaagtacagcgcagaagcccacagagaccgcatttttgggaaacacgtggctgactacatggcccacctgaaggaagaggacgaggaagcgtacaagcgtcagttctcccagttcatcaagaatggcatcgagtcgggaacggtcagttttatttgggacagagggaataatattatcatacacagacagccattaaatggtgggtcatttatgaacacccaaaattgaatgatcggtgttaaatgattatttgatgctctttttagttggaagaaatgtataagaaagcgcacgaggccatccgcgcggatccgtccttcacgaaaaaggaaccaaagaagccaaaggagcaaaaacattggaacaaaaagaagtacacactgaccgagcgcaaacaccgtgtggccaaccgaaaggtgcagctttcagtatttttatttttgtctaattttcatcttttaggcgtatctgttgcatctgaaaaaccagcaggaggcagcgttggaaggctgaaaaaagcgattgacctatttgagagtgattgctctttctcaatttttatttgttgttttgtggtgagagagaaaaatttgttgtttgcttttttggcaattttttccaattcaaatgccttgatctggcgctaaattttgttggtttatttgacctcgtttatttggcaattgtgaagattattggtcccacaaaaaaaaga

SEQ ID NO: 46919 - DNA, 1435 bp, Heterodera glycines; identical to SEQ ID NO: 11030
  Genomic contig location: Contig_ID=SeqID_11030; Location=1..1435; Strand=+
  SCN-specific regions: Sequence locations=1-237,260-487,511-1435
  Gene Ontology: Mol. function=specific transcriptional repressor activity; Cellular component=cytoplasm; Biological process=B-cell differentiation

SEQ ID NO: 46920 - DNA, 119 bp, Heterodera glycines
  Genomic contig location: Contig_ID=SeqID_11058; Location=579..697; Strand=+
  SCN-specific regions: Sequence locations=1-119
  Gene Ontology: Biological process=body morphogenesis (sensu Nematoda)
atggaacgccttgaggcggtggtgcacgaacggaacgacgcctttttgcagttggagacgggcgacagcgcgtcgcccccgaaaaggacggtcacttccttcatgggattcacctacga

SEQ ID NO: 46921 - DNA, 771 bp, Heterodera glycines
  Genomic contig location: Contig_ID=SeqID_11060; Location=2166..2936; Strand=-
  SCN-specific regions: Sequence locations=1-276,319-613,635-771
atgccctcgccgttcccgctcagtctgtacacaaaagcatttgaggtgcaggaaacactgaacgaactgtacttccgcatctcctgtgaccacgagttcctgctcgagacgtacaaagacgtgatcaaggtacagtgtacggattacggtatactgtcctaatcaggcccgtagcaaaattaaaaaatttcggagggaagaagaaccctgcttagggccaaaaaattctttttctccagcttatttttcaaaaatttcaatgccggagcgaaaaagcagaaatttatagcggttttatgccaaaaaattcaaaattttgccattttctattaagttttcggaaaaaatcgaaaattttgaaattttcaagggcgacccgtacatcaaacgatgcgtggaaattgcgcagcaaatccatgacgaaggagtgcaccaaccgttggcgctcagtgtccaacgtgccgattatttgtcccattgggacgagcagaagcaatgcattgagctgaaacaggttgggaaaagcgatcgatcaaaaaaacattcattttctgatcagaggtgatcagttggaagttttgaaaaattttgcattttgaagattgatagacgttatgccaaaatattttgctgccaaatttgaaagcaaaaaacttcatttgatcagtgaggtgatcagaaatggaagaaccgaggagactctcggcacttccctactggtcagagaccgttagctaggcatatgtaggaagaatctatcattagaataaa

SEQ ID NO: 46922 - DNA, 1397 bp, Heterodera glycines
  Genomic contig location: Contig_ID=SeqID_1551; Location=1902..3298; Strand=+
  SCN-specific regions: Sequence locations=1-1397
atgacctttcacaaaattgacgcgagtagcatcgattcgattaccaatgccgttgattttttcagtatacccccgacaaatgttaccgtatcatcgtcaaaggttttcgagattttgccgagtaatccactcaccgacactccttatcattttaaaatacactcgagccaaaactacattgacctgtcaaagtgttaccttttgaccgaatttcgaatgcgaaaattgacacccccaaatggtgaatggggacatttggatgcttctgatcaggttgtaccgatacaattgatcgggcacaccttcatgcgggacctgaaaattgcaataaacggtcgtgaaattttcaattctaattcactgatggcatataaaacttatctttctcatgaactttcgcaatcacttgaagctaaagtttcgcatttaactgctgctggatacgaccgtgaagatgctagtaatctacaaaacgcaaattccgaagggttcaaaagtagaagacaacggtatttgggaggtcgaacagcacaatacattgcaaaaatcgatgccgatcttttcaatgtaccccaatatttgattaatcattgtgaaattgacataacgatacaaccccatgacgacaactttttgttaattgacaccttagacccccctggtcaaccatatagccttgagcttgttggattgaaactctactgtaaaaaagtcagtcttatggatggtttggctcttgagttggcgaaaaaattggaaatgaaaccagcacggtatgctgtacgaaagacaatgatgaaagcattgttcataagcccaggacgctatgaatttaatgcaaacttgttcatggaccaagttccacgccgcgtaacaatgggacttgtcgcaaattcagattatgtggggaacatcaaaaggagcccattcaactttcagcactttaatgtacgggagttaagtgttgtggccaatggtcgctcctatccccaggcaccgtatgacattgactatgaaaattggaaatttgttcgtccctacaatgacacgcaggaggcgcttggttttgccaactctacatatggaaatggaattgattacttttcttttttgcacactcactgtatttatgtgtttaatatgacaaacagcggcgacgatcatggcggtttatttgatctaatcaaaaaagtctgtacagcagtgaacattaaattcaaaaaaccagtacccgatggtggaataacacttattgtgatgggtgaagcggactctatttactttttggataaaaaccgaacgattgcaaccgatacaaccatttgataaaaatgtaccaaattttacttgcttccatattttttcaaccaattgtttcattgattgttgaagaagga

SEQ ID NO: 46923 - DNA, 3010 bp, Heterodera glycines
  Genomic contig location: Contig_ID=SeqID_11085; Location=33..3042; Strand=+
  SCN-specific regions: Sequence locations=1-192,216-685,707-1168,1191 -1378,1402-1547,1571-1591,1627-2199,2221-2546,2568-3010
  Gene Ontology: Mol. function=DNA topoisomerase activity; Cellular component=nucleus; Biological process=establishment and/or maintenance of chromatin architecture
atgcaagtgaagaatcacatgtgggtgttcgtcaattcgttgatcgaaaatccgtcgttcgactcgcaaaccaaagagactttgacactgcaagccaaaagtttcgggtcgaagtgcgatgtgagtgaaaaattcatgaaagaagctgcgaaatgtggagttgtggatttggtgctgaattgggtgactttcaaagaaaatcagcaaaaggacaagacgagcggacgaaagacggcgaaactgaaggtaaattattactgaatccctattattagactgacaattatgtaaatattttccaaatttagggcgttgcaaaattggaggatgccaacgaggctggcacgaaaaactcgaagcggtgcacattgattctcaccgagggagattcggccaaaactttggctgtcgcaggactcggagtgattggtcgagattattatggagtttttcctctccgtggtaaattgctcaatgttcgggaagcgagtcataagcaggttcgaaaatgcatctctattttgctatatttttttcacaatagataatggaaaacgccgaaatttgcaatatgatcaaaatcatcggtctccaatacaaaaagaagtatgactccgagcaggacatcgaatcccttcgttacgggaaaataatgatcatggctgatcaggtgaaagaaattgctgaagtggaaacaaaacaaatgggtcatcatttaggaccaagacgggtcgcacatcaaaggattggtcatcaacttcatccattccaattggccttcacttatcaaacggaatttcgtggaagaattcatcacaccaattgtaaaggcgacaaagggcaaagaggagaaatgcttttattccatcccggaatacattgagtggaggaaaggcacggagaattggaagagttggaagataaaatactacaagggtttgtattcttttgggtttctcaaatatatcattttgctacccttagggttgggtacatccacctctaaggaagccaaggaatacttctcgaatatgttgcgacatcgaattccttttcgctataaggatgacacggatgatggcgccattgaattggctttttcgaaaaagaaaatcgaagagcgcaaagtgtggttgacaagttggatggaagtgcgtttttgatcattttgggtgaaataaaaactgaatttgtcaggagagaaagcagcgtcgtgaacaaggagaacatgacatttacttgtacaataaggacactcgaagtgtcactttcgcggagttcataaacaaggaattggtgttgttttccaatacggacaatgaacgttcaattcccagtttggtcgatggtctaaaacctggccaacgcaaagtgcgtgaaattatttttatccattttttgcaatccaaatgttctctgtttaggtccttttcacctgcttcaaacgtgcggacaaaaaagaagtgaaagtcgctcaattggccggtgctgtcggtgaaatgtccgcttaccatcacggagagcaatcgctaatgagcacaattgtgaacttggcacaaaactttgtcgggtctaacaacataaatcttttgctgcccattggtcagtttggcacgcgacttcagggaggcaaagactcagcttcgccacgttacattttcacgcaactcaagtacttttgaagcttttctgatactaatttaaaatattctaatgtttaagccccgtgaccaaagcgctttttccttcggtcgatgaaaacgttctccgttttctctacgaggagaaccaacgcattgagccagaatggtattgccctgtaattccaactgttcttgtgaatggggctgaaggaatcgggactggatggtcgacgaatgttccgaattacaacccacgggttttggtggccaacatgcgtcgattaattcactctgaacagcttgaaccaatggttgaatatatgtaacaatattataattgcatatgttttccagattccgtggtacaaggggtttaagggtcgcattactcgaatggacgaaactcggtttgagacccgtggtctgataaatatcattgacaatgggagtaacgacttggtggaaattacggaactgcccatcaaaacatggactcagtcttacaaggaacgagttattgagccgatgtatgatggatccgacaagaaaccacaattattgcaagactacaaggagtatcacacggaccaaaatgtgcattttgtatgcaaattgaaacaggacgaacttcgcgaagccgaacagaagggaatttatgatgtgttcagcctgaagtcatcagttaataccagcaacatggtgagtttcttggaattaaaacaatgaatgtttaactcaaaggtcctttttgacgctgccggatgtctaaggaagttcgactcgcccgagcagatttgcctggaattcttcgagtgccgcagggaattgtacaagaagcgcaaacgctacctcgaaggaatgctgcaagcgcaaagcgaccaactcagtgaaaaggcacgcttcatagtgatgaagatcaaaaacgagatacacatcgaaaacaaacggaaatcggctatcgtagagcagctgcagaagcacaagttcagaccggatccggtgaaacggtggaaggacgaacagaagcggaaagagttggagctgtgcggagaggcaaatgtgtcagacgacgaagaggacgtaagaaaacttaattagtaaattcattaaaaccctaactgaacgactggacacaacaggaagacgaacatgcggaccaagcagttgatgaggccttggagaagcgctgctctgattatgactaccttgttgggatggccatctggaaactctccatggaagacaaagacaaacttttggcagaaagtgaatcaaagaagaaggaacttgaagtgttgaagaagaaggaatggtcggatttgtatgaggaggatctcgaagcttttaccaaagcattggatacacag

SEQ ID NO: 46924 - DNA, 1804 bp, Heterodera glycines
  Genomic contig location: Contig_ID=SeqID_1553; Location=1..1804; Strand=-
  SCN-specific regions: Sequence locations=1-612,640-835,875-1178,1201 -1804
  Gene Ontology: Mol. function=metabotropic glutamate, GABA-B-like receptor activity; Cellular component=integral to plasma membrane; Biological process=embryogenesis and morphogenesis
tttttcacgcgacttttgccgcccatcgctttctccgccatttattccgcgctgtttacaaaacccaatcgaattgcgcgcattttggcgggcagcaaaaagcgcattttgaccaaaaagccgcgcttcctcagcactttcagtcaggtggagcaacgatggggggggggggcaaagagatcgacgaacactccgatcaccgggggttttaaatacttgtgctgtaccattttcgacaaaattaccaaatcttttcgttcaaccttccggtttgacattccaaaaattgcgtcgacacactgttcaacccaagtatttcggtatagttagaatggtgatccttttagctgtttataaaaaggataaaagatatattagatggggtgcgtatttttttctttttctcttgttgtttgaatctccaattttatatgctattttttgtcgaggaaaattaataactgtttaattatgcaaaattaaaatatacaggtagtaatcacgtggtccttggtgggtgttcagtgcgcaattgttgctgtcagtgtgatggaggagatgcctcaggcggggttcgaccccaatttgatgccggtaattatcccattaaactttaatttaataaatttttaaattaatgcttcatttttcattagcgtcgcatgtttctgatctgttccatttccacgcgtgcatttctcgcccctttcgtgtggaatttcattctgattctcttctgcactttgtacgccttcaaaacgcgcaatttgccggagaatttcaacgaggccaaattcatcggattcacaatgcaagtttatttttttgttgacattcatttgcttatttcttaaatctttgatttaattgccattttgccaatttaaggtactgtaccttggttacttggggcgcgttcgttgtactgtatgtgaacgccgtaaacaaggtgagaagcaagaatgggcacagacaaaattcctatcgtactgtatcccactattttcaaacccgcctgttcaattttgacggcctcactcaattcactgatctatgctttgtataataaatgaaatgctaattcacaattaattagttatcgacctcattactcacccaattagttccccctccatcttcgtcactttttccctctccaaaggcattgaccgccagtttcactttttctctgtccgcttcaattgcgctttgtctgctgttcttccccaaagtcttcatcattttgcttcggcccgagaagaatgtgcgctcctcctacaccaccaccaaattgatccgttgccatttcggcaattcgcaggcgctcaacgacagcaaacagttctcatcatcgaaggcgcgcaacagcacacaatcgctgtcacttgggtcagtggacaaaacaatgggaaaattggggaaaacttaaaatttaattattgaaaaacttaaaggcgttgaaaatttgttacacagaaacccttcagttttacgcttagttgcccaacgcggaccgcctcgttgcacgtggccaaccacaacagcgtggccggcacgccgaccagcgggctttgcccgcgcagggacgcctttgcgcagactgaattgtccacaattgtccgcagtaatcatcatcaacaggcgcggcaacgtcaccacggcaccggaggatttgcacgcttcacgcgcaccttttccgtgatgggcggcacccacggcgggtacggacggacaacgccgcagcggtgcaacgggcaggtgaccgattgtccgagtcgagagggggagggagcggatccagtct

SEQ ID NO: 46925 - DNA, 1700 bp, Heterodera glycines
  Genomic contig location: Contig_ID=SeqID_11096; Location=533..2232; Strand=+
  SCN-specific regions: Sequence locations=1-8,30-168,206-279,301 -589,624-848,924-1142,1164-1301,1323-1479,1516-1519,1612-1700
aagacaccgacgaaggacaaaaacagcagtattgtgtaacggaaattgaacacgacccaaaaattttgcttgaacgtagtcaggatgccacagattgggcactgtccaatgggctgatcaaattagtgccggcaatgtgccaaaattgcagaataaaaatgcaaaatgttaattaataaagaaattaaaataaaactttaaattacattttcagcaaagcttcgtcgctgaatttattccaatttctttgtatccatcgccatttcccggcaaattatttcgacaagccatggaagtgcacaaagtaatcactttaagggtgaacagtagattgtgcgggaccgggacctggtactgaaaaaacgtacaactgagtacctaagtccaggttttgaccgggaccgggaaaagtcccgattttttcgcggttttcccagccaaaaagtcccgggttttcaacccgaaaagtcccggtcacggtttttctcaaaattcccggtcccgtacaactctagtaaaaagcttaaattaattaaattatttcgtcatattcgcgatattttttttccgaataaaaattgaagcaaactttaattttcaaaattaaatttaaataaaaatttcttcaattctccgattgatttgccattgaatttcacaggcaatgcttttgctgtattttcgcgcctcccaagattttgcttttttgaaagaaacgcatcgccaattagtggaaagtaatgaagacaacaaaataaagaaaatgatctcactgcttgacggtctttatgaggaaggcatcaaacaaccggtggcaatgttttgccaaagatcggtaggaaaatgccaaaaattaaatgataattcaacattaatcaaaattatttttaattatttttacctaaaattaattatatttttaagtgaataatgttaaatagagataacatttataggcactaaaaaccgccaaaataggtaggctttaggctctaaaaaaccccaaaaataggcactaaaaaatggaagataggcactaaaaatcctcaaatttagggggtgtaaaatgacaaaatgtattcgaaaaaagtaaaaaaaaattaggccaatattgagataaataatttttaaatcacaaattcttgtcaagaaaataaataaataaaatttggagatgaatttttgaaaaaattttttatttcttaggggtgtatttttgaaaattttcgggtcgattcttagagatgtattttttgaaaaaaaattaggtcgatgcttaggggtgtatttttcgtctttattgcatttttattaacaaattttggactcaggaaaaaatagccttttgcctaaaaatgttatccctaattttaaataactaattttacatttatcaaaaggattacatggcgagtcaaaacgatgatggagagtatttgctaaagcaggtgattacatattaaaaacaacaattaatggataatttctttaaaagaaatttttttaaaaattattcactaagataaaaaactaacaaaataaaaaataaagaaatttgaattaaaacaactaaaaaatttaaattaaaaaaaaacgaaaactgaaaataaattttaaaaaaactcataacgtttcagcatcttggtcccattctgtccccgggtaacctcgatcgagatcaacctaggctttttggttga

SEQ ID NO: 46926 - DNA, 681 bp, Heterodera glycines
  Genomic contig location: Contig_ID=SeqID_11097; Location=1..681; Strand=-
  SCN-specific regions: Sequence locations=1-178,201-486,511-681
ggttgtttcaattattgttaattaaaaaaatcaaaagaaagcgccaaaatgaaagacgtgctcattctgcacaacattaatcaggtagatccaagagatttgtattgaatggtttaagtgtttggaggtgcggggcgggggtgaaaggacagacaattgcagtaatatttgccactgattgtttctttgatttcacacagattgttcaagtggtggacgatgatcggactttttgtttattgggtgatcaaatggggaaaatcaaagtgatgctaattccaaaattctcacataaaaatttcttaattcaaaagataatggaatcagatggccacgaattggccattctttgcatcgaaggacgaattgagcaaattggcatttttgaagaggtcgaaaataaagtgctgtaaaattcataaactcaggcgcagatttcttcccgattcaactcgaaagaattgaccgatgtgacgagggtggactgtgggggagggagtgttctgccgggcatggcggacgcccattcccacccggtgggaacaagccatttcaaagggatttgatcacaaaacaacttaacaaaaaaaaaggtgttctctggcgatcgggtgcatgaatttgcgatgaaactcgctggtgaaacttatatggaagtaccgatggaagcaaagaaaagaa

SEQ ID NO: 46927 - DNA, 563 bp, Heterodera glycines
  Genomic contig location: Contig_ID=SeqID_11103; Location=131..693; Strand=-
  SCN-specific regions: Sequence locations=1-563
atgttcgacaagaacaatcacgggtacatcatggccacgcaaattggccaaataatgcgggcaatggaccaggactttgaggagaagaagctgcgcaaactgatcagaaagtttgacgcggacgggtcgggcaaattggaatttgaggaattctgcgcattggtaaaaaagggggggggcgatatggtaccggggggaaacgtttgatgaaccaacgacaggtgtatacggtagcaaattcggtggacaaagagacgttgcgcagagagctgagggaggcatttcgaatcttcgacagggaggtgggcagaagcagggggtttatccgatggaaggccaactttttatttgaacactcaaaaaacattcattccccggagcaataaatcgtcgggtcattaattaggctaattaacccagggcaatggctatttgtccaccgacactttgaagaatttgctgcgagaaattgagccatctctgagtgacaaagagctccaatcggcggtggaggacattgacgaggacggatcgggcaaaatcgaattcgaaggtggcgaaat

SEQ ID NO: 46928 - DNA, 1059 bp, Heterodera glycines
  Genomic contig location: Contig_ID=SeqID_1556; Location=1769..2827; Strand=+
  SCN-specific regions: Sequence locations=1-551,573-714,771-1059
  Gene Ontology: Biological process=reproduction
atgtttaaaattttcgttttattcaacgcttttttgctgatcaaattcgcaataactgatgaggaacgagaaattcctcccggtggagaggttgaacaggatgtaaatagcgagatgattaaggtaaaggaaacaagtaattaaaagcgaattctcgagagtctcagcttcaaatcgagaaaaaaatggctcaaaatcgcaaactttggttattttttagacaaaattatttcggttgaaccccccccccccccgtccccttctgtaatggtcttttgaaccctggtctcgaattcgtctctaatttcgggctcgcgcatcgctagtgattaattgaaataatttggcaaaattccttaattaattatttttgtttaattaagacgctcgcctctcgtgcgatggacaaaatgaatcaagagtccaacaatacgctcatgtttatccctgtgaaggtgctcagtgccacatcacaacccgtagctggagtaagatatgaactgcgcattttggtcggaaagtcaaaatgcttgaaaaaggtaagtgcaaaatggggagaaattggcacaaaaatgggcaagtcggcactgtaatttttttttttgggggggggggggggaaatttctggactgacagtttaaatcggatttgtatcgagattactttttgttttccaaaagtcgtattgctcattattgggagggataaatgtgaaatttaaaaaacaaattttataaaagtaaagttaaatacaattttgatttaaaatgtagtttttaaagcagccaaaggcgaagaagtgcataaaatatgaaaaagaaactgaccgggcagcacgaaaggcatggacataattaaataaattaatacttaattacatgctaattagactaattgtatattcttcaggtctataaagtggaggtgtaccaacgagcttgggaaaactttgaggagattacattcgaacaagaaaaaattgcaaatatgacaggatgtttgggataaagttgattatcaattaccaaattggacatgttaaagtgccaccatgttga

SEQ ID NO: 46929 - DNA, 2038 bp, Heterodera glycines
  Genomic contig location: Contig_ID=SeqID_1560; Location=1759..3796; Strand=+
  SCN-specific regions: Sequence locations=1-177,199-845,867-1242,1264 -1265,1294-1491,1513-1544,1566-2038
  Gene Ontology: Mol. function=protein binding; Cellular component=DNA -directed RNA polymerase II, core complex; Biological process =regulation of transcription, DNA-dependent
atgggaattgtgcaggacacattgaccgcagttcgaatgatgactaaacgcgacgtttttattgattacgctcgtctcatggatttgttgatgcatttgccaaattgggatggaaaaattccgcagccagcgataatcaaacccaagccactttggaccggaaaacaagtgtttacaaagataattccaggttttgtcaaatgaaacttttcctccattctttgttttgttctaactaaggcagtgtcaatgttatccgaacacattcgacccatccggacgacgaagacagcggaccatacaaatggatttcccctggcgacaccaaagtgctcattgagaacagcgaacttctctctgggataatttgttccaaaactgttggcagaggttccggaaaccttcttcacattgtcgcattagaattgggtcatcaaattgctgccgagttatatgccaacatacaaactgttataaacgcatggcttctcgccgagggacacaccattggaattggtttccaattttactttacaataattttgttcaactctcaggtgacacaattgctgatacttccacctacagagatatccaggagaccataagaaaggccaaacaggatgtcattgatgttatcgagaaagctcacaacgatgatctcgagccgactcccgggaacacacttcgacagactttcgaaaaccatgtcaaccgaattctcaatgatgctcgagatagaaccggagcttcggcacaaaaatctttgtcggatgcgaataattttaaggcgatggtcgttgcgggatcaaaaggatccaaaatcaacatttcccaggtcgctcaatacaaaagtgttttttattgttaatttaatcattcaaggtgattgcctgtgtcggtcagcaaaatgttgaaggaaaacgaattccatttggatttcggcacagaacccttcctcattttattaaagatgattacggacctggtaactctaaacagtactttcgttaggttttgccatttatttacagaatcgaaagggttcgtcgaaaactcttacctcgccggactaacaccggctgagttctttttccatgcaatgggaggtcgtgaaggactgatcgacacagctgtcaaaactgcggaaacgggctacatccaaagacgtttaatcaaggcaatggaaagcgtgatggtcaattacgatggcactgttcggaattcgtctgggtatacagttttcctttattttttaataaaggaaatgctacaaatagggctgttattcaattacgttacggcgaagatggactggatggcatgtgggtggaagaccaaaccgttccaacgcacaagccgaacaacaatttattcgaaaacgagttcaaattggacctcaccgacgaacgacaactgcggaaattatacacagaaaacattgtcaaagaaattactgtaagtaactacaaaaaatcatttcacttatatgactaaatccaagaattctgccgatgctcttcactcggttgagtcggaatggcgaaagttggaggaggacaggaacattttacgttcaatatttcctagaccaagcacgaaagtctatttgccttgcaatttgaacagattaatcaaaaatgcgcaaaaaatctttcatgtttccatgaataaaccagttgatttggtgagttccccaatatttttggcatgtccttttctttatcttccacagagtcctgtccgagtaatcgaaggggtcaccgaattaaccaaaaaactggtcatcgtgtctggagaggattctattagcattcaagcccaacataatgccacactgttgatgaacattttattgcgttcaacactttgtgcaaaacaaatggccaaataccataaattgaatcttgaggcatttgaatggcttcttggcgagatcgaaactcgctttgaccaggcgatttggtgctggtattccatatttatgttttatcgtttaaggctattgcacaaccaggcgaaatggttggcgcattag

SEQ ID NO: 46930 - DNA, 1216 bp, Heterodera glycines
  Genomic contig location: Contig_ID=SeqID_1561; Location=332..1547; Strand=+
  SCN-specific regions: Sequence locations=1-608,638-827,850-1216
ggacaaatatccgccgtcaaattccatccaatcaaacctgttttggtgacggccaatgtttctggcaacatttcgttgttcgaagtgagtttaaaacagggcacgtgggcaaaataaagtatacggtgcaataatcttggcccctcatttccactattctatttttaggtgtgtaaagacaatacaaatttgaatctgaagagcaaagactcctttctccaaagcgtgcatttcccacgttttcgtcttgaaaatttcgacttttttgatgatggcaattctattttggcaagttctgcgaatcaggtgatggatgaattaatgacgtgctctgaattttgctttttttatttagaatcatctttacacttatggtatggcagtcacccttccgcttttttttctttttcagatcttttaactggcaaagtggcattggtccgtcaaccgataggtccgttgttgaactcaccgttggaaacattttaattccgtgccttttttagtacttgactcccttcggatgcgaatggcccgtctctccggcgatggttcgcttatcggaatgttggccaattcttccgacattttcgttttcgacttcaaagtttttaaattaaatttctataatttaaaactcattagcattaaaatcgcagtcagcaaattttccaaaatgacttctataaaaccgaataagattagactgcacatttaaatttcagacgatggaacatttgcacacttttcgtggtggcgagaacgtcgtcgacttttgttttgctccatttaatagacagattttgtattccctggcaggtgccattttgttttatttctttactttttcgtcattcgttcagtcggtggtgctgtgaacactttcgacttggccaggtgcactggccaggacacattcttcgaccagggctgtgtccgtgccacgtgtctttcgtgcagtccttcgggccaattcatcgcctgcgggtgcgtccgcttggaaactcgggacatttttgtgttaaattaaaccccatttacttttagttctaacacgggaattgtcaatgtttacgacctgacaaaactctctccgagtttggccaagtcgaatgcaccaagaccagtacggatgttcgaccagctgaccactttggtgtcattcgttcgctttaacaacgactcgcaaatgttgggatttggtactgcagtgccg

SEQ ID NO: 46931 - DNA, 2020 bp, Heterodera glycines
  Genomic contig location: Contig_ID=SeqID_11160; Location=478..2497; Strand=-
  SCN-specific regions: Sequence locations=1-220,244-727,760-851,973 -1105,1127-1196,1226-2020
  Gene Ontology: Biological process=negative regulation of gluconeogenesis
gcccccttttcagaccctttacctgcacaatgccgaagtttggtgcgtcaaatttttcccctgcggcaattaccttgcctcgggggccaaaggcaatcaggtgctgatctggcgggtgatcaggtgggcgagtgcaacaatggccaatcaaccgaccgaaacattccagtcccacccaagtgcacatccaccagaacatccacattctgcaggaaattgttggcatttcttccctctcctggagtcaggacagtcgctacttggcggtgaccagcactgagcaggccaacggagtcggggtcggtctttcagtcccttcgtccgtttcacccccccccccccttaagtgtttcatttacttcgtgccaagtggtcgtctcgtcaaggcattcgttcccccgcttctcttccctttcaagactttttgtccttaggagtacgtccattacaccggcgatgcctttaccaccgtcgcctttttcaaagacggctcccacaaattggcatgtgccggcgaaaaaggccattttcatgtttatgtgagcgaatcaatttcaaaataaatttaatccgtaaagtggagggccactgactgaccaacggtactttcccaaattaggacatccatcggcccgaggacagtgccaaaatgttcgaaggttttcgaattcgttgtttatacgcgtgcatggacgggaaaactgttttggcagcggacactcacaacaggtgggaggaggggagaaggaaaagggtacaccccgaaatctcgccgggacaaaatctcgccgcagaaatttcaaaaaaaatttttcaaacggaaaattttcaaggaaaaaattcttagaaagttttttataagaaaatttcaaaaaaaaatatttattaagttttttttgaaatttttcgaaaaaacagtaattatcataaaaattaagaaaaaataatttctttaaattttttcaaaattatctaagaattttttccttgaaaattttctaagttagaaaaaaaaatttgagatttcgggcggcgaaatttcggcggcgagattttgtccagtccccgaataaaggggaagggacactgctaatttatattcaattttttaacaaattaaaattcactaaattttactcggcggcacctatcggtaccccgtggtctcacttaaccataatttttgaaattgacccaaaaataaaatattttgatatatttttttggcgaaaaacgactacaatccacttgagaaaaatatttttgatccgaaagcaaaatagctttgtggtaggctggacaacgtgaaagtaagttttaaccatatacgattttcagaataagggcctacgatttcgaaacgatgcacgagcaaacgctgattcaagaggccagccaaatcatcactttttggtgccattttccctcctccatttctaattttccatcgtttcttcagcgttgaccgaaaagagaagtattgtctggtgactaccaaaaccgagggcattcggttgtgggacttgcggacaaatgacctcgtccgctcttttttcggctcaaaacacaacgaatttgttggcttttcattaaattgggtttaacgggttcatattgcatcagccccccccccctttttgataatggaattgtttaaaaataaccaggaaaatgcctattagaaacctgttgatttgaaacattctcttcttcaggtgatcacttcttctttcggtggtcctgatgaattattcattgcctctggctccgaaggtgtttttgtgcccaattctttcccaattaattgcttcccatcagataacactgtggtcatttggaatacgcgtcggactcacccggtcaagcgactgatcggccacacaagtgggcgaaagcggaagaaatgacttattaaataaagaattaaggcacggtcaacgcggtcagttggaacccggtggacaattcaatggtggcctcgggcagcgatgacggaaccataaagtgggggggggggagg

SEQ ID NO: 46932 - DNA, 920 bp, Heterodera glycines
  misc_feature (818)..(818): n is a, c, g, or t
  misc_feature (841)..(841): n is a, c, g, or t
  Genomic contig location: Contig_ID=SeqID_11175; Location=887..1806; Strand=+
  SCN-specific regions: Sequence locations=1-194,219-847,886-920
  Gene Ontology: Mol. function=helicase activity; Cellular component =eukaryotic translation initiation factor 4 complex; Biological process=regulation of translational initiation
ccaaaaagataatgtgaagagtgaagttggagatgtgcccaatggcgggacgtcattcactgcacagcttagcgacgatttcactatccaagtaaattgggattgggctgtgtgttcactttcattgtggaaatacaaaaatttggagtttcttttcttcagcctttgaaattaaaaattcataagcacttgcctttttaaaattaattttatattttgagtcgaatacgaatgaggtggtcgattcattcgacaacatgcaactcaaggacacattgctgcgtggcatttactcattcggttttgagaaaccatccgcaattcaacaacgtgcaattgttccatgttgttcaggttttttagattcgctttttcattcattccgattcttcttgaatcttccttggctggcccttttttattttttatttttagggcgtgatgtgatcgcgcaagcccaatctggaaccggaaaaacggcaactttctctatttccgttcttcaacgtgtcgatgagaatgcaccggatgttcaggcacttgtgatggcaccaactcgagagttggcccaacaggcaatcccacccactcttcccattggcactctctggacttacttgtctccgtttgacagattcttcttgttatgcgtgcacttggcgagtatatgggggtcaagtttcacacttgcatcggcgggacgagtgtgcgcgacgaccagcgcaaattggaggggagcgttcaagtgatcgttggaacaccgggacgagtcaatgacatgatcctgcgcggagcactcagttagagctttttgtaanatataaatttgcattttctattnagagactgacaaaataaaaatgtttgtgcttgacgaggctgatgaatggtgtctcgcgggtcaaagaccaaatttatga

SEQ ID NO: 46933 - DNA, 3988 bp, Heterodera glycines
  Genomic contig location: Contig_ID=SeqID_11176; Location=177..4164; Strand=-
  SCN-specific regions: Sequence locations=1-121,152-356,380-523,554 -565,587-590,612-627,649-668,704-733,755-785,807-885,947-1060,1092 -1232,1317-1391,1413-1576,1614-1615,1638-1642,1664-2071,2280 -2621,2659-2936,3005-3163,...
  SCN-specific regions: Sequence locations=...3231-3289,3311-3471,3493 -3586,3608-3623,3672-3783,3805-3988
  Gene Ontology: Mol. function=actin cross-linking activity; Cellular component=actin cytoskeleton; Biological process=cell surface receptor linked signal transduction
atgcgactggtgctgtttccggagccccttcttgttgagcatgtggcacagctgaaattggaaacaaccggtgaagggcccgtggacagagtcaaagtccaaatatttggtaaattaagcgtttaatatttaattaattaatttattttttcatttcagaaccatccggcaacgaaatcgcggtcgtttcgcgcacttacgcagacggcacactgcgcgcagaatggcaaccggccagcgaaggccgtcaccgggtaagtaattaccagtgatataaattgtatggacttacatatatttttctgcgcatgtgttatgaagaaaactgttcaaaaaaggcatttctacgttaaaaattttttgatttgattaatttttagcgcatataaaagcatattttggggtttccgagaataaatgcataattgtgggcattttcgggtttttagggcatattttatgcgcatatttagcatttctaatgcatagggctgtcaaaaatatgtacaaaaccccaaatatgtaaataaaatttataaaatgattattttttgggaaaaaaaaattttcttaaagtatgaaataggcacaaaatgccataaaaattacttcaataagcttagaatcacttttagtattttataaattactttttggtatttttaaggatattaatacaaatgaaaatttttaaattatattaccatatatttccattttcctaattttttaatcagtttgaggagaacaaatcatcccccccccccccccatttgaatgttttcgatgaatggctgataattctgacattttttctattttttccgttccgatgtttcaaattaatattaatcacgcacaactttttgctaaaacaatatgaagaaattattctatttttatttttgatttattagattaattttttcaaaaataaaaaaaatatccaaattaacatatttacgttatttgatttttgttcttcgatttaaattctccatgctcaattttgtgaaaaattgcattcatttcttctcactgatattacacaaattattggtatttatttatttttatttatttaattttttcccccaattttaggtgctcatccgcgatggctcccgccacatttgcggttctccgctgcccgtctccgtgttggatttgtccgccgtccgattggttggtcttcggaatgccaatgccggcgttgagcagaatttttcatgtaaaattttgaaatataaatttaagtaatttattttgtttttttaatttatttttcctttttcccttttttctcccctctctccaaaatacaaaatattcttccattcgctgtcccattgttcacccccccccccataatattgaattgttgtgcccaatgtttgctgtcccctctttttcaagtggattggtccaattccggcggccaatgggcatccgtcggtgtgcaacacgaaagcggcgaattggttagcaatttgtaattatgaaaattattagcatttttaaacgttcatataatcaatccattaatggaatggatttaaaattgtacaataatgtcaaaaaattaaaatttatattcttttaattttataaaaggaccaaattttcatttcccttgtaataaatggtaataatttttaatatgctttccgttaatttttttcatttttgcccaatgaaaatagcctttgttaaatgaattggtttgacaattggtcatgctctcgtcaattaatttcttcataattttcttaatttcctttatacaacctagaagaaatcaaaataacattaataaaaaccatttttacttttaaatttattcattgaaaaagtttctatttttaaaatttttcttgaaattgaattttatttcaaatttcccttaatgacctccattttatttatcgcactttaattttgtaaattaactcaaataaattaattttccctccttttcaggtgaagtgcacaatgaaacggcagaaacgcggtgtgaacgccgtgtcattcactccgcgacttcccgggctacactttttggtgatttttgaaaaaataaaaaacaattatttaaaaaaaatatatatttcgaagaaatgaaaaagaacattaaaaaataaaagcacataataaaatttattttaaaaagtcaataaatatttttttaatacttatattatgattaaattgaatataaaattttttatttaattttagcaaaatatatttggaaataataaaacaatttattaattttagacaattttgattgatggcatgatgttaccaggtgaaacgatcaattaaaccctgaattactattaaatttttcatttctttggcagaatgtccctacgaatgcgttgttggtgctgagggggcgccgttggcacgcggcgacgctttggccaaagcacaacgcggcagaacggcacgctttgaagtgtcgccgggcacaacgagcgcgtcgcgcgatttggacgtcgtcgtgacgagtgcgatttaggaaaaataaaatttagaaaaccaaaacttcaaatctatagagattttcaatagatttacattttgggaaaatcatttaattctgatgttatttcaattaattaattaattactttactaattaactaactacacaacaatttctttgttgtttgctttgccattttgttcagctaattgctttttttttgtgttaatttaactttttttaattgcttttgcaattgtcttttgtcccttttaatttaattaattctataccaattaattttgtattaattaatgcctttcattatgcaattaattttgcccaatttttagacccccagggcagtcctttgccggtccgttgctacaaacagcaggacgacagttattgggttgagttcactccggaaatttgtggtaaatttattttatatttattatacaattttataatatttattttatcattttattttttcgaatttattttcaatattttttaggtgcccattccatcgaagtgatgttcggcgatcagcccgtgcccggctcaccgttccattgcgaagttgtggacccacgaagagtccaagtgcacggtgcggacagaccattcacaatacgaacgatggccaattttgttggcaagtttaaaatttttttttcaacaattataatagaaattttgcttaattcattttaattttttatttttagtcagtcgaaaaggtgctggcaccggcccattggcagttgaattgacagaccctcagaacgagcccatcaagctggacagggtcgacaattgctttaaaatcacctgattatttttgctgtttttttcaggtactgaattcatccggcgatgagtcgttcacttttgtgcccactcgtcttgggcctcacaaattggcactcaaattggccggctttgctgtgcatggtttgaaatgatcgtagcttaaatttaaacatataatttcaggctcacccttttcgctggtggtcgaagagcagaaggagccgtgtgtttacggagcggcacttggttaagacaatcgccataaaaatcaaaatcccatttttattccggcatttttaacggaatcattttaaaattaatttttttaaaagttaatttttattaataattttaagattatgccattgagcgtggtcagcaagcatcgatgattttcgacccgaacaatcattcgggtgggctaaaggtcagtccgtgacaatttatgctgaaagtgacaaatttccaaaattacattttaaaaagcaatgcaattaaagtaatctttttaaatttcactttgttttcaggtcgatgtccatgacccgtccggtgcgaaggtcaaacacaacacaaaccgaaggcccgacgacagcaccgaaatttcgttcagaccccacgaagttggcatttacacggtggacgtacaattcaacaacagaacagtgcagg

SEQ ID NO: 46934 - DNA, 407 bp, Heterodera glycines
  Genomic contig location: Contig_ID=SeqID_11188; Location=2654..3060; Strand=-
  SCN-specific regions: Sequence locations=1-26,48-188,225-407
atggaaaaaagtgtcacagaatctttggtgtttcacgacgaagtggaaattgaagactttgaatttgatgatgagtttcagctgtatcacttcccatgtccgtgtggcgacaggtgagagacggatcaaatggcaaacaaatgccccgaatgattcagattcgaaattacgcgagagcaactcgagtcaggagaagatgtggcgacgtgtccgagctgctcgctaatgttgcgcgttatctacgacatggaacagttcgtcaaattggagacactgcgcttggaaccgacaaacgctgttgaagcggtcaaatgaatgaatgaatggaagttaatttattaacaaaaaccatatagttattatttaattaagtcatttatcattgataaaaaaaacaccggaataaa

SEQ ID NO: 46935 - DNA, 1401 bp, Heterodera glycines
  Genomic contig location: Contig_ID=SeqID_11217; Location=442..1842; Strand=-
  SCN-specific regions: Sequence locations=1-35,57-214,235-364,386 -423,456-528,552-577,600-1080,1153-1288,1310-1376,1399-1401
  Gene Ontology: Mol. function=actin binding; Cellular component =troponin complex; Biological process=positive regulation of growth rate
atgtacaacgacctgttccagcaaatgctcaagttggaggaggagaagtacgacatcaacttcgtggtctcgcaaaaggacgcggaggtaaagcaaaagcatttacgaattggggacgaaagaagaaacgctaatttcaccgtttcagatcagcgaaataaccatttctgtgaatgatttgcgtggaaaattgtgagatttaaaaaaaataataatttatttatttatttatttttatacaatatttgatattaaagtgtgaaaccaacgctgaagaaagtgtccaaatatgacaacaaattccgcaaagcggcattaacggagggcgaaagtaccgcgccgaaggaggacttccgatcgaaactgaagacggtggagaagaagaacgtgatggaagagttggagagcaaggtgggacaaattgaggaggaaagggaaaaagggtgggggagaggcgacagcaaaaacggacagttcagcatcaaagctaaagtcggacttttcatcaatcaatgattgaagaatgaatgaattttgcaaaaaatgtgaggagtttggagaaatgcccgagtagcaaaacaagtttattttggtaacatcggccttattctgttttttttaatttggtggcgaaacgtccgattttgtctttggtggtcaaatgtccgggtggcaaaatgtcgtgtagccatagggtgacagtgaagaagagggatggcatttgcattttaccactatgatcatatactggcgggagtggactggcaactctgggatggattttgctgtgcatttattccccggttaacaatttgtctgtccgtcctttgtccgacgggcggacaaatgagagaattcggcctgtgtccagcaagagtcacgcggagacgtcgtttgtcccgcgtggacttttgctggacgccgtttggcatttcagcagaagaacaaggcggagaagccggaatggacgaagaaggtggaaaaggacgccacgggacgccgggcgagccaagcgagctcaaagggcggaggagccagcgaggcggagccaaccacgccaaagttggcgaaaccgacgccggaggaggcggaggaagaggaagagcgtaagtggagagggagaggagaagcaggggaaacgagtagggagggaccagggttaccgcggagaaagaaaaaaacgaatgggtttcgggtcgctgaaatccgggtttcgggtgtagcgtttcgggtaacgcgcggcacctctggtaggcataaccgaagaggagggcgcgggagaatcactggggaggggaagagggaagaagcataggagaatggggctggaaaccagcgaaaatccaaaaaaaaaactaatttttagctgaggttggcgacgaggaggaggacgaggagtga

SEQ ID NO: 46936 - DNA, 467 bp, Heterodera glycines
  Genomic contig location: Contig_ID=SeqID_11224; Location=20..486; Strand=+
  SCN-specific regions: Sequence locations=1-193,215-467
  Gene Ontology: Mol. function=pre-mRNA splicing factor activity; Cellular component=small nuclear ribonucleoprotein complex; Biological process=neurogenesis
atgcagaaccattgggaaatcattttgcatttgccattgttgtgcgaagacaaaaacgtcccatatgtattcgtgaaaagcaaggtgattgactattttgaagttctaaaataagttaaatatttaggctgcacttgggcgtgcatgcggtgtgactcggccggtgggtttgctttgctttaatttaccgaacaaaaataaatgtcaatccatttttatttatgtatagagcaattaagaaaaacaccaaaaagataaccttttattttattaaatacctatgtatctagggttttataagactcgctgcgaatcctaaactttgaagaactcccttgtaaacagggaatttacttgttcgcttattcctttaggtgatcgcaacttcgatcattcaaaatgaaggatctcagttgaagtctcagattcagaagattaaagaagatgtggaaaagttacttatttga

SEQ ID NO: 46937 - DNA, 1770 bp, Heterodera glycines
  Genomic contig location: Contig_ID=SeqID_11224; Location=719..2488; Strand=+
  SCN-specific regions: Sequence locations=1-582,604-933,958-1331,1354 -1532,1574-1770
  Gene Ontology: Mol. function=RNA binding; Cellular component=nucleus; Biological process=mRNA processing
atggctgacattaatgctattttggatggtactgacggtgatgaagcgctgaatttgaatgatttggatgaaaaagaggttcttggtgatgacgaggaggaccaacaccaaaatcaacacacaacgtatgtgaatgcgtccattgaccacttatttaatggcccgacggataaaacaaatgggatgccttttaaaaaagcactagatattatttacttatcaatgaaaaacactggcttctagttccattcagcagcatttgtatatactgtttagaaaagaagaagtggaagacctttacgacgaagccatggctccgtccggtgcactctctgaaaagcgcgagtcggctgaagttatttcgtcgttgccaagttcgattcagcacaaatcgtcgtttgccatgcctatgatgatcaaatctgagcccggcattgctggcgggtcgcaaagtggcaaacgctactgctgctacattggcaatatgacttggtggaccacagacgatcaactccaggtttaattaacatttgtttcggctttgttctgcttccattcgcactgtgttagttatttcactattcattttttaagaaactgattcaaaccctcggcgtcgacgatatgattgacgtgaaattctacgagaatcgcaacaacggacagagcaaaggttttgcgctggcagtgttcgccagtgaaccgtcggtgaaagcggtgatggagaaattgccaagcaaaaagctgcacgaacaatcgctggcggtgttgccgtacactaagcagtcgttggccaagttggaggaggccaccaaacgctacgaccaggtcccctcttgtttctgcaaaatgttatcctatggctcttctgcattctttgcatttctttgaactccgatcattgcttgtcgggacgtagccagtccaatcaatccttggcattttgtcaccccttacactttgcaaacaaaagaaacgtaaacaaaaaagggagacttgtgcccggcgtagtgcaataacctcttcttcctggctacgtcatttattgtcttatcctactcatttggaccaactttcgataacaatcctatgagttgcattttaatgtcatggaaaatggttggataaactcatttcgcttagccatagcctctaaaccatcaatacttactataatcagtcttaaaagatcgtctcataaaatttacgacattcaatttatttaacgctaactaagaaaggaaagcatttttatgagatgattgaaaatcctttctgacaatgagttaaatccacgagatttttattttcagttcagaatttacaaaagtttttcttccccaatattaatgtattacatttataaagcaaaaacaaattgtctaacttctatagtgcttataaaattgcaacttcctgtcacattttataaaaccatagaaaattaatgttttagatttgtcattttggttttccattccattttcgaaaaaattgtttattcatgagaaattgtatttaaatttcacacctgaatgaattttcaacaaaatttttgtgttttctcagtcatgatggataggaatctcataatttaaaataatgattgcattaaaattttaacattaatggaccaatcaaaaggtgttgggcttaaacacattcataagagcgggaattaattgatggacaacatttaatggaaaactgaaggaaaatccggtgaaagtattcgtcccgttttaagtccgttcacttctcaaaataaca

SEQ ID NO: 46938 - DNA, 1107 bp, Heterodera glycines
  Genomic contig location: Contig_ID=SeqID_1577; Location=4377..5483; Strand=-
  SCN-specific regions: Sequence locations=1-692,714-1107
atgtcaattaaaaagctggattctgacaccaataaatatgttaatttgaaagtgaatgagcaagcggcaacaattaatatgattggtgcgacttggataaagaatttaaaaatcactgtgcagggacgtgagatttatgactctaactcactttatgcttataaagcatatttggatgccgaactttcttattccaaaaacgtaaaggagtcagacctacaggcgagcgggtattatgtggacagtgagaatcaggacggcacggatattactcagcagggttttgaactgagaagaaaattgttttcacaaagtcaaactgcacaatttattacaaaattggatgcagatatttttaatcaggacaaatatatggtgaatggcgttgagattgatatacaacttacccctaatgacaatgagtttatgataatggcagcgtcagacgataaatatagaatagaaattaccgcttgtaagttatatgttaaaactcttgaagttgttgatggtcttgcattagacatacagaaaaaacttgaaaacaaagaagcaaaatatgcccatagaaaaactttgatcaaatccacatttataagcgagaatcgaactgaatacaatggaacgctatttacgggtcaattgcctaaacgggtcattctcggaatggtggagaacgctgcatacgtaggcaaccaaaagaaaagcccatttaattttaaaccatttgatattcgatccgtcacattgatggcaaacgggaaacaatggcccgctgcgccttttgagcttaattttaacaaaaatttatataccagggcattccacgaaatgaatgaggcgttaggtatggccagttcaacagatagtaacggaatttctcttgagaagtatagaaaggggtggacaatttttgcgtttaatatgactaatagcatggaggacaacgagggtattgatcttattacagaagggacgactaccgtgtgcattcaatttagatcacctgtcccatcgggtgggatcaccctaatagccatgagtgaaatggactctattttgatattggataaaaatcgaacagtaatgaccgatacaaccatttaa

SEQ ID NO: 46939 - DNA, 2680 bp, Heterodera glycines
  misc_feature (2044)..(2044): n is a, c, g, or t
  misc_feature (2068)..(2068): n is a, c, g, or t
  Genomic contig location: Contig_ID=SeqID_1577; Location=7604..10283; Strand=-
  SCN-specific regions: Sequence locations=1-238,260-544,566-974,1003 -1221,1243-1879,1901-2385,2407-2680
atgggaacggaagcatggattcaggcgtatcgtgagatacgtcttgtctgccaatttaactatgacgtccatagaaatcgttttgtcctgaacaccgatccgcggtacgttaaaaaggttgaaatctcgcctcaacttgcctacattctcggcttcaacaacacggagtttatgcagcccgaaatcgaggcacaattcatgccggacatgagcggtggagtgtcatccttccacgtttacacgccagacctcattgaaccaatgatgattggtgacgtcacggcccccgtgttgcgcattgtaaccatacgcggagaccccgaccaagtgattgaagaacaattttttgccatacaatatcacaaaattttattaaaggaagtttctgaaattctgattgaaatccgtacaaatagcggaagtttgatgccattccaatacggaacttgtacattaactttacattttagaaaaatgtcctatttttaaaaaaatgaacacgttggaaattgacaaaacattggcaagaaacaacgtgactcgccactactatattggttgttttgcggcagaccaaataccagccggagcaattgtcaaatttccacattgtatggtggtgaatcttgaccccagcacctcgcgtggctctcattgggtatgcatttattgcgcttctcctttgcgtttggagtattatgactcattagggatgtggccaccacccagtgttcttattgtgaatcatttgtcacgctacaaacaaattcaatatagctctatcccccttcagtctgccaactcaagtgcgtgtgggcgtcatgtcattttctttttgtactgtcgatgtgttggaatgacctttgaaaaaattgtcagatttttgcactttggaaagcagcaaccggatacgctcgtaaacaattttgtaaaaggcataattttcaaagaatataaataatgaaaagaacaccaaaatgaattttttaaaaatgcatgttgattttgatcctcttcaagtggattggtccgcgttctcgtcctcgtgtgttcaatttggtggatacaacatttacaggggattaccctatcagcgtggagcgggagttggcgcagtgttccgaagccttatgagatacttgctgccgattggaaagcaaattggctccgcaattggacgtcaaggaatgcaaagcggaaatcgagtactcaccaatgtgctggagggaaaagacctcaaagagtcgctcgttagtgagagtaaggcgggactaaagaatcttcttgaaaaagcagccaacaacataaacactcaaaagggccaaggttttgattttaaacgttataaaaaagactcggctcccaaaattggaaaaataaggcgaaaaatataaataaacttcaatcctcctttgggccaccaatggttgtaaagaccaaaaataaacgtctgcgtgttgactcattaggaacttactaaaaatgacttgcccacaaaaaatcagcgacagcagtcccctagcaattaacagtggcctaaacattttctcagttccaccgaccaatgtgtctgttgtgcgttctttctttcgtcaagtgcttccgctagcaacaatcacacaagaatcaccgtacctgtttcgtctgtacagtgacaatttgtggacagatttgtctcggatctatctttatctcgaactgtccattgaaaaaccgggagcaaacgataaatgggttgcgatagatgatgcagatactagtgtctctgccattcaagggattggtcaaacatttgtccagcaactaaaagttacggttggtaacacggaagtatacgatagcggaaatttatacccatttaaggcatatatcaccaatgagttaagttttccaataaatgccaagaaaaattttcttggttcaacagggtattatcacaccgtaaatcaagatgattcaacagacgatgggttcaaagagcgttgtaaaatttttaagggtggaaaaaatgcgcaattcctctcttgcctcgactttgatctgngaaaccaggagctttatctcttanataatttggatttgctgttcacaaagcctctacaaaacacttgaaaaacaacccgccacatacgcagtacgcaagaccgaaatcaagtcgtcattcatcagtgtcggtcgatacgaatttgagtataatgtcttcagcgcgaccattcctcgacgcgtgacaatcgcgttagttggaaattcagcatttcatggtgactacaaactgagtccattcatgtttgagccgtttgatttgcgtgagatttcggtacatgctggtggcgtagtttacccagctgttccttataaacttattttttcaaatgatcactttgtcagcgcctttgttgacatgtatgaggcactcggaatggctaactcggaacgttcatttgacatttcaatggcccagttcaaaaaagggtggaccttttttgtcattccattgacttccacgcttgacgacagctgtggatttgagctgttgagaagtggtacgacaaacgtacgagcaacattcaattcaccaattccgcatggtggtgtagagatgattgtcttgggtgaattcgaccaaatgattatggttgattataaccggcacattgtgaccgactcaaagcttgggtaa

SEQ ID NO: 46940 - DNA, 613 bp, Heterodera glycines
  Genomic contig location: Contig_ID=SeqID_11238; Location=1812..2424; Strand=+
  SCN-specific regions: Sequence locations=1-275,297-613
atggcgcaacttccaccagaggacgtcgcaacaatgcccacgcagaaggtcgtcttcaacgccccgttcgacaacaaggccacctactacatgcgggtgcgtttggcgtggtgcacgtggcatgcggaataaccccccccccccctttttcaggtgatcaaccctgggacgaagcgcatcggctacgccttcaagaccaccaaaccgaagcgcatcaacatgaacccgccgaacggagtgctcggcccaaaggagtccgtcaacgtggccgtctcctgcgacgccttcgaccccggcagcgaggacaccaagggcgaccgtgtgaccgtggagtggaccaacacgccggacccagccgccaccgcgttcaagctcgagtggttccagggagacgggatggtgcgccgcaagaacttgccgatcgagtacaacgtctgatggaaggatgcttcgtcacctcaacatggacatgataggatcccaccgtcccaaaattgtcattttgtcccccatcatgtaaattgttgtatctgtatgtaaatttctgtgatcatcacttcaaatgaatgtatatttaattgttgcctatgtaattgtattgttgttgtgctta

SEQ ID NO: 46941 - DNA, 1826 bp, Heterodera glycines
  Genomic contig location: Contig_ID=SeqID_11241; Location=1..1826; Strand=-
  SCN-specific regions: Sequence locations=1-94,116-1628,1650-1826
  Gene Ontology: Mol. function=guanyl-nucleotide exchange factor activity; Biological process=signal transduction
aacaacgtttttccccagtgccatgttcccaatcgtgccgaggatattgaacatgtgctaagggagagagtggccttgttgcctggcgttaggtaaacataatttaaaatgcaaatttagaatttttcccaaaaaaaaacgctttttcagggatcgtgaaggtcgtccaattatttttgtgcccgcccgagaggtcaattctcaccccgatcacttacgcaaccttctcacgtatctctacgaagttacacagtgagtcggcttcatcatttaattgttttacaatttaattggtttatttaattacttgggtctttttagagacgatgcaaagactcgtggctttacttttgtcattgacatgcgtcgagggaccacttgggaaattgtcaaaccgatattaaaaatattacaggtgaatatcctgactttatttctacatattatatattcctgagtttcaggaatatttccccgctcttattaattgtgtgtacatagtgaagccggacaaaattctcgaaaaatataaaatttcaacgacaaaatacaaattcgacgtccaaatgatctctctggaagcaatgccaaaatacattgacttttgccaaattatccgcgagtttggcggctctttgccttatgatcacgacgaatggatcgaacttcgcaaggcgcttataattctgactattttattactatttaaaataaactacccttcaggacattgaaaggattttgcaaagaatgtgcgaaattctcaaaaatttggaccgaatttccaccgaaatggacaacgcggaaatgcccatcgatgttcaatcctcccaaacatcaattgcaaagcaccaagatttgtacccaattatcactgctgttccgatggatgagttcacttcggaaatccaatcgctgagggacagagtgataatttccggccataaacaaagtgtgggcagtcggaatggctccgtcctttccagtccaaaccccgaccttttgtcagtgtttccacaaatagaaatgctcaagcaaaatttagacaagcaaaggtgccaaaagcggaattgtcctccaataaagtagtttttcagaggcattgtttatgcgaaatgggactatcggaagaaggacctcgaccggtactttcagttgaaactgtttgagaaagatgcggaggaggcgagccaattcgcttttaattaactcgtcattttttgactttcgttcagttgtcaaaatggatttgctcccatttgaatgttctgagtcaccgatttgtgctcattggcgaaagtgaaacggaaacgaaccgactgctgaaggagcacaaagactttgcggactcagtgaatgtgagcagcccaaatgatttgaatgttttccatttctttgcagacatcccaagtcagttacgagcaagtgatcaccgtcagtcttcgccttctccaacaattccaatttatcggtgtcaatcgaattgagagcatttcgcaacaattgcaggccgattgggaccaatttgtgggaatgattgtgcaacgaaccgctcttttgcaaattacgctaaatatgcacagaaaatgcgacacggtccgttttgaattcgctaattttgcatttgaattattttcttatcattttatcgattcttgtaagtattttaggagttttgaagttaattacaatttttttggcttactttctattttattcgggtcagcttcttaaaaatgccaaacgttggctgcccaacgctggggtcgacccgaactccatccgctctgaggacgaattgcctaatgctatgcacaggcataacg

SEQ ID NO: 46942 - DNA, 751 bp, Heterodera glycines
  Genomic contig location: Contig_ID=SeqID_11241; Location=2111..2861; Strand=+
  SCN-specific regions: Sequence locations=1-507,529-532,574-692,715-751
  Gene Ontology: Biological process=cell cycle
tcattttattatgcttacgaattggtcttaatttaatcctttgaattagcatttctctgcataatttattccaatgctaataaaagtgaaaacgctgaccggaaaagaaattgagttggacattgagccgacagacaaagttgatcggatcaaagaaaaggtgctaatttgaaattaaaattcaaaataattctttatttgaccatttcttaggtggaagaaaaggagggcattccgccgccgcagcaacggctgatttttgcgggcaaacaaatgttggacgagaagacggcgcaagactacaaagttagtattcgtaattaattacctattgtgaaaaacaaaaggcgatcttttaaatttggccaaaaatgtactctaccttttgttcggattcgagttaagcattgattcaaaatggaaatcaactgattcgagatcagctaccccgtaacccagagaacgaattttcaagattttgacaataacaaaaatttggaaacccacgggtctcccctttggttttggtactttcctgttttatttatttatttattcagaagaaataaaaatatccaacgaaggggtgaccacttacacgttagattttagtaaagtaatataaagtccaaggagctcttttacagactttcttcggaaaacaatttctttttttgtatgtcctcccttttagatccagggtggctccgtgcttcatcttgttcttgcccttcgcggcggatgaatgttc

SEQ ID NO: 46943 - DNA, 3671 bp, Heterodera glycines; identical to SEQ ID NO: 11253
  misc_feature (3638)..(3638): n is a, c, g, or t
  Genomic contig location: Contig_ID=SeqID_11253; Location=1..3671; Strand=+
  SCN-specific regions: Sequence locations=1-119,141-154,178-251,286 -319,341-525,547-747,769-1188,1211-1929,1951-2013,2037-2430,2452 -2757,2779-2786,2809-3055,3077-3355,3379-3551,3573-3671

SEQ ID NO: 46944 - DNA, 1206 bp, Heterodera glycines
  misc_feature (1204)..(1204): n is a, c, g, or t
  Genomic contig location: Contig_ID=SeqID_11276; Location=22..1227; Strand=-
  SCN-specific regions: Sequence locations=1-10,32-78,100-103,134 -720,755-1206
  Gene Ontology: Mol. function=1-phosphatidylinositol 4-kinase activity; Cellular component=plasma membrane; Biological process =actin filament organization
tcacatgcgcgataagcaaaaggcgaaggctgctgtgatcactgagcagcatcgaattccgacaaaagtgacagcgacggaggaggagacggaaaacggtgatagaaaatagcaaatgcataactttacatttgtttttcagtgtcttgtaaaggttcggacaatgacgaaacgactgcacttataaaggagccacaaacctcaaaggtacagacattccaagaccgttttgtttattcgatttggctttgcttctgtaaagtaaattaatcatttaagaaaaccgaacgcattcctcttcttggcaattctgtcaatgctcattcggaccgcgaaagttcgacttccgttcgtgtgacaacggattttcagccatcagacgaagaaatgcatcgcatttgtattatacattattttttaaagagattggcgttaacttcccatcatagtcaacgaacagtacggaagcacaagcggagaagacttcgccgcctgtctcgtcgaggcaatccgagccatcaatcgagggactaaccccgaacgaattcctcagggctcttcgggctcatattttgtcaaaaacttacaaggggtaatgcttcaacaaagaaacattcagtgataaatatttttgtttttcaggaagtgatcggtgtgttcaagccaaaaaatgaggagccttacgggtcattaaatccaaaatgggttaaatgggcgcacaaattgctctgtccctgctgttttggtcgttcgtgccttgtcccgaatcaggcaaacaatttacaacagtcttttgaccttttagcaattcagggttatctctcagaggcgggtgcttcgctggtggaccaaaaattgggcctggacattgtgccaaggactgcgattgtggcattggcagcacccaccttttactatggacgaattgataggacggtgacgaacacaaaagaacaaattgccaggaattatcccgacttgggccggcatttcaagcgcatcggattgccaccaaaggtggggatgactttcagtttatcatcttccattactcaagcagaaattcatttagcggggcagtttccagctgtttgtccgtggcttcaaagatgccaaatattggctcgaccaatgggaacagtctccggaaaagacattgccaaagccaagccgaagagaattgcaactcccaatttgagaaaantg

SEQ ID NO: 46945 - DNA, 1650 bp, Heterodera glycines
  Genomic contig location: Contig_ID=SeqID_11285; Location=10..1659; Strand=+
  SCN-specific regions: Sequence locations=1-59,94-119,141-249,315 -571,619-718,746-771,806-910,933-937,960-1005,1068-1210,1240 -1371,1403-1471,1498-1538,1581-1650
  Gene Ontology: Biological process=growth
atggtccaccgcagcagctccagcggactcagtgtggcggtgatgggcaaagtgaggcgaataatttaaaattaatataaaaattcttttttagcaagccaacaaatacaatacacaggagggcactctgttgttggaatggatcaaaaaggtcaccggagcgaattgtatcaacacagacggaagtgctgacaattttgtggcacaattgaaggacggcatattgttgtgcaagtaatgataaaacagattataaatatttaagaattacaacttttatttaaataaaactttatttaaatataaataattaagagagtgaaaaattcagttgaaaaattaattgctcaaattgaggctggcaatgaagctggagcccaactcaatcaaaggggtgacggacaaggccagctccacgttccagcagatgagcaacttggagctgttcatccacttttgccgcaagcagggagtcatcacgcaggagttgttccgcgccgtggacctggtcgaggcgcgggacctctactcggtgtgcatgacgctcaactcgttgggccgaattgtgagcataaattaataattaaaatattattcttttatatgtaaaaatttaaagacgggaaatttttgaattttaattgctagatttcttggcattttttaattatggggaggggattcaaataaccaatgattgcttgtagtgttaagcgtgaattattttatttatttatttatttttgtctcatcatttccaaacagtctaagtataatttatcataaattatttaataaattaatagatggaaaagcacggcaaaacaggtcctcggcgtgtttctgtacatgaaattgtcaatattccgctggccgatcagctgcgtatccatgacataaaaacgttttgatcattttcactgctgattttcttttattaaattaactaaataaaaacataagctcttcgatttttgtatgaaaatagacaaatttagcttttacaattttaaaatgatataaaattattaaaatgatttcgttataaataaattcattttttaattgattgaaaattatccattttcctttttattactgaatttaaatttttggtaaaaaattttgtttccatttgtaatagattttaaagaaaaaaaattgccaatttgaaagatttcaagaaaatttttggagagctgactatcaatttgtaatattctgtatttttcttctacctgtatttttctgtacatttatactgggagtatggtacaggccattcttggaatacaggtacaggtacaagataaactcgaaaaacctcgatttcctggacaaagttttcgaatttattatttaagtgaccgatttttcttcaaaaaatttaaatagaattaaaacacattattattgtaaaattgttatttttagatatcataagcaattaattcaaacgttttttttttgctttttaaaacaaatttcaaaaaatccaggcatggatccaggtctcgaagagccttatttttcctgtatgtgaatttttctgtacttttagacagaaagtacaggaacaggcctttcttggaatacagatacagctacaggttttacctaaatgtcgatctctagtttggaccccaaata

SEQ ID NO: 46946 - DNA, 616 bp, Heterodera glycines
  misc_feature (559)..(559): n is a, c, g, or t
  misc_feature (566)..(566): n is a, c, g, or t
  Genomic contig location: Contig_ID=SeqID_11309; Location=14..629; Strand=-
  SCN-specific regions: Sequence locations=1-462,490-616
  Gene Ontology: Mol. function=SAR small monomeric GTPase activity; Cellular component=COPII vesicle coat; Biological process=ER to Golgi transport
atgtcgtggatcctcgactggttttctggcgtgctcaactatttgggactaaccaaaaaaagcggcaaattggtatgcaatattaaagtttaaattctacttgtatttctaatagaatgaggatcattaaaacattaaaatggacaatttataggtgtttctcggccttgacaatgcgggaaagacgacgcttctccacatgctcaaagacgaccgtattgctcagcatgtacccactcttcacccaacgtccgaggaactttcactcggtggtattcgcttcaccactttcgatttgggtggtcatgtgcaagcgcgtcgtgtatggaagagttactttcccgcattggacgccatcgtttttttggtggacgctgccgatttggaacgcattcaggaggcacgagaagaactgtggagccttttacaagacgaacaagtccgaacgaatgcattaggctattttatgggttttttaaggttgccaatgctccactgctcatcctgggtaacaaaattgacaaaccgaatgcactcggagaagatcagctcaaatacntacttgngagtccaacaatattgcactggttggccaattagaaaatcattccaatag

SEQ ID NO: 46947 - DNA, 304 bp, Heterodera glycines
  Genomic contig location: Contig_ID=SeqID_11309; Location=2254..2557; Strand=+
  SCN-specific regions: Sequence locations=1-304
  Gene Ontology: Mol. function=structural constituent of ribosome; Cellular component=cytosolic small ribosomal subunit (sensu Eukarya); Biological process=positive regulation of growth rate
atggctgacgcagctgctcaagaacaaaaaaagaaacgcacttttcgtaaatttgtctatcgcggagttgacttagaacagcttctggaaatgaacgagtgagtctgagtcgtgcttccttttcaaggattaatgaccttttaggaagcaattcaaccaaatgattcccgcccgtcaacgtcggaagatgaaccgcggattgaaccgaaagcacaaatctttgctcgttcgtctgcgtaaggcaaaactcaattgtcccgagctgatgaaaccggagtgcgtgagactcatttgcgtgatatga

SEQ ID NO: 46948 - DNA, 567 bp, Heterodera glycines
  Genomic contig location: Contig_ID=SeqID_11319; Location=1359..1925; Strand=-
  SCN-specific regions: Sequence locations=1-567
atgaaaccagcacggtatgctgtacgaaagacaatgatgaaagcactgttcataagccctggacgctatgaatttaatgcaaatttattcatggaccaagttccacgccttgtaacaatgggacttgtcgcaaattcagattatgtggggaacaccaaaaggagcccattcaactttcagcactttaatgtacgggagttgagtgttgtggccaatggtcgctcttatccccaggccccgtatgacattgactatgaaaattggaaatttgttcgtccctacaatgacacgcaggaggcgcttggttttgccaactctacatatggaaatggaattgattacttttcatttttgcacactcactgtatttatgtgtttaatatgacaaacagcggagacgatcatggcggtttattcgatctgatcaaaaaggaatgtacagctgtaaacataaaattcaaaaaaccagtacccgatggtggaattacacttattgtgatgggtgaaacggactctatttactttttggataaaaacagaacgattgcaactgatacaaccatttga

SEQ ID NO: 46949 - DNA, 2820 bp, Heterodera glycines
  misc_feature (1750)..(1750): n is a, c, g, or t
  Genomic contig location: Contig_ID=SeqID_1596; Location=589..3408; Strand=+
  SCN-specific regions: Sequence locations=1-246,315-860,882-964,986 -1148,1172-1715,1757-1920,1942-2356,2378-2569,2591-2820
catcacactgtcaacgagctcagtgatctcattcgccaatggtgagtaaaatcatctttcaaattttgaacataatttttcggctttggtatactgtatctttttgggatacggtacttttggggtttatgtaaatgtgttatttttttaattgaaattcctttcagtgagctcaccacaattgctgcaacttcaacactgttaaagtcactcgccgatttgtgggaggctggtagatgatatgccaattaatttttattaaaatttcataattgagaaaataaaaattccaataaaatttaaattcaaattttggcaaaatgtacaagaattaattaacttgatatcggccgaaagcctattcatatatttttggaagccatctttcagctcttgctaacgaataagggcacaagcagaactcataaagttattattggtaccactaatagccattaatagctctaattagcgggccagttcatggattttttttatcataatgcatcctttttttattgcagtgccgggtcattttcaccgtttggcggatgttagccgctccaacgccccgggcgctgatttcttgtcttttcttcaatctttgccttctgccgattccttctcttcgtcctgctggtcagtcattctgatcactgattgatcagtccattctccgacccaaaaaaatttaaatcgactcattccaatatataagtaggctcaagctaaatgctgatcacaattaacccattttttgaccaatgttatttttatatcaaacgggttgctgatcacttaaattcgatcaaatacattaagcctaaagctcgatagagaatgtctatcgattctaccgtatatgtatcataatggaaaaaccacccttttcgatcgttagtgccacaatgtattatcgattgactcaaatgaaatgagcaatagcagatcactctgtctgttgatctgtacacccatttccttaactgatcaaaccagcattttgctcttaatcctctttttaaggcgtgaaagtgacgaggtgtcagccgccgcacccactgatcaccacgcccacccctactccaatcacaaccaattgcgcttgttgaacaacggcattggcacaacagcggctaaccaccacaatcataatcatcatcaccattatagccataataatcggcattattccgtcaacaacaataacagcaccgccacggcactaatgagcaacaacggcggcaacgcgtcgttgtcctcgagcagtgccgcctcctccaccgttgtgccaatgcggtccgccgccgcagcttcgtcgtccggcaccgtcacggacgctggcgctgtgccctcctcctctgtgccatcatcgtcggtgtgtcgtgtgcagcagcgccggaacgcgctcagctcgacggacgacgcgcctcctgccaagctgatgatgaccccgtcgcagcacaagcggaaaggcaaagcggcggaaatgagtgagttcagaggcgggagcggcgcaaggggcatgcgtggcacgcgcaaatttttgatcgatcgatcacttattatgccattataaatccgatcttgaatagaactgataagttgagagcaggtgataaaaaaatggcacaatttggaccagaatcaccaaaatttggcggcaaaaaaaatttctttttttcgaaacccaaaatggacaaactgggacactcttatataatttaaaaaaattaaatttttataaatntaaaatgaggacttaaaaccttttttttagctgctcgtctgttcgacatgcaatcatcctcgtcttcctcaacaccaatccaaccatcagacgcagcccggtgagtcatgttacaaatgataaagccatggagttcttttttcaaccaactaggagggaggcttaattgaagggggaggggtggttatttagaaggggagggcaatttaaaagaatacaggtaatttgccaaaaaatttttgtccttcttgtgccaaataatttggcaaaatgttcagatcccatcgacttgctcgtactcggcaagtgtcaaggtgttcacagtgcggacaattgttgatcttcgatgcagtcaagtgtcaatgctggtcagtctaatgacacttaatgatcaactaattagctatacataaatgaataaagcgtgaaactggccaaaaaatttggcgacagtgaggcattttttggtctcattgaccaaagcagatgttccaccattttttacatattttctataatattcgggatcattgactaggctaatcagagcgcttgatagtgttatttcatttctgatcagtcagtcacccattggttttggcgaatatatgatcaggaaattcaacacattgtccttatttcttgctgattagtttaattcagatcgttcagctcatttattgaaactaaaaaaaaacagacccactaaaacccggatcaatgacatgtacaaggattaggaatttttggaactccggcgagggggagggggaaatggcacatttttatatcccatgtcattaagacataaggaatttaaaaaccctaaaattagaaaaatttgaaggggcatgggcggaggggaaataatttttgccaaaaaatgcccctattttcagcggacttttgtcccacaaaaagtgccttggctcggtccaactttggtgtggcgaaaagacggccaaacggctaacggagtgcggtgccgaccggcgcatgtccatctttggcgtgccgttgtccgagtcgttgcgcacccagcacagaaaagtgccgttcattctggagcg

SEQ ID NO: 46950 - DNA, 1993 bp, Heterodera glycines
  Genomic contig location: Contig_ID=SeqID_11334; Location=1137..3129; Strand=-
  SCN-specific regions: Sequence locations=1-972,995-1034,1056 -1100,1122-1744,1768-1993
  Gene Ontology: Mol. function=Notch binding; Cellular component =cytoplasm; Biological process=Wnt receptor signaling pathway
atgcctgatttaagcaatgaattgtggcaccgttttaaggttgtcaacttcaacggacaacatcacttcagtgtcacgccagcactacagcatacaccgcaggaggagaagacagaaccagcgaactcgtcgccaaccatcgcgaacttcttcactttcgtctatgacggaaacttcgatggcattggaagtgattactgtgacggtaaagagggaattggggggggggacacttgccccattttgccatttgcagcttaacatgaacacggtgaattttttgggcatttccattgttggtcagtcgtgtcctcgcggcgacagtgggatttatgtggtaagtcccgtcaagataagctctacccttcgcaatcccattttaggccaatgttatgcccggcggtgagttaatggaaaattgtttttcgtttttatttttgtttcaattataaggtgcggttgctttggacggtcgtattgagccgggggatatgattttgcaggtgaatgacatatccttcgagaacttcaagaacgaccaggcagtcgaagtgctcaaaagggcagtgaacacgagggggtaatcaaagtgaaagcacgaaacaacgccaaatctgaccacctttagtccgataaagctaacagtcgctaaaagcttcgatgccaaccgaacgaattatttttcggtgccatcgcgtgagccggtcagaccgattgacacccacgcgtgggttcagcacaccaacgcagtcaggggcatgaccagcactcttgtgaatgcgatgaacgcgattcccgagggtaatttgggtgggaattggtattgaacaacggacaacaattttggataggcattaagaatttttgttttccattgataatgaaactccaatttttgtcggaaaatacttataaattaggtaccaatgactataacagacgaattttgttgcttgggttgatttccattaagggcaaaataaaaaaggtggctcaaaactggttgattatgttaaactaaaataatatttatgtattgtagtaaatgaaagccaaaatttgtcaaagtgaactaatcatgagtatggtccctcgtgcagcaaaactttggggtttttgttcaaccattaaagcattggtaagttaaggttcggagggtacgccaacgcccattccgtctggccattttccgcctacgtcttcctcccttctgcacactttcgcaccgccgacttccgttcccagccaaaggcccgccagcagcagcacttcgacggggtccggcggcggtgcggctcaaacgatcgtcggcccgggcggagtcattctgtccatgcaacagcaacatcggctggacgtacacagtgacaaacgcaaagtgatccaaacattggctatgccggtacttttggcactgtcgccgcactttgtctccattttacctttattctttagaactccggcctcgacattcgcgatcgaacgtggctgaaaatccccattcccaggtcttttctcggtaggtttgacaaactttgtggcacaaaaacaagagcaatttccgtgtgtttaggcagtgctctcatcgattggcttattggaaatgtcgatggattggacgaccgaaaggaggcgaggaaatacgcctcggggctgctgaaggacaaattcattgcacatgtggtcaacaaggtcaccttcacggaacaatgttattacatttttggggaacaaagcgcaggtggtatttatttatttattacaatcgtactgattaattgcacttttcttttcagaattgctcaatttgcgtgcatcgtttcccgaagacggcacattgtccaacatgcaaaaccaattccaacacatggaaatagccaatccccaccaacaggggacagtcctttactcaaacagagcccaggaacaacccaatttcatccaaccaacgaatttggggaccggaacttctatggtatttttggcagaataa

SEQ ID NO: 46951 - DNA, 1623 bp, Heterodera glycines
  Genomic contig location: Contig_ID=SeqID_11352; Location=1178..2800; Strand=-
  SCN-specific regions: Sequence locations=1-1143,1179-1276,1306-1623
  Gene Ontology: Mol. function=procollagen-proline,2-oxoglutarate-4 -dioxygenase activity; Cellular component=mitochondrion; Biological process=protein folding
gaaagcccaccgaatacggaggcggaagggacgccgcttcaattgtggcatggctaaagaagaaggctggcccagcggccaaggaactgaagagcgcggacgaattgaaggactacaaagactcggcggaagtcgttgtcgttgcctacttcaaggtttggactttcttcttctttccatcaattcaataaaaataagcttactgggtgctaaaccaaaggaaaataaaaggtattttcataaccaaatgtgaacctaaaatcggacaatttccaattaatggattaattttgggtttgttccagtctgctttactatacttccctaacttataaaatgacatttaagaacaaagaaagtgacgcggccaaagcttacttggaagttgctggtgccatcgatgacgttccctttggcattgtgtacgaggcggatgttgccaaggaggcggagttgaagaaggaggactccatcgctcttttcaaaaagttcgacgagggccgtgacgaatttgagggcaacccaactgaggtggacgacatcaagaagttcgtgcagtccaaccgtctgccgttggtctcggagttcagccaagagacggcgtcagtcattttcggtggagaaataaaatcgcacaatttgtaagtggacttgggaaggggacgtttggattttcttatttgtctcaatatgcaggttgtttgtgtccaaggagtcaagcgactttgagaagttggagagcgaatttcgcgccgctgccaaagagtttaagggcaaggtaaaactatctttaatttattattattttccaaattgtgtctgtttcaggttctcttcgtgtacattaacaccgacgtggaggacaacgcaaggattatggaattcttcgggctcaaaaaggaggaccttcctgcggttcgactgatttcgttggaggaggacatgaccaaatacaagccggaatggagcgacatcaccaccgagaacgtggtcaagttcacttccacttacgtggacggaaaactgaagccgcatttgatgagcgaagaagtgccagaagactggaacaaacagccggtgaaggtgctggtcggaaagaacttcgaacaggtcgcgcgggatgacaccaaaaatgtgctggtcgaattctacgcgccgtggtgcggtcactgcaaacaattggcacccatttgggacaaattgggcgagaaggtcagtgtaattctaacatatctgtgtaaccgaacgaggcgtttaagtacaaagaccacgagagcattgtcattgccaaaatggacgccacaggcaacgaagttgaggacgtgaaaattcagtcattcccaaccattaaatacttcccagcaaactccaaaaaggttgatttatcactaaaaattgccaaaacggttcaagtttcgtccaggccatcgactacacaggtgaacgcactttggaaggcttcaggtaaggaggaaaaccaagctggagccaatgaaaatttccaaaaaatttagcaaattcctcgagtcgggtggaaaggacggtgccggcccatcggaggaggagaaagcggccaaagaaggcgaggaggggggagacgaagagggacacaccgaactttga

SEQ ID NO: 46952 - DNA, 798 bp, Heterodera glycines
  Genomic contig location: Contig_ID=SeqID_11371; Location=320..1117; Strand=-
  SCN-specific regions: Sequence locations=1-211,241-539,561-600,623-798
  Gene Ontology: Biological process=embryogenesis and morphogenesis
gaatttccaactccaatgggtggaaaacctttgagttcccaggattttgcggttatcgacgccgacattgacgccactgagaatttgcagtgcatttggtcggtttgggaagtgtccttcgccgtttttccctttctctttggacttatgttaaatgatttcactcttttgaggtgaaaggataaaacggagaaggcacagactgtttaatatttatttgcaaaataaataaacaaactttcttcaattaaggtgcggaatgtttctgtccaagttcgtttgtatttttgcgcaatttttccttatttgtcgatttcagcaaagaattgggcatgcatttccacgaggtgcaccctgaagaggtggaagtgcccaagtgcaacttgtgcatgcaagaactgttggtaaacgccagactcctggagaaatttggcgaagactttggcatcactttgcccaacgaacattcgtttcggagcattcgcttcaaaaaagacttaaaaagtgaaatggcaatggaaaacggtacggggcaaaataattacattgaaaagggtcggaaaaacaaaattcactgatttttgattatttgccattttgtttattaattattcatatatttagcgatttcgaggtatttacggagaatcagcgaaggtgcggatccgactttggtggacattgagagtttagacgaggaaagtggggacggggaggagcgggacgaagacggaccaatggtcggacaaacggtggccgcgtcgtgcgaagcattcgccaacagtcgaatgaattgtg

SEQ ID NO: 46953 - DNA, 2787 bp, Heterodera glycines
  Genomic contig location: Contig_ID=SeqID_11417; Location=438..3224; Strand=+
  SCN-specific regions: Sequence locations=1-7,29-326,348-413,439 -459,481-621,667-861,883-1847,1869-1928,1958-2096,2119-2173,2200 -2436,2467-2787
atcgaaaccagcgttccatgtcattgggtggaccagcacatgagtcactgttgtccaagcaacattcctcctcccctccacagacggtggagctgagccgggccgacaacggtgtgtttttctgtcgaccgcaggcctataaccagaaaaaaaatccgggaggggaagccggagagctttttattttatttttttactcttcggtccaaaatgaactatattttcggtgccgtagaaaaaaaaacgggaaattttggcaattttgagacctaattttggaaaaaaacatgcgaaaattgggacccggcggtgcttataggcgcccgccggggaaaatttagaaaattagggtcaaacatgaattcaatcgagtaaaattttaaaaaaaaacatttttcgcacaaaaaatttaatttttcatttggggaggggggctggtccactggcaaaaattctgacaaattttttttttaatttttactcatcccccctaggcgactgtgttgtgttggttgtggaaaacacgcggttcattgtgaacccggctttgctggtcgtcaaaccggacacaatgctgggacgaatgttctcgttgagggcacgcacgggcggcgggacaagtaaataaaaaacaaattaattcagtttatatataaaaaatatttagcgcattttaaaaaatggcaatgcatccctttttgaaaacaactaaaatttaaaaataggaaaaataaaaaaccactgggatttcaacaagaatttgtcgaagaaatttctcttttttacatttcgacccaaaattttgttagtgaatttttcaaaattttatcccatttacgaatataccaaaattcagagttgaaaaatctcctttttataaaattgttctaacattttgtcactgatttttatagaattcgacgcaattagaattaaacgattttaaaattagacactctgtccgtgccctcgtcgtcgtcgtcggccaatgaccccggcgccgaccgtggctcccccagtgatttggtgcgtcccaacgagcgcaatgagtacgacgtggcggagggactttccgccgcttgtttccgtgttgtcatggtaaacggagacggctttatagccccgatttgttacgcttgactcgcttttcaaggacttttaccaccgtggctttatgcacgtgccccagtccatttctgtggccgaacttcgcgaggtttgccatttgtatgggaagggccctaaaaatggcattttttgtttgattgagtatcctcactcactcaggaattaccctattgtcctaaaactaagatttttgactagcatcatgagtattcgatggaaaatttgattcggaggataattttcttggcattttgccgctgtcgcaataattacacttttttgcttccttaggcatgtgactatctgttggtgccgttcaatgtacacaatgtgaagtgccaagacctgcgcggtttgctgcacgagctgagcaatgagggggcccgggcacaattcgttgtgtatctggaggacatcattctgccacaattggtcatcagtgccgaggcaagttgtccgtgtccaactccgaggggtcaatatgtctccatgccatgctcaaagaaatttcagaggatgcctagaaatatgaagtcctttttctttccatagttagactcggttagttttttgtaaattttgacccagaaatacctaaccatttgagcagttttgggcatgtttccgagattaacgaaatgaggagggcgaattcaagtctttgttttttggtgtcaaaatctacgacgaaacgaagggcttttttgctccttggtccaaaatttttctcaaaaatttttcgtatcacgggagaaaaaaagaacacatttttcgcatatttatattcaataaatggggccatttttattaaaatttttaatattttaaagagttaaggagtccggtgctgcgtgccgattagcaaattttatatgattttaggaaatgtgttttgaaattgatgcaattcactcccccctcccccttggacattcacctgcccattgcaacaactttttacgtactttttctttcctttcagcgtggtgagcgtgagtgtcacattgtggtgttgctggacgaggacgtggtcgactgggacgaggagtacccgccacagatgggcgaagacgtgacccaagtggtgtacaggtaaacgccgagcgcggggcaccacccaatttgttattttactacactcgtgattatggattttcatttcgcaaaaaaaatccctgcatttgtagcactttccgattgcaccccaaaaaaccgtaaactttacatgaaaattttactaaaataaaatttttcgtgaaaaatggttatgaaccgaaaagtcatgtatttttggcactatgaaacaacaaattattaaaaaaaacattttttttattacgatattacagtacgccgctctacaaattcttcaaatatgccgaaaaccgcgatgtggccaagcgcgtgatgaaggaccgcgagctgaagaagatccggcttggcatcgaaggcgtaaaattttgttaaaacaaaaaaattcccgcgaaaactcttttttcccttgctgtaatacagtacccgacgcacaaggagaaaatcaagcggcgcttcaaccgttccgaagttgtttacaactatgtgcagcgtccatgtacgttttctggacggtgtaaaaattatttttgaattgttgcacttttttattggtgcatattttca

SEQ ID NO: 46954 - DNA, 1573 bp, Heterodera glycines
  Genomic contig location: Contig_ID=SeqID_11422; Location=98..1670; Strand=-
  SCN-specific regions: Sequence locations=1-99,121-339,361-554,576 -664,729-836,882-903,936-1019,1041-1210,1232-1317,1339-1353,1375 -1460,1504-1573
  Gene Ontology: Mol. function=ATP binding; Cellular component=membrane fraction; Biological process=response to nutrients
acaggtgaactgccattggagttggcctccgtgatgaaacatttgtgggccgacacaggcgtccaggagtgctttgagcgctcgcgtgagtaccaactgaacgactcggctgcctactacttgaactcgttggaccgggttgcacagcccggctatgtgccgacgcaggacgacgtactccgcacacgggtcaaaacgacgggcattgtggagacgcatttcacttataaggatctcaatttcaagtgggcgcaaaattttatttttaaatcgtggttttttcattttgattccttgcattcattttacaatggactgtaaattttccatttttctaacaaatttcattgtattctaaatacggttcgctgtaggaaaattgtctattgtcaattaattctattgggaaattttaaatgtgaaaaaactttccatttcgacgatcgacgtaaatttttcgctgtttcaccccctatttttataggcttttcagtccacggttcggacaagtaattaccaaccaatctcccatggttacgggcctggaatggattttttaaacatatccaaaattatagccctaaattgtttcaaaaattttgtcgccataaaaaataaatgcctccttttttggcagaatgttcgacgtcggagggcagagaagtgagcggaagaagtggattcactgctttgagggcgtcacggcgatcattttctgtgtggcactctccgaatatgacatggtgttggcggaggatgacgaaatggtagcaaattttttggaaattttttaaattttttttgactcctttttgtcccgccaagaatcggatgattgaaagcatgaagttgttcgactccatctgcaacaacaaatggtttctgaacacgtccatcattttgttcctgaacaagaaggacctgtttgaggagaaaattcgcaggtcaccgctcacgctgtgcttccccgaatacaccggtgagacaggcatcaagcaccaaaatttcctttttcaaccaaaattagtttaaaaaatacctaggttttcttcccgcgctgaactttcgaacaataaaactgaagaaaaaagttttagctcgaagagcaaaaaaaaagaaaagaaaaaagagacttcagatttgcaattaattaggcggcatttcagtgaactcattagcagacatttaaactcaagaatgctcagtttgaacgatttttgggtcaaatttaagcaaaaaatgtagggactcggggaaaactctttgtaaataaaattaagcaaaaaatttttatagaattcaaaaaatttgtccttcttattttataattaaaaaatagggtaattcgtctggatttttatttatttgttgtttcacccccaggctcaaacacttacgaggaggcggccacctacattcagtaccagttcgagtcgttgaacaagcggaaggacgggcagaaggaaatctacacgcacttcacctgcgccaccgacaccaacacatcaggtttgtgttcgacgcggtcaccgacatcattgtgaaggagaacctgcgccagtgtggcctgctg

SEQ ID NO: 46955 - DNA, 1077 bp, Heterodera glycines
  Genomic contig location: Contig_ID=SeqID_11429; Location=33..1109; Strand=+
  SCN-specific regions: Sequence locations=1-868,890-893,915-1077
  Gene Ontology: Biological process=embryogenesis and morphogenesis
tgcctttgacattttcgtgcgctttgtcggagaggcacacccagcgttgcgcttaaagaaactgatcgaacttaagcgatttgatgacgcattggcattcgcaaagtcatacaaccttccggcagatgtaatttaatttaacgcttttttattcttctaatttacatgtttcagtcggtgtacatcgaacttttgttatattatcaagagcaaattcaaaacggaaaggacggcacttatgaggaggaaacgtttaaagaactgttgcagactctgcggatgctaagcgatcacaatactgtaaatttttcttttgtgaactataattgtgtggtttatttttaattttacaggctgctgaccattgtgtagcaattctgaactttgtgaaccgatacgaacacatcaagacgattctggacttcgcaaaggcactcaagataacgggtgctaaattttgacgagtttgtacaatattcctttgcttacagatgagtacacacaaaaggaaattgcccgttttcgttatgaattggcctcctatcgcatgctcttcgaggcccatggtccaagctttgaacgcgactccccatggcctcaatttctgtcgagtggcagtcacaaggagttttttgacgcattttgcgaggccggccaaatgacgcaagcccggcttttgctctcccgctattccaacattgggcaggagttgcaagacgaaaaatcaatgaaaagattgctcacggttttcaaatctactcttataggcatgtgcctctttcaaattttttaaaatttgctttccgttcagaaaaaccgcatatcagtggagcaatcagtgaatttgtggaaattgagttggttccgctgcttttaacctcaaacaatgcgctcaacacgaagatcatctgctccactttctgcgatttcttcgtcgacatttcccttcttctcgaacgacttgagccaaagagtttccctgacgcatcgcttcattttgccgagactttcgaccgcgccatttctttgcttcgcgcagactgtcgtacttcggagaaacacgtcttatttgtctga

SEQ ID NO: 46956 - DNA, 650 bp, Heterodera glycines
  Genomic contig location: Contig_ID=SeqID_11438; Location=2334..2983; Strand=-
  SCN-specific regions: Sequence locations=1-220,259-388,410-457,496 -564,591-650
  Gene Ontology: Mol. function=DNA binding; Cellular component =nucleosome; Biological process=nucleosome assembly
atgcctccaaaaccatccggcaaaggagcgaagaaggcggtcaagtcgaccaaggcggtgcgcacgggagacaaaaagcggagaaaggcccgcaaggagtcttactcggtaggtttttttctgaattttttagggttttctgttttagttttccaatggcttaacaaaatgaaattataaatttaacccggctttccaggtgtacatctaccgtgtgctcaagcaggtccacccggacaccggcatttcctccaaagcgatgtccatcatgaactcgtaaggcccaatttggcgtttttccgtcccaagattctcaattttcccatttttaaggtttgtcaatgacgtgttcgagcgcattgcggcggaagcctcgcgattggcccattacaacaagcggtccaccatctcatcgcgcgaaattcagacggctgtccgactgattctgcccggcgagttggccaagcatgccgtgtccgaggggaccaaggcggtgacgaagtacacctcgtcaaaatgagcaggagatgatgaaagcggtggtgatcggacggaaaaaactatcccaaacggccctctttagggccacaatcactcaaatggacgcgaatgacactttttttcctgttttgtatttgaacgcaaataaa

SEQ ID NO: 46957 - DNA, 2271 bp, Heterodera glycines
  Genomic contig location: Contig_ID=SeqID_1614; Location=195..2465; Strand=+
  SCN-specific regions: Sequence locations=1-333,355-371,393-695,740 -956,1031-1043,1286-1410,1451-1545,1614-1657,1684-1828,1959-2141,2187- 2271
atgacggacactgcaaatcgacagcaacgaagccgaggacgaggcgggagacgtccacgagcggtaagacagttagccggagaacacaattctgacatccatttctaacccctgacccggattcgaacaaaaacgcaaaatttcaattttcgacaaaattaaaattatgcaacaaaatgcacgagataaaacggagaacatgtttctgaacgcaagacatagtgtatttcaggcatatttgaactgtttttgttgcatgacttgaattttgccgaaaactgaattttcgagattgtttgagtccgagttagggattcgaaatggacttcatacagcgcccccgaaaacccccctaaagcatcacaaagccgctcattccttttttcctcttttatgggaccacttaaacttatgattaccaaaatttgacataaattttagtcaattttcagcatctgcgcgacagtgccaagaaaatcaccaaagcgtccattcttcgtctggcccgacgtgccggtgtcgcccgaatcaacgcaaaagtctacgacgaggtccgtgccgcgttgcgctcgtacttggaaaccatcattcgagacgcgccaaattttctgttccatcagggaattgaaccgaagagacaaataaagaaagtaaaaaggtttagccacttgaccacttatgatatgaacacatgctaaaaatgaaaataaataatttaatttatttttatcaaaaatttctgatccctcaccaattcccttctcttttctcacccagacccccattcttaccagtgcttatttagtcccgccgggaccgggactggcaaaaccgggaccgggatttctgtttttccaaaaaccgggaccgggatttctgtttttccaaaaaccgggaccgggacctgaaaaaaccgggatttcccgccccggtcccggtcagctcaactctacttaaaagaaataaattaataaaaaatagatataagaagcatataaaaatattttattaataaaaaagtaaataattagcttttaaatgtgattttaaacattttatatacaattagaattaattttaataatttttggaatttaatatgaatgataaaaataatttttacaaagctttgtcattataagaaacatattaaaatatttttcctattaattgttatattaaaaaaattttacctattaattgttattttaaatattttttgcatatagattaattatttttaataaagaaaattaaaaaacattaattgtaatattaattattaccaaaaatgtaccataatttattatttttacccagttgcaatgctgcgttttcctggacgaaagcctgtccgaccaacagccatgcttcgctttccgggtcgaaaaccaactcggcctgaaaaagtttttaaaattatttttttaaaattttattttaatttattgcctaatgcggctgttcgtttgcccattgcagattctcgaaggccaatctcggcaagatcattttcctgctcatttccagtctcgggcagaagactaaaaataataataataatttttaaaaattgtttaaaattttttaataaataattaatttgataaaatgaaaatgattaatgtttgaaaaatgtacatattaaaatgcactcattttatttaatttatttataattttcgattattgttttttgaaatttattcaaaattccaattaattttttgctactgttaattttgaccgttcctttattgttatatcaatatcgtactgagagatttaaaaagcattaataaaaaaaatttcatatttgtattgttttttaaataattaagtaatgtaattttattattataattaattatataattaattaaaggtactttttatcgttaattaaaaatgaattaattaatgggaatatttttcgttaattggttaattaattatttccattaccgaaaattgatgtgacggacgacattgggcttggcttgaattggcacattgtattccacttcagacggtgccaaaccatatgacggctgtttttcactgagcagcaacaaatcatagcgtctgttttgccgatcgtgtgcataagcaccggagacgggaaaggaccaacgttttcctaattttcattttttaaattttttaaaaattaaaaaaaaaatttaccaggccgaaatgacagacggccaagcgtcattgaacgcttttcaaagccgggctccacttcatattccgtctaaagcattttaa

SEQ ID NO: 46958 - DNA, 1092 bp, Heterodera glycines
  Genomic contig location: Contig_ID=SeqID_11449; Location=229..1320; Strand=+
  SCN-specific regions: Sequence locations=1-55,77-272,294-1092
  Gene Ontology: Mol. function=protein binding; Cellular component =cytoplasm; Biological process=anterior compartment specification
atggccacggttcgaccgataaacaatgatgaagtaagaaacagctcaattcctgacccaattgcctttccattttcgatgcaccgaatggttgggatcatccaaaagaaattctccaccatccaagtgcagctgaagcaaagtacttgcgaaaatgtgatggtgcttcggtcgcgttttcttgacgcgaggtaattccattgttaagtttttgaatttaaatggacaacattgcagaagaaagcgtcggaacttcagcaaacaggcgacggaagtgctcaatgaatacttttactcccacctgagcaacccctacccaagcgaagaagtcaaggaggaattggcacggaaatgccaaatcaccgtgtcgcaggtgtccaattggttcggcaacaaacgcattcgctataaaaagaacatcgccaaggcacaggaggaggcgagcatgtacgcgcagaagaaggcacagcgtaagtggcctcgaaaaggcggattaaaatacattgcggtgaaacaacactatgtcccggctaattagctgcgactcagctaacatttcaatatattgcaagactatatgcaaccgcatgtcgcgaaaaaaaccataaaaaatattgataaatttagttgaatagcccattatttgtttctcaacccaatctgtctttcttttcagtgacccttttgcttattgtcgatgtttaaaaacgaagcagtggcgttaaattttaaaaaagaacaatgtcgtgactttgtcattaatttctcacatttcacttcttcagcttctccctacggcgttttgtccggcacttccgctggggccgttgccgtagcggccaattcgatgctgagtccgtacgcgagtatgctccacgccggccagaatgatctgcagcaccaagtgatcgccagtgggttcgacttggcatcttctgggtacaacccgcagttagtaagtttcccggatttggccgaagttgggactttattgtcaacattggcaaatttcagtttcaaatgggttacctcccatcacaacagacgtcgacttcgtcaccaagacaatgacgaagaatgtaactgaaagca

SEQ ID NO: 46959 - DNA, 862 bp, Heterodera glycines
  Genomic contig location: Contig_ID=SeqID_1618; Location=27..888; Strand=+
  SCN-specific regions: Sequence locations=1-560,582-862
atgattcaacagacgatggttcaaagagcgtgtaaaatttttaagggtgaaaaaaatgcgcaattcctctctcgtctcgactttgatctgggaaaccaggagctttatctcttaaataatttggatttgctgttcacaatttacaaagccaaagatgtttttcttttgcaaactttaaaagcaaatgatgtaaccaaatatcgtttgacagttcacgatgtcaagatttatgccaaaatggttgaggtccaaccctcactaaacatgagcctctacaaaacacttgaaaaacaacccgccacatacgcagtacgcaagaccgaaatcaagtcgtcattcatcagtgtcggtcgatacgaatttgagtataatgtcttcagcgcgaccattcctcggcgcgtgacaatcgcgttagttggaaattcagcatttcatggcgactacaaactgagtccattcatgtttgagccgtttgatttgcgtgaaatttcgatacattccggtggggtggtatacccagctgttccttataaacttaatttttcaaaggatcactttgtcagcgcctttgttgacatgtatgaggcactcggaatggccaattcagaacgttcatttgacatttcaatggcccagttcaagaaaggatggaccttttttctgatcccattgacatccacgcttgacgacagctgtggatttgagctgatgagaagcggtacgacaaacgtacgagcaacattcaattcaccaattccacttggtggcgtggagatgattgtcttgggtgaattcgaccaaatgattatggttgattataatcggcacattgtgaccgactcaaagcttggataaaatataa

SEQ ID NO: 46960 - DNA, 1753 bp, Heterodera glycines
  Genomic contig location: Contig_ID=SeqID_1619; Location=1924..3676; Strand=-
  SCN-specific regions: Sequence locations=1-330,355-384,422-566,597 -776,822-863,906-976,1010-1471,1493-1753
  Gene Ontology: Cellular component=extracellular space; Biological process=embryogenesis and morphogenesis
cactgaaaaggacaaagtgttcgtgtacttctcggaccatggcgcggtcggagttatcggattcccagcagccgacgtactgtaaacaattaaatgaatttaccgtaatttgcgcgggaattttttaacaatgaattaggaataatttgcataacaactatctttgatatgtgcaaatgtctttaatttttcagttaacggttaaacaattgactcaaacactgaaggaaatgcatgccaaaaaaatgtacggcgaattgacattttatctcgaagcatgcgaatcgggctcaatgtttgaccacacattggcgcagagtttgaaaagtgtattttttaaattaaaaaatatttgaaaaccaataaataagatagactaattaaaatggtaataataatagtaataataattataatgatagtcaattaagtttacgcagtcaccgcggccaatggcgacgaatcgagctggggctgtttttgcgacaccaaatttttgcccggaaattgtttgggcgatcttttttcagtgaattggatgcaagactcggaccaggcatttcagtcattatttttgggggaaaatttcaaattttcaggaaaatttacgcaccgaaactctgcggaaacaatttggcattgtgcgcgaagaaacgaacaaaagccacgtgatgcactacggcgacttgcaaattcaggacgaacacgtttctgagtttatgggcaaagagcaggcgcaaaagcgcaacgaacgcccagtgaattaattaatgggcaatttaaaatttaatttgaactttttaaattaatttttaattaaaccattaatggaattgaaattttcgtttagccatcaccgcacaaatttccaatgtttccttctcgagacattcccatgttcatgatggcacgccgtcagaatgagtctaagcagattcagcacaatctccgcgtggcgtggaaagttggaaaacgcaaaatattaaataataaaatttaaaaaaaatttgcggaaaactaattaggttattaaaatttcaatcacatattgtatcacagaaaagaagctttctcgagcaaacgattaaacaaattgtgcaccaacttgtgcacgacatgaacaaccggcgacagattttgacgacgtatccgcaacaaattcgcgacttggactgtcacaatgaggtgaagcagaaagtgcaaagcaaatacaactcatataaaaaacttaaaaaacctaaaagaaaaacatagaaaaatcaattttcaataattattaaaggtaaaaaatcgcatttaaagcttttggcgagtcttgaggattttgaactttttttggataaattgttaattcaaaaatgatccaaaattagattttgtcaaacaattacgtataaatacattttgcttgggtccacctcaagcgattactggtgtttaaacgtcaaataaataattaatacactaattgtatttaattaactgaaaaacaaatcattaaattaaatttcaggtggtgcacacgttcagcaatttctgcttcaaatttagcgaagtattcattttttcctttttttcattaatactttgtcttcgttagaatccgtacgcgcttaaatatgcctatgttttggccaatttatgcgagcgacccgagttggacgccgaacgtatcaaaatggcactgattgaacagtgtgccgaagtcgaacttagcggtgtcatatgatcgaatttgaaaaacgcaatttga

SEQ ID NO: 46961 - DNA, 2702 bp, Heterodera glycines
  Genomic contig location: Contig_ID=SeqID_1625; Location=5018..7719; Strand=+
  SCN-specific regions: Sequence locations=1-159,192-558,580-1876,1898 -1918,1958-2316,2338-2676,2698-2702
  Gene Ontology: Cellular component=membrane; Biological process =intracellular protein transport
atgacttccggcgaacaaccctgctttactttaattcatgtcgcgaacgatgttgaatttccatctgagggacaattgaaggacaaatttgagcatggtaagttatctaagtgcgaaattcaaaaagtatacttaaaatatgcgtttttagaaatttgaaaaataatttgaaaaggaaaaaacaattcaggtgacacaaagacgaagacggatgcattgaaaaagttaattttgatgattcaagcgggcgagaaggtcacaagtcagctgatgatgtacgtaattcgtttttgcctgccatcatccgaccattatctgaagaaattgctgctaatcttctgggaggtcgtgccgaaggtgctttttgttttttattagtttttgcttaaaattgtcgtatcatttgttcgtaaaatttgttaagacaaatcaagagggcaaacttttgcatgaaatgattttggtctgtgacgcgtaccgcaaggatttgcaacatccaaatgagtacatccgcggttcaacattacggtatttttacaatatgcaaaaaaataccgttgttttgaattataaataaaaatctcaaaaaaagtgcgctggcgcacctccttatgcatttgtgctcctcttcgttgctttcaaatgacaccacaaaggtgtaatttgtcctgtccccgcatacaaattccgatggagggttgcatatttcattaagaaaaattaggactataaatttcagaatattgaacctttttctttcgcattcagattcctatgtaaactcaaagagcctgaattgctcgagccgcttatgccttcaatacgaaagtgtctggaacatcgtcattcttacgttcggcgcaattccattttggccatctatacaatctacagtcagtttttttaactttccgtttttgcaatccttttttaaattatttccgtttttgtcgaatgcaatcctttttcatccaaaatatcttttgattttagaaaacttcgattttctgattcccgatgcgcctgaactcattcaacaattgttagagactgagcaggacgcctcctgcaagcgtaatgcgttcattatgcttttgcatgtcgaccgacagcgggcattggattatttgtcgggttgtatcgaacaagtcgcacaattcggcgatatcctccaactcgtaattgtggaactgatttacaaagttagcaacaaaataaacaccaaattttgcttctctacacaatccttttaaggtttgccataacaatccaggagagcgcaatcgcttcattcgctgtgtgtataatttacttcagtcgcagtcgggcgctgttcgttatgaggcggccggcactttagtcacactaagcacagcgccgacggcggtgaaagcggccgccaccgcatacatcgaactgatcgtcaaggaatcggacaacaacgtcaaagtctgtcttgggttgcgaaagtggtacattttttaaatttttcagctgattgtacttgatcgactggtcggtctgcgtgagatagtgccaaacgacaaagttctgcaagagttggtcatggacatccttcgcgttttgtccaccaatgactacgaagtgcggcggaagattctgcagttagcacttgagctcgtctcttcgcgtaacgtaagtcttttcagcaatttttcaattggcctatattaagtttaggtgcatgaaatggtgatgtttttacgaaaagaaatcgacaaaacgaacaatgacacgcaggaggacaccggacgatacaggtaaaaaacgcacttttcaaaaggaattctcagtgttgtgtccgtacacaaattaattcgacccggtcaactcttaggcaaagactggtttttggaaatttattaaaattcaaaaaggtttaaaagaaatgtgaaggttcaaaattaaataagcaaagtagagttaaaaggttttagtgagtttgatcgcttcaggcagggaacctgagatgggaaaattatgggtagaatgacctgcctttcgagatgggaagagttcttaaatagtgccacaaattgagaagaaaagagcagaaggacattacataggaaagggttgaatggcaatgcgaaggaaatgcaaaattaggccaatggaaagggaatggaattggttaggatgattgacggccagagggacaaaatgggaaaaggaatcaaaaataggaaagaaacaaaaatgcttttaaatcgaaaacgcagacacctcagagatcttagtaaaaaaaacaaaaatcattttgagatgacaaaaatgaaattattcccgttattctttttaattattattttaattgccaaaattggatcagcaaagaataaactgcaacaaaaatcatttgaggaaatatttggaggaaaatgggaagaaaacttggaagaaaaaaggcaaataattgaaaaattctataaaataaaagagaaaataaagcaaaaaggaagaaaacacacagcaaaagaatggagtaaaattgaaagaaaaatagtgaaacaattggggacaaatcggaattacattcaaaaatggattaaacaatttgttctacaaaaattcaaattaaaattggagtaagccatggaacaattaaaaaatggaagaaacaatttgacattcgatatatgagaataacggagaaagaaaaaatgaaaatttattggcaa

SEQ ID NO: 46962 - DNA, 2869 bp, Heterodera glycines
  misc_feature (31)..(31): n is a, c, g, or t
  misc_feature (82)..(82): n is a, c, g, or t
  misc_feature (2821)..(2821): n is a, c, g, or t
  misc_feature (2836)..(2837): n is a, c, g, or t
  misc_feature (2859)..(2859): n is a, c, g, or t
  Genomic contig location: Contig_ID=SeqID_1629; Location=1..2869; Strand=-
  SCN-specific regions: Sequence locations=1-197,219-336,358-1970,1992 -2017,2048-2320,2342-2782,2805-2869
  Gene Ontology: Mol. function=microtubule binding; Cellular component =plasma membrane; Biological process=common-partner SMAD protein phosphorylation
tctggagatcaacgattgtttcagcgatttntcggatggaattctcttgatgaagttggtgatgatggcaacagcaaaaacnaaaatgtgatttaattgctcagatttctggagattatcagtggagaaaaattgggaaaaccgaaccagaggacgaatgagagttcagaagatcgaaaacctgaaccaggtaaaagaaaaaggagaacgaacggaaaacaacggaaaaacttctcagatgtttggattttctaaagtacaaacggattcaggtgaacaattagagagattaatcagcagaaattgggaggaatattctgttggtttttagttggaaaaccattggggcggaagatataacggacggaaacgaaagattgattttgggcttaatttggacaatcattctccgatttaccatcgaaaacatcgaaattgaggtgactgatcattctgtgcttttgatccgtccataaaaatgtaattttttgcagacgaaagaatcgggtgaacggaaacacgcgaaagaggcgcttttgctgtggtgccagcgcaaaacggccggctacccgaacgtgaaggtggacaacttcagctcgagctggcgcagcggactcgccttctgcgcactgatccacgcgcacaggtgctaaagggatggggcggcgactcattgggtttactttcgttggtcaggcccgaactgctcgacttcgacgcactgaacccgcaggaaacgatcggttggaccgggggggggggaattgggcatgcctttgtgatttaggcaatttgaacttggccttcgatgtggcggagaagcatttggacatttcgccactgctggacgcggaagatgtgaacgtgtcgcaccccgacgagaagtttctggcctggcattggccttagtttgaacttcccccaaaggtccatcatcacttacgtgtcgctgttctaccactttttcgccaaacaaaaaacggaaatgaccggcgcaaggcgagtggccaaagtgatcggagaattggtggagcaggacggcatgcaagaggagtacgagcagttggccagcgagctgatcagttgggtgcgacggtcgatcagctggttgtccgcccgacacttccccaacaatttgacggagttgcgagacgaattggcgcaattcaaccgattccgaaaggaggagaagccgccgaagtaccgggaaaagggcgaggtaaaaggcgtgcgaagggaagggcaaagtgacggacggaccaacgcaatttttggcattttgcgaaaaattggcacttttatgattcacatcatttcccttttcagttggaggcccttttcttcgctatccaaacaaagcgaaacgcttcgcgccgcagggcttacgcgccccccgaggggtttcttctgcacgatttggagggcgcgtggagcgaattggaaaaggcggagcacgcaaggcaaggcgcactgatcgaagagttgcagaggcaggagagattggaacaccgcgcccaactcttccacaaaaaggccgatgtacgggaagcgtggcttcgagaaatgtaagcgcaaaaggcaaatgaaagcgaaagcaatcggcggaaggcaccgaccgaattatcagtgataaaacagactgatcagtgatcaattcgttcagttccgtcgtcctcggacagttcaaatgttcgccgaatgcgcaaagtgttgagacggggaagcgaatgatgcgaaacatccaaacggaggcggcccccaagaaggaacgctttcagttgctgaaggaactcagcgcggaactgcaggcggaacgattccacggaagcgcagagattgcgcagagagaaagggaaatcatcggacgatggaacgcatttctgacgatgttggaagagcacgagttggagttggacaggtcgaccattctcatgaacacaatgccgagtccctctgatcgaaaatggcattgccattttgggagaaaatggcactttttagccgcagccatgaaagagtgaagagaagaggggaatgatcaatgcaaacactcgccataaatggccaattggaccctcctcttcttaggttggaagagctcagccttctcgtcgaggcattggacacattgggcgaggagttggacagtctcggggcgcaactaaaacttcgagaaaaaggacggcacatggccgaagtggacgaactgatgaaggggcaggaactggcggagacggacttatcggcaaaaggcgaaatgctgaggaaattgcgaagaaaggccgaacttagcagcaaaactcagccgccccacagagaggcggcgttggagatgctgcagctcagactgaacgcgatcggcaagcagtacgatcagctgcgaagggacgccagggaacggcgagtggcactgcaaaagacgcgcgagttttttcaggtaggaaaatggaaaagagactatgaacaacggggcgtccaagtaatggcattgcttaatgggccattgcttaatcattttggcattgcttaattggccattgcttttcccctaagttcgtccaacacttcgatgaattgtccggttggctttccgatcgcctctccgcctgcttcgcccttctccaattgcgcgacctttctgctttgcgcgactcgcaacgattgcacaaatctttggagactgaaatgcaaagccaatgggaaaggaccaaaaggctaatttcggatggggaaaagttgggagtgccgggggaagtgcaatggcgcgccgacactttgcaagggtgggaaaagggagggagggcaaggcacggacggattntgaggtcgtgggaanngagtgcgacgacaacgccgcgntgaccgattg

SEQ ID NO: 46963 - DNA, 2876 bp, Heterodera glycines
  Genomic contig location: Contig_ID=SeqID_11542; Location=679..3554; Strand=+
  SCN-specific regions: Sequence locations=1-480,502-606,644-1224,1260 -1430,1453-1600,1626-1853,1876-1957,1980-2223,2245-2344,2370 -2536,2559-2876
  Gene Ontology: Mol. function=translation elongation factor activity; Biological process=protein biosynthesis
atgctttttacttcacttaaaaatttagtgctattttcgatgttctttgaactcgaacgcaaagacttggagttcgtcaaaggcgaaagccaagcagacattgagcaggtcgacgggaagagccaaaagtacaacggtttcttgatcaatctgatcgactcgcctggccacgtggacttctccagcgaagttactgctgcgttgcgcgtcactgacggtgctttggtggtggtcgactgtgtgtcaggtttgtcttgaaaactatgttttttgatttgcacaaacaaattcgcggttgcattttaatttcaagtgcactagagccactatttctacatccgctctttaggtgtttgcgtgcaaactgagacggtgttgcgtcaagcaattgccgagcgtatcaaaccggtgttgttcatgaacaagatggaccgtgcgctgctcgaacttcagcttggccaggaggaattgttccagacattccagcgcattgtggagaacatcaacgtgatcattgccacttacggagatgatgatggaccgatgggtccgatccaagtggacccgtccattggcaatgtcggctttggctctggacttcatggttgggctttcacattgaagcagtttgcggagatgtacgctgacaagtttggagtccaggtttgaacacagcttgatattttgttcaaatttgcttatttttagattgacaaattgatgaaaaatctgtggggcgatcgcttcttcaacatgaagaccaagaaatggaccaacaaccaagagcccgagaccaagcgaggcttctgccaatttgtgttggacccgatcttcaaagtgttcgacgctgtgatgaacatcaaaaaggacgaagtggcgaagttggtggagaagctgaacatcaaactgaccttggaagagaaggaacaggagggcaagccattgctgaaaacgatgatgcgcaaatggttgccagccggtgacactatgcttcaggtttgtatgggattagcccactttagtcttttttcgtcgggaatttcaaaataacagaattcggttgtaaatcctgtttttatgcagatgattgtcatgcatttgccatcgccagtcacggcgcaaagataccgcatggaaatgctatacgaagggccgcatgacgacgaggcggcggttgcaatgaaaaactgcgaccccaacgggccactgatgatgtacatctcgaagatggtgccaacctctgacaaagggcgcttctacgctttcggttttaccttttcacaaataatgaacaaacaattttatgaaaactcaggtcgcgtgtttgcgggcagagtcgccactgggatgaaagcgcgtatccaagggccaaattatgtggtcggcaaaaaggaggacctctacgagaagaccatccaacggcaagcaacaattcatttctggttttcatttacattcaatccccgttttctagcacaattctaatgatgggccgttacattgaaccgattgaggacattccggccggaaacattgccggactggtcggcgttgatcagtacctggtcaagggtgggaccatcaccacctacaaagacgcacacaacatgcgcgtgatgaaattctccgtgtcgcccgttgtccgtgtggcggtcgagccaaagaatgcgggcgatttgcccaagctggtccgacattttcatgtttcaacaaatttaatttcagatttaaggtcgaaggattgaagcgtttggccaagtcggacccgatggtccaatgcattttcgaggagtccggtgaacacatcattgccggcgcgggcgaactgcacttggagatctgcttgaaggacttggaggaggaccatgcttgcattccgctcaagaagtctgatccggtggtgtcctaccgtgagacggtcaccgaagaatccgaaattgtgtgcctgtccaaatcgcccaacaaacacaaccgtctgttctgcaaagctaggccgttgcctgatggactgccggaagccattgaacgcggcgacgtcaacccgacggacgacccgaaaaatcgtgccaaaatactcaccgagaaattcgaaatggacgcgaccgactcgcgcaaaatttggtgtttcggaccagagggcactggtgccaatttgctgattgacgtgacaaagggtgtgcagtacttgaacgaaattaaggtatgaaacgtttaaagaattcgattccttttttgctattactaattttaacggaaatttaggattcggtagtggccggcttccaatgggcaaccaaggagggcgtgctctgcgatgagaacatgcgcggtgttcgtttcgacatccacgacgtcacactgcacgccgatgccattcaccgtggcggtggtcaaatcattccgacggcgcgtcgtgttttctacgcttcggtgtgacggcaaaagtgcgtctattctccttacatatatgtattgcttccaatttttcaagtttgaaagctggtattatcgcttttttgggattgtactagattggttttttctaaaagtaaaacaaaatctatttttcatgggatgcaaatccatcctttacacaatgctttgacttcgcttaaaatttagtgctacgcaaagacttggagttcgtcaaaggcgaaagccaagctgacattgagaacagttcacacccctttttcttaatgtgcccattcagaaaacatattatttttgtatcagggactggaactccaacgctcgaaaattttcccgaattttctaaatccgatggtctgaattttttatttcagcagaattctgaccctaaaatggaaatctatttcatcgaacagcaaaatccactcttggaacaatattaa

SEQ ID NO: 46964 - DNA, 1095 bp, Heterodera glycines
  Genomic contig location: Contig_ID=SeqID_11607; Location=1..1095; Strand=-
  SCN-specific regions: Sequence locations=1-74,98-283,306-458,501 -742,775-1042,1064-1095
  Gene Ontology: Mol. function=DNA-directed RNA polymerase activity; Cellular component=DNA-directed RNA polymerase III complex; Biological process=growth
tccgtctaaaattggccaaattttatgcaatttttttagtcgaaagaatgcgccgctgacgatggcccagtgcgtttccaaagggtctttcattaacattgcgcaaatgatcgccctggttggccaacagtccatctccggcaagcggccgtccgacggatttgaggtcggttttcggttgttcaattggattgacacaaattgtgggagtgcaaattaaatcattatcacctcatactaatttaaaaaaaaagttttttgagtccttcccaagttcggaatcttaattaattttttaaaataatcgccattaatcaaactgaaaattcaacgaattttttttgttgaaaattttggtgagttgttaagatttttcaacaaaaaaatttccaaaaaattgctgtaaagattttcgcaattattttttcgcggagtttctcgtaaaacaacgttttaagatttttttaaaattttataagctaaaaaatcttttttaaaaacatttctcggggggggggactggtatggggggaaacgagctgctcacaccaatcatataactctaaaaaaattccgtaaaaataacctttttaaaaaggtaaaaaatgatttatgatgctaaatgcaaacccatgatttattacgacggtgtgcgatgccatcaccaaaattttactcccattatcgcacatttaattaatggaattttgttacttcgccacagaatcgctccggcctgacgcccaccgagttcttcttccacacaatgggcggaagggagggcctcgtggacacggcggtgaaaacggcggagaccggatacatgcaacgacggctggtcaagtgcttggaagtgcgtttttttcgcaattttttttaaatttaatgcctcagcggatgggacacagacttcgatacaggaatgcttcaaatccgttttcgaccaatttttgatttccaaaacttttctgtccactaattgggcggagttttttgggtggtttgaaatagttgaatttttgtcaaccacttggttttatgcgattttcttttaaaaatttagtttttttttgtttgaaggataatgaaaatttt

SEQ ID NO: 46965 - DNA, 3302 bp, Heterodera glycines
  Genomic contig location: Contig_ID=SeqID_1646; Location=2138..5439; Strand=-
  SCN-specific regions: Sequence locations=1-435,459-461,534-1286,1308 -1339,1361-1553,1581-1641,1672-1774,1799-1952,1998-2256,2278 -2514,2536-2568,2591-3009,3032-3065,3095-3302
atgcgcaagctgcaatttgttgggcccgagctgctgctgattcgaatggagcagccgaagggcgacggtaagggaaaacgaaaacgattttcatgtcctagtggtctgtggcgttggccaccaaaatgagggagattgggttccagtccccttcacgttgctcgcagaatatcatttgataattgcttgttttgttattcccgcctttcggttttttttttttttgatttttttatgtgtcaattttcgtcgatttaacaaatcttttatcatttcaaattagcatgcatttataactgtgattaaaattgaacaaatgtgcacataatcatttatagcattttactcaattattataaaatatactttacggaattttttttattcaattattaatgctaaaacattttacagatgattttgacgaccaccaattcgcttcctcctccttttgccctccctcttcatcatcatcgtattcgtcatcatttgctgctgctaatcaccaacatcatcatcatcattaccagcatatgtttgtgctgttcgagtggcgagtggggcgcattgtcggcgtgttcaaccgctcctccgaggcgttgttcggcgcgttcgagcggcacaacgagcagttccgcaacgggcacattgtgcgcacaatgttccccacttccatggagcattgcggtgcggaacgggcccaacacgaggcgctcaagcagtcttccctgcttaccggtccgtacatcagccagtccgtccggcatgccggaccggttcgaaaacccgaagtttttaagaaatcgaatatctgtgcttcgttgggcattctgtcacatcaatccatttgtccatgtacgattaatttaatgaatgcgcaccaattcagtacccgcttccgatgttcgccgacggtttttggcagctcttccctatccgaacacgcaatatttgctcacttcaccatatcttgacccaaatatgttcagctacgatgacaaattgctgaatatgaccgaaacgggtcgctaccctcctgatcagccattaaattaagattttttgtttcaataaaatgccatatgcttttaatcaaacaaaatgccaattgaatggggatgcttttttgctaaaatcccgaattggagtcaatgactcactttgagaatcccgggattaaaacttagtccagctactctggataattcgttttcgaatcggtcatttgttcctgccaaaacgttttcaacaattttttgtttcgactggtcctcgccattagttgagtccggcacccgtgttttgctaatctgtccggcattatcagccctaatgaacataaattgttgaaaatccaaaacatttcgttcccccattttcaggctgttcagtcgtcgcaccaaatgccttcacacccggctggactttcgcatcagtgccatccgaacactgtcctacgcccgtgtgctgttccatccggtggacccatttgtgatgtcgctgcacaagggcatccaaccggaaacactgatctcattccacacgctccccctttattaccagaagaagaagaaataatagtccaatataatttaatttggcaacccgggttttaatgtgattgccaattagataattttagttgttccttgtttgttttttaaatcaattccaaaaaatcaagttccccgcctgggtccatgccatgtcaagcgttttttgggatttttgtccagaaaacccaggctttttcaaaatgtcggactttaaagattaggcaattaaaacataattttttagttcgttttgtgaagcgctctcaggaggagtactacgacagtttgttgagctacagtcagcagcggatgatgctttacccctaccatttgtcggacattttggtgcgcgaacttcgcatcactccgttcacttattacacgtacggtttggtcaaaaatttttttttttttgtaaaaaattattttttaaatttttaagttcccgaaaagaaattttgcgctttttaatcgctttatgactcaaaagaaagactgtttaggaacatgattgtagaggtgatgcaagccgagaagagctacgattccatcccgaatttcactgccggtaaattttttttaaattgcactaaaaattgtgtgtttcagacaaaaatgacggaaattcataccatgtaaccccatttttcattcatttgtcacaaatttttcaaaatagggggtggtggagtctatttaaattgtttttccataaaaatttagcttttcatatcaagttttgctactccctttaacgattgattaacagttgacgtcatgcgcatgttgggcatcggtcgcaaccagtacattgacttgatgaaccaaaaccgggccaaccggcgactgtttcgacgggcaaagccagtgcgcgaaattctgccccaaaagccgtgcaattttgcgcccattgagccatggtttcagctgtgcttcggctgcattttggaggcggacattcgagtgaaaatttacaaaaattttttacgattttttttttgcaatttttcttaaaaaagtgaatttctaaaaaatatgtttaaatataatggatcacaattttggtttcattgaaattcaaaatccaagcagtcattagtcgaaaactaaaacggtttaatactttttcaaggagttcaaaaaatttttaccataaatttcaattcgattttttgatatttattttaatcattttgaatcaaaaaatgctttctgaagatgctcagttcgccggagcagttgatcatcgaccgactgcttgacgagggttccgtctgctgtggtctgttggacaaagccattgttctgcgcctgttgagccgtggcctcgtctatttggaagtgccaattgggtctgatgactacgtttttggcacgtcattttggttttgagtcaatattaaacaacccctcctccctttttttgtcatttatcatttctggtcgattttgtattttttatataacttaaaattttgtgggattagaattatggtggtggtctctccgaaaaaaaaaaaatttttttttgaaaaatacggttttttttatccacttttttgattttctataattttttcagtgccaactcttgacgggtttgtgatgaatcgggtccaaggcgactattttgagacattgttgtacaaaatttttgtcgccatcgatggacaaacatcagtgatggaggtgggttgggtccacaaattatatttcctcaatttttttaagtttttagttggctga

SEQ ID NO: 46966 - DNA, 2527 bp, Heterodera glycines
  misc_feature (5)..(6): n is a, c, g, or t
  Genomic contig location: Contig_ID=SeqID_1649; Location=1..2527; Strand=-
  SCN-specific regions: Sequence locations=1-21,48-313,335-397,419 -634,656-723,745-753,870-932,1014-1125,1147-1370,1402-1461,1483 -1490,1512-1617,1655-1771,1808-1857,1939-2019,2056-2102,2124 -2233,2256-2468,2490-2499,2521-2527
  Gene Ontology: Mol. function=cation-transporting ATPase activity; Cellular component=integral to membrane; Biological process=mitotic spindle orientation
tctanngagtcacgagaaggcaattaattttaaattaataattaattcataattgcccctcaccctccattaaggccttcgcactttggttgtggccaaaaaagtgttgaccgcggaacaattggccgattttgagcgggaatatcaccgggccaaaatgaatgtcaccgaccgcactgaacacatggcttcggtggtgcgacggcttgaaaacgacttgcaactgttgtgtttgacaggggtcgaagatcgactgcaggtccagccattatacaaaaacaaattgacagaaatttaattgtaattttttttgttaatacatatttttgaataaacacccctaggacttcggggctattcatgaaatacgtcatttttaatggcgatcccaaatttacaccccttcccttctttgaaggaccaagtcaccacttcgttggagctgttgcgcaacgcgggcatcaaaatttggatgctgaccggtgacaaaatggagaccgcaatttgcattgccaaatcgtccggcctcttctccaagacggacaatgtgcacgtgtttggccaagtgcgggaccgcaccgaggcacacaacgaactgaacgcattgcgcaagtgggtggtggacaatgtttagcattgttgtgcctttttcaaattgtggtacactttttcactgtttgtcttttgcacgccttcctttttctctcctttcctcctttttttctctccctgtctcgtctcctccgcattcccctctttctctctctctctctctctctctccctccctccctttttttctctccctttctcttccactcattccttcatctctctcctttccccctttctttcattctttctctccctattttcattcatttcctatactctgttaccccatttgtccttttacttcttctcacccgacgcctctctctacttctctcgctcttttcttctctttgtttctctccccctatctcccctctatcattttctctccctttttcttgttgttcgaatcttattatgttacacaacaggaaaagtgacgttgcactggtgatgtccggctctgcgctgaacatgtgcctgcagtactacgaggcggagttggccgagttggtctgctcgtgcaccgctgttgtgtgctgttgctgctcaccgtaacagaaagcgcaaattgtcaacgtgctcaagcgctaccgacggcccgcccgtgttgccgcggttggcgacgggggaaatgacgtgtcaatgatccaagcggcacacgccggcattggcatcgatgccaacgaaggtacttagattttttttaccgacgagtcgttttttaaccaatttttgggagtagtccccccccccaaaaaagaaattttttaaatttttcccattccaggaaaacaagcctcgctcgcggccgacttctccatcactcaattccatcacatttgtcgtctgttgcttgtgatgcatcgcggactaatcatctccaccatgcaggtaggtggtatttgtcgtgggttcgaattggatagaaattggatgccattttatttttcgttttttaaaaatttctttcaaattacatttgtcctggattaatggtgggaaatatgcatagttttgtttttatctattttgtaattgacaggctagttaattctcaatttgtaaaaattttttaggccattttctcctgcgtgttttatttcgcgtcggtgtctctgtaccggacattctgatggttgcgtaagttttgtttcttttttaaataaaaaattcataacatttttattattcaaatgtatccgatgtaaatacatgtattaaaactagagtgccacgggaccgggaccgggccgggaattcccggtcatccgaggtcccggttcccgggttttgaaaagctcaggtcccggtcccggtagggaaaccgggaattgggaaaaacaagcactggtaagaatgggggtctgagtgaaaaattagtgatgaaaattggagtcaaaggaaaaaattaaaaaataataattaatattctttaaaagtaacactgccagttgtgcaaatggcctactggctagtctccttgactttctcttcttctttcccattgttcaattcctctacagtaattaaaatattttgaattttctttttgtatactcatggctttcctatcgacaaaatatgattcctcatagtttttttttaaattaacacatttttatcattttttgttgaaaatctgttaataaattacactcaaattttcaaaattttccccggcggcgcctatcggcaccgccggacccctttcttcgccaaaagttttttggaaaaagcgcgccgaaaaaatttatgtgaaacgtaaatctgaatttctataatattcgatcatttagtccaaaatgattaattgtttgaaatgactgaagaaaatttgatgtgaaaattttcattaatttaatttagcttaaacgtttggagtttattcaataaaaaacaaagtaaaaatt

SEQ ID NO: 46967 - DNA, 472 bp, Heterodera glycines
  Genomic contig location: Contig_ID=SeqID_11617; Location=1952..2423; Strand=+
  SCN-specific regions: Sequence locations=1-50,86-416,438-472
  Gene Ontology: Biological process=positive regulation of growth rate
ctgatgttaaacgtgttccttttgcaattcctaaaccaattcaagttttgtttatttatttttttgattctattttttaatttaagcgttcgccaactgacttgctaaaagcacttgcaggcactgttaaggaagatgaaacctcagttcactttggactagtcgatgatccgataatgattccaactggttttagagacaaacgactctatctgatgtcaaaggcatatttattttagatattcaaattaattacaaacgatgctttcaaatttgaggagcttggtcgccggactgctcgcaaaattgttgaggaatggccaacattatttatgctcgaccgtgatgttcccgaattgaaggctttcagaccgcagaaaccattggatcccactttggtacaaccgaacgaggaaaatttacaaaaaatgataatggaccgacgagtgtctgatgctataaagctttatca

SEQ ID NO: 46968 - DNA, 1018 bp, Heterodera glycines
  Genomic contig location: Contig_ID=SeqID_11633; Location=306..1323; Strand=+
  SCN-specific regions: Sequence locations=1-434,456-577,600-636,666 -834,870-1018
  Gene Ontology: Mol. function=hydroxymethylglutaryl-CoA reductase (NADPH) activity; Cellular component=endoplasmic reticulum membrane; Biological process=ergosterol biosynthesis
gttaaagacgcgtgttgcgagaacgttgtcggctttgtgccgttgcccaccggtgtcgctggtccgctgtattttgacggaacttttgtccacctgccgttggccaccacggaaggcgcgctggtggccagtgtcagccggggatgtctcagcattaatgtatgagattttttaaggcaaattggggccattttttggattttttgattcggttaaatcctcgcccgaacttttttttgaacgtccactacccgagtcccggagaaaccctgacatttttccccgtcccgaatttgggagtcccgaggccgacatcgacaattttttcaacctacggaaaaaatattttgatttgaggaaattgtattgattattgaaattgcatccctaaaaaattcgaaatttcacccccccccccctcaaaaaacggacactaaattttttttataaataatgctaatatgtgccaggaagccatttccatgttgggcaacaacgcgttcagcgtgcacgtgttccgtgacggaatgagcagggcaccaatcatcgagtttccatgtgtgcgcgattccatgtatgtttcattttgtttaattttccaaaatggtatccaattgtggatttttggaaaaatttagcgtaattttttggtaaatttggatgactaattgtgagatcttggagaggaaaaatcgaaaattttagcaaaaaaacccaatttttcatttttctcgattatttccccccccctttttttacagtgaatgtttgcgctgggtccaacagaatcggacatttgtgcagcttaaacaaatttttgaggagaccagcaagtaaaaaaaaattttattaattttttcaaaaattttccaattagttacgcctgtctgcaacgcattgacgcccatttggagggcacctatttgtatttgcgctttgtcgcctcaaccggcgatgcgatgggcaaaaagatggtgaaccttttttgtcaatttttcttcgaaagttgggacctgca

SEQ ID NO: 46969 - DNA, 4972 bp, Heterodera glycines
  Genomic contig location: Contig_ID=SeqID_1656; Location=36..5007; Strand=-
  SCN-specific regions: Sequence locations=1-125,147-255,277-430,455 -503,526-603,630-1376,1399-1592,1614-1690,1724-2097,2135-2418,2441 -2526,2549-2800,2836-3032,3063-3346,3385-3634,3656-3702,3727 -3812,3836-3940,3962-4225,...
  SCN-specific regions: Sequence locations=...4247-4749,4771-4779,4801 -4972
gaaccaacaagggaaaataatattttagatttggtttttagtcaacccaaggaactcatttataatgtaaaagttggctcccctttttctaattctgatcataatactgtttggtttgatataaatcaaactattccaaaaacagatagtcaaaaaatttttatcagagatttacgccagaaaaattttactaaactcaaccaagaaattctttttaatgggccaaactccctcccaattacagtttcagacataaatgagaaatactgcatatttaccactgaattaaaaaagcgttttgataaaaatgtacccatgaaattgcttaaaacaactattaagaaaaaacatgatgaaaaaataaaaactttagtaagggaaaaagcccgaacccatagcatgctaaaaggaaaagctgagtgccgtgagcttaaaattaaatataaaatattatgcagggagtacaaaaaacatatccacaaattatattgtgaaaatgaagctaaatttatttcaaatggaagaaattctctctataaatttgttagaaatcggcttaaaactaacaccggaataccaacacttattgatgaacaagggcaaattatttttcggaatgaacaaaaatgtattttattggctgatgtctttcaaaagtcatttttgtacaaggaaaataacaatgacttactcagccatgaaaaccctaatcagatcacagacattgaatttaatgtctataatatttggaatttattaaaaaaactccctagaagaaattcgacatcgcctgatggcatcccttacatattattaaaagaatgcgcattacccttggcacccatactaactgaactctttagaataattttagattcatctaaaatccctgaaatatggaaaacgtccataattatccctgtcttcaaaaaaggagatacagataatcccataaattatcgccccatttcactaacttgtactttatgcagagtaatggaaaaaataataaagctagaaatacttaaatttttgaataaaaatcaattttttagtccatttcagtttggattcctgagacaaagatccaccacaacacaacttctatcaactttaaatgatttttatatatcgattgaaaataaaagttgtgttgatgtaatatatattgatatttctaaagcttttgatagtgttccaattaaattacttctacaaaagcttaaaaatatcggtattaatggtaagattcataaatttatcaaaaatttcttaaatgaccgttcattcagagttaaaatctctgaacagtattctaactcaaaaaacatttatagtggggtgccacaaggtagtgtcttaggccctttgctttttcttatttttattaatgatcttccgaataatttgcctaaaaatgttggtattaaaatgtttgccgatgatattaaaatttatattgagcataaaaatgataaaaatagagagaatttatcttccgcgcttgaggcaataaataaatggtcaaaaaataatggactaaaaatatcaatagaaaaaacaatggtcctttacttgggtgaaaataacacaaaatttatttattttcttgatggcgaaccattgccagaaacaaaatgtgtaagggatttgggcattttaattgatcaaaaactatccttttctgaccatattaataaaattttaaaaaattcatatttttcttgttatcagcttctccgagcgttaaaaactcggaggcttgaaacattaattttggcatataaaagctatatcagaccacagttagaatacgccacagaaatttggaatccattgaaaaaagaaaatgtccacaaaattgaagcagtccaaaaattttttacaagaaaagccttcaaaaaatgtgggcttgtccccatgccgtatgaaaaaagattaaagttttgcggaattaagacattggaaattaggcgcaaaattaatgatattacaactacttttaaaataataaaaaaacatacacatcttaaaccatctaacttttttgctgttgctaaacgggctattcgcaaaccctttttattacaaaataggatatatattacaaaaacaaaaaataatttttttaatagggttattaattcatggaatttattaccgaaaaatattatggaaataaatgaccccaaaaaattccgagaaattgcaaaagaaataattaagcaataatgcatattttccccattgagaggtgtgatttgtttcatttatgtctattgtttttaatttgacacctattctgtgatttgacacttatttttgtgatttttgactgccatttatgttttatttttattctcacttttttctttttacaccactgttagagtgcatagcaccttgtggtttgttcgataaataaataagtcatgaaaatacatttccaaaggttttcgggtacgctgatcacgaatccgcggcatccatttcgtccaaatccgaaccccagacccgaattcgaacaaaaatttaaattttaaaaattcacatttatgcaaccaaatgccattaaatgcacgaaataaataaaaaacatgcttattggcatggataaaattgcgaaacatgatagttcaaaaacttgcttagtcgacaattttgaaccttataatagaaccaatacacccaatgtgtatcttttgatcaagttaagaccttcaaaaaaagtcccaaccaagaggttagccgacatttgcggaccgacatttgcggaccactatttctgggttgaactgtcaaaaaaaacaaaaaaaaataattttttcaaaaattgagtgactaagtagttttatttgtgatttttaccaagttgaacatcgcccttcaagagtaatcgatcaactgtttgcaatcaacatcgaaagaacccatttttttaaagaagtttagtttccatagataaatatagtatgtagttgctcatttttaattttggacccatagttttaataacagcaaattacggacaatttttgagaaaaagaaaaactattttagtttttgtttgttaatttaattggtttggcatgccggaaaaaaattaagctctcggttaactaaagcgtggaagtgaaacacgataataatttttcttgctataaaattcttgaactgacttttatatttaatttagcgaatttttttcgccaattttcacagtttaattataagttagaaattctataaaaaagaaagaaaaaagttatgtcaaataagacttctctccaattgagacagatcgctttgcatcagcttaccttcactaattcaatttggaataatgaatttattaaaatttcttattatttttttctttatttagacagttctatcgagaaatagtggtccgcaaaagtcgcactacgaaccaagaaccctgtttttgcccgacaattccttgtagtgcaacgccaatttccaccaactgctacaatcgaagtatttccaccacatcaaggacatgagcgacgcgaatgcaagagtcccaaatgctcaagccattcgacaaaatcattgtcattcaaagccagtttttcatgcaattttttcaatgtaaaattttgaaactcttccaatacagccatttaggtatattaagcgctgaaaacatagttaaaagctcaacaatttacaaatgtgaatttttaaaatttaaaattttttgtttgaatccgcggatttggccgaaatgggatgacggactcgtgatcactgatcagcgtccccgaaaaccttgctcatcattgtgttttttgttcttttgtccatcactaattgccagcaaaagacggccaatttgtgatgctttgtcccgtttcttctgccggtggcggagacaaaggcctaaattaagcgcaaatctcaaatttggatatgtataaaaacaaatcccctttttattgctcacccaatgcaattagtggtaccgaaaagccaaaagaacacattgttacaattgttgtcccaatttccgtcttcccaattgaccgccgctgtctctccaattttgcatcgtttcattatccatcggttgtccaattcattttcatttgctttggccaatgtcagcttttcctttgtccattcgttcaccaattcaaatggcaccatttgtattgacggcacatgaacataaaaatgaatttcgtaactgacggaagaaatggcattggcacgaagaaaatgctaaacaatttggaaacaaaaatcagtgatttgtcgagattatgggccacacctccttgaaattgttgatccaatctaagtccgtttgttcgtagtaattatcgcaacgcaatcgcttgggttggccatcttttctcggattgtgcaaccatttggacaatgcttggccagcagaaattgttgaatttggcccatcaaaatcatcaccaaacgcagcgggcaacaaagcaccggaatagattgaattcaattggttgagatcggtgagaattgtcggcgaaatgcgacgacgcaaattgtccaaatgctcagcgtttgaaatggtcaaatgaccaatgtttggcgcaaaaatgggccaaatttcacgaccaaaaatgtcccaaattagttggccattcgtggtatgtgaaggaagccacaaatgtaaatcgatgcctcttttgtcgaaaatttggtgatttgaacgaagaaaagcgatgacggagtgatcaatgtacctgaaaatggaaagaatgcttttaatgtcatagctctgcttttaagtactcaatctgaatagaatcaaagcgaattttgctgggcaacggacggtcgggcaatggaaatggcacaaatttgtcaaattttctatccatttgtacataaagtttcggttctggtcctttgtccttgcgaatttcgattggtctccaaattgtcaattcgcttttgccattgaaatgtt

SEQ ID NO: 46970 - DNA, 1072 bp, Heterodera glycines; identical to SEQ ID NO: 11652
  misc_feature (1040)..(1041): n is a, c, g, or t
  Genomic contig location: Contig_ID=SeqID_11652; Location=1..1072; Strand=+
  SCN-specific regions: Sequence locations=1-519,544-710,732-741,764 -890,912-975,997-1072
  Gene Ontology: Mol. function=translation elongation factor activity; Cellular component=intracellular; Biological process=translational elongation

SEQ ID NO: 46971 - DNA, 987 bp, Heterodera glycines
  Genomic contig location: Contig_ID=SeqID_11653; Location=675..1661; Strand=-
  SCN-specific regions: Sequence locations=1-146,172-367,391-396,419 -461,483-987
  Gene Ontology: Mol. function=ribonucleoside-diphosphate reductase activity; Cellular component=cytoplasm; Biological process=DNA replication
atggacgagccgcttctgcaggaaaacccaaatcgttttgtcattttccccatcaaataccatgacatatggcaattttacaagaaggcagttgcttcattttggacagttgaggaggtatttgcgtgaaatgtttgaataaaacgaatgaaattttaattttgcttttaggttgatttgtcaaaggatatttccgattggaaaagcttaactgataatgaacgattttttatttctcgagtacttgcattcttcgcagcttctgatgggattgtcaacgaaaatttagtaaaattcgtttgtttatttagaattttaattttgctaggtggagcgctttgctcaagaagttcaagttccagaggctcgctgtttttatggtttccaaatagccattgaaaacattcattctgaaatgtattcgctgttgattaactcttacgttaaggattcggatgaacggtattattttcatacattaatccctcctatttgtccttttagtgctaagctttttaatgccattttcgagttcgaatttatcaaaaagaaggccgactgggcccttcgttggatcgcaagttccgacgcttcttttgcggagagactcgttgcatttgctgcggttgaggggattttcttctcggggagttttgctgcaattttttggcttaaaaaacgaggccttttgcccggtctgacgcacagcaacgaattaatttcgcgtgacgaagtttgacttgctttggttttttttaaatatcaaaaaccgcatttccaagggcttacaccgtgactttgcctgtcttctctacacccacctcaaaaacacgccacccaaagaacgcatctacgaaatcatctcggacgcggtaaaaattgaacaggtaattgggcctttgctagacaataaatcgccgttttttgcaggaatacctaaccgacgcacttcctgtctatatgatcggcatgaattccgatttgtaa

SEQ ID NO: 46972 - DNA, 4108 bp, Heterodera glycines; identical to SEQ ID NO: 11663
  Genomic contig location: Contig_ID=SeqID_11663; Location=1..4108; Strand=+
  SCN-specific regions: Sequence locations=1-121,144-413,435-533,555 -663,689-795,827-1178,1200-1228,1250-1390,1414-1963,1985-2312,2360 -2798,2820-2828,2862-3725,3747-4108
  Gene Ontology: Mol. function=nuclear localization sequence binding; Cellular component=cytosol; Biological process=protein-nucleus import

SEQ ID NO: 46973 - DNA, 955 bp, Heterodera glycines
  Genomic contig location: Contig_ID=SeqID_11667; Location=177..1131; Strand=-
  SCN-specific regions: Sequence locations=1-533,555-955
  Gene Ontology: Mol. function=protein tyrosine kinase activity; Cellular component=plasma membrane; Biological process=cell proliferation
atgttcaccgtggacctcaactccgacaagggcttccgaacaatcgaacgattcgtcgacaattatctgcgcaccggagtttccgtcaccactgtaagtcaaacagcttgaaatctttttttttcattttcccttttcagcaacaatacgtcgctctcatcagggccgtgccccgcgcgcactgggagctgtcgcacacttcaatcatcctgggcaatgaacttggccgcggcacgttcggggtcgtcaagagtggcgtctacgtggatcagcaggggactcgagcggcggtggccatcaaagaggtgtctcagacgagcaccaaagagcaagtgaggaaagggggggggggggttggaagtctgcgtccgcatttattaattttcagatcaaggagttcatgaatgaggcgcgagtcatgcggcagctccgacaccccaatgtcatccagttctacggcgtcgcggttggccaggagcccctgatgatcgtcatggagctggcgacggacggcagcctcaccaactacttgaagcagcagcggcggagcgcgcgggtcaaactctacatgtgcctcggcgcagctggcggactggaccacatccactcgaagggcatcatccattgcgacgtcgctgccaggaactgcctctacacggacggcgtggtgggtgaaaaagcaccaaaaaaattttttttgtcatgaaacgtctaaatttgttcattttccccacaggtgaaaatctcggacttcggcatggcgatcaaggcactttcaaagcaaatcgagagaggcgcaaaactgcccgtcaaatggatgtcgccggatgctctgagggaccgcagcttcacccagaagagcgacacgtgggccttcggcgtgctgtgctgggaagtcttcaacaatggcgagacgccgttcgcgcagttgagcggaagcgaggtcgcggcagcg

SEQ ID NO: 46974 - DNA, 463 bp, Heterodera glycines
  Genomic contig location: Contig_ID=SeqID_11667; Location=2948..3410; Strand=-
  SCN-specific regions: Sequence locations=29-30,55-55,141-163,185 -202,263-358,381-463
atgcagatcttcgtcaagacgctcaccgggaagaccatcactcttgaagtcgaggcgagtgacaccatcgagaacgtgaaagcgaagatccaggacaaggagggcatcccgccggaccagcagcgcctcatcttcgctggtacatcaactttcaagccgttgcaacattcaattttatacataacccttattttcagggaaacagctcgaggacggacgcactctggccgactacaacatccagaaggaatcaactcttcatctcgtcttgcgccttcgtggtggaaagaactagaacgacgaacggaagaaatgagtgatctgtatcgatccatatccgtatcttgagactgtcctgtattattgtgttccgttttattcatcatcatgaaatgtatttcaatgaccacggaacgataaatccatcaaaactctgccttaagttctcccgtcggaaaataaa

SEQ ID NO: 46975 - DNA, 1329 bp, Heterodera glycines
  Genomic contig location: Contig_ID=SeqID_11695; Location=402..1730; Strand=-
  SCN-specific regions: Sequence locations=1-237,259-355,380-420,442 -856,879-1064,1086-1329
atggagccgggcatgtacttctacaaaattgaggacccggaagcggataccgactcgaaacatcgtcttcgtgacggcgttccgttgaattggccgggcgaaagcaatttggaaaaattgggatggtttcggtgggaaaagggccacggatgggcggtgcgcaagggactcgagaagataacgcaagcgcaggcaatgcgaaaagggcacggcaagaaaaaactcgcgccttattcagcacatcagcgtggaggactgcaaatcgcagcggtaccgcgccactttcaacgcggaacaatttgtgctgcgacggcactccccggccgaagaaatgccgactccaaagggagcaaatggggaggaagaagccgagggaacggcggaagagatgggcaacttcgacctgggcaatttggtggaggaggagccgtgggcgggggcagtgcggacgagcgaaagggaagttgtgctggaacatgccgagggagtggcactgacagtgagtgccggcaatcgctccgacgtaccaacgcactttcagctgactcttcggactgagtcatggcctcggattgtccaccattcgtccgaactgagcgacttctccggctcaaattgtcttggacagagagtccaacctgtttctgaacctcactttctttgttggtttggcatttgtcggaaaatgggaaacatttcggcacagaatgcgcgggggacactcatcggacagatattcagcagtcaagactcactctcggtgatggagagcatcttcagcattgacatcagcaaatccacgcaaagcaaagcccaacgagcggtggccacttccgtacggtccccgcgtttggtctgtttttatcccatgggaagcatcgaaaagcgaaagtgccatcggctggactttgttcgccaacccctccaggtacaaacaaaagtatagatataatgggtttagaatttttctttttgaggagaaacctccaatgactgatcattggcaaaggcaacgctcggagtgccaaggtaatggccgaacactttgccaacatttcaaatctgaaaatataatgaatggctttagggtgcaacgaacgcggaggttacttaaaaaaacgacgacgacttgcaattgtttcattttccacctcagttgagtcttttctgagcagtttggacccgcgccaatggctggacgggctgaattcgcccgcagagctgttcacatgtctcgtggaattggtgctgtgtctcgttctgctactgctcgctgtcctcctcctgaccaaatgtgtcttcccattgtgccgttgcgtccgatttgtg

SEQ ID NO: 46976 - DNA, 1268 bp, Heterodera glycines
  Genomic contig location: Contig_ID=SeqID_11699; Location=14..1281; Strand=+
  SCN-specific regions: Sequence locations=1-117,139-154,177-313,335 -831,853-982,1004-1099,1121-1268
  Gene Ontology: Mol. function=3'-5' exonuclease activity; Cellular component=nucleoplasm; Biological process=regulation of mitotic recombination
atgaacaccgaagacggacgaattgcccattgtgcgtcttctgatcgcatcggacatccatgccgggttcgcggagaacaaagagcatatcagcaacgattcattcgaaacattccgcgaagtgctcaagattggggtcgactcgaaggtggactttgtccttttgggtatgttttgctcacatgatcaccattttctgttgagcagaaaattgttaggcggaaatggacgatcataaaaagaaattggaaaatcattggttttggaattggtcggtgtttgagtgaataatctccggttcttgaccggtattaattagccattaaatgtgtcagaattcagggggtgaccttttccatgagaatcacccgagccgtgaaacgcaactgaaggtggtccgtctgctacgaaaacactgtttccgcgagggtcgacttggcttggaattcgtttccgatccgaccgtcaatttccaacacagcaatttcccggtcgccaattatttggacgtgaatcttcacgtgaacatgcccattttcacaatccacggaaaccatgacgatttgtccggaaaagtgagtgaactcactgattatgcaaattttcatgttccaacttttcttttcagggtctttctgcgcttgacgtgctccacgaggccgggctcatcaacttgttcggcaagttttgtgatgtcgaccaaattgaagtcactccgattctgttgacgcggggcaacacaaaaattgctttgtacggcatcggaagtcagcgagacgaccgattggcacgatcatttgcaagtgggacaacgatggaacttgaacaacaattaacgattaattgtgttgggttttgcagagggtcgagtgaagttcaatcgccccgacggggatgacccggactcgtggttctccattttggtactccaccaaaatcgaccgccgcgaagcaaattgaggagcaccaaatcccatctctccttcaagcacatccctctcttttttgacttgggttagtcattgcaaatccctgccatttttatggttccaatttttcagtgatttggggccatgagcacgaatgtttgataggtatggaaaacagtttgtaattttgacttgtttcagtgattttcagagcccgatttcaaatacatggaccccaacgattcaaccaaaggcttttacataattcagcccgggagtacggtggcaaccgcactgagtgttgaggaggccaaaaagaagcagattgggattttgtga

SEQ ID NO: 46977 - DNA, 2340 bp, Heterodera glycines
  Genomic contig location: Contig_ID=SeqID_11722; Location=1..2340; Strand=-
  SCN-specific regions: Sequence locations=1-53,77-279,301-383,417 -450,472-475,504-552,574-750,788-796,964-972,1028-1138,1300-1303,1325- 1343,1365-1406,1428-1612,1634-2340
  Gene Ontology: Mol. function=asparagine synthase (glutamine -hydrolyzing) activity; Cellular component=soluble fraction; Biological process=asparagine biosynthesis
aaattttcaaaaattttcgagctaggccccctagaaatttcaaaaatttttttggggtgaaaaagagggtgaaaaatatttttctggggtaaattagggtcctgagcacaaatatgatgtttattttaagtttcagattttttggaatattttaaaaattctttattttttggcaattttttggccctcgggattttggcctaatatttgaaaattcataacaaatcgaagggttgatcaattttacaggaataaagccttaaaaatagagaaaaatcaggagaattttatggactttatttggaatttctatctgtaaaatgaaaaaacttattccagaatttctggaaaaattcgaattttcagaaaaaaattcataactcggttctgaaaagatattctggaaaaataaaatactacaaaaatccgcagttttttgctctattatataaattttatttggcatttttatcacttttttaagaatttttataaaaataaaagtgattttgtgattcgggaccaaagggggtggacaggatttttgagtggaaaaatttttctcacaaaaatcttccaaaaatatgtatttaggtgttatttgggccgctgatcatgattacgtaatcagattttacttttaacatcgataagacctcagaatccctgtgtgattggggattctgagcatcattttgaggggggagggggcaggttcggatccggacggtgtaaattattttcgttatatttatggttatttttaatgtttttatttcatttaaaagagtgtttgttttataataaaaaataaattttttaatttaaattaaattatttttttatgaaaaattttattaaaattaattatttttttaattaaataatttcatatatatttttttatttgagtttttcagaaattaatttaatttcaatctaaataaatttaaattattataagcttcaaagttttttttaataataaaaataggcatttattttacaattttaaaaaattattaaagcatttttgtacctcttctaccatttgttgtacctcttcaaatcgctgttgtttttgggccaaaattcagaattttttaaatagggcaagttcgaacccggacggtaacacattatttttatatttatttttggcttattttaaatgtttttaattaaatgaaaaaccttttgtaaattataaattattttttgatgaataaaagtttaatttaaaaattaattactattttttaaataaagaatttcgtgtatttatataaattattttttgatgaatagattttaaaaaacgggcgcgaagcgcccgtttggccccaacaaaatttaaatgggtgcgaagcgcccgtctaagcccaacaaaatttagaaacgggcgcgaagcgcccgtctggccccaaaaagtctaaaaacgggcgcgaagcgcccgttcttcggccgcgaagcggccgaatgttccccacaaaattaaaaaacgggcgcgaagcgcccgtcccaaggccacgaagctgccgaaaattcccaacaaattaaaaaacgggtgtgaagcgcccgtctaagcccaacaaaatttagaaacgggcgcgaagcgcccgtctggccccacaaagtctaaaaacgggcgcgaagcgcccgttcttcggccgcgagcggccgaatgttccccacaaaatttaaaaaaacgggcgcgaagcgcccgtcctgaggccgcgaagcggccgaatgtcccccaaaaaattaaaaaacgtgcgcgacgcgcccgtcctgaggccgcgaagcggccgaatgtcccccaaaaaattaaaaaacgtgcgcgacgcgcccgtcctgaggacgcggagggggcgaatggcccccagaaagttaaaagactagcgcgacgcggccgttctgacggtgcgatttatcccaatgcttcagaataaaataacaaattttccttagagacattccatgcggtcgtcgtgcgctgtggagttgcccattttctgctctgtaagcacatcgccgccagcagtgaagtgaaagtgcttctctcaggtacgcttaactctcccaaagttcgcttcatcgcttttccaggcgaaggggcggacgaactgttcggctcttacgcttacatgcagcgggcgccgtccgcgccccttctccagcgtgagatcgtccgtcgtctccgactgctccaccaatacgacgttcttcgctgtgatcggtgcttcgcttgttccgctttacctttgctaatttgtcattcaggtgcccttcctgccatggtatttgaaattcggatccctatcctcgacaaaaaattcg

SEQ ID NO: 46978 - DNA, 1085 bp, Heterodera glycines
  Genomic contig location: Contig_ID=SeqID_1668; Location=1..1085; Strand=-
  SCN-specific regions: Sequence locations=1-722,745-822,844-1085
  Gene Ontology: Mol. function=kainate selective glutamate receptor activity; Cellular component=integral to plasma membrane; Biological process=glutamate signaling pathway
gtcgcaaattggacgctggagaaaggaatttggccattgtatggccatttgaacgtggacgtgcaacatttgaatcactaccgtatcgttacaataatcgttgagtcaatcaaatgcaaattgtgtcattcattttctgttgttcgttttgttcagcatgaaccgtacatccaattggtgtcagaaaacgcaactcaatcttcggccattgagaagcccaggccctgtgccagcacgaaacccgtctttctgaacacgggccaacgcgtggagggctattgcatcgatttgctaacgatgctaacagaagtgggctgaccaattaacaacgataattgcccactaattgactgattaaaacgttttaccccctttttcaattgtcttttttagtctctgaatttcacatttgaactgtatttggtcgaagatggcttattcggctcttttgacgaaaatggcaattgggatggaatgattggcgatttggtgttgggcaaagcggagttggcacttggcccaatttcgggtggggatttacggccaaacattcgcctgcctttctttacttttgccctttctttttgccaactttcagtgttggccgagcgtgaaaatgacattgactttacggtgcccttttacgatttggtcggccttggcattttgatgaagcgatcggacgttgaatattcaatgttcaaattcctcaaagtgatttgttgattctctctttccttttttatgtttaattcccaccaaaaggtgctcgaatggcccgtttggatgtgcattttgggttcgttttttggcattttccaactgtttgtcccccaggggcttatctgttcaccagcactttgctttgggtgttcgaccggttcagtccctactcgtacagaaacaacagcgaaaggtacgccgaggacgaggagaagcgcaacttcacatttaaagtgcgcatttgccattcgaatctgtccactccctcccccctttaggaatgcctttggttttgtatgacttcgctgaccccccaggggggcggcgaagcgccaaaaaatgttgcgggttgtttggcggcc

SEQ ID NO: 46979 - DNA, 1547 bp, Heterodera glycines
  Genomic contig location: Contig_ID=SeqID_1669; Location=1680..3226; Strand=-
  SCN-specific regions: Sequence locations=1-533,566-639,662-835,858 -1131,1153-1229,1252-1365,1388-1472,1494-1547
  Gene Ontology: Cellular component=actin filament; Biological process =cytokinesis
atgagtggttgggatgcgtacattcagtcattgacttccagttgtgcggagattactcgcgtggccataattggcaattcggacgcgagtgtttgggccaggactgaaggggagaacgaattcaaggtttgggcttacaattagtaagaatgcctgttctattatggttctctctaatctctggttgtgtttgttttagttaccgactttgttcggaaataaaactcgaaatatataaagggatagattaatttttgcaaataaatcaacaattattcattcaggcgagtgagcctgagctcaagaaacttgtcggccaattcgatgatctttcgcaagttccgtccgtcggtgccgacctcgagggtttgcccatgtgaaacttcggttctctattttgtactttcaggaattcattacattgtgccgcgaacggatgaaaatcttatctttgggaagagggacaaaacggggtttgtgcatttctaaaaataattttttttaccattctcaacccacaaaaatttattacttttccgcccaaattttatttttcccccattttggccatgtttttatgcttttcctcactttcattcagctttttcgctgtgaagaccaagtccgccattctgatcgccatttacaaggacgaggaaagtgtcgtcggcgccgacgtgcgaggggcggtggagaaaatggccaaataccttgaggacgccggttactgagccgttgctcggtttcctaaacgacttttgtgttgccaaacgaaaagtgctgagaatggctttgacttattcttccaaatgcattccttttccatcccaaatgatcacttattattttattattacacattctgtgaagtgcgcgtgccgatttcttttttattatttggcctttggatgtgaataataaaaaggtgtaacgctgagaaccaaaaactgcttttgcttttcgaaaaccttttccatcaatccgttggcgggcaaatgtctccgccaatccaattctgtaattgatacgggcagtccctttaattaatctgacccacaagtgccctgctttttgtttggcttggccttgcgtttgtaattcgagctcacctcgggggggggggggaggaatgtccgttcccttttgccttggcaacattcgccttatttcgcgatgctttttgtctcctttttcgtcttggcattgctttttccccttggtgactccgttctgtccgtcgttgcccctcctccgtctccgttgtctatcagtgcgtttcctccgtcactttccgccgatttcgtcacttttcagccattctcatcgatcgctttgatccgatcgcttccgttttcgtccaacatttgaacgtctctctgctctttttccgggaccactacaaaattgacgatgaaatgctccgtttggacacttttcacgtcgacaggaaaagtctgactttacacgccaacggcactttggactttggcaaaagcgcaatttattcgaaaagttggccaattaattcagtcaaatgctttcattaa

SEQ ID NO: 46980 - DNA, 545 bp, Heterodera glycines
  misc_feature (470)..(470): n is a, c, g, or t
  Genomic contig location: Contig_ID=SeqID_11734; Location=1..545; Strand=-
  SCN-specific regions: Sequence locations=1-278,300-371,393-423,459-545
actgtatttatattgattttcaaaaagcatttgactcagtgccccataatttacttttatacaaattggaaaaaattggtataaagggcaaacttttaatgtggataaagggctttttgagtaataggacttttcgagttaaaattggggattctttatcctcaagtaaaaaagttacctctggcgtcccccagggctctgtcctgggccctttattatttttgatttatattaacgatcttcctgatgctttgccatcaggagtgaaaataaaattatatgctgatgatgataaattatatatttgttataaagcaagaaccgacacagagattatgcataaagcattgcataatttattcgaatgggcaaataaatggcaaataaaagtttcaatgcaaaaaacttttgtattatatttgggttcaaaaaccccaaaagaaacatataaatttgatggaaatacaatnaatgctgtggatacaattagggatttaggagtaaacattgataacaaattacaattttccgatcatattaaccaa

SEQ ID NO: 46981 - DNA, 295 bp, Heterodera glycines
  Genomic contig location: Contig_ID=SeqID_11736; Location=1317..1611; Strand=+
  SCN-specific regions: Sequence locations=1-205,229-295
  Gene Ontology: Cellular component=mitochondrion
aagcattcgttcaccgcatttcattcgcggcggttttgcgcacggcgttcgcggcccgtgcacccaattttacatgctgcccaacactgtccgaattcacgggctccgcaccgcgttgaccctcaaacatgcgcaggacgacttggtcattgtggacagctacgacacgctgaacagcgcggacccacaagttggaggagggtggaaaaaaaaatttttttttttttactagtttttgaacgatttggccgacgcacgcaattggggctattccgtgctgtttgttgatctgtga

SEQ ID NO: 46982 - DNA, 1209 bp, Heterodera glycines
  Genomic contig location: Contig_ID=SeqID_11742; Location=958..2166; Strand=-
  SCN-specific regions: Sequence locations=1-140,162-449,484-491,557 -894,916-1209
  Gene Ontology: Cellular component=actin filament; Biological process =actin cytoskeleton organization and biogenesis
atgcgctttttcctcggctctcaacgcgacgaaaagccaaatgaggatggacaaaattcgtctgacgatgaaatggaaggaggagaggaaggcagccgtaaagagaccaagtcatttctaatcatttaaacatttttaaacgtattttatcttcattttaccattttagatcccttaaagaggtgctgcaaaagtttcgtcatgccaaaaaaacgcgtaaacgcaagaaaaatttggaccaggccaagaaggtcattgtcactgcacagcgcaagaaggaagagaagcgactgcccaaagacatgaagcaatgcaacatggaagccatcaatgccatctacgaccctcagaagttttgtggaccgtctcttcacgacggctggagggtcgtcagcggaacgagaaatacgcgattaggttgaatataatgtctccagataattacatcgaataattttaatttaaaacaattaaaaaaattttcttgcatcgccgttatagctcagtcggttagagcgtgggtctaataagcccaaggtcgcaggttcgacccctgctaacggcactcaattttttcatttttttaccagtttttagacttctccaaattgcactgtgtgctcgagtgattggtgttcatcaactacaaacgcttggtttttactcatatttgcatcgctatatacgaccaaaacagaaggaggtgacacgcattttgctatacgccgcgcaggcgtgccacccattggtgccgtcggatgtcattgaacaattggtaacatctttccttcaagtgtgattttggtgaaaagggtgccggaaagggaagacaactgagcgacaacccaattttctttttggtagaactcttcatagttgtccgaattgaatgaatttaatataattctgaacataacgatatttttttggaattttgcaggctaaaaaaattcaatttgtcaactaaaatgggttttatcttttatctaaaaaccggaagattagtcttattttttactttaatttttttaatgggttttcaaaaactttcagattcgagtggttgcacaaaattttgtttccgaccgcaacacaccggaggcaatcactgtcggcctgaatacaattcgtgaaatttacaagggttgccctgaggcagccactgaagagatggttcgggatttagcggcggtaaagttttcccagtaa

SEQ ID NO: 46983 - DNA, 1766 bp, Heterodera glycines
  Genomic contig location: Contig_ID=SeqID_11756; Location=1098..2863; Strand=-
  SCN-specific regions: Sequence locations=1-358,381-1452,1474 -1532,1554-1766
atgacacacgtatttttcgatcccgagtcggtcgattggtcatcttttatcactccccaacatggaagaggacagaaacaatattttgtcggaagcaagtatcaacggggattcggtttcctcggtaatgtggcacgtttcttgacccctattgcgaggaatattgcctcgagtgcaggacatgaggggctcgccgcggggcagagagttctgagtgacatcgcccagggtcgtgatttaagggatgccgtcagggaacattcaagacaggggctgactaaccttaccgacaagttacaacaatgtgggaaaggaaaaaggtctctgatcactaataagaaccggaaacaagtatatgatcagttaagtttcatctaaaggtataaatggaataaataatacaaaaagttaaaaatgacaactctcaagaaaatcgacacggcgagtgaggacggtctcgaggggggcctttcacttttcgacatccctccgacgaacgttgcaattaataaatccagtattcgggaattactccctctttcagcaataaatcaatctggaccgtatatctttagactttttcagataatcagttttgtgatctcaataaaacttttctttatttgtcaacttcaattgagagaaaagacaaaagcaattggattccgattaccaaggacagtgaagctgaccaacacgtcggtgtcattcaaaattttgggcagagctttgtcaaaacactaaaggtgtcaatttcaggtgttgagtcttatgattccggcatttactatgcgtttagggcatatatgatgaatgaattgggattttcagaagatgtcaaaaagggtctctgtgaagcgtcctgctattatgtcgacgatgtcgaccaggatgattatacaaatagcggctttaaaaacagagcgtcacgttttgctgatggggcgaaatgtgaaacaatggtgaaacttaattttgatctcgcccgtcagcccaatcttttgcttaataactctgatgtcatttttagcatacaccgtaacaccgatgattttctaattatggcaccgccatatgtttcaggaaatgcagtcatagcgaacccgcacacatatcgtattaacatacatgatattagaatttatgtaaaaacagtcgacattacccagtcattaaataacgtaataagcaatcagctacaaaccaccccagccaaatatcctatgagaaaaattgagatcaggagtcttttcatcccacgaggcacttctgatctctcacacaatgtttttacaagcattgttccgagacgtttaattgtcgggtttgtttcaaccggtgcgtataccggaaatcctaaagagtcacccttcgtctttgaacatgcaaaaatacgctctatcggtgtcgaagcgaatggaaacatattccccgggtcaccctattctcttaattttgatagaaacaaatacattcgagcatttgttgacatgtatacaggactcgggatggacgacggtgaaagaacaatgtcgatcaatatacaaaaatttgtaaacgggtggtgtttcttcgtcatcccgatgacctctactctagaggacacccccgggtttgaattgattcgaaacggaacgaccagcatcaaggtacaatttaatgagcctataaaggacggaggttatgagatgatcgttctgggggaatttgattcgattctatctattaatgctaatcgggtgctcagtagcgacggaagcatatga

SEQ ID NO: 46984 - DNA, 2239 bp, Heterodera glycines
  Genomic contig location: Contig_ID=SeqID_1675; Location=1724..3962; Strand=+
  SCN-specific regions: Sequence locations=1-310,332-413,437-629,651 -965,987-1099,1121-1330,1353-1396,1418-2056,2078-2239
  Gene Ontology: Mol. function=myosin light chain kinase activity
atggacttgttttcaaacaacaacaataatagtgccaaaaaagctatttccattttccccgaagaaaatgtcaatgaggatgttattaacaaaagttctggcagttcaagcaactcttccgatggtgtgcctaccgaagaagatgtctttgaggttttataagattttattacattaagcagtacttaatgctaacacatcttaaggtggagaaaattattgcgcataaagtatgcgaagggaaagattattggaaagtgcgctgggttggttatggaccaagtgatgacacgtgggagccgcgggagaattttttggacaaaaaagtgttgaaaatgttgaaggactttgagactgaacagcatgccaaaaaggaaaagcgtaaagaaatcagccgtaaagtaatctttactagtctttcatttgttttaataaacttttagagcattgaatatactcgaagcaaacaggaagaagacgatcaggaggatgcaacagacgaaaagaacgaaagttggtttggcattaagccggatgaaggcacgctcgaacagaggcgactttttgtacctgaccgacgtctctccaagacagaaaaggtcgaatcattatatttttgacaattctgaagaaatgggtttctattttttggttaaaatttgcatatgatagttttccgggatgcttaactaaaaaatgaattcagatttgtgttcgatactccggaaaaagttgtatgccaatctttaacccaaaataaaattttaaattagaaactcatattctttggcgtattttattataattttccttttattatacagttattgaccgaaattggttcatcaccaggagtgcgaatattgcgaagacatttgaaagaacattctgttgaacgtttaatttcacctaaaattgaggaatcgtctccgcaaaaatgggaaattcataaaccaagaaagagtaaaaaattgaattattttatgaaacaatattatatcatttaggaagacgtaacgatgagatttttacatctgagtcgtcagcacaagaagtcttcgaaacaaatgaaaagggtgcagttgctatcccggaaaagcccaaaggaatatcccaaaaaatgccaaatgacaagcggattaaagaagaagtgggaactcatgagatgaaaatggtatttcacaaaaggccaaggcttggcgaggaggaaactcacaattccgaattgggcatcagtaaaagtctgaagccgaagaaattagccaaactcggtcaaaaattgaagttaaaagccgcttcaaaaagagaagacattattcacatgaagaagaccaaagaagagaaaaatgcatcaaaaaaacacgaattgtcgaaggaatcagtgccacacaaaaccaaggacaaacaattgagtaaattagccgtggtgagacttgaagagacagggctggtggttccgtttgcttccgagggagtaaatattgccgcggcattcgaacgtttggcagtggaaagacagacctctctttccctcattgataatccgtttttgatttctcaagaggtacaatgtctgtttatcatcaaaaaacaaagccgattttaggagtttgaggaaatggtaatggatggaaaggtcgagaaagtgcaacaattgctttatggccaagcagcgaacaacttcagcctgaaccgtgtagacgaatttggaaaaactttacttcacaaagttggtctatgtttactcttactgatttcggcttatttctttcagctttgcgagattaaatgtggcgtttctcacacgcaatgtgaattgattcatttgttggtcgcatgcggcggtcgtttaaacattatcgaaggtggaaacagtcaaattcctctccacgtaatatatttctgcaataaatattccttatatttaggcgaaaaattgaaggtaataattagggactggatttgtatggatttccatatttttttttgcacacttatttcggcctaaaaaaccacgtaaatagtatttttagcttggtttaatgcttctaggacacatttttatttccatatttcagatttttgtccatatttgacatccatatttcggcattttcacaaaaaatacacccctaaagatggacaatttttggaaatacaccctaaaatcgaaaaattttgggaaaatttacaaaattttgcttttttgttctaagaaaattcaattttttagtaaaga

SEQ ID NO: 46985 - DNA, 3451 bp, Heterodera glycines
  misc_feature (2665)..(2665): n is a, c, g, or t
  Genomic contig location: Contig_ID=SeqID_1678; Location=863..4313; Strand=+
  SCN-specific regions: Sequence locations=1-106,138-310,589-624,686 -816,840-903,959-961,1035-1056,1320-1325,1349-1421,1444-1538,1568 -1645,1689-1802,1862-1882,1904-2069,2091-2521,2610-2648,2859 -2881,2903-3003,3032-3120,...
  SCN-specific regions: Sequence locations=...3175-3200,3222-3229,3251 -3264,3286-3293,3326-3331,3369-3451
tatgggtatcgcacagtgggccaaccaacgcattgtggggccatgaaaaattggtgcccgaggaggaagtgtggcacgagaaaaacgacgagtaaaaaaaagatccaaattttacaaaattttaaaatattttatatgttttacagtcttcttactatccgtcatcataccgttatggttatgggtacggctacaacaactacggtagcagttacagtggctacagtggcggatatgcgccggatgtgtaccagcaaaactggatcaccagtgagcacaatcgctacagacgaatggtgggttcgatgtgataatttatttaaatgtttttaaattaatataaaaaaggtactaaaaaattttcaatttaaataattaaattttttttttaattttaataaaataaatttttttcactttaattataaaacgaaaaagttgaaagcatttttaaatcaattaattgattgtcttaatattttgggaaaaagcattattattttaaatttattttaattaattctagaaaaaaattttaattttaattaaaattttaatttttttttaaatttatttcttatattaattgaaactaatttagcctttgatcttttcttgggtttctataaatttagaacttttaaaacccaaaaaagttttttctccccaaattttacgcctttttctttgtcactccgcgcaattttcgcgcccaattagtgttcccaatttgtgcaattcatcaaataaatcaccgccccgctgtgacgtgaacacaatttcacgcattttgtgctctgatctttcccctcagtgttaatacaaatttatatttttcacgtgtcaaatttttgcaaaatttgtcacaaaataacaaaaaaaaagaaagaaagaaaaccagggaatttaaaattgaaatttagaaaataaatataactttttttttgtttaataaatacaataatttaaaaaattcaattaaaaaaaaaccaaaatatgttttattaatattaaaaaaaattaaattaatttaacagtgccattttcacaattttcattaattctttttttttaaattaataaaattaattaattgttagcaaaactttaaaatttaaaattttttattataaattatgaaataaaatttaataaatcaaacatatttatattaatttaaaattgatgttttcactgcttacaataagttttttcttggaaaacaaaataaaataaattatttgaataataattatgagcaaaattttatgacaaaaaaaattattaaataaaaaatttaaatgaaaataaattttaatcaggttccagcaacggacatgagaatggtgtattggaatcagcagttggccgcaagtgcgcaagcacatgccaacacctgcgattttcggtgactaattaaaagcaattaaaaagaaattaaaatttggtaaattattatttttagacactctcgaaaccgggcaaacatggcgaaaatatttggtgagtgaaacagaaagactaatttttgcggaaacttttaattaaaattttccatttttatagggccgctccctactacaattacacggacgcaattggacgatggtataatgaggtaaaaaccaaagcatattaattatgctaattaattaatttataaaatttggaaaaataaaaaatttattccaacggaaaatgttgttttatatttttacgaaatgccaaaacaggactaaaattggtaaggaagttcgaacctggcaaaaaggaagtctttttctaaacaaaatcattacaagaaataaaaataaaaacatcaaaaaatttatttttattttaataaattaaaaataaaaatgcatctagaatttcgtaggtgaaaatttatttttaatatttacgacatgccaaaatagacaaaaaaagggtataaaagttcgaacaaaaaatgaaaaaataaaaatcccaaaatgaaaaacaaatgcctgcctatttttcaggtgaacgacccgtggtgtggttgtggcaccgggtacaagcactgctgtggacattacactcaggtcaataaaattaaaatttaaaatgccataattaaatggaattaaataattaattggattcggaattatgtggaaatccaactattcttaaactgaggcctgaaaaccacgaatgatttcttcaaaaaataactgcattcctcgattaaagcggcccttttgagctctaaggatcggaataaatttaaaaaaaaaactttttttggggggattttatcttaaatattataagaaatataactttctaaaaaatttgaaatatatgccaaaaataatcaaaaaatgaaaattttcgaattttaactcaatattcatgaaaattaataaattttagctttattttgtattaatagatggtatgggccgagacaaatctgatcggctgtggatatgcgcaatgtaacggtgtgacgggcgtcggcggttatgcgaaagctgtgtaatgatggattttgaatttttattattttaaatatattttaattaaatagtatggtaaaaataatattgggcaaataattaattataaaaattgaaaaaaatgattatacaagaattaatagataaatgaattggctaggcaaaaataaatgaatatntaattgaaaacaaaattaaatttcattagaaagttatataattaatcgaattttaattagttttatgaaaaacattattttttaaagagatgaattaataaaatattttaaataaaatttactaaaaataatttaattactatgaataatttaaataagaaagtttcaaaaatttaataaaaatgtattaattgcttaaatgaatgtcttaaaatcaaattataaaattctaatttttatcttttcagatttgtctgccattacaacccccaaggcaacaaagtaatgtattacttcaatggaggggattatgcggtcagtagctatgctttttttgcaatttttaaaattttttttgaattttttgtaacccaattttttcaataggaattttttttttgctttattaattcgcatgagttgcttacaacacaatagtgtgaaatgaagtgcgcttttatactaataaataattttaaaaatattattaattattattaaatttaattggcacaaaaagtttaaatcttaattggcttccttttttaaaaagccattgaattgaaataattattaaaaattaaacaaaaagaccatttatttgatttaaatttattattgctgactgtttggcttttccttgctttttctttcgcttttatgtgtcataatttttctccctttattttgtaatttttaacaattaactaatgaggggcttaggtttttcagttcagtctggacctggctccaggccttgatattcctggacctggattttcctag

SEQ ID NO: 46986 - DNA, 619 bp, Heterodera glycines
  Genomic contig location: Contig_ID=SeqID_11792; Location=1540..2158; Strand=+
  SCN-specific regions: Sequence locations=1-272,294-619
atggcgcaacttccaccagaggacgtcgcaacaatgcccacgcagaaggtcgtcttcaacgccccgttcgacaacaaggccacctactacatgcgggtgcgtttggcgtggtgcacgtggcatgcggaataacccctccccctttttcaggtgatcaaccctgggacgaagcgcatcggctacgccttcaagaccaccaaaccgaagcgcatcaacatgaacccgccgaacggagtgctcggcccaaaggagtccgtcaacgtggccgtctcctgcgacgccttcgaccccggcagcgaggacaccaagggcgaccgtgtgaccgtggagtggaccaacacgccggacccagccgccaccgcgttcaagctcgagtggttccagggagacgggatggtgcgccgcaagaacttgccgatcgagtacaacgtctgatggaaggatgcttcgtcacctcaacatggacataataggatcccacccatcccaccgtcccaaaattgtcattttgtcccccatcatgtaaattgttgtacctgtatgtaaatttctgtgatcatcacttcaaatgaatgtatatttaattgttgcctatgtaattgtattgttgttgtgctta

SEQ ID NO: 46987 - DNA, 1955 bp, Heterodera glycines
  Genomic contig location: Contig_ID=SeqID_11810; Location=1817..3771; Strand=-
  SCN-specific regions: Sequence locations=1-489,511-605,648-676,698 -723,758-810,852-875,897-1735,1757-1827,1852-1955
  Gene Ontology: Mol. function=alpha-16-mannosyltransferase activity; Biological process=dolichol-linked oligosaccharide biosynthesis
tgaacttctccttctcttcggcccggcctttcttttcgtttttgtcgtttattggcgtcacatttcggtgctcaaaactttgctcgttggattttgttcgctgattatcgtcttgagtttgttttttatttattttgatttctttcttttcttcattctcttatcattggcagttttgtctgtgcttctcgactctctcatgtggcgtcgttgggtttggcctgagggggaagtgattcactttaatgtgtggcacaatcgtagcagcgagtacggcgtgagtttcacaaattggcccataaattcaaaaagggggggggggtggcgtagacaatttttgaaaaatgcaccaatggggggactttccccctcctgctcttactcgtttattgttttatgagggatacactggaagaaatccctcaacaaattctgttaaaatattcaaattttcccatttgtccctccctttcgtctcctcaggtgttgcccttttggtggtactttttctccgctttgcctcgtgccatgtttctctccgtctttttggtcccttttggccttctcatccatcaacgtgtccaattcgctttggtttcgctgtgtcttcccgcctttctttttgtgcttctcttctcctttttgccgcacaaggaactccgtttcattctctacgctgtcccattgttcaacacttccgttgctgttttttgcgcttggatgtaaaaaatgggagggggcagggacggtcccaggatttcggcttgggggcgagtgcctccccccgggcgacgacctttttgtttcacacccacttttttgcggcggtttttccaaaaacttttgggggacagggggtccggtggtgccgataggcgccgccagggaaattttttgcggttttaaatgcggtttgttaacagattttgtccaaaaaatgaccaaattttgtaattttgagccatctttagcagatttcatcaaaaatctaaaaaattttgatttgctatgggttattttgttttgattttgatgtttttgcattaattgcatttaaagatggaaaaaggctcgcgactcgtggttcttccgcttctgtgcctttttggttgcgttgcatttgctcgtcaatgccattttctccgtcagttttgtttatgcgagcgcacaaaactacccgggcggagttgcactgctcaaattgcaggtgaattctccaatttcaacaaagatttacttatgaagcattttcccgatcactcattattttaaacaattaattccaagcatacgcaatgtttttaatttaagtcagcattccaaaaaggccgcgcccttctggcgcccggccaatttttgggaccatcccggggcgcccgtttaaaagattcggtgtgcatttacgtattgttcagcataagcaccgcttccttcgggacaagccaatcgccgttcacatcgaccaattttcggctgagactgggatcagtcgctttttgcacctctatgacgcgtgggagtgagtgtattgtctaaatgtctcgttcaaggcgtacctttgattccctggcttcgctattgatctttattgccgataattagcaaacttctttacaatcaaatctcattatcagatacaacaaaactgagaatttggcgcaagaggagtttggtcgattcgattacattttggtcggcaattacgatggtcgtcttcgtgctgagatgacaaaaaacaatttgaatgaaacacacacgaaacatttcattgtcaaggcatttcataaggtccaaaaaatgcaattggtttttatgtttaatcaattgatttttagcaattttggaagaagccgactctccccaattggctcaattggtctccgctcaataaactgcaagtgcccgcttactcttacaagccaaaagtcatggtgatgaagcgaaaggacgagtga

SEQ ID NO: 46988 - DNA, 1050 bp, Heterodera glycines
  Genomic contig location: Contig_ID=SeqID_11817; Location=53..1102; Strand=-
  SCN-specific regions: Sequence locations=1-140,162-744,766-1050
  Gene Ontology: Mol. function=protein binding; Cellular component =focal adhesion; Biological process=embryogenesis and morphogenesis
atggacagaatccgcagcagaagatccaatacagcggcgacgcgtggcaaaacacaaaaacatttcgttcacgcgacgcgacgtggtcacggtatgttcaaggggaaaaaacagggagcaaattccggcgttttttgaatggcacctttctgtgtcccttcttccgctttcccaattgatgatccattgtcatcattttcccacagatacaccggcgttgacctccaatcgttggcgctgaccaaacaaattgcgcagtcgcattccggcattttgtaccgcggcaaatggcagaacaacgacattgtggcacgggtgctcaatgtgccgaatgtgacggagcgaatatcgcgcgattttgccaccgaatttttgcaactaaggcgagttcggaaatgaaaattcttgaagcttggcacgatgagagaggccctttcattcattttaaagaaatttatgccacattccgaatgtgtctttcaaaatcctaattttaaaaaaatgcccaatttttgccttttaaattttttttattggattggaaatatacttacaattatcaacttttttgaatttcccattttctcctttttaaatgggggtattgttttttgttaagaatattcgccagtgccttcgtcaaccccgtgttggccgtggtcaaccaaccgccccaactgattgtcatcagccaattcatgcctttcggctcgctttacaatgtgctacatgagcagtcatgtgagcaaaaacttaagcaaatatatgtaaattgatagatcttttgcaatttgaactaattaataagacaaatttttgcaaaattcagctgtggtcatcgaccaccaccaggccattcgttttgcgctggacctcgcccgtggcatgtccttcctgcactccttggaccagcccgtcctgcgatattatctgagctcaaagcacgtgctcatcgacgaggatttgtccgccaaaatttccatggccgacacaaagttctccttccaggaggtcggccgattaagtcgcccgcttggatggcgcccgagg

SEQ ID NO: 46989 - DNA, 1530 bp, Heterodera glycines
  misc_feature (48)..(48): n is a, c, g, or t
  Genomic contig location: Contig_ID=SeqID_11830; Location=1737..3266; Strand=-
  SCN-specific regions: Sequence locations=1-128,151-253,275-331,354 -522,544-587,610-1079,1101-1238,1268-1433,1465-1530
attcttagccaaaatatttacaactttctcctaaaactcttaaaattntcggaataccaatttggttttgttagaaataggtctacgacaagtcaactaataacagttgtggaagattggtatgatgcaattattaatggaaaaaatgcggactgtatttatattgattttcagaaagcttttgactcagtgccccataacttacttttatacaaattggaaaaaattggtatacggggcaaacttttaatgtggataaaaagctttttgagtaataggacttttcgtgttaaaattggggatgctttatcctcaaataaaaaagttggctctggtgtcccccagggctctgtcctgggccctttactatttttgatttatattaacgatcttcctgatgctttgccatcaggagtgaaaataaaattatatgctgatgatgttaaattgtatatatgctataaagcaagagcagatacagaaattatgcataaagcattgcataatttatcagaatgggcaaataaatggcaaataaaagtttcagttcaaaaaacttttgtattatatttgggttcaaaaaacccaaaagaaacatataaatttgatggaaatacaataaatgctgtggatacaattagggatttaggagtaaacattgataataaattacaattttccgatcatgtaaacaaaataacaaggaatgcgtatttacgtatgcgttccttgtttcgaataattaaatccaaatcatctaagatttggattacgttatataaaacttatattaggcctttattggaatacgctccggaggtttggaatccgtctcttcaaaaaaatattaaaaaaatagaaaagtgtcaaaaatatttcaccaaacgggtattttttaaatgcagccttccgccaattccataccaaaatcgattaaaatacctgcaactgccgacacttgagaataggcgaaagctatttgatctgttcatggcgcataaaattgtttatggccgaacagatctgaaactattttcaatttttaatccatcgacacgctttaacatccccttttacagatttaacacaaaatataaaataggcaaaaaattcattccctttgccgggagggtaacaaaattatggaatcaacttgataaagaactaataaaaacaaattctttaaatcaatttaaaacaaaacttaaaaattcattagggtaataaccggaaaagcaaaaacagaattaattttttaagtgattttacatttgtgttatcgatctcaattgactttgacctcattttattcatatattttgattttattttttgatcatccatatatattatatcacttactctacgacatactatctgaacagtcgtcagagtaagtggttttttgcccttctgatgactttttattcacgaataaataaataaataaataaataaataaatttcatctaattacagatttaaagaattaagtttttttcttttatttaaattcattttttgtttttg

SEQ ID NO: 46990 - DNA, 839 bp, Heterodera glycines
  Genomic contig location: Contig_ID=SeqID_11836; Location=39..877; Strand=+
  SCN-specific regions: Sequence locations=1-683,705-839
  Gene Ontology: Mol. function=phenylalanine 4-monooxygenase activity; Biological process=phenylalanine catabolism
atggtggagaaattggctacggtaaatactcgctgccccacggtgggagtgtactgtattttttagtagtaatatgagggaggcgcttttcctaaaagactaaaaaaagtttctcagagtttctcggttacttcaaaatgcttctctggacagatttctaccataacaaaatacagtagaccaaactgctaccgtaatcattgatttgccgactgtttttgtgccccttttttagctctattggttcaccgtggagttcggcatttgcattcaaaatggggcaaaaaaggcgtacggtgcgggactgttgagctcatttggcgaattggaatatgcgctcagcggacaggtgaataaaagacaatttaattttccatttttgtacggatttagtaaatcccggtttatataaatttttccactaacactgatttatctcctctctctattatctgcccccaatttgtagcccgaattggctgcgttcaacccgccggagacgtgccaaaccaaatacccgatcactagctaccaacccaaatattttgtggccgaatcgttcgcggatgccaaaaacaaactcgcgtactgtatttgtcgcgctcgcgttttgagcatttttaaccctccccgctcccgcagtacatggtcaacgagcataccaagacagttccaagtcaactacaacccatacacacaacgcatcgaaatgttggacaatgagagtgcagcaaacaagcttgtccgggatgtgaaaagtgagtcacaaccgtggtgagtcgaagtgacaaaagtgcgaatgagtggtgatcagaaggggcgggtcttttcagtacgga

SEQ ID NO: 46991 - DNA, 2123 bp, Heterodera glycines
  misc_feature (42)..(42): n is a, c, g, or t
  misc_feature (92)..(92): n is a, c, g, or t
  misc_feature (173)..(173): n is a, c, g, or t
  Genomic contig location: Contig_ID=SeqID_11847; Location=773..2895; Strand=-
  SCN-specific regions: Sequence locations=1-72,103-188,210-661,693 -753,795-814,836-837,885-1069,1125-1194,1234-1265,1296-1412,1434 -2057,2100-2123
aagccattttgtcttattttgaaaaaaaaaatttgggagccntgataaaaacacaaatttttaagaaaatgcaattttattattaatattgntatttttattcataatcaattcaacggataaagctttgtctgttgatttggcaaaaaatgtaaaagtttggccatctttgnatgaactatttggccaaagatgggaaagtgaaaaaacggaaaatgaaactgatcaggccccaaattattatgaaagtgatcaaaatgaattaatttatccaattggcaatgatcagaacaacgaacaattcaaagatcagcaaaaaagtgaaattgtttataaattccatgcaataaaagatggaattaagaaaaaagaaaatattcgacaaaaatttggagtaaaattgagcaaaaaattgcagaaaatttgggaattggccaaacaaaaatttacgaatggaaaaaagaattaaaatttaagaaaaacaaaatgaatgataagaattattatgaaaagaaaaagaacgaatttattaaaagaataaacgaattttaaaaaatgccaaaatatggaaaacagaaacaatttgcggttaagagttgggcattgacaaaacaacactaagcagatggaaaaacaaatttggcataaaatgtatcgaatgtaaaattattttaatttaaatttttatttttctgttttagaaggaaatgcgtagttaaatgatcgaaaaatggccaatgaatttttattgtaagctaaagaaagaaaatccttttttaagttacaaagaaataattgttggattcttgaaaatctcaaaaggcaaatggaaaaaacaaaaaataaataaataatttttggctttattttaatatttattaattgttgatcaaatgctgttcattacccttaattattgtactccaatttttttttatgcaaaaattttgcatttgcgcatacgccagtgagaagtgcgagcggtccgcgcattaagttccgcggcttaatttttgtgtcaatgcatttttgggaagaagccgaagggtaattaactaataagccatggatttaatatataaattaatacttgaaatttaaaactgtaaaattattatttttaagttgaaattttgttatcacaagtttaattttttttaatggctttttgaattgattgattaaattgtttggtttaaaatgatattttaatttagttttaaaaatttttttgcctatttccaaaacgattattttcactaaagtaaaaaaatataattgtaatattaatttaaccatcaggagtgaatattaaattatatgctgatgatgttaaaatctatatttgttataaagcaagaacagaaacggaaattatgcataaagcattgcataatttattcgaatgggaaaataaatggcaaataaaagtttcaattcaaaaaacttttgtactttatttgggttcaaaaaacccaaaagaaacttataaattttatgggaatacaataaatgctgtggatacaattagggatttaggagtaaacattgataacaaattacaattttccgatcatgttaatcatataacaaggaatgcgtatttacgtatgcgttccttgttccgaataattaaatccaaatcatctaagatttggattacgttatataaaacttatattaggcctttattggaatacgctccggaggtttggaatccgtctcttcaaaaaaatattaaaaaaatcgaaaagtgtcaaaaatatttcaccaaaagagtattttttaaatgcagccttccgccaattccataccaaaatcgattagaatacctgcaactgccaacacttgagaaaaggcgaaagctatttgatctgttcttggcgcataaaattgtttatggccgaacagatctagatatattaaaaattttcaaaccttctaaacgctttaatgtccccttttataggtttaacacaaaatataaattaggcaaaaaatttattccctttgcggggagggctacaaaattgtggaatcagctggataaagaaatcattaaaataaattctttaaatcaatttaaaactaaaattaaactccttaacgtataaaatgaccgg

SEQ ID NO: 46992 - DNA, 898 bp, Heterodera glycines
  Genomic contig location: Contig_ID=SeqID_11855; Location=35..932; Strand=+
  SCN-specific regions: Sequence locations=1-37,59-263,285-435,458 -662,698-898
actttgcgcagcaacgcaaagcgtccaagagaagaaaagtcaacgaaaccaccaccaaaactgcggcagatcaaaggcttggagggtgcagcaaaacaaagaaatgttcgattcgacccgcgcttttccgcttcctgcgggcaatttgacgaattcagatttcaccaagattactcctttattaacgaacttcggaagacggacatccaggtcaggaatgtgcttttcgttttgttttcatcagatgaaatttggacggaaaagaaacaaaaatatttacacccataagaaaagtttatttatttttttgttacaggaactgaaaaaggcttttcgacgcgcaaaaagggaaggaaactccgccctttccgacagaattcggtgtaatttgcttcgtttggagaatcaacaaaaggttctttaatcacggttacctattttataatttttatttattctaggctgaaatggagagacaaaaaatggagaacattcgattagaattgaggagggggaacattgaacgaatgaaccgaggagagcgcccgatttacctcaacaacggtcaataataattacccattgattctgggcaatttaaaaaaaaatcccgtttagccgaattgatggcccgtgcaaattgcgagaataatgtcgtagcgccaaattcatagaaaaagaaaagagggagagagggtaatgtgaagacgattattgactcttccttctgatccaaacaaaataatattgttcgagttgaaaaaagtataaattttgggtataagaagttgcccccacaaagagaaacgaaaaacgcactctcctttaaatgtgcctcatccaaatcgtttgcttaaaaaaaatcggcaattgtgtagaattgtggtcccgaccaaaa

SEQ ID NO: 46993 - DNA, 1934 bp, Heterodera glycines
  Genomic contig location: Contig_ID=SeqID_11884; Location=1073..3006; Strand=-
  SCN-specific regions: Sequence locations=1-327,350-1327,1349 -1468,1490-1549,1572-1583,1606-1751,1785-1796,1827-1893,1918-1934
  Gene Ontology: Mol. function=heterogeneous nuclear ribonucleoprotein; Cellular component=nucleus; Biological process=RNA processing
atggttgaggttaagaaggaagtaagttaaacatgggttagttgaggtgggataacaacacttaagcgggggagtcgccatcgaaatgggaaaatgattttggtttgaatggtaacgaatttcgagaaacacttttgatgaagactctcacgctttaaaataattaatcgtatttaacggtaatttttatttcattgacaatttaaatccccgggttcctttgataattgaaggaaaatggcatcgaccgatcgcaccagcggagcggcaagtcgggaagtctcgagccggagcagttccgaaaactgttcattggcgggtctgtcaataaaatgttttatgattgttacatactgttttgtcgttttagtctgtcactaaatacaaccgacgagtcactgcatgctttctattcccaattcggaatgctcgtcgattgcattgtgatgcgtgacgcacaaacaaagcggtcgcgcggctttggttttgtttcgtttcaaacagccgacgaggttctagtgtttagcgaattgtttattttgaggtattatgttccttgaggttgatgcggcgatgtccgcgcgtccacacacaatcgacggcaaagtcgttgacccgaaacgagcggtcagtttttcatttatgatgaaagaatgccctttttctttattactaaatccgtatttcattcattatcattccattggaatctgccaattttcttctcatatcaggttcctcgtgaacaatcagcaaaagccgagtccaatgtgtccactaaacggctttacgtttcgggtgtccgagatgaacacgacgaagaatcgttcatgcattattttactgagtttggccccgtcgcaaaggtcagttttcattcctattcgcgagtttacttcgcatattgaaaattataggtggagataatacaggacaaaaacactaacaaagcgcgcggtttcgcttttgtcacattcgacgattacgaccctgtagataagtgagttagtcatgagaaatcccgtcaaaatgtgaaaaaatttcagatgcgtactcctcaagtctcatatgatcggcggttatcgttgtgacgttaaaaaggcgcttagccgcgaagaaatgcaaaaggcacaacagcacgacagagacagaatggagcgagggatgcgttcacgaggttttccagacccaagcgtcattgcatttatttgctggttcattggtttcaggtgtgccaccgcagtacgggggacgtggcggtggttacggtccacccccgcctgcctacgcacagtacggtggcggctacggcccgcctcagccgggctgggggccacccccgccccaatggggtaaggcttcggacatcgccacaaaaggaccatttcaaattggcatatgttttactagattaaaatatcctttttacaggtggttatggaggagggtatggcggctatggacaaggacctccagcagccgcttcgtggggcggtgcaccaccacaagcgcccgctgggccgcttcctgcggcgggtactgcagctgctgagcaggggcagtggggcgcagcggcgcaaggatggggccagcaaggaggtgcttcctggggaccgcagcaagcgggcgcatggggaggtggcggcgcggccggcggtggtcccgcggccagtggcgcctacggagataaaccacaacaggacgcaattggttgtttcttcatttgaaactgtgaaaacaatttctttttaagggggtggctggggtcagccttcaaccgcagttcctggcggcgtgccgccaccacagcagcagcagtggggagcgacgcgttactgattgtgagcaatggtggcacacgacgcttttgaatttaatgcagtcaatcatggaaaaacctttattattttttaatttcgatttatggaattaaa

SEQ ID NO: 46994 - DNA, 2196 bp, Heterodera glycines
  Genomic contig location: Contig_ID=SeqID_11885; Location=584..2779; Strand=+
  SCN-specific regions: Sequence locations=1-811,833-1050,1072 -1598,1620-2196
atgaatgcttattcgaatcgtagctacggaatcaaatacgactacggctccatcatgcaatatgcgagcacaattgcttcaagtgccccgggcaaaaagacaatggtggccaaattgaagccgaccgaaaatgaacggctaatgggacagcgggaaggactgtccctttcggacgtggaagcggtgaagaaaatgtactgccaaccgagtgagagggaaagggcggcacacggacaaactaatcaatcaactaattacgcccaaatttgggcctttgttgctcaatttaaattaatcatctaaatatccctactgtaaccagcaacaattatttgttaaggttgtgacgacaaaataatcttttgtggcatttgggcgacgatgaatttgtgtgagttcagttgaaaatgattatctcaaaatattttatgctttcacatttggcgattattgcttaaggcgacccgcgaatgtggcggagagcggtggtgcacgcgtggattgtggaaaactgccaaaaatcatgcaataaatgcggggagaaagtgcaatcggtcaaagggcaggcggccattttaaagttggccaattgacgcggaaagcgacacaaaataacttttgaatggcattcattgcctttgttctcactccgtttggtgcttttgcttttcccttttttctttttcatatccaacattcgcaattgtctcttttgctcctttcgccccctcccctcctctccgtgttttcctttctctcttcctccttttcttccatcattccgtcctttctcaattccttgccaattgttctgttttcttttccatctttcgccgttacttttgccttcgcctcctttttgaccttaaatggaatggcaatgcttttgaaatgcattttaaattgaacggacaaagtgtcggagaaggacaacgacccaaacaattgctgaggcgacgaaaagtgtggcaatgaaaatgcgattgggctgaggctttttgtgctcaatgatagttcgagtcgtataataagaaaagactccaaatgaacgaaatatttccaaaaagggagcaaatttcctgaaaaatgatttccgacgcaataaaaatgccaaatttcccactttttgtcgaagaaagcgccgaaagactgcactaaaaggaaaccatttttacgaatgttttttgactttttgtcaaaggacttgtgcaaatgaagaaggcgattttcagtgtgaagtccaaatagcccaactgagccctgtcgtattcgaagtggaggaaaatgcaaaggagcagcagaaaatgggcgaggcaataggccttaagccaaacggaaagggacgggtcgtacttttggacaggcaattgcacctgaattagtgaagggttgggagggattagcacagggaacgaaaaataatgagaagccaaatacaaatgggagaagaaaagccatttgaatggaaattcaccgggggaactccgaaagagtggtcatccaacgaagtccagtggaagaagtggcgaatctgaggacaaaaggctgagcaaatcggaaaagtacacagattgccctgctaaacgcacttttgttccagggaaccaacccggagggaagaaaagcgccttcactttgtccgtccatttggggaacactttttgccccttttcgtcctttaagcgccatttgtcgcacaacaattccttgagagtgtgaaactaaaaacgaacgaaaactgattagaagcacaattggaagccgacaattcaggcctggagccacagctgatcaaagcttcgctcgggacggatcagcccgtagaccgggggctcttccttgcgctcggcctcgaaagtgcggaacatccggtcccaaatgatcaaaacaccttccgaatattaaaacagcagttagtacaagtgcttttttcaccgaccaccaaagttacggtcgatacagtatgcctggaaagggaatactcattaatttgctgctggagagagtggcaaagtgcggacattgcgtccgtggtgcacgcggtggtgggacggagtgttgaacacaaagccaagggggccgagagaaccgagcagggaagtgtgcatccaaaactggaagatttcggagaaatagcgatggacgaggaaaatggacggagggatgagaaaggcctgcattggaaggacaatggaa

SEQ ID NO: 46995 - DNA, 1168 bp, Heterodera glycines
  Genomic contig location: Contig_ID=SeqID_11887; Location=531..1698; Strand=+
  SCN-specific regions: Sequence locations=1-231,267-282,357-377,403 -460,486-501,523-752,822-931,954-1168
  Gene Ontology: Mol. function=DNA binding; Cellular component=nucleus; Biological process=Wnt receptor signaling pathway
atgtgctacaaaaagttttccaattttaaatgtgccggtgattaactttttgcgtttcccttccagcaacatcatttgggtgctccaggtggtggcggtggaggctttttctacgcgcatcaacagctgacaccgcccgtggcccctggccaacactcgccgggccagcaacggcactacgcaccgccgccgccacaaatgctccatcccggcatgatgtatcaccaccatcagcagcagcaacaggcacaacagcagcagcagcacatggcatcgccttatcaccagcagcaacaacaatacggagcagtacagcatcagcaacatcaacaggcaatggcagcggcggcggcggcgtattgggcacggacaaacggacagcagcaacaacaacaacaacaaatgccaaccccaccggcacaggttggacggacgggatgggatggaaatgacggcaaatctcaaaaacgagatataatttccctgtcgttcccccactcattttcttttgttcaggatgttggtggtggtgccgtgcctggcgcgtccacctcggctcggcacacgccgcagccttcgtcagtgccaccgcccaatccatcgcccgtcgcttctgccggcccaccgcagcagccggtggttcagtccagtccatctgtaacagctgcgacttcgtcggctccgggcaccgcgtacgatgaatgcggcatggccgacgtcggtactaccgactcggcgcagcgaccacggtcacggcaacagcagcagcaacaacaacaggctgtacatctacaacaacaacaacaaccgccgcaacaccacccgaacgctccgccgcagcaggcgatgatgctcacaccgcaggcggccgctgcccatttgcgttacgcgtccgccgtgccgccttcgcccggcatgatgatgatggtcggcccaccagggggaggaccaccgctgtcccatgggctgcccccgcaacagcagcaacaacatgcgtacgcaccgccgatgggcccgccgccgcatccctcgccgcacatggcgatgccgccgatgcaccaccatcattacgcgacggcgcaagggatgccgcctccgttcccgggtctgtcgtccggcagttttcccccacaattcataggtgtgcgagagggagggagggggccgg

SEQ ID NO: 46996 - DNA, 1269 bp, Heterodera glycines; identical to SEQ ID NO: 11888
  Genomic contig location: Contig_ID=SeqID_11888; Location=1..1269; Strand=+
  SCN-specific regions: Sequence locations=1-454,477-663,685-905,940 -941,966-1002,1025-1180,1202-1269
  Gene Ontology: Mol. function=DNA binding; Cellular component=nucleus; Biological process=Wnt receptor signaling pathway

SEQ ID NO: 46997 - DNA, 1348 bp, Heterodera glycines
  Genomic contig location: Contig_ID=SeqID_11891; Location=190..1537; Strand=-
  SCN-specific regions: Sequence locations=1-3,26-91,113-178,201 -1035,1057-1348
  Gene Ontology: Mol. function=protein heterodimerization activity; Cellular component=nuclear matrix; Biological process=embryogenesis and morphogenesis
atgtacatcaaagaagtgaatatcactggttttcgcagttacaaagagttgacaacagttcgcaatttttcacccaaacacaatgttgttgtgggccgaaatgggagcggcaaaagcaacttttttactgcaattcaatttgtgctgagcaacgatttttcctcattgactctgcaggacaaaaatgcctttttgcatgagggggtcggaagcagagctccaattgcaaaggtcgaaattgtctttgacaacacggacagacgaataccaactgacagtgacgaagttcggataatgcgacaggtcggccagaagaaggaccaatttttcatcgacaacaaaccagtgacacggactgaggtgagccgaatttgatccatgaaaatttgaattttataaactcgaattataaagattgtcaatctgatggaatctgccggattttcgcgctcaaatccctattacattgtcaagcaggggaaaatcactgaattagcaaccgcgtctgatccgtacagacttaagctcattaaggaggtgcgtgctttacacgatgacattggattaattgcatttttattaaaggtggccgggacacgcgtttttgatgagaaaaaggatgaaagcaccaaaatattgcatgaaactcagacgaaaattgagaagagtgttcaattgctcggttatattaatgaacggttgaaaaaattggaggaggagaaagaggacttgaaggagtaccaaaagtgggacaaaatgcgaaggtgcgattgcggtgtatggtgaggatttactactgaatattaagggcaattgagtacacaatttacgatttggaaatcaaagaggcgaggagcaaaaacgagaaactgacttcgcatagagagcgaataaacgcacagcaaaacgaagtcggcaatttgcaactgtccagcaatacaaataaaacgaagcacttaaggtggagacgaagctgatccaagccaaaatgtcaatccaagaggcggagatgcaaatccgtcgattggagacgcattacaaaggcgtgaaggaagagcgtgccaccctgctcaaggagcagacggaccttatggagcgcaagacgcagttggagttggccattagggacttggccgaagacgtagaccgtgagagaagcgggcgcgaaattgcggaacattcgctgcaacaactgaaacgcgacatcgcggagaaggagggccaattggaacagttgcagccccaatttgaacagttgctagaggaggagagtcagctgggctcggacattcgcattggcgagcaaaagtgtcgcgaattgtatgccaagcagggccatcgtgaacag

SEQ ID NO: 46998 - DNA, 3133 bp, Heterodera glycines
  Genomic contig location: Contig_ID=SeqID_1706; Location=8070..11202; Strand=+
  SCN-specific regions: Sequence locations=1-475,504-509,531-638,660 -706,729-747,784-800,846-1036,1059-1163,1185-1615,1637-2288,2310 -2523,2545-2707,2730-3133
  Gene Ontology: Mol. function=ATPase activity; Cellular component =spliceosome complex; Biological process=lariat formation, 5'-splice site cleavage
caccaaaatgtccgtctcttttcccgaagagattatgccgccatcctcaagtgataacccaaaacaaaatccattcaccggcaacaatttttcgtcaaaatattggcaattgctctctgaacgcaccaaactgccagtttggcgtcacagagacgaattcatttctgcgttggcaacgcaccgatgcattcttttggaggcggagacgggcagtgggaagaccacacaggtggacgacgagagaaaacaaatcccagaaattatttaatgcattttaaaatgtgtgcaatggttcatttaagagtgatgtccaaatccccctcccccacagattccccagtggtgcgtccaatggctccgaacccgcgacccccacaacaaatccatggtctgttgcacccaaccgcggcgattggccaccgtttgcgttgcgcagagagtggcggaagaaatggacgttatggtgaaaaaacacaaaaaatattatataaatattataaatagtataacatttgtaacattttgtttcagttgggcgaggaggtgggctattccattcgttttgaagaggccctggccacagcacacttttgaagtgggtattttcacaaaagtattaatgattgaattataattcaattattagttttattttatttgctaaataatacatcataatttagcttaaacttagtcaaattaattaaatttggtattgaaggaagttcttcgtaccctctactatataataactttttgaaataaaatttacaaaaagttgtttaagctaaattatgttgtattatttttaaacaaaataaaaataattattattttaaatatttctatcagtcacccttctcaggtattgcaccgacggaatgcttttggccgagtcgtcccgtgacgaattgctgaagagttacggcgtcattctgctggacgaagtgcacgaacggacgatgatcaccgacgtggtcatgggactcatcaaagtcagtttgccggatccaataatttgttgtgccaaaattgccagattaatttttgagattcttttccatttcgtttctcccttttctcgaccttttcaccatctccttccgttcgctaattatgccttttttagcgtatttccgaatttcgtcccgaattgcgtgtcgttgtgatgagtgcgacactgaaaaccggcaacttcgagcagtacttttacgggtgccatctcatgaaaatcagaggccggtcttaccccgtcgacataattgtaacaattgctgcgctttcccattttggtccattcattaagtaattgaaatgtccgtttagcattcagaaatcaacgcagtgatcgacggcgacaattacatcacaaaatccgtctccaaagccatcgaaattctccaaaagacggaaaggggcgacatattaatatttctttcgggattagaggtgcaaaaaacaacaaaaaataaacgaaaatggccatttaggacattgaaaaatgctgtgaaatggtggaaaatgaggcagagaaatgcggcggaagtggccgattggtaattcacagggaaattgggcgaaagttcaattagaatatatttatttttgttttcgattgtgattcctctctatggctcaatgcaaaacgaacaacaacaaattctgatggaaacacagcaaaaagacggtgggagagagtgaagatttggagagtgaagggggggggggcgattgaagaggtccgattgccgacagattttacattaatagtaaggctcaattttatgggtttatatgtgactgtaaatgccgacaatccgctgggagaatttcttaaagtattgtgatccaacggaatgaatcagccaatgtctcaatttaaacgacaattttccacatttaaacaaattccaatcgaaaaacaccgtttttcacaaatgtttaaggccctcgtcggtgtattgtggccacaaatgttgccgagacttccatggtaattctctttcgcgggaatgtccgaatttaccgctttcccgcgtcagaccatcgatggcgttgtgttcgtcatcgactcgggcttctgcaagcgcaaaatgtacaatgcgcggtccaagttggagtctctgctcgtccagcgcatttcgcgcgcctccgccacccaaagggcggggagggcgggccgaacgcaacccggcaaatgctttcggctgtacacggagcaatgctttagggaaacgatgaaggaaattgtgccggaggtgaaattgccgtgatttttgggggtttaatttgtgcctttctttgctcagataaaacacaccaatttggacagtgtgattctccgactcaaaaagtgcggcatcgacgacatttaccaattccatctgatcgacgcgccttcgcccgactccattcaccactccatccgacttttgacagacctcggagcattggaccgtaagtttaaggaaatagagaaatatttattgtccccacaaagattacccaaaaacggtgtgaatgaaatttaattaataaaattaagaaacagttataaaaaatgattgttccgcaggaattctacaatcgacagaaaattcgtctttgagccgctcaacccgacgaaattttatattttttgctaagttcacatttgataacgttggacaaagcgttttaatcactttttgaacaaatttaaaatcagaattatataaaatataaaataagcttcgtttaacaaagcagctagtcctatgagaattcttcccctgaacggggttaacacttcctctgaccttttaaaacggtcaaacccgaacatatttggtatcgttcgggtgctcttgatgagctatgtctataaattcgagaataaagtcgaacaacgccgtttgagcaccaattaactcgatgggcttttccaaattaaaaccgtttcaaattatgatgatgttctctaataattacatttgtctctcaatgtgtcagatttgggccgtatcactccgttgggtgaacacattaacattttgccggtcgacccgccgttggcccgaatgatgttggagtcggtcaaattgcgctgtaccaaagaggtgatttgcatttgcgcaatgctttccgcgccgaa

SEQ ID NO: 46999 - DNA, 616 bp, Heterodera glycines; identical to SEQ ID NO: 1707
  Genomic contig location: Contig_ID=SeqID_1707; Location=1..616; Strand=+
  SCN-specific regions: Sequence locations=1-186,210-616
  Gene Ontology: Mol. function=ubiquitin-protein ligase activity; Cellular component=nucleosome; Biological process=establishment and/or maintenance of chromatin architecture

SEQ ID NO: 47000 - DNA, 1602 bp, Heterodera glycines
  Genomic contig location: Contig_ID=SeqID_11964; Location=891..2492; Strand=+
  SCN-specific regions: Sequence locations=1-148,193-792,814-1150,1172 -1602
  Gene Ontology: Mol. function=ubiquitin-specific protease activity; Cellular component=SAGA complex; Biological process=protein deubiquitination
atggaaaacgatgcattaatggaagaagatggtgagcagaatcaagaggatgagatgacattggaagactgttggaacatttgttggctcgattcagaacgatgcattgcgcataaaccaccgaagcggaagtaaataacactcaatcagtgttttcatttacttcctttggttaagagcacaaaactgcaaaaagaatccttattgcatccatcggcttggtttggagaagtttgacaaattattgaagactcaacaaacgtccaaagtgctggtacgccgtgaagagtcaaagcaaccgtgtgggttaaataacgccggcaacttttgctatgtgaatagctttctccaggtgtttcttgaaattgattaccttttaaatcatttcctaattttagatttggtttaacgatctcaaatttcgtcaatgcgtttacaactggcgttcctccacgaattggattatgccgcagaatgccaaattgaacattcagacggttatgaactgtctccagcaattattcctcacaatgcaattcactccatttgtaagtatttattctgcagcttgttcacactgcaaatttaaaggaagttaccgacgccaatgactttatcaagttgcttcggttggacaatcaacagcaggacgttcaggaattccatacactctttttcggaacgattgaacgcactctcgaggcgcatccgaacggccgaccagtccttgatgtcatccgccaactttttcaggttttaggaatttcctttctaatctgattatgcgtactcaatatgactgtcttattttagagtcgcatcagtcaaacaatttcctgtgcaaactgcttgcggaccagtgaaacggtcggtgaataccgttctctacagattggcattgatggccatagcactctcatctcggctatccaagctttttttgcgccagaaccgttagttttcacatttgacaactgaaaaagtaaatcgtattttgatgtctaaatataattttagactgagagactttcggtgtgaccagtgccgggagactaattgtgtgactcggtccagcagattcactcagcttcccgaattgctcattgttcagcttaaccgttatgttctagcaaggtccattgttatgcttgttttttaaacctgtctaaatttagcaatggaaaccttcgcaaattacaaaacgccgtgcattacccacgccttttgaccgaacttggaggcgagggaatcccggactatgagctgtgtgctgtgatgattcatgaagggaagagcactaattcaggacattactacgacgtcattcgtgacccggtcatcgaccgttggtttacctacaatgacgaagtacggattgtgtggtcttattatcccattttacgattgtgccccatacagacggtgaatcaaaagcgcacagctcccggctatttgggcagactgactcagaaaccacgcgcgagtgctgacacgacggggtgttatgcgctgatctaccgaagggtgggcagtggcttgagggggccggtgcaattgccgccagagaatattgtgacggaagcaaagaaaagggtcggttga

SEQ ID NO: 47001 - DNA, 1215 bp, Heterodera glycines
  Genomic contig location: Contig_ID=SeqID_1716; Location=900..2114; Strand=-
  SCN-specific regions: Sequence locations=1-521,552-582,604-1215
atgtcgcgcgtctacctgttcctcgagctgtccatccaaaaggaggatggcggcggacgttgggtgcccattgaagctgcagtggccgccgatcaactcgtcgcgcctgcccagtgcgttggacagacatttgtacaacaactcaaggtgggtgtccgtcacacagtccgtttgactataataatcaccaaatttgactaggttgaggtccaaaacacggagttatacgacagcggaaccctctacccctacaaggcgtacttgaccaacgaactgtcctttccgaacagtgcaaagggacactttatggccagcgcgggctaccacccatcaagaaagcacgacgacgcgacggacgccggttttctggcacgctgtgcgcgcttcgcgggcggccgtaaagcacgcttcctttcccggctggacttcgacctgggcaaccaggagctgtatctgttgaacaacatggacgtcctgttcaccatctatcgggcaaaggatgcgttcctgttacaaagtctagcggcggcggcagcagcagcagcggcagcccaacattacgcgctgtacctacacgacataaagctgtacgtgaagatggttgaggtgcaaccatcgctgaacctgtccatctacaagacgctggaaaagcagccggccacctacgcggtacggaagacggaggtgaagtccgtgtttctgaccgctggccgtaccgagatggaccacaacatattttccgccgccatcccgcgccggctgacaattgcattggtggcgaacggagcattcaacggccagctggcattgtcaccgttcaacttcaagccctacgcgatccgtgagatcagcgtgcacgctgccggtcatgtgtatccggcagtgccacaccgcatggacttctccggctgtgcctacattcgaccatttgttgacatgtacgaggcgctgggcatggccaactcggagcgctctatggacatcacgctggagcagttccacgacggatggaccatcttcgtggtgccaatgacatcgacgctggacgacagttgcggctttgaactgctccgctccggcaccaccagcattcggctcgcgttcaacgaagcgataccggcaggcggcgttgagatggtcgtgctcggggaattcgatcagttgatcatgattgactacaaccgccatattgtatccgactcaaaaattgcataa

SEQ ID NO: 47002 - DNA, 3061 bp, Heterodera glycines
  misc_feature (28)..(28): n is a, c, g, or t
  Genomic contig location: Contig_ID=SeqID_1719; Location=14..3074; Strand=+
  SCN-specific regions: Sequence locations=1-198,242-428,479-740,762 -789,820-1025,1064-1168,1190-1304,1326-1805,1838-1928,1951-2059,2081 -2178,2203-2238,2261-2508,2530-2547,2613-2630,2652-3061
  Gene Ontology: Mol. function=oxidoreductase activity; Biological process=epoxygenase P450 pathway
ataatttttttcttaaaatattttgaanttgaatttgcctttttaagtttttggctttaccgtgccacctattggaaacgacgcggcattccatgcccggatgggaagctgttcagtggcaatttggacaaaatgttttgggaggagcttcgcctgtttcagatggccaaatggacggaacagtacggaaaggtgcacaattaaaatataatttttattaaataatataaaagtattttttgatttggtttgttaggtgtacggtttgctcacgggcttccagccgatgttggtgatctccgacccgacaatggtccacgaattgctcacctccaaatttgaatatttccattcaagaatggtgctttctttatcaattcattaattattatcaaaaacgtaactacgaagtgaaaattaataaattgtttttttgtgtctttttgacttttcttttttttctttttttatttcttttaatatttaattattgatttctattacaaattttaatgatcatttaattatgctaatatcaaacttgaaaacatgaaaatctcatcaaattttcttaagccgtgccttctgtttccgtccacactgttcaaaaataagcacatattttccattttttttattaggtttcctccttggaaggcgatgttgacaagaatccccgaatgaatttggtcaatgcgcgcggcgcgcgatggaaacgcctcagagccatcgcaaatccggcattttcaattagcaatttgaaaaaggcaagtttaatcaaaaagaatcatttttatttttaattaaaaagaaataaatcagaacacattttcaagttaatgccaacaattgatgattcgatcaaagtggcaatcgaactgattgagaaagagcgccaagcgcagccaaatgcgccaataaatttacaccggtaaggccttcatttattggcatttcgatgaaatagttttgattaattatatttgagaggaatttttaaataaatttgttatgacaaattacgctttaaaataatatttcatatttaatttttagtttttttgtggagatgacttacgatgtgattgcacgcgtcgccatgggccagcgcgagtcgcgacaattccaatcggaggacgccaaattggccgtgcatgcgtttcaacgactacaaaacaattggtataattgcagagccgggattttattgtaaaaattcgaaggttcacatatccgtcccttaattctgcagcgatcagtttttctgtgggattaatgggaggaaatggggcgggcttgcccagattagagatgtttataaattaatagaaaaaatggcaaaaatgagtgcccttaattaatcgccaaaaattgtgttgctaaatgtttgagtgttgtctaaaaatgtcaaaatttttctcggcggcgcctatcggcactgccgccccccccccctttttccagtttttttagaaaaagcgcgccgaaaaagctcggttgaaaagcaaaaaaaaaaaaaaggtcatcgcgacggccgacgccccttcgcaaaaactttttcctgccctccctctatttaaaatatggtctaatccccacatttaattttaaaaaatatcgaatacatccggattcgagttaaaaagtgaaaaatttgaaccaaggtttgaatatttggccatgttgttcccatggcttggccccactgtgctccggcccatccttttgctgaccgtcaaaatgcgtcgcgatccgttacttctgctgacactcaaaatcagagagcaagtggcggaacgacggcgccaaaaacagcaacaacaacagaatgccaagcatagaaatgctgatcaaaccgaaagtgatcagcagcagcaacagagggtgcccgtcgatttcattgatatgtttttggactctgtgacggatgaggggagcattgagtacagggacgagttgggcgtgttcaacaaagctggcacaaaggtgggccagggagggttggccaaacactcaaaatcattggaaattagctccatttcagttaatgcatccaattatgaccttcctctgttcctaagccatgtttttttttgttaatgcgtacattcttggcatcaccgaaaccttaaagtctttagcttatacaatttaattctgggctaaagttaacaaacaaaaaattattcttgattgaaaaaagcagaattttcttgtttttcaatgtagttttttaggaatatctttatttgctcttttttcttacatttacaaattcatgagactttaagctttcgtttggtaccaagaatgtatggattaacgaagtaataacaaagttatggccaaagaaactgaggatagtcattgttggacgcataaacttaaatagagccgaaaaagttgtattcattattatttaggttttataaattaatgaatttgaaattgttttaagtttaaaaatggaatgccaacattaaggttgatcgaaccaacactgttgacgaaattgaaatgcaattgcaagtgtttcttttggctgggtaataataattaataataataataaaattttctgtttttaatttaattctttttaatttaattttcgcttcgacaccaccgccaattccctgggctttgtcagtttcaatttggcctgtcaccctgaagtacagttgcacctccaagaagagattgctaccgtatgcataagcgaagtgagtgccaaatataattattagctcatgggggattggctcccggtaaattggacaccagtgatcaatcgtcacccatttttggtgcattttgtggcacattgatcatcatttaacccatttattctactcaaatttattttcacctaattcttgattttttttaaaaaggaaatcttagtgtccaattttcctttagtgtccaaaattccggcggtgtccatttttccgcttggtgtccaattttctggtgtccaatttaccggtccccggaggattagaggtcgggaaaaagaatctgaggtcgggcatgcgcccgatttgccatattaaaaaag

SEQ ID NO: 47003 - DNA, 1744 bp, Heterodera glycines
  misc_feature (35)..(35): n is a, c, g, or t
  Genomic contig location: Contig_ID=SeqID_11990; Location=47..1790; Strand=+
  SCN-specific regions: Sequence locations=1-405,427-728,754-944,967 -1103,1125-1189,1212-1363,1386-1572,1613-1627,1656-1744
atgcatgctttttggtaaaatattcaaacaaaatnttatgcaaagaaattataccatgaattacgcaattaataacaaaatagatagcctaatagatatcgaattaaatgctgccttggtctggaaagcacttaggaagttaccaaacagaaactcgacatctccagacgggttaccttatatattgattaagcaatgcgcagatttattggcacctatcataagtgaactctttcgaataatcttagattatggggaaatcccaaacttatggcgtacatcttttatcattccaatttataaaaaggagacaaatcgaatccaaataattaccgtcccatctctctgacatgtactttatgtagggtttttgaacgactattagcatggaacattgttaaacatcttgagaaaaataaaattttaactgatgaacaatttgggttttaaatccaggtcgaccaccacacaattgttggtctccctggattatttttataaatcaatagaaaatggacaaaatattgatataatttttatagattttgaaaaagcatttgattcggtgccaataaatttgttaattgttaaacttcagaacataggtatctgtggaaaaattttgaagtttctccaaaattttcttatatgcaggtcatatcaagttaaaattggagaaaacttttccgaaagctttagaacttattcgggggttccacagggcagtgttcttgggcctcttcttttcttggtttttataaatgaccttactaattatataccagctgcagtcggaattaaattgtatgccgatgatgttaaactttacatttcgcatgataatgacacgaaaagggatttactctctttagcgttggctaacttagccaagtggtctaaagacaatggcatagccattgcgcatgagaaatgcgcagcattatatttaggaaaaaataattctagacatgagtataaaattggcgagaaagtaattttaagcgtagattgtgtccgtgatctgggggttttcgttgatcaaaagctctcatttaacaatcatatttcaaaaattttaaaggcggcctattacaaggcatatcaaattttaaaaatattaaaaacaaggaatatcaataccttaatcctagcatataaaagctatataaggcctcacctcgaatacgcaagcgaagtttggaatatctcctcaaaagaacagagtaaaagaatggaaacggttcaaaaatttttcacaagaatcgtatacaaaaaatgtggcctcaaggctgcatcatatgaaaaaagacttgagatttgcaaattggagaaattaagtaatcgaaggtcgctcactgatatgaatatgactttcaaaataattagaggcttaactcatttagacccaaaaaaatatttcgaattttcaacaagatcgcaacgaaaaacatttaggattcaaaataaaagattcagtaataaatctcggaataacttttttattcgtacaattaatccgtggaattgcttacccaaaacagctatggaaatcggaactttagctaaatttaaaaattttgtgaaagaattttattcagaaaataagtcctgagtggtaattcatccctttttattttttattttatgtatttttactgtattgaccatatcatatttttctaattgtattcattactttgttttccgctataagtgcaactatgttgccttgcggtttgttcaa

SEQ ID NO: 47004 - DNA, 1620 bp, Heterodera glycines
  Genomic contig location: Contig_ID=SeqID_11992; Location=497..2116; Strand=-
  SCN-specific regions: Sequence locations=1-448,476-617,639-989,1011 -1151,1173-1208,1299-1620
atgtcggttatcagcaaatgtcgtcgtccgcaaatgtcgggtaacctttagttcctagctcggttcgaacaaattttttttaaagtttttcatttttcctggaaattcagcaaatttagttttatactcaaaaaagctaaaatactttgaattttcttgaaattttgaaaaaattttcttttgtttgcggcgacgttttggggtgtacccgacgccccccccccccgccccttcgcacggaaagggcctcaaaatgggggaccctttgcaccgaaggggaggggggtgtaaaagttctggggggatgagtcgccggcgaatttcttaaatgatcaaattttcttaacaaattcattaaaaatcccaaaataatttattttctaggaattttttctttgataatttttgtttgagatttttttttcgggggcgaggggcgattgacgcacccattttttaaataaaaaattgaattataccgactctttcctacagcatcagttgaaaatggcacaccgccagcagttgcgggcaatgcgcaacaacaaaaacttcagcaattgtgcgtggcatgccgaagaatgtgtgcctacaattttccggtttgataatataatattttagaagttaatttaaaaaacagttaatttggttaaaaacaatgcagttgcttaattaaagcttggtgtttcgtacaaattggcagattctaccgtacttagatttcctaggctaagttttttttaattgtacgaactgcttctaattcttattcctgtcataaaattattgtaagatttatactattataccgtaccacttttacagtgtttcgtcgcggtgtttggcgaggaggcggacgtgttcagcgggcgactgttgcccattttggagcagttttgccgcgactcggacgacgaagtgcgcagcataattgcctcaggctttcacgaaattgttgcacaacgcaaaattgcgccaatgggaacaaaaaatgccaaaaactcttcgtcaatttcggcatctgtgccattgttgttgggcccatttgtggaccttttgtccagtggaaatgcggacattgtgcaacaattgactgccaatttgcatcgcattttgccaatgttatacgcggaaatcagtgccagcgcaacacaaaagcggacggtaaaatttaaaaatcattaaaatcatatctcaattttggcttttaaatttttttaatattttattttacgatattaagcaatacttttcgtttaaaatttatattaaatttttttttaatttttatttttgagagaaattaaattttttgccatttattacaattgaaattcttttctttcaaatattttttccattttattaattattttcccctttttagcatttgatatttgctaaattggatcgcattttggtcagttgcaacaatttgatgaaagggtccaccggctcatggcgagcccacgaggcgtatttgaatggcattgcagtgttgcgaaatttggtcagcaccaaggatttgctgtccaactttgtgccattgctcaagcagggagtgctaaccgcggtaattgccaaataaattatttattaattgagtacccaattaaa

SEQ ID NO: 47005 - DNA, 780 bp, Heterodera glycines
  Genomic contig location: Contig_ID=SeqID_11997; Location=643..1422; Strand=+
  SCN-specific regions: Sequence locations=1-111,135-366,388-634,664 -722,758-780
  Gene Ontology: Mol. function=transcription factor activity; Cellular component=cytoplasm; Biological process=establishment and/or maintenance of chromatin architecture
atggtgtggtctcgtggaaagcgaaagcgcattgccacggagaatccaaaaatgcacaattcggccatttctcgtcagttgggccaagagtggaaattgctgagcgatgttgagaagcgaccgttcattgacgaggccaaacggctcagacagcttcacctgtacgaaaaatcattaataaattaattggcaaaataatttgttaattacttggtcaaaaaattacaggcaattaaatatattttaattaggggggcggggtcctcttccggtcccgatgtccccgatcttcgattcccttgttccccgacattgccatccccgccttttgtgtccatgacggctcggggaggaaccctaattaattgtttatgataaataaataataatgattcattcctaaataaatccaaattgctaattacatataattaatgaggcattcattggaatttgatttctctttttcagttaaattataatggaaaaataattttttttagcctccaacacccaaattacaaatatcgcccaaggcgcaaaaccaaacatcccattgctgttgacaacatttgccagccgcataataattgtgccaatttgacaacaaaaattggcactttcggaatggaaaaacaacaacaccaccaacaacactttccaccattgaaaatcccgaaaatgaatggtgaaatatgcaataaattcgagattgaaatgccttttaattttttgattatttacttaatatttaatagatgcttaataattattgattga

SEQ ID NO: 47006 - DNA, 1324 bp, Heterodera glycines
  Genomic contig location: Contig_ID=SeqID_12031; Location=2631..3954; Strand=+
  SCN-specific regions: Sequence locations=1-383,406-558,580-1239,1261 -1324
atgtcccgttttgtgtgtgctatttctggaaatgagcccgaggtggctgtggcatcgcccgtctccggagaagtctttgagaaacggctgctcatcaagtacattgaggagaacggcaccgatccgatcaccggccacaaacttgacacttccaacgtttatgtttttgggtggagaattttcttgttatccatgcctaatttggcacttttgtcccttggacccgtgcctaatttctaccattgaaaccttttatggttaacttttctccacgtttttagttggtcgagctgaagcaggacccgggcattcgttctatgcaaaagtgagtccatttatagtgccgttatcaaagataggattacagccggaagagcctccgaatttgaaaatattgtcggaaattattgggattcttaacgaatttcccgtttaacaataattgttacttaaccaaatcggttgaatttttcaaaattttttcattaatttttttttgaaaatccgaaaggattttattatttaagacacaaaattcgcgatatttggattgactatttgataaaacaggattttccattttaaggtcgattacttctggtggtggctcttttttggcgtttgcaaagctattagctgagtggaagtggatagtggtgtgttttgctttacaacttgccttctaattgacactaaatatgacttttccagattaataagaaatttcaaggaaacaaatgaaaattttcactaattggaaaacattttcaaaaaaaaaatcataatgaatcttggaaaatcgctaaattacgattattttatgaaaattttcctgtttttttatttttctggggggacgaagcgcgtgaaacgtcctgctctgtaaatgaacacttaattgttttagattttgctgatcttgcaactcggcttgggtgttattgcggctgacatgtccaccgcgtcgtgcaattgggactggaaaattatcctgtctattgcagcgtttttcctcctgtcatgggtctctgttttggtattcattgctaactcagtgaaaggagaattgtccgcaaaaatagacggcgtgaagacagagctaagggacaaattagatgttgtgaaggcggagctcaacgagaaaatgaaggagatgaacgataaattcaacggagctcgtgtagaaatcaacggaaagttcgaaattatgaaaatcgaattgcgtggagacatgaaaggtctgagtggagagatgaacgccatgaagtctgagctcaatggacggatcgatgttttgaaagcagagatgaatggaaaaagatga

SEQ ID NO: 47007 - DNA, 1117 bp, Heterodera glycines
  Genomic contig location: Contig_ID=SeqID_12037; Location=529..1645; Strand=-
  SCN-specific regions: Sequence locations=1-269,291-364,393-503,530 -604,630-725,771-853,882-982,1004-1117
atgaaaccgaagaagcgtccgatgaagcatccctctgctcccttttcgcgcgactccccgcgctcaaaacggttgaaacaatcaacagacggtgccggcgggaaacggttgttcgttgtgattgaggactgcagtctcgaagtggccaaagtgtgtaatttttgttgcccgggggggggtgttatagctgtttttgtctaaaaaataattcttttactagtaatttgtgggtaaaatccatgcatatgataaaatgtgtgtccggcggcgttcttttttgtgctcccctcaaaaaatatggtttttctcgttggatgttgtaaaagtaggggttgtcggcaattgtgaagattattggtcccacaaaaaaaagaaaaaaaataataaaaaaaccatttttaggggttatttgatgcgctgagcacgaatatgacatccatttcgaccaatttcgaaccaggacccgaatacgaacaaaaagtcgaatattcaatttttcgatttcgcacttattctaaaattgattaaaactagcagaaataaatcacaggtagttttaacagcaaaaataagtcattttatgtagattcaaacatacataaagtaaaaattaaaaaaatttaaattttcgactttattcgaattctggtccggggttcgaaatggatatcttattcgtgatcagcgactttgaaaacctcaggaaagacttttatttagatgactttttataaaaatttatttttaagtaaaaaattaattaaaaaattgttcgaatcagggtttggggttcgaaaaaagtcaaaaaaagatcatattcgtgctcagcgcatcaaataacccctaaaaatggttttttttattatttttttcttttttttgtgggaccaataatctttcaccattgccggggttgtcattaaattaatttctgtcactgaaaaacagcctgtttttttgttaatgggtgaaattaggccataaatacaataaataagcaattggtaatttgtaggtcggcgccgaacacgtcgtgttgtgcagtgacaaacacgcgaattggctgcgcaaacagaacagggacccggcccagttcaggccggacattcttcaccag

SEQ ID NO: 47008 - DNA, 1224 bp, Heterodera glycines
  Genomic contig location: Contig_ID=SeqID_1733; Location=80..1303; Strand=+
  SCN-specific regions: Sequence locations=1-227,256-510,537-637,660 -889,913-1224
  Gene Ontology: Cellular component=chromatin; Biological process =chromatin modeling
aaagaagacatgaaaagtctgatagaactgatcgcccgcagacagccccatttagtggtcatcggaggcgaggacattgacgcgttacgcttaaccaccgatgttcggttgagtataaacgaggctgcccaacagaacttgaaaattcctttgcaactttccgtggaaattgcaaattccgacgccgcgagagtttacatgaacagtcgcatggcaatggtgtcgattagccaattaaaacatttggtctgaaagcaaattattgttttagcaagaatttccgaagtatccgccattgctcctcaaagcaatatcgctggccagatttacgcttgatccgttgatcgaaatttgccatctttgcaacgcggacgacgacattatgtacatgaagttccatccgctgcagaatgaagttccaaagcaagaacttcttttcgcgcttcaagttgagtgcatcaaccgtgttaacgaggttgaaaatatataataaattccattcacaaaatcttgaaattattattattattaggttggtgttgatatcaatcgctgtttggagtttccatacaccgccggcctcttacaattcgtgtgcggtcttggaccccgaaaagcatctcatttgttgaagattctaaaacaaaacgaaaacttattggaaagtcggacaaaattggttacatattgtcggatgggaccaaaggtgttcatgaacgcagcaggatttattaaaattgacacaacgaaagtggctgataggacggactcttatgtcgagtgagtccgtaatttcattattgtttagctttaaaagttttccgttaagaatgcctttgttaaatttagagttctggatggttctcgtgttcaccccgaaacctatgaatgggcaagaaaaatggcagtagacgccctcgaattagacgagccatctgaccaaacaatcgcaatcgaagaaattttgaaggcaccggaaagactcaaagaattggacctggacgcatttgcagaggaattgggcagacaggtctgccgaaccgaattctttgttagttagaagaaataaaaatgtttagggatttggaaacaaaagtatcactttgtacgacattcgggctgaactgaattaccggtacaaagaccttcgaaagcctcatcaggcgccgactggcgaagaattggcacaaatcttgctcaaggaggactgcagcaatttgcaaa

SEQ ID NO: 47009 - DNA, 3060 bp, Heterodera glycines
  Genomic contig location: Contig_ID=SeqID_1734; Location=1258..4317; Strand=-
  SCN-specific regions: Sequence locations=1-318,343-472,494-880,903 -1309,1346-1391,1422-1467,1503-1599,1626-2050,2073-2191,2214 -2435,2457-2611,2633-2691,2714-3060
atgttaacaaattttccaaagttttgttgcgcccctccctatctaaaagtgatctcattgaccgtgcccgactcattacactgtgtaaatctcaacgtgaaaatgacccatcctgtgattatattgtctatgcggggcatgtgcttgcccgcgacgacattcccgcctttaaatctgacctcaattttaaatgtatttgtcataacaaatcttaatgtgttttgggtgaccactcacgaggcaataaccttaatttagctcttttacaaactaaatatagaaaattgaacaccccatagaaaattcgaaaactttactaaataaaaaacaaaattttttatactcaacatttatcaatatgcgatccctaaataataagcttaacgaatttactgcgattatagccctaaaagattttgaattagtttttgtaactgaaacgtgggcaaaagaaaaaatacctttccaaccatttattactaacaattacaaaatatatgaagctagcagaagcggaaaaaatggtggtggagtaatgattttgacaaaaacgagcgtaaattctttttctgtcttatcctgctctaaattcaattgtgaaatccaaattattcagataaatggagcaaaaaaattaagaatagcattacttttacagaccaccgaacacttctgctaatttcacaaaaaagattctgaacctcattggtaactattttgaagaagattttatattaatgggagactttaacctaaatgcaaaggacataacttggaccagtggaacgccttatgctaagtcggaaaaaggaaatattttttgtgaattttttaataagtatggcttattccttatgactaatggacccactcgtggtagtgcttggcttgatctgattctctcttctaaacctgattttgttaataatgttttaattgaggacatttttagttctgatcatctttccactaatttttcattgtcatttcctcagaataagagtaaggcaaatacatttacagtacgcaattataattctactaaacttaatctactaaatttaaacttatcttcaattttaccctacaaattactacaaaaatttaccattgaagataagtttaatcatttttaccttctttttagagaatatgtagaattatacttgcctaaaatcactgtcggtcaaaaatccagaaagcctaattacccattgagtcttaaactgtcaattaaggaaaaagccagactttataaactacaaaaaataaaccgtgataaatatatgcatttgtatgatagcatttcattacatataaaaattcaaataaataactttgttactaaaaatgaaaaaaattttctgaataaaggaaaaaatgctatctacaaatatataaataaatttacaaaaaattttgaacaaatccactctcttagttacgagaaccaaattatttttgatgattatttaaaagcagaaacttttgcaaaaattttccaagaatccttttcaaattcagatgttccgcaaattagcagttgtccttccaatcccaatgaaccatctatttctgatgttgaatttaatgccgatgaaatttctaaaattttaaaaaatttatcgaatcgagaatccacatcccccgatgaaatttcctttagaatcttacgtaattgccaccttactctttctcctgtaatttccgaacttttcagaatatcaatggacacaggcaaaattcctgaaaaaaaatctattgttatacctctctttaaaaaaggtgaccgaaatgatccacataattacagacccatttctcttacttgctgtctatgtagagttatggaaaaaataattgcaaaaagcatttataacttccttcatctgaataatttaatatccgaacatcagttcggttttgttaaacaccgatctgctaatactcaactaattacagtattagaagattggtacgacagcatatacggtaagaaaaatattgactgtatctatgtggactttcggaaagcttttgattcccttcctattaatattttaataaataaacttcataacattggcattaggggaaaactgctaagttggttatctgaatttttaaaggatagattttacagagttaaaattaacaacaaattttctaatttatatccgattcagtctggtgttccacagggttctgttcttggccctctgttatttttaatatacattaatgacctcccgcaggtaatccctccgggagttagcatcaagctttttgctgatgatgtcaaaatttatgtttcttacaaaactcgtgatgaaagaagcaaattaaatgttgctttagacaatattggaaaatgggctaatgcatttggtttaaacatctcccaaaataaaacatttatattatttctcggcaaaaataattcaaaacaacaatataaatttttcaacaatattattaatgaggttgaatctattagtgatttaggcattttaattgataataaattaagattttcaaatcattatactaaaattattaaagctgcttatttaaggattcgcaatattgccaaaattttaaaaacccgctctatacgtatttggaccaaagtattcaagacatacattcgtcctcttttagaatatgcacccgaaatttggaatccgacatacaaaaaagatataaataaattggaaagatgccaaaaatattttacaaaaattgctttatttaaatgtaggcttccgtatataccttacgaacaaagacttgatttattcaaactttagaagaaaggagaaaaacaattgatttagttcaggcattcaaaatcatcaatggtctcactcatcttaaaaaagacatattcccccaattttctggtcacatcccttacaatcttagacgtaaagttgtgttaaaaccacaatccagtaaaacttcaaattcttttatcaacagaacggccttaatatggtctaaactcaacaaagatataacagatgctccatctgttgacagtttcaaaaaacgaataaa

SEQ ID NO: 47010 - DNA, 3129 bp, Heterodera glycines
  Genomic contig location: Contig_ID=SeqID_12049; Location=466..3594; Strand=+
  SCN-specific regions: Sequence locations=1-485,526-726,748-786,808 -1018,1041-1204,1226-1283,1305-1847,1883-2700,2726-3066,3088-3129
  Gene Ontology: Mol. function=DNA binding; Cellular component =nucleolus; Biological process=apoptotic chromosome condensation
atgaccgaagaaagtgaagaatattgtttgggaggcagacctttatctgatctgaaggtggttgaattgagaaaggagctcgaaattcgcagcttgcctaaatctggcaacaaaaaagaacttgttgagcgtttgcaaaattttcttcgagatgaaaagtctgagcaaagaactggaggagagtctcatcaggcgcaaaaaacagcaccaacaatggaattgaaccaatctccgagtggggtttcagtgccgaatgttgtggcacaatatcttgcccagcagcaaattcagcttcaagcagccagacgaagtgccggtgatttctttgttaaataagttaattggtccgtaaatctctttggtctctattatattattattctgatattaaagttttgcttccctcagacagcaaaagtttattcagacaatgagaccgaaaatgttcaataagctctaatatactcttgcacatttcattttaacacccatgataaattattgtccttttttaattaaaaataaccaacgaaaaaatagtatttcccttcaaatacatattaaaacattttttgttcattgtcagataaaataagagccgacacttcactggacgattcagcagaaattatgccaatctcatcaccaactgaggaaatccaaccatcgcttgaacagcaaaaggaagaagaaagtcaagaccaaatcaagcaaagcagcgaatcggcacctgaactggtgaattctgatgtaaaggaaccttcggttgagaaaactgaagaatctgctgaggtattaaaacattattgggtccaaatagccataattaaaattcaacaaaattataacagttacaaaagggcgctgatcaacatttggaggtggaaactgataaatctcttgaggaagaaagaacaaatactgaagaaaaggaggggtcgggtgatggttcaacatcagaaaaggagcgcgaaataaagaaggaggaacggacggaagagaaaacgacggaaccgacgaaggacgaggaggagaggagcagccgaacagaggggacacaaggggaccagcaaatcgaagtcaaagccgagtcagacgaagacgaaactgagaaacccgtagagactgtgaaccgaaccgaaacggtggacacacacgccgaagaaatgtctcctgacaaaagtgccaaggcacgctcttcagttgtggaggaggaattggatttcgaggtttgcgaaagaaagatttggatagttattgttttttgcttcctttgttagaacgaggaagacgacgaagaggaacgcgaagaaccggcggatgacgggggaaagcgccgcgcgcatttgaaacagggctcaccagtgacgatgaaatcatttgagcacaaattgggaccggagcatatggagcagaaagtgaccgatgtcatttccaccagtaaaactgtcgcggtcagcgagtccgaagttgggcctttggtcggccaactgaccgcttcaatcaaagaggagtcgagcaaaccgccggagggacagcaggagaataccccggaggggttcatccggcgcagaccttcttcacccgcgaggcgggctaatcgcttaatgattggatttactcgctctgtttcagacaccctccgtcgcgttgggttcacatcagaaaccttaagcggccgttcacaaaggcggccctctttgatctgcttagtaagtttggcacggtggacactactcacttttggatggattccatcaagagcacctgcattgctacggtatgttgggttcagaatttaagaactgccttagattagaataattgtccttttagatttttttaactttggataaatttttaaaataggaacaagctcttccactttagtacgaaacggacgaacaagcccaattggcccgtgaacggcttcacaacgtcgtatggcccgtggcgagcgatttggcactttgtgtggaattttcaactgaggaaaaggtgatggattattggtgacaaatatacagaaacaaatctcattctgtcagctgaatcgacgaaaggcggaagaagagcaggaagcatcggcgaacaattcggcactcggcggaggattgggattgacaattgtggtggataacagggcatggattttaaaattgataattcacttaaactatggagatcttttccagggccgtgggcctgaaactgtgcccaactcgggccccacggtgctcattcagcacgacaaaaagcgacaaaaggacgcggaaaacagaaaaagaaaaggtgccttttgtgaaattaatggtgatttataaaacggattttagttgaggaattggaaaagtcacagaagactctcgacgaagtgttcaagaagacaaagactctgccggccatttactttttgcctttgtctgacgagggggtggtcattttgttttgttggtccatcggaatctgtgaaattaactccgaattcaggcggtgaaacgacgaaaaaagttgtcagtcgacaaacagcagtcacaacagaatagcacttccgaatcgcaccgaaattcgggcgggaatttgtcgcgaaaccgcccaagtgcgagtggaggaatgtcgcgaagaagcggtggtggcggggaaagcggaggacgaagtcgccagtcgcggcgataaacggaacggcgtgggaggggagggcatggaagttgtgaattcgacgtttgggtgggcagtgagtgagtgagtgcttatgacccaaactcagcgacctttagctgcttctcccctcccctcattcgaatatttctccccaattcgttcctttcgccaagatcaaatgtcactttttgtgtttgtttctatccgctttcagttccgctattttctcaattcgtcgctttattaaaggatttactcttccaagaaaagaacacccaccaattaaccaaattggctgattcaactgaacccgtctttgttgtcgccaaattcgaccaaagaatgctcttccattcattcgttggcattgtgtgaagaatggcatgcgcttgctgaccaacggaaatttatttaaacaatttatttgtttccgtgctgatgttcttttattttgtcttggaaagttaa

SEQ ID NO: 47011 - DNA, 1617 bp, Heterodera glycines
  misc_feature (172)..(172): n is a, c, g, or t
  misc_feature (1159)..(1159): n is a, c, g, or t
  misc_feature (1205)..(1205): n is a, c, g, or t
  misc_feature (1227)..(1227): n is a, c, g, or t
  misc_feature (1344)..(1345): n is a, c, g, or t
  misc_feature (1356)..(1356): n is a, c, g, or t
  misc_feature (1358)..(1358): n is a, c, g, or t
  misc_feature (1362)..(1362): n is a, c, g, or t
  misc_feature (1369)..(1369): n is a, c, g, or t
  misc_feature (1375)..(1376): n is a, c, g, or t
  misc_feature (1379)..(1380): n is a, c, g, or t
  misc_feature (1384)..(1384): n is a, c, g, or t
  misc_feature (1386)..(1387): n is a, c, g, or t
  misc_feature (1401)..(1402): n is a, c, g, or t
  misc_feature (1412)..(1412): n is a, c, g, or t
  misc_feature (1416)..(1416): n is a, c, g, or t
  misc_feature (1422)..(1422): n is a, c, g, or t
  misc_feature (1433)..(1434): n is a, c, g, or t
  misc_feature (1473)..(1474): n is a, c, g, or t
  misc_feature (1484)..(1484): n is a, c, g, or t
  misc_feature (1488)..(1489): n is a, c, g, or t
  misc_feature (1495)..(1495): n is a, c, g, or t
  misc_feature (1501)..(1501): n is a, c, g, or t
  misc_feature (1509)..(1509): n is a, c, g, or t
  misc_feature (1518)..(1518): n is a, c, g, or t
  misc_feature (1525)..(1525): n is a, c, g, or t
  misc_feature (1537)..(1538): n is a, c, g, or t
  misc_feature (1546)..(1546): n is a, c, g, or t
  misc_feature (1556)..(1556): n is a, c, g, or t
  misc_feature (1558)..(1558): n is a, c, g, or t
  misc_feature (1566)..(1566): n is a, c, g, or t
  misc_feature (1571)..(1572): n is a, c, g, or t
  misc_feature (1574)..(1575): n is a, c, g, or t
  misc_feature (1578)..(1578): n is a, c, g, or t
  misc_feature (1581)..(1581): n is a, c, g, or t
  misc_feature (1583)..(1583): n is a, c, g, or t
  misc_feature (1585)..(1585): n is a, c, g, or t
  misc_feature (1589)..(1589): n is a, c, g, or t
  misc_feature (1594)..(1595): n is a, c, g, or t
  misc_feature (1598)..(1599): n is a, c, g, or t
  misc_feature (1601)..(1601): n is a, c, g, or t
  misc_feature (1603)..(1603): n is a, c, g, or t
  misc_feature (1609)..(1609): n is a, c, g, or t
  Genomic contig location: Contig_ID=SeqID_12051; Location=253..1869; Strand=-
  SCN-specific regions: Sequence locations=1-104,131-926,948-1254,1277 -1617
  Gene Ontology: Mol. function=RNA binding; Cellular component=cytosol; Biological process=proteolysis and peptidolysis
aaagattatgctgttgtggtcgcacttatggtaatggtcaatatattctgtatggagggggagttgttaaaaagtgaccacagatgacttttttccgagttttagcgtgcacaaaacgagctttcttcatatcagcagaaagttttcaaattggacgatcatctcggcttgntctatgtctgggcttatttcagatggacgcattttggcgtgagttcgaatacagaaataaagcgaaaatttgagaaatattcataattgcgtgatgtcagtgggaccacaaatctcaaaataaactaactaaagtcgatgggcccaacttttatctattttttggcctagaaaattacacctgaatattaaatttatttatttcagacgctttatgcaaagtgaatgcgccgagtttcgctggaactatcataatccaatttcggttgaactgctcaaccgtaaattaggcttgagtaagtttgaaaatctaacaaattttgataaagagttcgtcaacccccccccttccattgcttgcaaagagagccaagactaattccttatattttatttttttgtcttcttgtaaccgacgccgctggcgaatatattcgacttttccagaacttcagtccaatacccaatattacggacgccgcccatttggtgtgggactgctcatcattggatatgatgttcgtctcttacagcttttccatgtatatttgctttttgacaggacaaagggcctcacgttgtgaaagccgaaccctcgggggacgtgtccgaaatgtttgctgcttcgattggtgctcggtcacaaagtgcgcgaacttatctcgaaaagaacctaccagaatttgagacggctgacagagacgcattgattcgccatgcgattcgctccctcaaagagacgctgcaggcggacgctggcagtttggatgagaatgtgaggcatagcaaaccagcggcaatgagcgaatattcgggtccttttctaatcccagtccagcacgcaaaagttaggaaaagaaatctcatagggtaacaaattgcactcactttcaaaaattttcccggcggcgcttattggcaccgccggacccccattttactttagtacaaatccctgtttttggctctcgggcgctgaattttttanaatagcactggtgtttttgcccgaaaagcaacaaaaaaaggtcttncagattccccccccccccgaanatttttttctggctacgggcttgctttggaaggtgtgcttcgcttcttcccctcccacacgtttctcctcgcaacgcttccttctcctatgatttttttgaaccaattttttgcttnnttttgtgtttngnccgnttccggnttcttnnctnntttncnnctttttgttgttcnngttctcgttngggntttggngtctttctcgnnttggtgcccgtgccgtcttctttttctgcgtccccgttnncttccctttngtcnncgtctnttgcgntcgtcggnttgggtctnccttttncctttttggggnncgtcgccncgcgggcgcntnttcgttcngttgnngnngcngcncncngggnttggnncgnntngnggggcncttttgtc

SEQ ID NO: 47012 - DNA, 1808 bp, Heterodera glycines
  Genomic contig location: Contig_ID=SeqID_12052; Location=139..1946; Strand=+
  SCN-specific regions: Sequence locations=1-194,216-384,406-942,964 -1113,1136-1213,1235-1333,1365-1393,1427-1637,1661-1678,1700-1808
  Gene Ontology: Mol. function=translation initiation factor activity; Cellular component=ribosome; Biological process=protein biosynthesis
atggccgcggatgatagcaatagcgagaaggaatcaaactctttgagcattcgaactgacaaattgctttcggtccctttcaacggagaagagacttccgagaacacatcccaacagcaacaacagcaaacgcccgttgcccttccgacttcatcttctaaaattttatctaaacagcacccactcaagacgaaatggaatttctggtttttgaacaacaaaaagaaggacatggactggttggaaaggttgtcgaaagtttgcacagtttcgaccgtcgaggaattttgggcgtaggttttgtttctaaaaggacatttattatttggttttttagtttttttgacaacattcatcctccatctggcatgtacggctgcgattacaactttttcagagatggaattgaacctttgtgggaggtggcacagaacaaagatggtggtcgactggtcatccaagtaagtcatattccttttaagtcatttgatgaattctcctttaggttgacaagcagcgaaatgagctccttgatggttggtggatggagtttttgttggcatgcattggtgaacaatttggagacgattctgatcaagtttgtggcgccgtttgcaacatccgtaacaaagggtcgaaggtaaaaaacgaatgaattaatcctccactggactaattactttttatttttagatcagcatatggacgacaaatgcgtcggaagaagacaaaaacagacggatcgggtgagttttgttatattttttctgacctaagctgatcgtggaatatttctgtaggcacgtcttaaaagatcgtcttcaagcttccggtggattaaagcctattaagataaatttcgaaggtattatcttgctctattacattttaggcgtccaatcagtgactttcctcagtttcttaagccttaactcttttcggtactttccccttttggggcctatttgtattttaaaaagcaacaaatggagcgtagaattgcaatttttttctcattgcataaatccattgaggaaaacttcgcacaaattgtggcatttatgccctcaagtaactttggcgcgtaatttttggaattctgcgcttcctttgtttaaaaaataaataaaatttaggtcccaaaactgaaaagtaccctcttttcttacttggtcaatgccttctttctttgtatctaaacagctgaaagtatatgattttttaagataaaaatttcagtgctaaaggcaacagacaaaaaatcattcttcaatatattcgtaaaattgattggtcgcctaaaagtcgattgggtggtgcataaatagccttattttaaatgattttctttttccaatttcattttagaccatgaagtggtgcagcagaaggtttgttttttgcttaatttttcaggcatttattttggcttcagacttcgagtgccatcccctgccgcttcatgatttaatgctttgttgttgatttgaaattatattgttagaaacgaaggcaaaattttatggaccgcgccttatgttattggttcggatatgtaccgtgttttatttcattgttttctatttactcacgtatgttagactgataaacgctttatcgtttcacgaaaatttccttaaaccagcttaaaaacataacacacaagtattaataagatcatcaacattgtttgttgttttgacgtcagtttcttgattagcgcctaaaatggtcttagaaaagggtttcacgggatgatatttttatcgcggggggggggcataacggaaaatcaacgcccccctgaa

SEQ ID NO: 47013 - DNA, 884 bp, Heterodera glycines
  Genomic contig location: Contig_ID=SeqID_1739; Location=1914..2797; Strand=-
  SCN-specific regions: Sequence locations=1-170,192-235,258-421,444 -727,750-884
tcctaggccctcttttattcttaatttatataaatgaccttcctgatgttataccatcaggagtgaatattaaattatatgctgatgatgttaaattgtatatatgctataaagcaagagcagatacagaaattatgcataaagcattgcataatttattcgaatgggcaaataaatggcaaataaaagtttcaattcaaaaaacttttgtattatatttgggttcaaaaaacccaaaagaaacatataaatttgatggaaatacaataaatgctgtggatacaattagggacttaggagtaaacattgataacaaattacaattttccgatcatattaaccaaataacaaggaatgcgtatttacgtatgcgttccttgtttagaataattaaatctaaatcttctaaaatttggattacattatataaaacttatattagacctttattggaatacgctccggaagtttggaatccgtctcttcaaaaaaatattaaaaaaattgagaagtgtcaaaaatatttcactaaaagagttttttttaaatgcaaccttccaccaattccataccaaaatcgattagagtaccttcagctgccaacacttgagaataggcgaaacttattcgatctgttcatggcacataaaattgtttatggccgaacagatctgaaacttttctccatttttagaccatcaacacgattcaatattcctttctaccgatttaatacaaaatataaattaggcaaaaaattcattccctttgctgggagggcaaccaaattgtggaatcaactcgataaagagctcattaaaacaaactcttttaacttattcaaaaataaaattaaaaattcttgagtaatgcttatgattgtg

SEQ ID NO: 47014 - DNA, 1579 bp, Heterodera glycines
  Genomic contig location: Contig_ID=SeqID_12114; Location=2259..3837; Strand=+
  SCN-specific regions: Sequence locations=1-1204,1226-1294,1316 -1527,1551-1579
atggatgaagaagacatcgctttggacttggttcgtgataggataaacattgatgtggaatcgggagaattcactgctttggacaaggttggcttgtagttaattaaagaaaatattcacataatcccaaattaggagagtgatgaagtaataggtgacaaaactgcagaaagtgataaacgccttattcttgacttggatgaccaacaagcggggccttcggagcaaaaagtcggcaggagagggcctggacggaagtcagcgaatccgttagtatttgtatatcgtcggcatcattcatccatttgttttcggattcaaggacattggacaatcttctgggccatgcaaacttagaacatgcccgagggcggacaaaggaggccatgacttttcttttcgaagtcatttatcccgttcatttcgactcatttcgaaatttaaggtagtcaagctggccccttaccatgtgcagacatacaaagaactttcggatttgtactcggaattgggccaaaaagagaagagctttgaattcaaaatgttggctgctcttttaaactctaagacaacagccgaagaatgggatgaaatagccgggactgctaagtcgtttaaccggttggaattggctgtcgcatgtttggccaaaggttgttctatgacgtcttcggcactttctttttaatttagcgattcgatgtgaccccgagaattggctttactacgaaaaacgcatccaaattcttgatgcatccggtgaaacggatcttgcaatgaagacacgactccaagctgcccaatcgatcaattgtcaaacttccaaaatcaacttcgcatggatcgataaattgataaaaacggtatttattttgggattttttaccgattgggaaggatacaacgccaacttttaaaatggatactgctcccacttctcccaccacctacattatgaatcagtcccaataaggcagccgattattattgcacgctgaaagacgaagaacgggcgaccgaagcattggaaacgttcattttacggagccgacaattcggacggtccattgatttcgagcatttggctttacttggtatgtggataagcaaaggtcgttttgaggactcagcaaagtcaattcttgcgatgcataacgaattggtcaaggcagtcgatgagaaaggcgacaacgcaatgactgtgaggaaatgggaattatgtgttcatgtgccgaattccaccaaattattatttgttccaggtgcattttacaaataccgattataaattgagcccatttccacctccgtccggttctcattgggtgatcaatgcaaaaatgaattcgcttttgctctcctatctgatcatttgctgggttcatcttggacgcctcgacctcgtcccccaacttattgactgcctcttggagagaccactcggctcttccgacgaagaaaatgcctttttggacattgctcggtcccttcattcaactcatcaacttgtattggccgttgaatatatgcagaaattgagaaaggaaaggcccgagtacaatgaaagcaccgatttttg

SEQ ID NO: 47015 - DNA, 321 bp, Heterodera glycines
  Genomic contig location: Contig_ID=SeqID_1754; Location=67..387; Strand=+
  SCN-specific regions: Sequence locations=1-262,305-321
atggacttttcccgctccgcctacattcgaccctttgttgacatgtacgaggcgctgggcatggccaactctgaacgctccatggacatcacgctggaccagttccgcgacggatggacaatttttgtggtgcccatgacctcgacgctggatgacagttgcggctttgaactgctccgctccggcactaccagcattcggctcgctttcaacgaagagattccggccggcggcgttgagatggttgtgctcggggaatttgatcagttgataatgatagactacaaccgtcacattgtgtctgactcaaaaattgcataa

SEQ ID NO: 47016 - DNA, 2689 bp, Heterodera glycines
  Genomic contig location: Contig_ID=SeqID_12151; Location=142..2830; Strand=-
  SCN-specific regions: Sequence locations=1-27,51-115,137-1203,1254 -1604,1626-2256,2280-2290,2330-2343,2365-2689
  Gene Ontology: Cellular component=COPII vesicle coat; Biological process=ER to Golgi transport
atgccgcaacaacagcaacaggcttttccacctgtgccgcagcagcaccaggcttttcctcccatgccgcatcagcaatccgtgccgcaacagcaacagacttttccttccgtgccgcaacaccaacaacaggcttttccacccatgccgcaacagcaagccgtgccgcaacaacaacagaattttcctccaatgccgcaacaagacgcttttactcaaatgccgcaacaaccgcccacttttccacctgtgtcgcagcagcaacaggcttttcctcccatgccgcaacaacaacagcaggcttttcctcccatgccgcaacaacaacagcaggcttttcctcccatgccgcaacaacaacaacagggtttccctcccatgccgcaacaacaacaacaacagggtttccctcccatgccgcaacagccccaggcttttccttccatgccgcaacagcctcaggctttttcggttggattttacggtccaagtaatttggcttccgtttgctatgactaaaaacagattccggtctctaagttcccgagacttttgctttgtgaaaattcatggcctaggaaactgaggatttgtcattgattggatgcataaactgaattagagcctaaaaagccctttttggatgtacggaccgcaaacatcgagccgcaaaataaatgggaatttaaaaaaaatgttttttttaaagcagggcagcgcttttccacctggccaaccgccacagccgcaacgacagcgtcttgacccggacatgatgccaagccttgtaagtgttggaaatgctgcgcttcatttagtccacgttttttggaaaattcttgcgagggggggcaaggctcttaaatttgcgtcgtcgccattttcccggtttaaatttttttaaattggcgcttaaatttaggccgccattttttaaattgatcattttggttaggttcaagtggctgaggatgaccagagcacgcgttccggactgtttccgaccggctttccgcaagcggaaagcccaccgcttgtcagcacggaaatcatcgcacaggaccaaggttttttttgtggaaccctcggattttctaggcctatttttttacaaatttttgaattttacgccgggatggaaatgattttttaagtccattgatgtggtattggaggcgctaaaaatagtacactgatcgtttcaaatttaaaaaaaaaaattttggtataatttttgataaatttttttttttgaattttcccaaaagtctaacacatttccattgttttccacacggtttgatgggtccatcttggaccaaaaaaacaggctctttcccatttttctacctttttcttcccctcagggaatgccaatccgaaattcatgcgctcaacactgtatgccgtgccgcaaagccaggacatggtcaaggccacccaactgcccctgtcgttggccatctgtccgtttgccaagctgcaccagtccgaggtacgccgcgaaatcattcacttttttaacgccacgttctcgggtttaaatgaaaaaatttgtcagaaatcaatccgattcgattttttttacccaaaaaagtttcgaggataggaattcagagacaattcgacgaaaaataattcttttgaaaaaaaattccgcagtatccgccaccggtgatcgatttgggtgaaattgggccggtccggtgccagcgttgcaaggcgtacatgtgcccgttcatggagttcattgacggaggccgcaaatttcggtgtccattctgccgtgccagcacaccaggcatgttaattaatacaagggttcacccaacgattcaatattttgtgtgatgcttttaaagtggaggatggttattttgcgcatttggatcacaccggacgacgcactgacattcagcatcggcccgagctgtacctgggctcctacgagtttgtggccaccaaacagtactgcaaagtgagtacggagggggggggggctatttcacgctaatttggaccatttttgtcatttaattcaatttttggggccaatcaatttaaccataattgtaaatgtttgttgcagaatggcacgccgcccaagcagccggcatacattttcatgctggacgtgtcctacaacgcggtgcgcaccgggctggtcgagctgttctgccgcaacatcaaagacatcgctcagggagttgccgaggtgtgtggcggcagtgcactacgtttttcatacgaaaatttcaagaaaagaaaatgaaaaagtttaccgtttttcaaaaatttataatgaattttaacttttttaaaaaattttccaaaaaatcgctgaaatttcaaaaataaaattttctttagaattttttttttgggtttttaatgggaaaaagttctgttcggagggataaacgagctgctctctatgggttagaggaggagggggctgacagatttttttagcgattttttcaaaaaaaaatttcagggaaaatttccgcgccggcgcctcctccatgcgcattgggctggccacctatgaccagacggtgcacttctacaacctgagccagcccggtcgggccgaaatgctggtggtcagcgacattgcggaagtgtttgtcccgttcgtggacggcttcttggtcgagtttgaacaggccgagaatgcgctcaccgt

SEQ ID NO: 47017 - DNA, 1139 bp, Heterodera glycines
  Genomic contig location: Contig_ID=SeqID_12195; Location=534..1672; Strand=-
  SCN-specific regions: Sequence locations=1-157,245-248,277-297,321 -330,365-496,528-890,920-1139
  Gene Ontology: Mol. function=glutathione synthase activity; Biological process=neurogenesis
atgctttttaaggtgctttcaacgcctggcattgttgagcgtttctttacgggacccggggaagaagggatggcccaagcaattcgaaaagtgcaaataaaaggctggccaatcggtgccgacgaaaacattgaggaaggcatacgacaggcaaaacataattaaataaaaaatattaatttaatattaaaaattaaaaagtaaagtaaaattgaaattgaaaatttgaagatttttttataaactgcttgtttatatttagaaaaaatgtttttacacgaaatgattttcttagtaattttttaaattcacaaataaaatgaacaatacattttttaaatttttattcaaatttaaataaaaagacgctccacaaaaaaagattttaacattatttattttttatcatatatttgtcctatcatttattgcacattttttgcacctttttgatattttgcgtcatttatttattttgattatgtttttggaacactattaattaaatatttcttaattaaaatattgcagaaagctatggaaaatccacaagattatgtgctgaaggccaatgattgtggcccaacaggaatgtattttaatgaggacatggtaaagaaattgaaaagtatggcgcccgctgagcgcgatttttactacctcacggaaaagctgcgcccaacgaccgttaaggtgagcagcaaaaaaaccagaggattagttattttcttgtaaaaaaataatctcatgggtgtgagcttggctcaaaattcatggaatcgaaacgagtttttaaaaaaatgcaaccaagtacgacaattgccatattttcgactcaaaaaaccgttaaattttcaaaaaaaattttataatcaaaatactcgattcagttatttttaaatttaattttttaaattttcttgtagaatcactttgtccgtccaaatgccaaaccaatgctcaacgttaatgccaatcctgagcttggcatttttggctgcctggtaggcaacatgaaaactggccaagtgttcttcttttcccgaattggccatatgatgaaatccaaaatggacaatgtggacgagggcggagtatggcgcggaaacagtgtgtacgattcaccgtaccttgtctaa

SEQ ID NO: 47018 - DNA, 2474 bp, Heterodera glycines; identical to SEQ ID NO: 12203
  Genomic contig location: Contig_ID=SeqID_12203; Location=1..2474; Strand=+
  SCN-specific regions: Sequence locations=1-179,203-235,257-408,430 -469,493-579,618-1452,1477-1849,1871-2220,2250-2474
  Gene Ontology: Biological process=embryogenesis and morphogenesis

SEQ ID NO: 47019 - DNA, 788 bp, Heterodera glycines
  misc_feature (5)..(5): n is a, c, g, or t
  Genomic contig location: Contig_ID=SeqID_12206; Location=801..1588; Strand=-
  SCN-specific regions: Sequence locations=1-346,369-637,659-788
ctttntgggcatcaaagacctccacgccaaagtgcgaggcagcaccaccaattacatcgctttgacctacgccttcgtcgccggcctgctcaaccaggagacgcaccagcaattggccgaacgcacccgacttcacgtggtcgaactctcccccaatcggcaattctttccgcgaattgtcgcctcgccactgaccgcaccggtcaaagcggacgacgaagttgacacgaaagaggtgaacagcggttacggatttgaaaagctaaggagacaaaatgccaaaaacaatcgatgcccttttagcgaatgaaattggacgaatattacggcgaaggccgtttcccgttgaagaaggcagagccactgcctttctatgccaacagtcctggccatcttcacgccgagtggagaaaacatccgtaccgaaacatggaaaaggtaggcaagggatacgagggacgcccgccgggtacacccccatccaagccatgagggtcgtccccgagaagggcgaagtagacggcacaaatgggaatcttttgtttgggatggcgaattgtataactgtttttttcaagaaaatcatcagattgctcgctgatggagtggtcaatcgatggacacggaaagagcggtacaaatggtcccaaaggagtgtcgaaatggtggcctctgggcggaagccgattccgttgggactcggcctgtcagacgtaaatcccccggagggagaaaaagcattgatcggagggggacggacggccaacgaagcgacggaggccgattga

SEQ ID NO: 47020 - DNA, 1411 bp, Heterodera glycines
  Genomic contig location: Contig_ID=SeqID_12210; Location=669..2079; Strand=-
  SCN-specific regions: Sequence locations=1-636,658-810,832-1390
  Gene Ontology: Mol. function=single-stranded RNA binding; Cellular component=extracellular matrix; Biological process=heart development
cgcgtaaagaacggagcatttcgaaggtgcacttttggaaaggatttccaaaaaaaacttaaaaagttaagaaagccattatcggatttatcgtcgattacgacgaaatgcgccagccgacggcatccgattaccaaaaggtggaggcattttttgatttttcggtttgacagtgaattcgagtttttgcttaagtattatcgccgcaagcgaagcacggagcaaaacacggcgacggaatacggtaaaagcgccggcgaatacggtgccaattccgactacggtaccagcggaggctacggaaaaacggacagcgaagtgaattacccgcgcaagccgaaggtcagtcaaagaaaaagcaccaaaagtcaaatcgttcaaagtttgacattttgcagaatgctcgctgcgtgtgttgcgcaccaaaagtgagaagggattttagtaactttaagctgttttgtgaatgggccaatttttgcaatcaaaattagcataatttattatatttttggctcattttagacatataaaccgtaccaatacggtggagcctatggtactgaaaatggcggatatggtggaaaggacgaatatgagaagagcgaatacagtagaaaggacggatatgataaaaagggatgtggtggatatgagcagagcggatacggcgaaaaggacggatatgataaaaagggatgcggtggacatgaacagagcggatacggtggaaaggagggatatggcggatacggtggaaagcagggatatgagaagagcgaatacagtagaaaggacggatatgataaaaagggatgtggtggatatgagcagagcggatacggagaaaaggacggatatgataaaaagggatgcggtggacatgaacagagcggatacggtggaaatgagaaaagcggatacggtggaaaggacggatacgaacagagcggttatggaggatatgcgcagagcggatatgagaaaagcggatacggtggaaaggacggatacgaacagagcggttatggaggatatgcgcagagcggatatgagaaaagcggatacggtgaaaaggacggatacgagaagagcggatacggtggaagtgacggatacgagaagagcggatacggtggaagggacggatatgagcagagcggatacggtggaagtgacggatacgagaagagcggatacggtggaagggacggatatgagcagagcggatacggcggatatgcgcaacgcggatacggtgaaaaggacggatacgagaagagtggatacggtggaaaggatggataccagaacgagtaccatgattattacaaaaacaatcgctgatcaatgacttatttatcttccgatctttgcagtgattaaagtgtatttttaaataattaataaa

SEQ ID NO: 47021 - DNA, 519 bp, Heterodera glycines
  Genomic contig location: Contig_ID=SeqID_12210; Location=1..519; Strand=+
  SCN-specific regions: Sequence locations=1-221,244-497
agggatgttgttcactttaaacatcaacggtcggtcatttgtcgccactttcgcaaaaccatgcaattttcatgccattgttaggctttttgattcgacagcgtttaaacggcgatgtggaaatcttctgccggcctcgccaaatcatttgttcgcctgaactcagcaccgtccacctgcgcaccgccaacgttgagatggaagttcaggtggtctctccctttgctttattttcctttcatccgatggtttctttccttttcagaccgacaaaaaggcctatgtgaagtacgggtcgaagcgtgtgcacgtgtcgcggagtgggatggtcgtgtcgaatgagaactgttccgcatcgatggaccacattggccgcattgtgtccgcctcttaacttaatgggccgtggtgccaaagtgtaattatgccataatgtgtctagtttctgctattcttttccttcccacaccgatgttaaagtgtactcatgtcctgaatttctgcgatctcattattttg

SEQ ID NO: 47022 - DNA, 3675 bp, Heterodera glycines
  Genomic contig location: Contig_ID=SeqID_1765; Location=1152..4826; Strand=-
  SCN-specific regions: Sequence locations=1-57,80-184,206-394,415 -433,462-1260,1282-1336,1366-1685,1707-1770,1792-1961,1984-3265,3287 -3371,3393-3675
atgccttcatcaaactcattctatgtgatcgttccttccaacacaaatgttgaaggaaatcgcacaaactcttttcgagttcgactaccaagaaaacttcaatttaattcggaatgggatgtgggcttaggtgtgatcatatacccccattcgtggccctcactcggcacatcagaggaccaatttgttcaaattgaatggaaaattggagagaatgttcaaataccaattccatcctctaacgtgacaaaccccgttgagctgtggaaaagactttacaaactgcttgaagaaggcaacaaaccgttcgcagttaaagtggaaggcgtacagaaaaaattcactgaagcggccaatacagcacgtcaattgggcagagccgagtacatcaataaacaacaacaacaacaacaaagagacaaaagaaatgttaatgatgatgatgatgatgatgatgacgaaaacgaagaacaattattaaacgcccttttagcgggggttgacacgttgcttgacctttacggagcaaccagtggtggtctacttgagagagaaaaacgtgcagcaacaagcaaggtccccctgcggaattgggatgacactgaagaggaatatcaggaaaagcttgataaatattttttgcgtctacgtggccgtaatttagaacgcttagagggactgataacagaaaagttgaatgcggaaattgcactgatggatgacgaagaaaggaagattctcgatcaaaccaaagaattaggcatgacagcatggataaaagttttccaatcagcgtactctgcatgtttcctgcattttgacagtgcaacgaacagattttcgttgaaactggacgatcgttatgtgcagaaaataaaaatttcagaccaattggcctacattttgggttttaactcaaccgatttcactgaaaaagaaacgattgcaaaatttatgccagacatgagtggaggagttgcttcttttcatgtttatgcacctgatctaattgaaccaatgatgattggtgacgtgattgccccagttttgcgtatcgttacgattcggggaaaacctgacgaaattatagaggagcagtttctctccgtccaataccatcgcgtactagtcaaagaaataagtgaaattttcatcgaaatcagaacatccggtggtagcctaatgccatttcaatacggtacatgtacattaacgctacactttagaaaaagttcctacttttaaaaatgaacagtgttcaaataaataaaattcttgctcgaaacccagtcacgcgttcgacctttttagggtgttttccatcagatcaaattccagcagtagcagccacaccagctccttattcaatggtgattaacgttgatccgagcggttcacctggttcacattgggttgccgtgtattgcgagcagcaaaatcgggtggaatactacgattcgacaggaatttggccaccgctaagccctttcatccaaaaatttttaaagagttttgctcaaattcagtttcatcaactttcgctccaagcaccatactcacactcatgcggaaagcatgtgattttctttatatttggacggtgtatggggatgcactttgaagcaattttgcaactgctaaaacgcgcaaaaatatcaccagatttttttgtgaacaaatttatgcaaaaaatgtgtttaaacaaatataaataactagaaaactcaatttaaaaagcgcaaaaaaaaaaaagaaagaaaaatgcacgttgattttgatccttttaaagttgaatggtcagcattaacccaaatttctccagaagtagtcgtccaatacggtggttataatgtgttcagaggggttccataccagcgcggtagtggtatcgggtctgtttttaggagtctattgcgttacctaataccaatcgggaaagaaatcgggacggccatcgggcgccaaggacttgaatctggaaatcgagttctatccaatgtattagagggtagggacctcaaagagtcacttgtcagtgagggaaaaacggggctcaaaaatttgctagagaaagcagccaacaacataaatgcccaaaaaggtcaagggttcgactttaaacgatacacaaagagaaatgatgcaagagaaggtggtgcatttggtaaagcgaaaaaaggtataaataaactacaatcaaggttgggaccacacgatttcctaccagcaaacaccccagcaggtcggaagaaaaaacacactaaacagaaatcggtcaaacgccttcgtaccgatatacttggaacctattaataaaacacccccccccccccccccagaagcacaatcatgagttgttcacaaaaaattagcgaaagtagtccccttgccacaaatagtgctttgaacatattttcagtaccttcaacaaatgtgtcggttgtgcgctcatatttccgtgaagtcctccccctagtgacaataacgcaagaatctccgtatctttttcgcctgtacagtgacaatctttggaccgatctttcccggatttatctcttccttgacctttcaatagaaaaaccggatgtggacggtaactgggtgtcaatcgcagctaccgatgctcaagtcggcaccattcagggaattggtcaaacatttgttcaacaactaaaagtctcagttggaaacactgaaatttacgacagcggaaatttgtacccatataaggtttacattacgaacacactttcgtttccgatgaacgtcaaaaaaagcttcctcgcttcaactggtcactatgcgacacgcacacacgacagcgtcgctgatgagggctttaaagctcggtgtaaaatttttgagggtgggaagcgagcccaatttctttcacgtctggactttgacctgggaaaccaagaactttatttgttgaacaatttggatcttttatttacaatttacaaagctcgtgacacttttatcatgcagacattgaaagcaaacgatactaccagataccgcgttagagtccatgacgtaaaactgtatgctaaaatgattgatgttcagtcatctttgaatttaagtatctacaaaacgcttgaaaaacaaccagccacatatgcagtgcgaaaaactgaaatcaaatcatgctttataagtgaaggtaggtttgaaattgactacaatgtattcagtgcaacaattcctcgacgtatgacaatcgcacttgtcgcaaacggggcatttaacggaaattatgctctctctccatttaattttaaaccgtttgacatacgagacattgccgtgtacgctggcggcatgatttacccaattgttccatacaagcttgactttgccaaagatatttttgtccgtccttttgttgacatgtatgaggcacttggcatggctaattcagagcgttctttcgacatcacaaaagagcaattcaaatctggttggaccttttttgtaattccactcacatcgacgctcgacgatagcacagggtatgaactcttaagaagcgggacaactagcattcgcgcaacatttaatagtgcaattcctgagggcggagttgaaatgatagtgctgggtgaatttgaccaaatgataatgatagactacaaccgtcacattgtttccgattcaaagcttagttaa

SEQ ID NO: 47023 - DNA, 1151 bp, Heterodera glycines
  Genomic contig location: Contig_ID=SeqID_12239; Location=669..1819; Strand=-
  SCN-specific regions: Sequence locations=1-233,255-529,552-1125,1149 -1151
atggcaaagaatatgaacagcagcggacacagcaacctgcccacttcggtggaaggtaaatggaattttttgaaaatatttttttgatctttgccagctgtcgaagtggagtttctcgccttcactgaccgactttcggcgacactcaccgaatgcgagggactgaccattcgggcactgaatcggatccctgcagagaatgacctcatccttggtccagaggtacattggacgggacgggatggtttcatcggattggtgcaattgccttccccatacatccattgatttcttttcctaccaaagagttccccaatcttccacttttttctttttagctttctgatcgtattctttccgcgattgctgcacttgaaaaatgcatgtgctgtctgaacgaatgctgcgcaatggccgtctcccaactgagcgccgtcgactcggaaggccttcccgcgcagcaactgctcgaatttctgcgaggtgaagtggaaaaattcgcaggacgtcttgacaatcagcaacaggtcgccttccatattttgtaagttctttccatttttcaattgtctttttccgttattcgtttaatttttgcctttatttcgtactaaattattatcggctgtcaattgcaattttaaagtgatgaacgtgagaggggccttgaacttgtcagaacggtgcttgacgagctcagtgtcgcgctggagaattcgtcgatggaacttccgccaagcgccaaagacggcgatccaacgcggaacggttcccccctgacaatcaatggaaatcccttcgttcctctaaacgaacgcgcgtatggacgtaaaaaggaagctgttgaggcggatggaatccgctggcaattggccaaaaaggacgaggaattgctcaatttgcagaaagcgctcaaagagcgcgacagtgaaattggcacaatgaaagtgggagaattctcaaaaatgtcgtctcaaatagcatttatttgttcagcttcgggtggaaatggcaaagactcagttggcagaaacgacggggaaaggcggcatttccgtggagatggaattgcttcggcagcgatgcaccggcttagagaacgacttgaagagacagaaggagtgcgtttttaaaaagtattatttaataaa

SEQ ID NO: 47024 - DNA, 1381 bp, Heterodera glycines; identical to SEQ ID NO: 12285
  misc_feature (1124)..(1124): n is a, c, g, or t
  misc_feature (1174)..(1174): n is a, c, g, or t
  misc_feature (1198)..(1198): n is a, c, g, or t
  misc_feature (1247)..(1247): n is a, c, g, or t
  misc_feature (1285)..(1285): n is a, c, g, or t
  misc_feature (1288)..(1289): n is a, c, g, or t
  misc_feature (1308)..(1308): n is a, c, g, or t
  misc_feature (1311)..(1311): n is a, c, g, or t
  misc_feature (1315)..(1315): n is a, c, g, or t
  misc_feature (1318)..(1319): n is a, c, g, or t
  misc_feature (1321)..(1321): n is a, c, g, or t
  misc_feature (1325)..(1325): n is a, c, g, or t
  misc_feature (1328)..(1328): n is a, c, g, or t
  misc_feature (1332)..(1332): n is a, c, g, or t
  Genomic contig location: Contig_ID=SeqID_12285; Location=1..1381; Strand=+
  SCN-specific regions: Sequence locations=1-35,58-147,261-274,346 -872,895-958,981-1381
  Gene Ontology: Biological process=jump response

SEQ ID NO: 47025 - DNA, 2687 bp, Heterodera glycines
  Genomic contig location: Contig_ID=SeqID_1772; Location=2135..4821; Strand=-
  SCN-specific regions: Sequence locations=1-49,71-75,97-353,379 -390,414-483,507-750,773-1388,1410-1621,1649-1804,1827-2354,2376 -2478,2505-2687
  Gene Ontology: Mol. function=single-stranded DNA binding; Cellular component=chromatin; Biological process=DNA dependent DNA replication
atggaggatcaaccacaactttcacaaggatttttccaggtctttaaagtttttccttctcaaactaatcaatctcttctgtttttagacttttttggatgaaaaagtgccggccgactttcagccgattttgcaagtgcttgagactcgtaccattggctcatcgtcggcgatgggcggctatccgccacaggggcagcaaatgcgggctcgtctcagcgacagtttgtactcgtacagcggttgcgtcattccacagacggtgacgcggcggttccaagacgacgggctgagcacccacaacggcatcatccaagtgaccagttggaaacgggtcgacgggtaaaatcaaacactttgaatattccactttaacatcaaattgtaaggaaaaaataataattaaaatttatgaattggcaatattcgtagtgagatgataaaaagaaatagcaacagttatacatatttcagtggaaagctttgtttcttccaagtgttggattatacgctgtactcgcttgactttcctgtcattggcaacccgcaaccacacagtggaaacccggcggaatttcgccgagttgttcaggtggcgtaaattgtcaaatttattgtcaatttttgtttcgattactttcttattagcctcaaaaagattccgacactcagcagacagcggccgaaagtgtcgccctttggcgcggcacccaagtgaaagacgagcctgaaaacgcatggggcggcggtgggtccgcgaagagggggcgcggctcgtcaccctcagaccagcgacagccgttgcggaagcgccagccggatgcgggcgcgcaaatggcacggatgggcgttacaccgatcgaagcgatcaacccgtacatcaacaggcaggcggaaaatctataattaatacgggaatgcttcaagattagaaattgaaaattttggacggacccgtcggattttaccttgtttatttgattatcagatggcgcatctgtggcgtggtcagcggaaaggatgcttccatcaaagacctgacgagtccgcgtggttccttccgcgttttctctttcaatgttacggactcaaaaggcgttgcaattcgaatcgctgccttcggggaacaggcggacaaattctttccaatcgtcgaaaatgcgaacgtttgttttttttctattcgaattcgaaatattgaaactatttcgaaaatcccatttagcagtctctcttattatatattctttttcgtttaaggcctatttcattagcggcgccggtggccctcgttccgttcgggcggccaacaaaagattcaattcgactggacacgactacgaattggtgttggaccgtgactctgaggtccgtttgcttttagttacaataagttttattttattttagctaatatttctttaggttgtctattgtgaggagcaaatcgaagtgccagaagtgaagctgaaaccgatttcattgaaagatttgccgaaccatgtgaacgaatgtgtggacgtacaagccattgtggacagagtgggcgaaattgcacaggtttgagataacagacacttttaagacggctcctctacggtttatgctaaatcccttccgaagaatacaaaaaagagaaaatctttttggccttgttattcaggtgacttcgcgcaaggacatgcgtcaattggacaaacgcgacattttcctgctcgactcaactggcaccgaagtgtgcctcactctgtggaacgaagaggcggtggcattccatgcgacgaccgggacggttttattttcgatcctttcctttctcggaatgtgccccgaggcaatgaaattcgcatttttgaggccctgtaacttttgaaggaggcaaaatgcaccgctaaaattaaaaattcacaatagaagtcgaccctcctctatccaatggtatatcatttatatgcattttctgactgacagctcggaatgttcccttgttagaaaattctatgaaaaaaattttcaggcgatttttttttgaaaattcttagaattcgtcattaaattttgaaaaatcgcctgaaaatttttcatagaattttctaacaaaaaattttctaagaacaaatttctaagattttttttttgaaaatttcagatgaaatttttttacaaatttattccacggctggattatgtctcggctgtgttttggggtgtaccgctgggatgtagtccacttggccgagtggactacattccagtcacaacaataatttattaggcatttccatattttatctccttttttagccggcttttccgtctccacaacttcgtccacttcgctgctgtttaaccccgagggaaaaaagtctgagaatctttgtctttggtaccgcgagtataggccggacgccaacatcaaatcgctgagcattgggtccgcctctgacacgcaagcgaactttggttggtctgcagttgattttttatattttaatttaaataaacaattttcttttctgtgctaaattcataataattcagagcgcgactttcggatgattggaattatccgacgggacggagtcagccgagacaatgacaagggcgagtacttttcgatcaaggcgatggtcgtcactgtgaagagtgaccaggccatctatcaggtcagacccaacaacaaatag

SEQ ID NO: 47026 - DNA, 625 bp, Heterodera glycines
  Genomic contig location: Contig_ID=SeqID_12291; Location=147..771; Strand=+
  SCN-specific regions: Sequence locations=1-625
  Gene Ontology: Mol. function=translation factor activity, nucleic acid binding; Cellular component=eukaryotic translation initiation factor 2 complex; Biological process=electron transport
gggctcaattgacggcaatcagtgtttaattgtcaagggcaagttccaacagaaacactttgagaatgtgctgcgcggttacatcagtgagccaatttctagtcatttatctcatgatcattgaaatttttgatatgaaaaattcgggtgtccttaattacactttcaccggcgatgggaggagtcgcaaaatgaacagaccctacctaaagcgccaaatttaattaccgatacgtttttaaactgtggcaaacaataatatttgtttttttgacactgagagggcttggttgtgtttgtatgttccggaaatggcgggcgtcaatttacaaaattttgtaccacctcggattctatgtatttttttgagcttggctcgactccgttccttgccataccattcgggcctaaatctaaatctcgggctgtccaacaaatatccattattgggacagaaggacataacccgttttgatcgtgttctcaaaaatttgccatttttagaattatttgataaccctcttcccctgctttcagatgaatacgtccgctgtcacacgtgccgctcctcggacaccgagttgaccaaggatgtgtcccgcctgttcttcatccaatgcaaacg

SEQ ID NO: 47027 - DNA, 1991 bp, Heterodera glycines
  Genomic contig location: Contig_ID=SeqID_12294; Location=1..1991; Strand=+
  SCN-specific regions: Sequence locations=1-23,45-53,95-128,156 -164,186-1536,1575-1582,1604-1991
  Gene Ontology: Biological process=embryogenesis and morphogenesis
tggagaggtcagtgataataccagaattcttttttccatttcagttttgcgagtttttattttaaaatttttactttttcaaaatattattttagatagaaattttttggtttcttatccaaaaagacgatttaaaaatacattacttataaaatacgtttcgaattttcaaagcaaaaagtagtaacttactttgaaaaaagagttactcaggtttggtcgcaattttattcaatgaaagaattcttataacaaatatatacacaatttttaaatcgaagaaaaaacgtcgcattttccagtttcgcatttttatggaatcattacaaatccccgaatggcatgccatgaattgggcgggttgaaattcaattccacccagattagctgattattcactgaccttctctggccaactcaatgctccacaggtcgcttcatcgtcggcttcgtttgacgacaataaggagaatggtacggacagctgggccaagttgaagaccgaccccgtactttggctcgacagaatcgccgacgtgtggcgtaccctccgtccatggcagcaacaactcgcctataaacaggtgttaacacctatggtccctgattcattcaaaatggtcgaaaaatggcttagttttccgtgttttcccaagtgaccaaaagcggcaaaaagaggaaaaatggatttacagctttgcacttttataacttgtaatttatttgtttttttaatttgaacataatgtagcttttcattggaagcgttctgccccctaaaagaggcaaatcgcatactcttacattttcaattcacagatggccaatgaacagcaacagattcccccggagtgcccttggctttcgctctgttcaaatgcgatggaatgttctcttaccacgctgcagcgccaccaatcgcagcaaagtgaataaatgactcatcttcggccattcattcatttcccaaggggtcgttgaacacgcgtgccgtacaattcgttttttgatccgttcgatgggtgcacagtccgtcgtgttcattgagccggtggcaagccaaattatgctcaccttcagccaatttccacattcatgtcttctctacttgtccagcattatggtggatgagtacggctcaatggctcaccttcagcccggaatgctccaattgttggacgtgagatcgaaggcatggcttagcaagtcctttcgttacttcagaatttggcgaatcggtccctctctcttttggcgactgactcggagaacggactgcgcgaccatccggacacggtggacgacctgtacagattggccatccgtttcattcaggtgatgatgttctgtgttgtaaacgatgccaaatgaatattctgtgaatacagcgttctccgtccactctcttttctcatcccatcgtggtccaactcttccaaggcgcaatccatggactcgtccttaaccaccaagatgccaacagatcggttacaaaatttgtgatggaaataattgcagcagcgaaaggaaaacgcgtaatttttttttctttattttatacaaaaatattatttctgcgccatttttacaaaaagatgttttttggtgttttagagtcagtcactttcgaaggagcaaactgaaagagtgcgccaaatgcttgccgagaacggcccccaactgatgttggcatgtgtaagtgccgcgctgttccatctctccaattcgctgtgcaaagaaatggccgaaattgtccatgcgttactcaagacagacaaaatggtccaataatttctcaccgatgcttaaatgctttttttatcttaaagaaagcagaacaatggctccattttgtctgtgtccaattgccgcacgacgggggacacagcgcaaccccgcaacaattgaacgactttcgcatgaaaattctggagtaaccttcctttgatcgggttattgtgctaatgcatgttttcaggtcggttcgtcct

SEQ ID NO: 47028 - DNA, 656 bp, Heterodera glycines
  Genomic contig location: Contig_ID=SeqID_12296; Location=116..771; Strand=-
  SCN-specific regions: Sequence locations=1-375,397-407,429-460,482 -523,545-560,582-585,608-656
atgcacgagcaggcgcaagaatttttgaagcgggcgattaaattgtgcccgacaaatgcgtccatttgggtgcttttgggacacgaatatttggagacgaaaaaccaccaattggcctcaacggcgtacaaaaaggcaacaggtgggcgattgattggtcaatctttgcccatttttacttttttttacgacgcccttttaactgttttgtttgtcattgtcagagatcgattccgtttgttaccgcggatggtacggactcggccaactttacgaaatactgaaacaatcggagaccgccctttactattaccaaaaggcgcacaaatgtcggccagcggactcgagaattttgatcgcattaggcgagactttttcggattaattttccttttcttcggatgtcattttaaatttcttttttaggtgtgattttctccaaaatcgaccggaaatcggatgcagaaaaatgctttaaaaaggcatttcaaattggcgacgtggagggaaatgcgctgacgcatttggccaagtaaaataaagcaaagtccgccaattgaaggtgacttctcttcagactttacgaagaacaggaaaaccagcaaaacgccgccaaagcatatgaagcttatttgacgctttacacggaggaattg

SEQ ID NO: 47029 - DNA, 564 bp, Heterodera glycines
  Genomic contig location: Contig_ID=SeqID_12319; Location=1861..2424; Strand=-
  SCN-specific regions: Sequence locations=1-246,268-564
atggcattccataaaatttacaatgacagtgtgaactccatcaccaacgccttggactttttccgcatcccgccaaccaacatcagcgtctcatcctccaaagtgtttgaactgctcccaagtaaccctttgaccgacaccccctaccacttcaaacttcactccagccaaaattacattgatctctccaaatgctatttgctgtctgagtttcgaattcgtaaagaaaatgcaaatggccaactggttgaccttgcagctgatgaggttgctccgattcaactgattggacacacattcatccgtaacatcaaaatgagcatcaatggccgtgaagtgttcaacgcaaattctctgatggcctacaaatcgtatttttcacacgaactctccattccacgaccgcgagactcgcatttgaatgctgcaggttattaccgtgacactggtggtgtgcttgaggtgggagacggatgcactgcacgacgcaacctgtttgtaggcagcagaacagcacaattcattgccaaaattgacgccgatttgtttaaccagcctcgctga

SEQ ID NO: 47030 - DNA, 1963 bp, Heterodera glycines
  misc_feature (10)..(10): n is a, c, g, or t
  misc_feature (18)..(18): n is a, c, g, or t
  misc_feature (36)..(36): n is a, c, g, or t
  misc_feature (106)..(106): n is a, c, g, or t
  Genomic contig location: Contig_ID=SeqID_12355; Location=463..2425; Strand=-
  SCN-specific regions: Sequence locations=1-40,149-232,255-326,348 -599,639-745,767-778,801-916,946-1043,1073-1193,1222-1287,1309 -1461,1499-1696,1724-1787,1809-1867,1891-1963
  Gene Ontology: Mol. function=chaperone activity; Cellular component =vacuole (sensu Fungi); Biological process=protein folding
attcactgtntcattctntatgaatcggattccatntaggtaaaaaataataattatttcaaatattttatttcaaataatttctaaacaaaataaattttatttntaaaacaattttatatttatatttttgatttttttttataaagctttcgccattttttggcgtgctcacttcaagccatttcttttctactgatcggcttttccacaacaatgtcaatggcacttgttggcgttgcgtttggctctgccgccgcgggatttggcgaaatttgttttttggcactttcttcattttatgacaggcaaccggaataatccacaaaaaatcattcaaaatataagccaaaaattttaaatttaagcaatgttttagatcaacagtttcggcgtggtgttttggcactggcgggtccggaattgtcagcgctaccgcttacgccgcactgactgagccaaaactgctgggaatgtctccccaaaatgccattttgacaatgctaattgtgccaactgtttattttttgacgtaagtttacttatgactttaatcataagtattcatgagctaatgacttaatgatatattttttacctttttataatttatttattaaattttaaatgatttttatgcttttcttattaagatattggttcgttttggtccattctccgcggatgcataaagcacaactcttgcggccatcatcatggattgtgccggcaatccgacggccaaattgttctggccaagtttatataacggaaaatgccatttcggactcaaaaaacggcaccaccggcggaggaacgcacgaattcacatttttgcaaaagctcaaattgattaaggcaataattacaatgactaactattttatgatcccaattggtcttaagaaacaaaccgattttaaaataagaaaacaaattaacatttaattggttcagccgcttcttcgctacatgctcccaattagcagtgtctatgttttggactttctaatcaactcaggattggtgaagcatccaaatactttttttataattattaaatatttttttacagggtaacaattaatcattagggggtcctgagatggagacataaatgtgccaacaaaaattttgcagatggcactgaactcacggatcaaattttggcaattttccggagaaatgcttaatgaaaataaacattttttggttttgtgaccccccccccctgaaattttcaaataaagtcatttatagggtaatttggggcgctgatcacgaatatgacatttatttttcaaaattacgaatcccgaacccgaattcaaacaaaattcgaaattcctaaattacaaggaaaacaaaaggactactcgagataatgtatacctttcgagatttaagaatgttaaaagtgggacattacttaatttgtcactctgtatttttgacaaaatgaatttttattttaccaattaaaataaatttttattttctcaaaatccattttgtcagctgcaacacgtcaaattcgattgtgctcgcagttttggcttgtcgttggccagccaattccgttggctccaaactttccatgtgatcggtcttttccttgctcggctaagtgccatttttgtcgaaatgccatcgctcattttgtactcacttcctattcttatggtatttttacatctaaaatttttaaattaaatttattttagttagcaaatttggcaattttctttggccaggctctgttcagttttgttccgcacattttgttcgtttttgcaattattttcttcgaaggaatgctcttcggctcgggctacaccttttttggcaaaatccatagaaaggtcatttttactaattttatttgtgaaagtccgctttagcacaaactgtgggcgtaagagtattttctagagatcgacttggacctgtatataggcccgga

SEQ ID NO: 47031 - DNA, 917 bp, Heterodera glycines
  Genomic contig location: Contig_ID=SeqID_12366; Location=302..1218; Strand=-
  SCN-specific regions: Sequence locations=1-142,164-370,392-793,815-917
  Gene Ontology: Mol. function=methyltransferase activity; Biological process=bud site selection
atggcctcttcacgtcccgaatattcgggtccacctgaacaatattatgacaacacagaagcacgcaaatacacggcaaattcacgcatacaaaaagtatggcagcaaatgaatttagaaattacatttcatggttttcacccctatttaaatttataaatttgtgaaatgtacggcaattttttgaaattttcgatttaacgcaaaatgaaaaattttctcattactaggaaaagtggtcagagttggctaccccaagatttcttgcaaatataggtctatgctagagtctggtgtgaccaggattcccgcaggatttgggggattttacgtaaatcccgatcccgtacttttagaccaaatttttatcctttcatccaacagatccagcgtgagcttgcccagcgtgcctatgaactgcttgaattgccggcattggacgacagtgcggcggcggccagttcggcgcggtcgcctgcgctcctgttggacattggctgcggttcgggcctcagcggcgctgtgttggctgaacatggccaccactgggtgggcctggacatcagcagggcaatgctcagttagtttgtccggcttttttgacatgtttagaccagtccaatttttttccaatcgtgtttggtgactggcggaatatttatttccaaaaatttggcttattttccgtcaaattttttctggatcgatccatgcccagaaaagccttgtccatgtcaaatatgaaaaaaaaccaggtccagattaggcacgaaaacccagggattttctggaaaagaaatttttcaattttctttaggcgttgcacatgaggacaccgaatcgaatggacaattgttgctggctgacatgggcgccggtcttccatttcggccggcttgtttcgatggagcaatttg

SEQ ID NO: 47032 - DNA, 1573 bp, Heterodera glycines
  Genomic contig location: Contig_ID=SeqID_12383; Location=839..2411; Strand=-
  SCN-specific regions: Sequence locations=1-241,270-689,711-741,771 -865,903-939,963-1312,1344-1573
atgtccggatgtggaaaaggaggaaagggacttggaaagggaggcgcaaaacgctatcgtaaagtgagtacaaaatagaataatttacaaaaaatagaaaataaaatcgggaaaatacatccctaagaaaagacccgaaaaatttcagaaatacaccattaagacttggaatttttttcaaaaattgatcgccaaattttgatctttttgcttgaaaaaaaaatttcttattcgaaaaagctataaatatattaataaacatttaaatacccaaatttgaattttttgcttacgttttaagtctcttcataaaatttaaatgccttttttgcgattttttggtgcttttttcgagacaattaatacttatgataaataaattatgtaattaaatgtaaaatgacgttttcgtttttttaaatttttcccaaaataactgttgtctgttcctattttccagactggtctccataacatccaatgcatcaccaagcctgtcatccgcagactggcacgttgcggaggtctgaagcgcattcccggtctggattacgaagaaatttcaatggtattgtttttttggctgtcataatttttctaaattctttgatatttgttaatttttttccaaagtggatttaatatataagcttattgaaatttcattcaaaaaataagccattttagaattttctgaaaattaatttttactaaacacataaatcttttcaggcacaccatgacaacatccaaggcatcaccaagaatgattttgcccgtaatgaaggagtcaagggcacctccggcgggatcaatgaaatttggccaaacgatttcagaatggtaaatattaaatcaaaaacagaataattataattaattaacaaaaaatatattaatttggtaaatcttaacaaattcatgtagacacgacaggtcaaatctcaaagtattaataaaactaagtaattaaaaatattttgtatagggagatcgaaggcgctaccggtttttggagattaggtccaattttaaatgatttcaaaaaaaatctttcaacgtattattaattttgttaaggccgagggggtcaggccagagaaaatttgagcaaaaatgtcgatcgaaaaagaaattaaacgaaattttacgcaaaaaaatctcataggcaatacgattggtttttttagataatcaaattatgatcgatcaatctcgatttgtgaggaaaattggtcgaatcgtaggaatagacggtagaaagaacggctaaaatttgttttttttaattccaaaaatttcatgctcgtccataaattctttatttttcttaaaaatttgctaggacttagaaattttattgaaaatctgttaacaaatagcttttcaacaaatgatcttgagctggaaatttgttcaggacaacgaaagtaacacaattgtcgaaaatttccaaatcgatgagaccgaagagcaaattgactgggaccctgacgcaaattcggcatttctcgacattggtgcaactgttgaacttgttggtgccgagtctgacattgatgatgggaattga

SEQ ID NO: 47033 - DNA, 382 bp, Heterodera glycines
  Genomic contig location: Contig_ID=SeqID_12392; Location=1295..1676; Strand=-
  SCN-specific regions: Sequence locations=1-382
  Gene Ontology: Biological process=mitotic spindle positioning and orientation
agaaagaaattgtcacaaatgcgcgcgaggattggtttcaacgaggtggccaagtgcacatcacaatttactgcaaggtatttacagcgattatgaccaattttataatttgatttcaattacgattttcgacttttttccagggagcacttccgagcgaaacatccgccaaatcggacggtctgacattggaagtgaccatcaacgggtccaccaaacggtacgaactgttcggggaaattgcgccgtccgaaagtgtggtaatgcaacagtttttgaggggaaacacttaattttggcatttgtgcaacaggtcattatcagcgaacgcaaagtggaaattgtgttgaagcaagtggccaaaattgggtggccaaaactt

SEQ ID NO: 47034 - DNA, 465 bp, Heterodera glycines
  Genomic contig location: Contig_ID=SeqID_12393; Location=484..948; Strand=-
  SCN-specific regions: Sequence locations=1-106,128-254,284-465
ttagtgctgcgaaggcgcgcattttccatattttattatctgctgtaaacgtttcacaacagaaaaagcgatgattccgctcaatttgcaaattgctgaggtatcccatattttctctgttttcattcctttttttggtttccgtttttagtctgctctgaaggtcctccaaacaaaaacgcccgggggagaaattgagcaaagtgcgacggcgggagctcactgtacaaacaatacgtgcaaaaaagtagaatcaaattagtaatttaaaaaattctaattgttttcccattttatgtgttcaccggtcccgagagcgatgccgaagagtgcgttttccacccgggcaatgccgtttttcacgaagggctcaaatactggtcgtgttgtgggcgcaaaaccaccgattttaccacatttttggaccaattgggttgcactcggggcaaacactgctggaaaaag

SEQ ID NO: 47035 - DNA, 1970 bp, Heterodera glycines
  Genomic contig location: Contig_ID=SeqID_12408; Location=1..1970; Strand=-
  SCN-specific regions: Sequence locations=1-116,139-487,511-1252,1274 -1483,1505-1725,1747-1857,1879-1903,1925-1970
  Gene Ontology: Mol. function=ATP binding; Cellular component=integral to membrane; Biological process=glucose transport
gtcgcccttttggtcggtctctccggtgcctttcactttggcattcaaattaccatcacaaatccgtcccaacaaacctttcttttgtttctcaactcatcgcttcacataaattatgggaagagaatggacacaaaacaattggaggtacgaaatcgaaatttggcatattttccagagggatttctttttttctcctttggtagtgacccacaattatcccccccccctctttccgcaaaaggtcttttggagtttgatcgtctcaatgcttttcctcggtgccatctttggctctctttccatccgtccgttggctgaccgctttgggcgtcttcgagttcttttcttcagcaatttgttgtgcaccttcggccttttctgcagtgccttttcctattttgtatgccaatgccttttattcattttttttttgtttgctttaagctgaatcggttcgaattgctgtgcctttctcgttttgccattggctttttattggctttatgtctcgggttggctggcattttcttggccgagtgcaggtgctttcccgtggttctgtcaatggcatcccttttcgaattttaagtcccaaatattgccgtggttttgtttcgatgagcaccggcgcattgcttcagctcggcactgtttttggctctttcgtggcaattccgcgcgttttgggctcttcaaatttgtggtgggtaatgttcacaatcgaaggcactcaacttttggccacaacaatcattttgacaatggtggcagaagaaagtccgaggtttgccaattcacattccaataaaactctttttgagttcagttttcttttgcttcgtaataatgaaacactcgcgcgacattctttggcattttatcataattgttcgggccaaattttggaagagcgaatgggcgaactgagaagagaaactctgcgaagtgttcggcaccgttccatcggactttttcggctggcaaagcaaaagggagccaaccgaaagggcactttttaagtcacccattataagtgtcaattctcacttgggtttttcattttcagaattggcagcgtcgtctcattgtccatgggattcagcggaattgccggtcttaaatttgccttgtgataatgccttttccccttccgttagtgatcaatgcttttgctgtggagcttttccgtaccactggtgtctctgagtattgggcttccattgacaatgttggccttgccctgctcagtttggtaccaattcttttgattccttccccgctaattaccacattaattattctcattagatctccaacatcgcctccgcccttctgatcgaccgttttggacgacgtcgtctgcttcttgtcacgttaacggccattctcttgatgaacatcgtaatcagtggccttatgtatgcttatgcgaagacggaagttggtgggaagggaagccatcgccggggcaattgaaaaaggaatatcaaataaattaaatgctatcggctttctgatcaaattgtttccgatcagctgagttggctcggcctctgtctgatcgtggccatttcgcttttcaccgtcgcttttgcctttggccccggtcccatctgttactttttggcctctgaactcgtcgagcaaagtgcgcgttcggctgcccaagggtgggctaatctctgccaaatgatcaggtatttctgtccacttccgatcacttcggtttccatctgatcagtcgtacctttcttctcgctattttcctccccctccgcgcttccattggcgttgcctccgcttactttttgctttttgttacggtcagtcattaaaaaaaaagcaaaaattaaaagtgaaaataacgtaaaagcaattcagcccattttgatcgctcttctctttttgtttttcaatttaccggagaccaaaagacgcgacatttgcgaagtgcggcacggaatgcg

SEQ ID NO: 47036 - DNA, 3377 bp, Heterodera glycines
  Genomic contig location: Contig_ID=SeqID_12421; Location=204..3580; Strand=-
  SCN-specific regions: Sequence locations=1-1739,1761-1787,1809 -1972,1999-2108,2130-2989,3011-3014,3036-3171,3193-3377
  Gene Ontology: Mol. function=chaperone activity; Cellular component =actin filament; Biological process=reproduction
acaatgtccgttcctattgttctcctttgtgaaggcacacaatctaagcagggacgtgaccaaattttaagcaacatcaacgcgtgttgcgctgtcgcggacaacattcgcacaacacttgggccacgagggttggacaaattgttagtggacagaaagggtaactaaagacattttctccaaggcgcggctttcagcgttcactttcattttccctgatttatttaaatataatttagggcaaacaacgatatctaacgatggagctacaattttgaaaaaacttgacattgtttttcctgctgctgtcatgatttgtgacattgcaaaaagccaagatgccgaagtcggcgatggcacgaccagtggtatgcaagtcttcttgacaatgctcttttttccttttcctgagttttataaccggtttatattttttttgtttaattttgcaaatatttaattatcaccacgtcaattctcttacaaaaacaaataattcttaattgaaaatacattatttttaggggctctagtgcactttatgagtccaatcaattgacaatcccgggtttctatacaataactttgttcatgttcgaacaaatcctatctttttggtatcattcgaatgcacaaagtctgaataatgtaattatacgagaaaacaacagaattctaacattccaagaaagttacaaacgaaaataatcagcaattacttaattaatcaaatcttttttggtaattgcctgaacgctgcgattttatatattttagcttcgttagactttgtgctttcgaatgatgccaaaaagattagggtttgttcgaaacatggacgagtataaaaaccaggtattgtcaattgattggactcacaaagtgcattagagccatttttagttgtgatattggcagctgaactgcttaaatccgctaagccttttattgaggagggtgtgagtccgcaattaatcatcaaagcatttaacgcagcctcacgagaagtttgagggtggaccgaggcgggaaaagggattttatttgtttaaggcaattagcaaattgcgcgagttgtctgtgaaagtgacgggcaccgaagagagtcgcgagatgctaatccgttgtgcagctacaacacttagcagcaaattggtagtgcaccaaaagaaacggcgagttaatatttacttcagctcaaacaagaacgtcatcactttgcgagtatggtggtcaatgcggtggattacttagacgttgatttgccactgaatatgatcggagtcaaaaaagtcagcggtggctcaataaaggtgaattcggtattacacatcgccaaacttgacaatcatcgttcaggattcgcgacttgttaagggagttgcattcaaaaaggcgttcagttatgctggtttcgaaatgcaaccgaagcattacaaagaacctctgatcgccattcttaacatcgagttggaactgaaggccgaacgcgacaacgccgaattgcgaattggcaatgttgcggattatcaggaagtccgaaatgaaacccagacaaaaacaaaacccaccgaagtatagccaacccccgtaaaaatgcacaattggtatactaaccgattcgtctcgacaagcacgaaaaatagatttcaagatatgaaaattggtttaaaccgatttaaattaaaaaattacttatcactaactttaaactctgactagttcgtatcattcaaaggctctttgacaagaaaaggagcataaaagatgggtgtgcgctggtttttgtgcaacaaacaaaatttcaattttcgttcatttcattaatttttttgggttttgaaccggctcaaaaacctcattgtcagaagagttgtgtatttcatcctttgatttttctacttatcaacagctttgggataatacttactcggggtttgagcgtcttaaaaagttagaagtgcgtggttttcttcattttggttttttaaaaacccgatttataaatcttgtgggtggttggctatactacatccaaaacccattaaaattgtggctcttcttttgcttaggtggttaatgcggaatggactattctttaccaaaaattggagaaaatacatgaaagtggtgccaaaattgttctgtctaaattgccgattggggatgttgctacccaatggtttgcggatcggtaatagcatttagccaaaattacaaatgatttattctctcaaacctagcgatatgttttgtgctggacggattcaggaagacgatctcggtgtgttatttttgtgattgctattttatgttcctttttgtttttaggtcgtataatggctgcttgtggtggctcaacactgactacggtctctcagatcgacaaaattgttttgggaaaatgcgctgaattctatgaacaacaagttgggagtgaacggtaattaaaaaaatacaaaggctcgatatttttaaaaagacacttttagctacaattttttcattgatgggtctaaacacaaatcgtgcactttgcttttgcgaggaggcgccgagcaattcattgcggagactgagcgatccctccacgacgcgattatgatcgtgagacgtgccaagaaaaacgactcaatcgttgccggttggtggatctttggattagtattttgaattcgtgtcaaatataattgatttaggtggaggggcaattgaaatggaattggcaaaacatttgcttgggttggcaaacactcgtgaaatgaaggaccaattcttttggaaggcttttgctaaatcatttgaggtttattttttctggttttctttatttcgatccatgtttttgctttttccccattttcagatgatcccacaacaactttgtcagaatgctggtttggactccatttctatgcttggcgaacttcgcgctgcccatcaacggggcgaaaagtgggcgggtgtcgacattcagcgggaatgcgtcgcagataacatggagggatgtgtttgggaacccgcacttgtcaaagaggtgcaaataataaaagtgtattatggttaattcatgggggaggggttcaatcgcctatttcccacaaaaatcgaagcaatttaaaaataaaaaactatcaatgaagaaagtatttatttgaatgagaaaacaggtatcaaaactgccacaccacaaaccttgaatcgaaatttttgcaaaaaaaaacgatagggtaggggaaattcacaaaaccgtactcatttaattcctgcagaatgcaattgtatcggcaaccgaagcagcttgtcttgttctgagcattgaccaaaccatcaaaaatccaaagaacaagaatgaaatgccgggattgcctggtcag

SEQ ID NO: 47037 - DNA, 1531 bp, Heterodera glycines
  Genomic contig location: Contig_ID=SeqID_12430; Location=954..2484; Strand=+
  SCN-specific regions: Sequence locations=1-71,106-282,321-558,582 -766,789-791,815-1201,1224-1531
  Gene Ontology: Cellular component=Golgi apparatus; Biological process= locomotory behavior
atgtctgaaggtttggtacaaaggcgacggaaagcagccgagtcgaacaattcgtcaaacggtggtcaacaattggatgtgtgtaattttaatgccaaatttacactttttggacttttcctttcagaatgatgacaaatcggcgggtacttacagacagacaaccgactcaaatggtgctggtgatgaggacaacgacaaaatgcaacggctaacactgatggaggaaattctgctgcttgggctcaaggacagagaggtgggggatggctatttgtcaatctttaacttattctgtattttttgtcccctcctaaaatttttcaaaaacttaggggtacacttccttttggaatgactgcatcagcagcggactgcgtggctgtgtgctcatcgaattggcgttgcgcggacggattgagttggaaagggcggggatgcgaaaaaagggcttttcctctcggaaggtcccattttgggacgtcctttctttaacacgaaaaggcatttaaggtgattttgaagaatgagaaaatgaccggcgatgttattttggacgaagcacttaaacacatcaaagagacaccacaaaaagagacggtggtcagttggattgaatatctgaggtgggccaaaaacgcgaaaatgcattgttaagatgtttttttttacatttagtggcgaaacgtggaaccctttgaagctgcggtatcaaatcagaaacttacgagaaaggcaattgcaatttattcataaattcgtgttaaaaaacttatcttttaaggcttgcaaaaaatcttgtggaaaagggcgtgctgactacggagaagcagaatttcctccttttcgacatgaccacgcatccattgaacgatggaaatgcaaaggcaaaacttgtcaaagtgcgttttactcaaattgtgaaccgaaaatgcccaaattcagcttaggtgacatttccctaaattagtaattttgtaaccaatgaatttgtttaccgatcaagccctatccaggggaaagaggggggtgggagaggaggtaattgccccctcccattcgaaatgaaaaatacgagggaaaatgggctttaacaaattaacaaaaatgcagttttttgtcagaaggtcttcgttttaattatgctttcaaagtatttttttgttcaaatgtttcagagagtacaagaggcggtcctctccaaatggacgaacgatttccaacggatggacaagaaaatgctttctctgctcattttggcacatgccagcgacgtgctcgagaatgccttttccccactgaatgaccagggtattcggggattatctgctcaattgttttccatttgtttatcccaccgtttccataagactacgaattggcgatgaaacgcgtgcggactttgctggagacggactatgaggcggagagtgtgaaaagcagcaaattgcaggccaacggcggaggcgaaagttccgctggctccgccttcgatgtgatatacgccgtgttcgaggcgttttcaaagtga

SEQ ID NO: 47038 - DNA, 1317 bp, Heterodera glycines
  Genomic contig location: Contig_ID=SeqID_1801; Location=1369..2685; Strand=+
  SCN-specific regions: Sequence locations=1-81,104-1317
atggcattccacaaaattgacaatgacagtgtgaactccatcaccaacgccttggactttttccgcatcccgccaaccaacgtcagtgtctcatcctccaaagtgtttgaactgctcccaagtaaccctctgacggacaccccctatcacttcaagcttcactccagccaaaattatattgatctctccaaatgctatttgctatctgagtttcgaattcgtaaagaaaatgcaaatggtcaactggttgacctcgcagctgatgaggttgctccgattcaactgattggacacacattcatccgtaacatcaaaatgagcatcaatggccgtgaagtgttcaacgcaaattctctgatggcctacaaatcgtatttttcacacgaactctcctattcaacagcggccaaggactcgcatttgaatgctgccggttactaccgtgacactggtggtgtgcttgaggtgggagacggatgcactgcacgacgcaacctgtttgtaggcagcagaacagcacaattcatggccaaaattgacgccgatttgtttaaccagcctctctacttgatcaacttttgtgagctggacattgaaattttgcccaacgacaacgaatttgtcctaatcacaccacccggtgttgctgcagccactcgctaccatttcgaagttgtcggtctgaaaatgtatgtgaagaaggtgtccctgatggacggattggcgttggacattgcgcgaaaacttgagttgaaaccggcacgatatgcagtgaggaaaacgctgatgaagtcgctgttcatcagtcatgggcgttttgaatttacgtctaatttgttcatggatcaaattccccggcgcatcacaatgggattggtggccaatgctgactatgttggcaccgtttcacgcagccccttcaactttcagccatttaatgtgcgtgaaatttctataattgccaatgggcgctcctaccctcaagcagcctacgacttggactacccaaacggaaagtatgtgcgccccttcaacgacatgaacgaagcggtgggattcgccaactcatcggaaagcaacgggattacactagcacaattcggtactacgcattgcatttacgtgttcaacttgacaagcagtggagacgaccaagcgacgctttttgatctgataaggaacggaaccacagcagtgagcatcaaatttaatcaggcggtgcccgctggaggaataatgctggtggtgatgggcgagtgcgactcgctggtgatgttggataaaaatcgatcgatcagcactgacatcactatttaa

SEQ ID NO: 47039 - DNA, 577 bp, Heterodera glycines
  Genomic contig location: Contig_ID=SeqID_12456; Location=2949..3525; Strand=-
  SCN-specific regions: Sequence locations=1-315,337-374,396-417,439-577
agaaatcaaagactttggagtgctccgtgcgttgccaattggcacggactgtgccgacggcgcggtctcttcaaaagcggcggcgtccaacaacagcaaaaggggcccactgagcatgttctcgcgcaacagttcaccacggaacagtttggcggcatctatccaaattccgttacatctgcgaaatgagggcgaatgttcagcaaatttgacatccaaggaaatatttcagtagggacttttaaattacaattacttatagacaataaattagttgttacatagacaattaattaataggtaccatttattccctgtttgatgccttgagttttgacaaattatcataattaagcactaattatacgcctctgttaatttaatttatatattttgaaaacagaaaagatcccacaaatgctgactttttggtggtccattcgaccaccccccattatgtgtcgtggcggaacagtgcaaacggcgcttggttcgtgcagagtttgtgcaaagtgttcagtgaaatggccccgaagcattgtgaaatttttgaaatgctaacgacagttaattatga

SEQ ID NO: 47040 - DNA, 1757 bp, Heterodera glycines; identical to SEQ ID NO: 12472
  Genomic contig location: Contig_ID=SeqID_12472; Location=1..1757; Strand=+
  SCN-specific regions: Sequence locations=1-1002,1025-1266,1288 -1674,1697-1757
  Gene Ontology: Mol. function=zinc ion binding; Cellular component =nucleus; Biological process=Wnt receptor signaling pathway

SEQ ID NO: 47041 - DNA, 1678 bp, Heterodera glycines
  Genomic contig location: Contig_ID=SeqID_12476; Location=1143..2820; Strand=+
  SCN-specific regions: Sequence locations=1-32,54-563,586-818,840 -1552,1574-1638,1660-1678
  Gene Ontology: Mol. function=ATP binding; Cellular component =cytoplasm; Biological process=protein folding
atgattactctttgcatgccacgccgtaagttctgtctcccattttccatttttgcatttgtccgaatgtcttttgttttcagttcgtgcgtttcctttggacaattcgctcggatgatgggtttcggggccaagcagcagctgaacgtcaattacgggaacagtgtcgtgaatttcaagcacatcctcggacgcactttcaatgacaaagtcgtgcagacatttcgtcagcacattccctgcggacttatggggaagttcaccgatgaccaaattgagataaaagtgtgccaaagcgtcacaaatcattttgtaattaggaaatgtgttttcttaggtcactcatttgggcacgacgcgagtgctttccccggaacaggtggtcgcctgtctgttgacacatttgcgggttcagctcagccgttctctcgggacggatgccactgaatgcgtcattaatgtgagatctttcttttcggtaccaaaaaggatgggcggataggaatagttttgggtgttaaaaatgctcttcaataacccaacagtttgttctccttcaggtcccgtttttctacgaggaaaaccaacgccgcgctttgctgaatgcgggtcgaattgctggcctttcacttcgtctgatcactgacccggccgcgttggcctattgttacggcatgtataacggggcaaagtgagtgagggacaggccatcaccaaaaaagttggagtgggacctggcaacttttttatcggcattaattcttttttggctttgataaacataagaaaatgaaatttaaaacttaccttgtattatataaatttgattatttttccaacttttccaattgtaaaaccctctttttaacacgcatttttcattctcctctttcagtcttcctccacctgaacagcccgctcggcttgttgcgtttgtcgatgtcggccattcgtctgttcaagccagtcttattgcattcagcgccggcaaagcggaggtcagcaggcgaatgttttaaactccttaattatttccattttaggtgctcgccgcctctttcgatttgaccgttgggggcgtccatttcgatgcgttgttgcgcgactatttcaatgaggactttggcaaacgcttcaaaatcgacgcgaggaaaaccccgcgggcgtggctccgtttgttggatgaatgcgaaaaggcattgacaatgaaaggcacaaacgaattagaactttcagatcaaaaagcaaatgtcggcaaacagtcagcccattccctttgcaatcgaatgctttgtgaaagacaccgacgtcaacggagtgatgcaaaggtgggtggtgggacagtacctgagttgttttaggatgtatgaaagtccatgggacgcgtaagcgttttccccctctgctgaattttgaaacaaaaattgtcatcaaataattacaaattagggaccaattcgaacaattggcggagaaactcttccaaaaagtgcaggcactgctccaacagctcattagtgacgcgaatgtgaaggtaaacaaaaacagtcaattaaaaataacaagtttttaggtcggcgatattttcgacgtcgaattggtcggggggtcgtcgcgaattccgcgcatcaaacaaattgtggcaggtagtaaatttggaaaatcattaaaaggatga

SEQ ID NO: 47042 - DNA, 2939 bp, Heterodera glycines
  Genomic contig location: Contig_ID=SeqID_12501; Location=1872..4810; Strand=+
  SCN-specific regions: Sequence locations=1-1138,1184-1496,1537 -1647,1672-1838,1860-2055,2077-2205,2227-2373,2395-2446,2476 -2486,2509-2644,2673-2850,2872-2939
ctgctgctgaagaaattcacagcgtttataaagcgattgaatgaattgtctttgtgccggactttgttcggcttccaccatttgagtgagggagaggacattatcacccgtctcgaccgacttgaaaagttgctagaagggtcagggaaccccactctggtcacaatcatcgaacgactagaaaagttagaaaagctggtagaacggctaatcgcgggcgagaatcgatatggaaatcgatttgctgaccctcaacacacctcccacacttcggcctccaccaacaacaacggcaatgttcaatggggtcaaccgccgccttttgctggcactggcgccgtttcgcagatgattaccgaggcaatcatcaactccgaacaactgaaagagaagtccactcgtgcggtcatcaaaaaattgccggaggcgatggaccaacaggcagtggtggagcaaattgcagaacaatgcggtgtcaaagacaaattgtcgcccgacattcaccgccacccaaggacacggcctgaaggaggggtaaaaagggatcggattttaaaagtgccgtttttggacaaattttcacgtgacaaatttctctttaatttccgtaatgctgtgaaaaaattgcccaatgtgccccaacatatcaaagtccgaagggatatgacccaaagtgagctcaaaatcttatactcccttcggcaacaagcctatcaggccaatattgccgcaggtgagtataagtattttgtggttgacttggagatcagatctctgaaagacccccgcccgctcagaactcgctagggatacgcgagcaaatcaaacaaaaatattgggaatacgggaaagaaaaatccttggatttcttgcctattaataaacgcccgatcgataacaaataaaatagctgacttagaacatataacccaaaaatacgatccttttataattataataaatgagacctggttaaactccagaaacacattagaatcagaacttaaagtaaatggtcaatatcaaataatccttgcaagccgaaatgataaaaagggcggaggatcggcaattttattaaaatcaaacatcccttatcagacacttttctctgaaattccaaagcgaaattattcacataaaattactttttaaaaaacctatttaaattataaatatatatcgtccaccaaattgtacagttcagaatactaaaaactactcaaattcatttctgaccagagcgattctgaaaataccatattctgtggtgattttaatatcccaaatatattgtgggatgaaaataaggtaaaaaaaataaatgatccggcgtctaattctctaattgagtttatgcaccaaagacaattgatacagcatgttaaggaaccaaccagagaaaaaacaattttagatttagtaattactagtgaattagaattaattaatgaattgacagttctagaaaatttttcaacttccgatccgaaaatggttggatttaaaataaaagtaaaattcagtcataaaaatcctaaaatttacagaagagattttaaaaatatcaatttttcgaaattaagtcaggcgatacttgaaaatcgaattgatttatcaataaactcagtgttcaccgttgaacagaaatataaagaatttttaaataaagttctgaaattatatgatatttttatacccaataggcctctaaaatcgataataaaacaatcgtatcctcaaaaaataagagacttattttcagagaaattacgtttgcataagcttgtaaaaaaattccctgaaaaaagtgatctcattttaaattacaaaattatttctagggaaatgaaaaaacaattgtacaaattaagaaatgaaaaagagtcaaaaattatttcccaagggcaaaactcagttaacaaatttattcgaaataaattatcaaaagttaatgaaattcctacgttaattgataatgctggaaatatgttttccagcaatgttcaaaaatgtaagatattagcagaaatatttcaaaagtcttttttaagaaaatcaattgttaatggtccacaaactcaatcgacacagaataagactaaactttctgacattgaattgaatgcgggaataatttggaatatattaagaagacttccccggcgtaattccacttcaccggataatgttccttacattttattaaaaaattgtgcagaaccaattacaaaaatattagcagatatatttaggctaattttggattccggtcaaattccggaaatatggcgaacatcattggtggtaccaattttcaaaaaaggcgaaaaaactgatccattaaattacaggccggtgtcattaaccagcactgtctgtagagtttttgaacgaattttgagtagcaaaattttagaatttctgaacagtacaagattctttgataaagaacaatttgggtttttaaaaaatagatcgactacaacccaaatattaaaaatgatggacgatatatataattctatacaaaagaatcaacaaattgacataatctatattgattttgtcaaggcgtttgattctgttccaattgatttattacttcaaaaaatcaaaaagattggaattgaaggaaaaattcataattttttaactaactttttaaaaaatcggagttttaaggttaaaattggcgaagaattgtcagaaagtttcagaatattttcaggagtgccccagggaagtgtcttagggccattactctttttaatttttataaatgatctgccgtcctttattgcaaatgaagcggcatcagttggcataaaaatgtatgccgatgatgttaaattatattatacacatgaaaacgatgaccattcgaatcagttggataaagcaattgaggctttggaaaaatggtcaaaaataaatgg

SEQ ID NO: 47043 - DNA, 1570 bp, Heterodera glycines
  Genomic contig location: Contig_ID=SeqID_12522; Location=363..1932; Strand=-
  SCN-specific regions: Sequence locations=1-15,55-78,108-222,260 -807,829-1186,1278-1393,1416-1570
  Gene Ontology: Biological process=cell cycle
ttccaaattttcgtcaaaactctcaccgggaagaccatcacccttgaagtcgaggcgagcgaccccatcgagaatgtgaaagcgaagatccatgacaaggagggaattccgccggaccaacagcgcatcattttcgcgggtacatccgcttgatatgccaggatattaaatgtttcacgtaatccttgtttttagggaaacagctcgaggacgcacgcaccatggccgactacaacatccagaaggagtcgacgcttcagctttgtctgaagcttttcgggggcgcaaggacgggcaaaacagcacactactctcggagcgtaagtcatgatatcacctccaaaagccctcttccccccccccccctccacaccgccgatcaggcggtcacctccttcaccgctgataagcggtccccctccacaccgccgatcaggcggtcacctccttcaccgctgataagcggtccccctccacaccgccgatcaggcggtcacctccttcaccgctgataagcggtccccctccacaccgccgatcaggcggtcacctccttcaccgctgataagcggtccccctccacaccgccgatcaggcggtcacctccttcaccgctgataagcggtccccctccacaccgccgatcaggcggtcacctccttcaccgctgataagcggtccccctccacaccgccgatcaggcggtcacctccttcaccgctgataagcggtccccctccacaccgccgatcaggcggtcacctccaaaaccccaacgaaaaattaaattttacatatttagctatgaatgaaacttttttggagtaaaaaataaggccacagaagaattggaaactctcgcctctcgccgaactctcgctctcgtctttttggggactctcgcctctcgccaaactctcgctctcgtctttttggggactctcgcctctcgccaaactctcgctctcgtctttttggggactctcgcctctcgcctaactctcactctcgtcttttcagaaacaagttacacccttggggtatatgccctgcggcaaggaaagaattgggtatatgcccaatggggaggagtcattgggtatatgtccaatgggaggagtcattgggtatatgcccaatgggagggagtcattgggtatatccccaatagggagtaaagtcattgattttttcattttttaatttatttttacaaaaaaaaacaaatttttaataatattattttgtaatttagttagtatacaatatttttttttgcatgttttcgttgttatttgggaattaacccaaagagacaccgtactgatgaggcccggtctctttcggttaaatttgcacgtttcgcgaagtgcccatttttgcactgtcgcgaaacgccccatttttacaccatttttgcactgtcgcgaagtgcccaatttttgcatttttcgcgaagtgcccaatttttgcactgtcgcgaagtgccctttttgcacttgtcgcgaaatgacgtagcaccgagcggtcgagaaagtagtgtttagaggagccggtttcagttttgtcc

SEQ ID NO: 47044 - DNA, 695 bp, Heterodera glycines
  Genomic contig location: Contig_ID=SeqID_1822; Location=780..1474; Strand=-
  SCN-specific regions: Sequence locations=1-165,194-695
  Gene Ontology: Mol. function=protein domain specific binding; Cellular component=cytoplasm; Biological process=protein targeting
atggagagcaacagggaattaatcttgtatcgtgccaaactagcggatcaagccgttcgttactacgacatgggacagttgatgaagaaggtggttttgatcattgtatagcttaatgaataacaaattatatcccttttcctttcccatttcaggtggttgagttggacaacgtcttgaacgaagaggagcggaacatgctgtcgattgcgtacaaagctgtcatccgtccgcttcgcttcgccttacgggagatctctccgatcgaatggacgcaggatgggacggaaaagcagctgcaaatgctcaagcgatatcgcgaaaagttggtcaaggagttgcacgacacatgcaacgagctcgtggtgagaggatggaccaatttattagttttaaaattcaattttaaggagttattggacaagttgatctcgagggccgacgaccccgaagtgaaggtgttctacctaaagatgaaggctgacgtctaccgttacatggcggcggaggcaatcggaggtgttgttgacaagtctcgccaagcataccaagaggcgttcgacatagccaaggacaaactacggccagcaaatgctacacggcttgggctcggactgaacttctgcatcttctactacgacaatttggacatggaagaaaccgcaatcgatttcgccaaaaaggctagggattaa

SEQ ID NO: 47045 - DNA, 2160 bp, Heterodera glycines
  Genomic contig location: Contig_ID=SeqID_12530; Location=371..2530; Strand=-
  SCN-specific regions: Sequence locations=1-173,221-281,355-586,621 -769,791-873,918-1100,1132-1209,1231-1242,1288-1366,1388-1490,1530 -1567,1590-1721,1783-1836,1861-1947,1969-2160
  Gene Ontology: Mol. function=glutathione synthase activity; Cellular component=intracellular; Biological process=neurogenesis
gaaattgttgaatgatccgcgtgcaattattttatttgtggtcgtcaaagacttaagcacttggcatttctccaaacgatatgatgaatatgagttggaaagattgtccggtggacgtgccaaaattgttcacctaacaactgtggaatgctttgaaaagtggggcaagggcgaaaatttcaaaaaaaaaaattaaaatattaatattaaatttaataaaggtctcgatcgagacattgatgttacatatttctgtaaaaattaaatcatcgtaccgaatgaataaatttacaaatatattaatggaaatatttattcataaatttatcatgcaaaaaaaaaattatttttttagacaatttcttaattttacaaaatgatgcacaaattttggtctattcacatgcaaaaaatcgatgagtatattaaaaaataaacataataatcagaaaaaataacaattttaaaacccaacaaattttgtaaattatcgctttacgaattatgctaatcttttcgggcttttctttcgaaatcatttgcttaaaagccaataatcgcatttgccattcactattaagcacagaatttatttaaataaataaataaattttttttttcagtttaaagcttgacgatgatttaacgcttcgattggacggtcgtccaattggcgttgcatattggaatctcgtgcgacttggcagcgacgcatttgggcctaaatcttgggcagcattgcgaatgattgaacgctcaacagcaattgtaattattaaattaattaattcgtaatttatttggtatattttcagaaagcgacttcgttgttctttgaattgagcacatcgaaaaaaattcaacaagtatttttttaattaattttttttaatttaaattaattttgttcaattaaaaatttcagttgcttgccaagcccgggatggttgaacgatttttcacagatcccagcgaacaacaaatggttgacgcaattcgtgcaacatttgctaaactgtggggattggagaataaggacgaggaaacgcaaaaaattattcaggtaattatgcaattaacgcattaacgataattaacagttaaaagaaaattaataaaacataaaattaatctattttagttaatctattttactattatcgttgcaaataattctttaaaatttcgcatcgattaaacaatagaattttatttttctaaattcctaatcctatgcaattcttttttacttttatatttttaaattattcaaattcatttttatttgcattttcgatttatttggtaattaagtataattaaggatgcaattgcccatcccgagcgttatgtgctaaagccaaacaaggagggcggtggagggaatatttggggcgaagaaatttctcaaaaattacgcaaattttctcgaagtgaacttgcggcacatattttgatggagcgcattaatccggtgacagtaaaggtaattttgataaaattggaattttaaagaaaaatttaaaagagtgtttatcaaggcgtcaattaaaaaagtgagggacccttttggattaaatttttgaaatatcgaattgtttcgaattctcggtttaaggaatttagagtttgtagaaatagatgctatagtgattgatcagagaccctgaaaaatccagtaacaaatttttttccttattttaggagaaatattcttcatctaattaaataaatttaatttttcataacatttctttctaattttgaatattattataaattgcaaaaaaaaaatgtctttaataattatgaacagcaggtagacagacttaaaacattaataaaatttttaaaattttacaaagtaatttgacttcttcattaatgagttcaaatatttttgtttccgatttctcttttttattatttattgtcacacattttttacagaattttatggtctggccctttaaaagggccgagtttgccgaagttatcaatgagcttggcatttacggatacctcattggcaacatgaacaccggggaagtgctggagtatgaacagcctggtaacatggtccgtaccaagaacatgcacaacaatgagggcggcgtttcatcgggcaacggagtgttggacacgccatttctatactga

SEQ ID NO: 47046 - DNA, 1495 bp, Heterodera glycines
  Genomic contig location: Contig_ID=SeqID_12531; Location=192..1686; Strand=-
  SCN-specific regions: Sequence locations=1-52,74-148,170-296,377 -484,512-700,736-815,856-958,980-1105,1146-1230,1253-1291,1333-1495
atggcctataaagatgtgattgaatcagatacgtctgttcggacgctgctgggtattttggaagatattaaaaaggaagggatcaaacagccaatttccatctttttgcaacgatcggtcagttcaaatttaaattcacataatttgagtttcaacaaaattttataaataaagtactaaaattgttcatcaaaacagacacacccaaatggattttaaatatacaatttaaatgaggtattccgagttttgtaattacttttgtcactgactgatcagatcagtgataactaagctattttaatattttttttttaaattttttttaagtttaagtaatatttatataataataattatataatttattttatttctctattttaggattatatgataacagctgaaactaattcaaagtccaatcaaccaaactaccaactaaagcaggtcgaccaaacgataatttattatttcacgaaacaaatttaaaaatattataaatatttttgccaaattttttcagattgaagttaatggtggctcaattggcagtgcgggatgccaagatcggcttttgagcattcatcagcgaatgctcaaacacacaggttgttccgaccaaatgatcagcaatgcattgcccgaaaatcgttcgggcgcggcaattgccaaaataatttacaaggcttggtcagtcattttattaaaatatattttttgattttttttattgcttttaattagtcatgattatgcagaaaaatgaataatttgtattttagcgatggtcgaagaagtccaattgaataatgaaaatttttctaaaaataaaattatatgttttttatattagccacaaaacaagatgaggctaaaatgaaaatttgaaccagcaatggtttttgatttatttattaataaattcgaaaatccgttaaaattttctttgatttaaaaaacatttgcataaaaataatattttatgtatattctaatgttttttctttaatcttttcactcccgagtagagttgtacgggaccgggacctagacacggacaactgagtacaactgagtatctaggtcccggttttgaccgggaccgggaaattcccgggtttttcagccaaaaggtcccggttttttaaccaaaaaagtcccggtcacggttttgccaaagattcccggtcccgaccaaccttactctcaagttgtctattttgttggattaacctttgacatttctattgaaaaatatgaaatttttccctgccgcctctggcgctccattaattattatttaattaatttttcattcttttttaataaccaggaaattgttgaatgatccgcgtgcaattattttatttgtggtcgtcaaagacttaagcacttggcatttctccaaacgatatgatgaatatgagttggaaagattgtccggtggacgtgccaaaattgttcacctaacaactgtggaatgctttgaaaa

SEQ ID NO: 47047 - DNA, 1993 bp, Heterodera glycines
  Genomic contig location: Contig_ID=SeqID_12537; Location=1..1993; Strand=-
  SCN-specific regions: Sequence locations=1-853,875-1644,1667 -1670,1692-1945,1969-1993
  Gene Ontology: Mol. function=GTP binding; Cellular component =cytoplasm; Biological process=rRNA processing
aaaaagagggaagatagataggaaaggaggaggagagtggcagaaagacagacaaacagagggaaaagaaacgagccaagtgatgacgaggagggcaggcagagaaaagggggtgcgaagagtgccgccggtgcggcgacggattggggaagggttcgtcctcggggtcggaccattcgtcgacctcagccgactgggccaatccatcctggggactgctcggaagcaaaggacgagtcgaagacgacgatggaaaaggagcgaccggagggacaaacgccgtcggaacccacggggcacagccgacgccggcgggcgaaaagtacagcagcgccttgaagttctcctcggcaccgcagtaattctcggccaaccactgaattgtgccatttagcgattgtcaaaataatccaaaattggcaattaatttgtatttttggccgtctcctgcgtccgattcacctgctcctcctccggtgcgttgatcatccattggagtgcgcatgagcagtgcagcgtattgtccgcaaattcgaatcgctgtgcgccgtcgtgccgaaggcattctggcgacaccatcggctcacgcacggtgttgtaagtgaacaccaatttgccaacattgtccatgccggaagaccaaccgggcgacagtcgcacaatttggttggactgaagttggacagagccgaccgtgaacagtccccgagggcaccctcgtcaatgcggccaatccggcactcgcgaatttggagctgaaaggcaaatgcaaaatgaaatttcggacagaattaaacaaaattggcattccctattttaggcatttgtccccccgccaacggaaagcaatcggataaaggccaaaaggacagtttaaagttgatatttcaactttgttgtgtaataaaaagtgaaattcgagtaggaaaaatcgaaggaatttaaaaaaaggcccagtgactgtggtgaccagcaaaaagagacgggtgaccttttttgaagtgccaaatgacataaatgccatggtcgacgcagcaaaaattgccgatttggtcggtttttgtggatatttggataaagaattctttcgattttctaggccctcattctcatcgacgcctctttcggctttgaaatggaagtgttcgagttcatcaacatttgccaagtgcacggcatgccaaaagtgattggagtactcactcacatggacaatgtgccgaaacggagtcaattgaagtccataaagaagcaattgaaaaatcgcttttggtccgaactttaccaagtgcgaaatgtctaccatgcgaatgtaaccgattgttaatcacttttagggtgccaaattgttttacctcaccgggatgcaaaagcagcgttaccttcaacacgaaatcaaaaaccttggccgtttcatttctgtggccaagttaaggccaattttgtggcgcaattcccatccctacgtgttttgtgaccgatttgaggatatcactgaccccgaggtggaactcacattcattttttatacgaatgcttttcctttattaagcttattcgttcggaccccaaagtgtcgcgttcggtttctctttacggttatgttcgcggggttcacctgaagaacaattcggctgttcagttaatattttacatttttatttcctcattaaatcattttttaaatccttctccagaccggtgggaagcaaattacgaatttttgcattttgatccaatggaattcagcggaacagagacgaattcatcgaagcactcgaaggaatcaaagagccgttggattcgaaaatgggaaaggcgactcttaagcttctgaaggaaaatcccgacttggaattggtgcgtttaatccttacaagggaacctcgcgaactgttagtcggaaaatgcatatgtattatataccattggatggatagaggagggtagacttctattgtgaatttttaattttacgggccgatagcgaaaa

SEQ ID NO: 47048 - DNA, 2886 bp, Heterodera glycines
  Genomic contig location: Contig_ID=SeqID_12557; Location=220..3105; Strand=-
  SCN-specific regions: Sequence locations=1-326,348-351,378-393,418 -637,661-727,757-768,811-1018,1048-1227,1263-1793,1818-2145,2167 -2320,2342-2456,2492-2720,2743-2797,2820-2886
ctgttcgtctgtggcaccggtgacgcgcgggtggaggcgtgggaccagcggtgccgacgacgcgtggcaatgctggactgtgtgctgaacaaggccatcgagttggagctggacctggacagcggcggcgggtcagttttagccattttttaaatttttattgcattttttctttttttaaggtctcagattgaagtgtccagcatttgctttaaggacgcattgcatttggcggttgggctcagcaacggttatgtgagtggcaaaaaaaaaaaaaaaaaattcgacgtttttaaatttcttaaaaatttgcccttttactgcttttttcctcttgaattttcttttaccaatattttttataatttttttttttactttttgcgcaaaaccaaaaaaaattttttttttttttttgaatttgtaagggctctaaattatttttgaaattttgtagggagtcaaattttttttgtccaccaacccatccttccattttcaggtgttgctgtacgatgtccgttcgtccaagccatatttgagcaaaaatcacaatttcggcctgcccatcacccgactacagtttgcacctgaacaggaactggtgctcagcatggacggacgggcactgaaagtaaattaaaaaagtgaaaattcaaattcactctcatttagcttcacatttcacaaattagcttacaattagccttgcacaaaaaatacaaacaaaaataattttctaattttttaaaaatagaaaagtcgttgtaaattataattttcacttttttattttttaaaatatattttctggtataaaaatcaaattttatggcaaattttattttgaaaattcgtgagaaaaaattttcccatttttttgctgccaggcttggaacgaacacaacggccagccgttcaccagcattgagccgggcatggacctgcgcgactttgcccgttatcccaactcgggtgggttcgttcgacggcaccacatccattccatttaaaaaccatttttaatttatttgattttaattatatccccccccccttctttttcaggcatcatcatgttcgcaaatgatgagccaaaaatacaacaattttttgtgccttcattggggcccgccccgcgctggtgctcccatttggtcagcgacaattttttttatggcagattaaaaatgaattttttctccttttaaaatcccccccccctcctaaataatttaaatattttaaaaattattatatttcaggaatcgatcactgaagaattggaggccgaaaaaccttccggtatgcatttaaaaaaacatttcttatttccttatttaattggagtcttccattcatcgttttttggcttagtggtctgtgcgtttgtcactttccccatttgttgtcgttggttcaattccgcgccgatgcgcacgccccaatttgtagaatttgccagcacaataactgtgctgctggcgagtgtggataaattgggcaaaaaattgtttcgctcgcttttatccgccacagtcgaatgtactgcttcaaaagcacactgtgcatgttggcttccagattcaagcgacaatttttttttaaatttaacaatagtgcaagttggagaactgaaaaaattttgcgtaaaattttatgggataggggtctcccacacgagaacccactaaaaaatttcgttcacccccgtcccttggcacatttatgccattgaattttaatgttccttccaatctaagcattccaaaaaaaaaattttaattgcctccttttgtgtttttttctggaaataactcaaaattcaagacaaaaaaaaattcaataaaaaatatgcctccaatcaaaaattttttcaaaaaacaataaattgaaaacctttacaatttcttggttgatttttggcactttaagccaattaatgactgactaattattgactaattaagaaaatgagtctccttcccttgaaagcgctgttttaaacaaaaaaaaagatggttaatcccacaaaaaatcactttgcccccatttttctcagtgtacgacgacttcaaatttgtgaccaagtcgcagttggaggagctgggcttgtccaaactgattggcaccaatgcgctgcgtgcctacatgcacggcttcttcgtggacatgggcacgtacaaaaaggcgcgcagtcagtgccaactgagcgcattcgaagcgtaccgggagaaaaaggtgggagggagtggtgatgacagagggatgaaccagaaaacatttatagtatttttaagaaattgattagcgattttggaaaaatttttatttaaaaaatcgtttttcaaatattttcggggcggaaaaactgattttttaattggtttcccgttgtttcaccaaactttttttttcaaattttcggtttttaaccgaaaaattccgtttgaaaccaaaaattttattgttttttaaccttttctcttttgttgttcagctgcaacatcagttggagcaggagcgctcagtgcaatttgtgaagcggaacgacgctggcggcgcggcgggccaacgctcgcgcaaattgcccaaggtcaaccgcgagttgccgcccgtctgcaagccgaactgtccatcaacgaaacggcgacgatgacgccgcacacaacggatattgacggcaaaaccggtgccaacgatgaggacggcacttttgctggtgaaggtggtggtggagacggggacgaagcggcttcgtcatcatccaaatcattggcagcagctgaacaaccatcgttggcggcaccaacaacagcgacaaaagacgcagtttctgctgaccatggcactgccatagctgctgctgtgacaaaaccgaaaaag

SEQ ID NO: 47049 - DNA, 829 bp, Heterodera glycines
  Genomic contig location: Contig_ID=SeqID_1831; Location=401..1229; Strand=-
  SCN-specific regions: Sequence locations=1-41,63-122,144-249,271 -332,354-829
  Gene Ontology: Mol. function=structural constituent of cuticle; Cellular component=collagen type III; Biological process=cuticle biosynthesis (sensu Nematoda)
atggacgtgcaagtcgtcgtggcaccgccgtcaaaggcccgtgccaaccccttcagctccatcttccgtgccaagcgtcaattgcccggccattgccattgcggtcccccacaacggccaaactgccctcctggcccacctggtccgtccggaccgcctggccaacccggacagccgggaggcgcaggactgcccggacagccgggagcacctggccaacctggtgagcaatcgctacgcgttccataattatcatggctaatatcacacagctcctccgtgcccgccccagaacatcccgtgcccactctgtccggctggcccacccggcagccccggagcacagggactgcccggacagcaaggagcccctggccaacctggtgcgcccgctccgggcggaggacaaggaccgcctggcgcgtccggaccccaaggacagcctgggcaaccaggacgcagcggaacacccggccaacccggacagcctggaaataacgctgttatttagtaagcagtttattgaataagtaattaggattacatattttttagtaacaccattcctggcccgaggggagctcccggtgcgcctggccaaccgggaagtcccggcagtcaaggccaacccggacaggccggaggcgagggaccgcctgggccctcctggtgcgcctgggactgcccggcctgtctggcaacattggtcagcctgggcagcccggggcacccggccaaccgggcaaagacagcggctactgcccgtgcccgcctcgctcttccgcgatggcactcaaaaagaaaatgggcggcggtcaaaaaagcataa

SEQ ID NO: 47050 - DNA, 2188 bp, Heterodera glycines
  Genomic contig location: Contig_ID=SeqID_12568; Location=5..2192; Strand=-
  SCN-specific regions: Sequence locations=1-167,204-309,331-384,406 -582,604-1257,1280-1348,1370-1592,1614-1856,1889-2188
  Gene Ontology: Mol. function=structural constituent of cytoskeleton; Cellular component=spectrin; Biological process=body morphogenesis (sensu Nematoda)
atggtttgtcggatttgagattccgtttggcacccggaactctagctttttggatgtctgttgattagattgaaggacggacagggattttgaaacaaattctagctttttttgatcaacctgatcagaatagaacattcgcattaattaattttacgattttaataatatttcctaattatttttaaggcttttctccaaaacgacgacctcggtgattcgctggacgcggttgagtcgctgctgaagaaacacgaggactttgagaaatcgttggccgcccaggaggagaaaatccatgctttggacgaatttgccaccaaactgatcgagggcggacattacgcagcggaagatgtggccaaacggcgtgaaaaggtggccaaattaaattttaattaataacatcgaaagttatttttctaaattttatccttttattaaatcccctatgccttttcagttgctcgcccgtcgtcgccatctgatggatcggatggcacagcgccgggagcgtctcaaggagtcctaccgcctgcacagctttgaccgcgactgtgacgaaatgctgggctggatccaggagaagctgaagacggccaaagaccaggtcaataaaaaaaataaagaccaaaatttctgatccgaatatatgatgaccaaagtaattgcgttgttcttgagttgtccttactttggatatttattattaattaggtccttgatttccgatcacttattagtctgaactgatcaagcggtccctaatctattctctttaaacccacaatcaattggatcacaccttaacttctggtttgagtttgtcagatcaaaccagaaagtaactgctttaaccgatcaagcaatcataaccatttaaacctaaaatgattattcttcctttttttacagagctatttggacccgacaaacattcgcggaaagttacaaaagcacggcaactttgagcaggagttgcgcgcaaatcgcaaccggctggatgagatcaaagccacggggcaagaactgatccaatctgggcactatgccaacgaacacattcaggtggggaaagcaaaaataaaactttttaaagaaaaggaatgcctaaatttttgaaaatttgttaaagaccgaaaaaatatatatttcccgctccctaattaggactgctcattgcaattaatcgttttagaatttctaatttgtatcatgggcctatttctttttttacaattacgattacgccatcgctaaattaaaatttgttttctgatcatatagacccgtctcaacgaggtggaacagttgtggaccgagctggctgatgccagcgggctaaagggtgccaagctgcaggaggccaaccaggagcaattgtacaaccgcaacattgaagacgtggagctgtggctcagcgaattggagggccaattggccagcgaggacttcggcaaggacctgatctcggtgcaaaatctgcagaagaaacttggccttgtcgaaagtgactacaacgcgcaccaggtgggactaacggggaaaatgatcaatgggtgagaaatgatcaatgtgagggatgggaaaaataataggagaaacggggaaaatgatcaatgggagggaagggagaaaagtaaaggaatatagaaaaagtttcgagactcgactcgggttttttctgggaaataattggtatagttttatcgaaactggtgaaatctttgggttgagacccctatttttcttttctcattttgagtgaataaattgaatattttgttctaaaaataattgtttgccaataagatcaaaaatgtcaattcaggaggcccgactttgatttactagtctaaaattgtatttaataattttaatttttaaacatttatcactatcagagcgaactttttcgacatttcaggaacgcattgacgcgatcgggcatcagacgcgcgagtttcatgacacgggccacttcaacgcaccgttgatcggtaaaaagttcgaggcgttacgcgcccgcttcgaggcgttgcgcgagccgttgcagcgccggaagcaaaagttggccgagtcgctgcttggccaccagctgttccgcgacatcgacgacgaattggcatggattcgagagaaggaacaaattgcagcgtcgacaaaccgtggccgcgacttggtcggc

SEQ ID NO: 47051 - DNA, 1710 bp, Heterodera glycines
  misc_feature (1641)..(1641): n is a, c, g, or t
  misc_feature (1654)..(1654): n is a, c, g, or t
  misc_feature (1693)..(1693): n is a, c, g, or t
  Genomic contig location: Contig_ID=SeqID_12571; Location=1..1710; Strand=-
  SCN-specific regions: Sequence locations=1-516,538-1148,1170 -1347,1369-1710
  Gene Ontology: Mol. function=electron transporter activity; Cellular component=mitochondrial matrix; Biological process=proline catabolism
cgctcctttcccccgtgtcttctgcgacggagtgcctcttcattcacgtgggctttcaatccatcgatgtttacaaacattgactacttgtgagtttcgctttagaggcctcacttcggaacagttcatgaagagcccaaccaatgagccggtgctcgaatatcgcaagggaagcgcggaaagcgacgctttggagaaggaactgcagaaactgtgggcagagcccatggaagtgccgttggccattggcggggagaagacatttcgcaaggaaaaagcaattagacagcccatggcgagtgcatttgaataggttcacaaaaacagaaaacctttaatttgagatgtcagtaaaggatagactttttcatttgttttcagccctttgaccacaaccgtcccattgcgttgtttaaccatgcgacaacggaagacattcaaaatgccatttcaattgggttggcagcgcgtcatcaatgggagcgacttccgcttatgtttgtgcaactatgttgatttttcaatacgattttaattcagaaagagggctgatatttttctgcatgccgccgacctcgtggcaggaaaatatcggatgttgataaacgcggccacaatgcttggccaagcgaagaacattcaacaagccgaaattggtctcaaaatttgtctcttttttgccattgctttgaatttagacgcggcctgtgaattggcggattttctgcgtttcaatgcgtatttcgcacttcaaaattcaaagtatcagccgatcagtggcaagggttacgagaacagcatgcttctcagaggacttgaggtgctgtttcagtataattagcccttaatcattcatattatttcaaagggttttgtcgcagcgattgctccgttcaatttcaccgcaattggcggtaatttggcttctgcacccgcacttatggtatacggaaacattgttctaaacacaaaatgatgactaattaggggaatgtcgtcatgtggaaaccgtcggacaccgcagtggcgagcaattatgtggcttacaaagtcttcgaagaggctggttggtcaaaatacataaccatcaaacattgtggctaaatttaaggactttcatccggcgtcatttcttttttgccatccgatgggcccacttttggtaatgccgtcacgaacagtaaagatttggcgggcatcaacttcacgggtttgtgaagcactcaaatcaacaacctttagcattaaatatttttgatacaatttggggaagaaccgggaaactggttgggagcccaaaccaagttattcaaacccagaaaaactccaaccatttgtgcacggatagtgcatgatcattggaaaataaaatctttacaggctctgttccgacgttccaacacctatggaaacagatttctgagaatttgactacttatgccactttccctcgtctcatcggaggtgcttttcatggtgttctaataaaattcgggtttattcagaatgtggcggcaaaaactttcattttgtccatccgtccgccgatgttccatcagtcgtcgcttgtacgcatcgcgcggctttcgaatatcaaggacagaaatgcagcgcatggtcagataaacttacgccttttgngcttcactatccnaatttagctcgcggatggtcgtgcccgaaagtctgtggncatccatccaaaaagga

SEQ ID NO: 47052 - DNA, 833 bp, Heterodera glycines
  Genomic contig location: Contig_ID=SeqID_12583; Location=176..1008; Strand=-
  SCN-specific regions: Sequence locations=1-487,510-545,568-833
atgttcgacttccctttgctcacttttctcgccactcgcgcccttctcgagtggacgcaaggggaacgaaaactcgatgagcaaatccatccgaaaatggcaccttctctggaggacgagactaacttcaatgaggagaacgtggtcagtccgtttttggcactccgtccgtcccatttccctcctcccccaaacttcccatttcagcgcctttttcgctacccttttctgaagaaccctttttgggatggacacttcgatgagaatgactccgaccgaatggcaggcaaagccctcgaatggctttcataccatttgaaattggcaaaaaatgacgaaacgaattacgacgagacactgatcagagtgatcagacttttggggttgagcatacagcggaaatggacggaagcgaagtcattggcggaagagatgtttatcacagttgctccatcggacaatgcgcggcaaatgatttattcctccatggaacaaatgcagcaatttttgaattttgacgaacagattgaagcggcggagaagcaaacggaaagagaaaaagacgaccaaaattcggaggaatcggagaaaatggcactgaaagtgataatggcaaaaaattatcattcgcacgattgcctattcagaaattatttgagcaaaaaagtgccgaatttgaaattaacaaagcaaaagcaaccgaaaaactttccgagatgttggcagtacgatttgagccaattttgcagaaggaggaggaacgaatgatggaagtgcaaaggaaacacttttgggaatgggccgaacgcagaaagcgactcattcacagtcag

SEQ ID NO: 47053 - DNA, 1352 bp, Heterodera glycines
  Genomic contig location: Contig_ID=SeqID_12584; Location=798..2149; Strand=-
  SCN-specific regions: Sequence locations=1-181,204-377,399-459,482 -1098,1120-1352
  Gene Ontology: Mol. function=isocitrate dehydrogenase (NAD+) activity; Cellular component=mitochondrial matrix; Biological process=hermaphrodite genital morphogenesis
caaaacatcacgatttggatttggttctcattcgtgaaaacactgaaggagaatacagtggactcgaacacgaatctgtcaaaggcatcgtggagagcattaaagtgtttggctggaggtcttttgtttaaaagagtagatttagattgtaactcgtcgcaacatcgaaaaaatagctcgttttgcatttgattatgcggttttgaacaatcggcctcagataaccgccattcataaggcaaacattcagaagcttggtgacgggctttttcttcaggtgaacaaccttttaagtaaaaaaagcgtgttgattttaggtatgtaaagaagttgctgaaactgaatacaaaaatgcaggtctccaattcaattctatgattggtatgtatctttgttttggggggggagtattttttagggatgggagggatgcgctgacatcataaattgtgaattttcctttattattcattttacattacatatgacacattagccctcccattgtttgtttccttattcagtggacaacgcgtgcatgcaattggtcagctttcctcaacagttcaataacgggattcttctgatgccaaatctttacggaaatattgtaaataaagacactgctcttccaggtggaacgtacaatataatcgtcgtctttttaaagatatcgaacattgcttgcggtcttgtcggaggaccgggccttgtctctggaatgtgagttttcactcggctacgaaatttttttactgaaacttaaggaatattggagaagaatatgccgtgtttgaaacagtaagttagggatttactgcatttgctaggtcggaaagttaaatattgccttacaagttggagatggattttatgagtttactttattcatgcatttttagaatactttcattaaagggcacacgaaacacgggaacctcattggctggcaaagacattgccaacccaactgccttcatcagagcttccatcgacatgctgcgttaccttgagctccacgattatgctgacaaactttctgatgccctttacaaagcattgacggagcagagaacgcatactcccgacattggagtaagttattcctgtgcctgcccacaaccatggaaaactaaaaaaggaatggaaattcaatgccaaaaataaagaaacccatttcacttacaattaatgttgaggttcattagagattaattgttcatttcacctgaaatcctcaattaattaatacaaaatggtttcacatttattttttgcagggcacgaatcatagtacagaagttgttcaagcagtcattaacaactacagcgagacaatcagtaacgcttga

SEQ ID NO: 47054 - DNA, 1671 bp, Heterodera glycines
  Genomic contig location: Contig_ID=SeqID_12612; Location=2501..4171; Strand=-
  SCN-specific regions: Sequence locations=1-163,185-479,501-688,710 -779,801-1671
  Gene Ontology: Mol. function=transcription factor activity; Cellular component=nucleus; Biological process=transcription from Pol II promoter
agcttgctgcctgcggtctccaagcggctcacccggcttccaactggggctactggctttggactgtacagtccaaaaaatgagtcagacttccgtcagatcatttccagcagtgcaccaacttcgtgtgacattgagtatgtggagaaaggacagttggaaccaaaaatgggtgggggtgtgaacttttgacaatgagaatggaaattataatgtgttagggttagatttcagtaatgatttaggaatttcatccgtcggggaaatgtcgtaaattcgcaaaatgcacaactgacaaatggaggaggaaatggtcagcacggcttaacggaggcggaaatttacaaagacaggcgcaagaaagacattcacaacatgagttagtttaagggagagctgaaagaggggagggcataacgaaaagcaaattcagtcgaaaggcggaggaggtacaacatcaacgaccggatcaaggagttgggactgatgctcccaaagtcgacttccgagtaagaaataggccgtacaaattaaataaataacgaaaccgaacacagggagatgaaactgaacaaaggcactattctgaaggcgtcctgtgactacattcgtcagctgcaaaaagacagagagatcatgatcaggtcaatcagtcagcatgggttggttgaataagtggattaggttgtttatttcttttgttttctctacaggcaacagcagcaaaccgcaaggttggaggacctgacacgacagtattttcagcgggttcaggttcgggtctggaatgctctcttcttccacgggattgtatctttaaggaattggaacaccaattggagaagaatggcatcaacgtgcctccgtccaatctacccgttttgggctctttatcgccactttcagtgaacggcagtaacaagtcgataaaaaaagagcctccagaggacagcgtcaacagtaactgtgctcagcaatcggtgtctttttcgccttctagcacgcctcaggcaaccaaaattgcaacgagtctgcaagacatgcaaattgccagccccattggaacggccaaccagcaacaacacgtgacactgcttaaaatgacgcattccgggccaacccacaatcatcatcatggctttatgatcggaaatgcgtccaatgaggtggccaattatctcagccaacactccaacgcaaataacaccaacgaaggcaacaacggcggcggcaacaacatggaccttttgcaacagcagcaacaacaatcgatggaatatggtgaggaacagttttgcggcggtagtggtagtgagtgccgtgtagaagcgaccacaattggaggcaatgcttttttgatgccagttccaggcgggtgcctgaactggccctcggcacagacccagttaggccaaatgttcaacgcggtgaattacgcagagctgagcatggaggagtttcccttccaggtcattcaaacacaaccacggaaatttaatgaccgctaattccgttcagaacagagggccacttcaagggcaggatccgctgattggctcctcacttaacaatcagctgtcgcccataatccaatgggaccagtcgggcttttcacctggcaacgacaccaacccgtgaaagaagaatgttgtacaaaatattgaactgtta

SEQ ID NO: 47055 - DNA, 625 bp, Heterodera glycines
  Genomic contig location: Contig_ID=SeqID_173; Location=41..665; Strand=-
  SCN-specific regions: Sequence locations=1-282,304-625
atggcgcaacttccaccagaggacgtcgcaacaatgcccacgcagaaggtcgtcttcaacgcacctttcgaccacaaggtcacctgccacatgcgggtgcgtttgggctttgggcgtggtgccgtggtatgcggaataacctcccccccccctttttcaggtgatcaaccctgggacgaagcgcatcggctacgccttcaagactaccaaaccgaagcgcatcaatgtgaacccgccgaccggagtgctcggcccaaaggagtccgtcaacgtggccgtctcctgcgacgccttcgaccccggcagcgaggacaccaagaacgaccgcgtgaccgtgcagtggaccaacgcgccggacccagccgccgcgttcaagctcgagtggttccagggagaccggaaggtgcgccgcaaggccttgccgatcaagtacaacgtctgatggaaggatgcttcgtcacctcaacatggacatgataggatcccatcccaccgtcccaaaattgtcattttgtcccccatcatgtaaattgttgtatctgtatgtaaatttctgtgatcatcatttcaaatgaatgtatatttaattgtactatgtaattgtattgttgttgtgcttaataaa

SEQ ID NO: 47056 - DNA, 624 bp, Heterodera glycines
  Genomic contig location: Contig_ID=SeqID_174; Location=389..1012; Strand=-
  SCN-specific regions: Sequence locations=1-272,294-624
atggcgcaacttccaccagaggacgtcgcaacaatgcccacgcagaaggtcgtcttcaacgccccgttcgacaacaaggccacctactacatgcgggtgcgtttggcgtggtgcacgtggcatgcggaataacccctccccctttttcaggtgatcaaccctgggacgaagcgcatcggctacgccttcaagaccaccaaaccgaagcgcatcaacatgaacccgccgaacggagtgctcggcccaaaggagtccgtcaacgtggccgtctcctgcgacgccttcgaccccggcagcgaggacaccaagggcgaccgtgtgaccgtggagtggaccaacacgccggacccagccgccaccgcgttcaagctcgagtggttccagggagacgggatggtgcgccgcaagaacttgccgatcgagtacaacgtctgatggaaggatgcttcgtcacctcaacatggacatgataggatcccacccatcccaccgtcccaaaattgtcattttgtcccccatcatgtaaattgttgtatctgtatgtaaatttctgtgatcatcacttcaaatgaatgtatatttaattgttgcctatgtaattgtattgttgttgtgcttaataaa

SEQ ID NO: 47057 - DNA, 170 bp, Heterodera glycines
  Genomic contig location: Contig_ID=SeqID_175; Location=1161..1330; Strand=-
  SCN-specific regions: Sequence locations=1-10,32-170
tggccgtctcctgcgacgccttcgaccccggcagcgactcctccaagggcgaccgtgtgaccgtggagtggaccaacacgtcggacccagccgccaccgcgttcaagctcgagtggttccagggagacgggatggtgcgccgcaagaacttgccgatcgagtacaacgtc

SEQ ID NO: 47058 - DNA, 2007 bp, Heterodera glycines
  Genomic contig location: Contig_ID=SeqID_1838; Location=1696..3702; Strand=+
  SCN-specific regions: Sequence locations=1-188,212-459,490-1768,1790 -1791,1822-1843,1865-2007
  Gene Ontology: Mol. function=trans-hexaprenyltranstransferase activity; Cellular component=mitochondrion; Biological process =ubiquinone metabolism
atgggcgtggaacttccgccgacgataaccgagcgactgagcactttgaaggtgccgaaattggggacgaaatggaaaacagagacaaatcatagagcgattgggtagtaattcgacattgcagaaggatgtgatcgatgctttgctggacaaaaacgcggtgccccccgaactgatcacttcgctgatggccggcgtcggcggctcggctttcagcaaagcgctcgaattggtcccgtcgtacaaccaaaacttgcagaagatggccaagtattacttcacggcaaaaggcggcaaactcatccgaccaacagtttcgctgctgatgagtgccgcgtgcaatcaatgcgcgaaaaggccaacgacgccggcggacaccgccccgggcaggcaagcgaaatcacaaagagtgtgatcggaaagggaaaatagggacaggaaatcccggaaaacccctcaattatttccaataaaaataaataaattaggacaccaaccagcattgtcaatgagtcggaagaacagccaattgagatcagtatgaatcagtacaggatagcgatggtggccgaaatgattcacaacgccactttggtgggtgggggcaatgatgtgttggtaaaagaactattttcggaatattcaggtgcatgacgatgtgattgatgaatcgaacacgcgacggggacagccgacggcgaacgcccggtggggcaacaaacaggtggagaacgaacaaaccacccaatatcaggggacggggaatgggcaaaccacccaatatcagggaacggggaatggacaaaccacccaatatcagggaacggggaatggacaaaccacccaatatcagggaacggggaatggacaaaccacccaatatcagggaacggggaatggacaaaccatccaacatttggtgagaaatggacaaagcacccaaaaaatattaggacgggggaacggacaaagcatctatcgtcaatcaaacgcgcaacttttctttaggctgttttggtcggagattttattttggcacgcgcaacaaaagttttgtgcagcatcggagagccgcccgtcattgagacaatggctgagattgtggaggatttggtgaagggcgaactgctccaactcaacgggccatgtaatttcgcttttttcatggaaaataagtaattcgtgccccttacgaatttctgttcagccacttcgactggcaatgcacggttcaaccattacatggtgaagaccttttacaagacgggcagtctttttgctaacagttgccgttcggtggcaatgctttcaggtcagtacattttgtttcgcgttttcatcctttcgtttttgttgacgtttatcggaatatttttttggaatctgtgcatttaagaaaattgcaatggactccttttggagttgaccaccgaattcggtcgaaatttgggcctcgcttttcaactcgtcgacgacattttggactattgcgccactgaggaagccatgggcaaaccgacggccaccgaccttcgccttgggttagccacctgccccgtgctattcgcagccgaagaattcccggacgcgttgaatccgatgatcgaacggcgcttttccgccgacggggacgtgcagagggcgttggaattggtccaacggtcggacggattgacccaatcgcggcggttagccaaagagcagggcgagaaggccattcaatgtgtgagtgaaggagcaacgtttccatcccttcgctgtgaaaatgaattttaaggaaaaattgctgtctttttaaaaatgtataaaaataaaaattttgtagccaactacgcttataattttgaaaaattaaccttgtgaaaaagtcttcggattttggggtcgaattgtcacttttctaccataactgatcaaatgcaggctgaacagctgttgccggagggtgggctcgtgcgcgactgtttggtggacattgtgcagcgtcagttgtccagagaacggtga

SEQ ID NO: 47059 - DNA, 2631 bp, Heterodera glycines
  misc_feature (2574)..(2574): n is a, c, g, or t
  Genomic contig location: Contig_ID=SeqID_12621; Location=159..2789; Strand=+
  SCN-specific regions: Sequence locations=1-125,147-393,506-678,700 -1596,1618-1829,1851-1946,1968-2060,2101-2177,2200-2425,2447 -2505,2527-2631
  Gene Ontology: Mol. function=protein kinase activity; Cellular component=nucleus; Biological process=development
gtcaaaaagttcgcttctcagcatttactgcagctgaaacaccttttgggcggtaagtccttctgcaattgatcattttgtgctttttcctttcattttcgctttgtttttcttaaggacgcggttttttgaagttcaaacgattgtatcgcctaaagggcgcgcttggccacggcggattcggaattgtttaccgcgcggtacgaataagcgaccaattaccagtggccgttaagtgaggcaacaattggcgatgcctaaaattgtgaatttgcagattcatcgaaagacgcaatgtccgcgagtggggaaaggtgagcaaatatcgacgccgaggaggcgggaattgtgatttatttttggatggtattccgaattcggcaatttttcgaattcttctctccccccccccttttctcctcctttttgttccttgcaccttttgttctcccttttcctcctcttcgccattgtcttctcctccattctctctttcttctgttccacttgtgatttcctttcttcccacagattgatgaccacaaagtgcccatggaaattgctttgttagcgcgttgttccaatgtttcgggagtgattgcgctgatcgattggttctctttgcccgagggttttctgatcgttatggagcgcccaattccctgcatggatttgttcgatttcatccaccaccagaaaatgttggatgaaaatgtcagccctttttagcaatgcccttcctttttttggcattttctatttgttttcagttggcccgtttccttttcctgccaattgtcaaagccgtcatcgaattgaccgaacggaaggtgttgcatcgcgatttgaaggtgttgttgttcactttcgagcttttgggtcggataatcgtttataataaatttaggatgaaaacattctgattaatttggccaacggtcaaataaaactgtgcgttcttttgccttcccccttaacggtgccttcttttttgttcagcattgacttcggtgcagcgacagtgttcacgcgcaatcggtgccacgacttccagggcacgcgtttgtactgtccgcccgaggtgccctttcatttggcactttttaattaccatttgatcatttttactctttgatcactccttccccctctccagtggtttctccattcgctttatttgggccgcgaggccaccgtttggtcgctgggcgttcttctctttaatatgctcaacggacgactgccctttctgaacgagaaggacatctgcacggcacatctgcttggcccattgccattcttcacaactctctccaaaggttggaaggcattggcgtaatgccatagccaatgccaaattcgattattatttgatggaatatttcaacttttcagcggctcgtgatcttttggcacaatgtctcagtttcgagtcagtgccctcctccttttttcctcccacccaatttaaattgtcttccttacaaattagggcgtcttctcgcccgtctctccaccaaattttggcacatcaatggctaaatgatgcgtctgccccaattaattggtgccaactgagtgcagcatgctgtagccaatgggttgtgggaaaagtggaggaaacggaggagcaaagggcagtgaccggcatttgccatcgaaacaaaaacgaaggaaaggacggcgaaggaagaaaacgaggagagacggcattggcactgagttacgacgagcgaactttgataagcgggaaagaaaactgcgcatcattttcacaacaacaaagtcagtccttccaaaaagcgaagggacgatgggaaattcgccaaatgaaattccattttcattcattggcaggacgaattcgccactcatcagcacaacgaatcgtttcacgctctttgcacacaacggcactgtccccgagaaacagtcacaaaacacttaacacaatcagacccacacaaacaacagacattgcccagtgaatatgaaaattgaaattagaacccaaaactaagacgtttccagtcactggaataagcggtttatagtaaaagttttaataatgtaataagtttattttattaaaataaatttgcaattgaaaatatttgagaaaattgcgctttcaaaaaaagctaaagcggtgccgataaaaaaataatgtattttaatcatgaagaaaatatgacttttaagctcgaaaagcggaatttcatttttgatttcgttaactgttctccgttcgttgggcttcgttctgctgttgttcctttgcgtcctccgccttttcctggcgatatttctgcaaaagatcacacgcatctttcaaggaacgcttcaaatcctcaatttcgccaataatctcctgaacaattaaaaaaaggattatttaattatacattccaattacgaaaatcaaacaattattttgccttgttttgtgagtcgagcaattccttcaactgatggcgcgtatgttcaacttaagagggatacattagacaaaaacaagaaagaaaattgagtttttttcaaaactgacaagatgggctcttcttataactatgnaaagtcatcagcgcggcatacattggctcagtcggctcattaaacacaatttcgtcg

SEQ ID NO: 47060 - DNA, 748 bp, Heterodera glycines
  Genomic contig location: Contig_ID=SeqID_12627; Location=2135..2882; Strand=+
  SCN-specific regions: Sequence locations=1-236,258-457,479-530,560 -588,610-748
atgtcaacccatcgtttgctcccgtccctcccgcgtttaaaagtgccaatcggacatcggccgcaacggcttaaacttccgtacattcccaacccgcgtgggcacttggaattggtgcgcaagttggtgaacagagtgatcagagaagaacggtgcgaattgaagtacaatcgagcggaagagtgccgtcagtacgtggagagggtcagtggcacttggcaactatttgctgatggtttcaaaaatttcacagctcatccaactcggcatttaccgtggcccgaactgtgcctacaccgcggaaatgtttcagtggtggttcattgagcaggatttggtcgacaaaatgtggtctattttggtgccccgtttttcgcattatccaatcgatcagtcgtacaccgaaatctatcgattgccgaccattcgactcaagtcgaaagtcaacaaagagacagagttctggaaccgttactcaattgccgttctagaactgaaaggtcgagaaactccctcatcatcagagtttccatcataattctgattgtgttttatttagagaacccttttccgccaatggatgacttagaaaaattgcgcaagaaaaatctggtcgattatgtggagaaggaattgctgaggactgaagaataataatagacgtcaatcggaatattttattgtttcctttccatcgattattatgcttgtttccttttttggatatacatatatccgaccggaaaaa

SEQ ID NO: 47061 - DNA, 1016 bp, Heterodera glycines
  Genomic contig location: Contig_ID=SeqID_12629; Location=675..1690; Strand=+
  SCN-specific regions: Sequence locations=1-157,179-312,335-455,477 -613,635-811,833-1016
atgaaaagttttgtcaaggacagatttttcgtgtttaatctggacctgggcctgtattttttttcatatttgatctacatacctaaatttcctgggcaaaaacaaggaaaacccagctgtcgaaaaatagcatgtaccagaaaaaatcaaggcctggatccaggtcctggtcaatctctagttttcattggtttgggggttcgctgcaaaagcaaaaacatgagattgaattgaaacctttcttaaaattttattctgtcaatcttaaatttatacgcacaattattatttaacgaatttatgtttacatacataattacatactttttcagtttatggattccttaatagtaacttctcttgtatttgacatcgattcattcgctagaaaattttcggccgaacaaagtgacttcactctaagtcgcttttcagaaatttttatggaaatggaactttcaagcatatttcttggtcgcttttctttttctgacttggttgaggtatggaatgcgttctctttcaaagtttgtataatatgacattgtcgaggggttttcgcgaaatccggaaaatctgaatttgcgacttttttaattgaaactttacttcctttttacagttttctgaaaatctgttcatctattgctcacgttttatgttcaccccattttcgagcactggttctgttggaaatggtgatcagattcatttcaactcagatggaatgtcatccggtagaattgcggaccgaaattacaaagtattttttccaagtaatctttcacaataaaaattttcagcaacgattatttggactttttctgtgctacagtttttactttcttcaaccttcgcaatacgttgttccgatttctgttacttcttctcagttggatgatttctatgaatttactagctccgttcttttacctgaagagaatttcgaggctctttattgtttttaccgtcttctcaacgcaaacgcattctcaattgcccctgttttgggaaat

SEQ ID NO: 47062 - DNA, 1860 bp, Heterodera glycines
  Genomic contig location: Contig_ID=SeqID_12648; Location=29..1888; Strand=+
  SCN-specific regions: Sequence locations=1-552,574-668,690-1222,1255 -1860
ggcggttccgtatggacaaaggactggcgcagcggcaaatgctgttgtgttggccaaggcatccggcaaattccgctggacatggccgggccgggacgcgcaaaggcagtgagcacaatgtgagtgggggacaaacacggtggtgatgatcagagtggccagatcagtgtttaaaattttgatctggtcccacagttttgatgttgatcagtttacgtgttttatccgtgataaggccttcatttttaaaactgacataatctgatcataattggttatttaaaaatgattactgacactaatagtatgaattttattctgatcaaaacaatggatgttcactgatctgacacgaatgatcacttggcacatcaagtcataaatgttcacccgttttcagttatttcttcgacgtttcattgggtcgtctaacgcccgcttcattcgccgcttttcctaatttggaagagattttcttggaccgcgcttctctgttggcacacgttgacagtcgggcattttctggactcaaaaaactgagaaaaatgtaattttaattcaaaattggcattttcccttttcgttcctcgttttttttggaaaattgcccataaattaaaaaagagttctggcatcatgttcatgctcgagttttacgcccctccccttttcagcacaatttcaaactgccccgcactggtcagctggactggcgttatgttgcgcgaaaacccgcaaattcaaacactgtcagtgggcgcccaactctcgagactttaccccgaaactaagaatagagagcaacaaaaaaaaccagtctttcccgagtcgagatcatgaagaaacaccgattctcgattgcagtgcggtgctgaacagcggcgcgttgcgcgagttgccactgctcgagatgggcccgcagcattcgctgcccatggaacgcatcgatttcagtggtgggtggtagagagcggaaatttctaattttctgatcccgctgcgggacttgaactcatcacgcgctttaatccacaaaatcccgaaatcctgcgtttttcaaaaaaaaatgcgggattgtggattgggattcccaaaaatcccgcgtttgatccagtcccactccgccggtctggagtaggtagtaaaagtgtttaaaatctcctctcattttgtcattgtttattttttgtttcaggcaattgcattgcacaaattggagaaggtaataaataaatatacacacatagacacatcgggaaattgtcggaatgcccttttttgattgccggtttcttacgaagttttttggtgccatcggaacccggtttccgatttctgaaactttttgagggcgtcggttattttcactgatttgcttagatttaatgtttaaatttcaaattgcacaaatactatgtgaaacgccgcccgcttaaggtgcgctgcgcaatgtgcaggccaaaacggtgtcatttgcggacaatgcgccatgccttcgcgcaatcaccggaaacgcattcccggcatccaaatttgtggagctgtgcgtttttttttatttagaattgggaaagagttccgccagctgccattatcattagctgatgtgctcgagagtcttctcgagccgaagatgaacagacagtccaaccgctcgcaaccattttggcacttttttccatcatttccaggcatttgtcggcaaatccgagcctggactacattgccgagactgcatttgccggcctggcacacattgagcatttggacatgtcccagaccgacatcacggcactgcccttcattggacttcgttcgttgaagcaactcacattgaaggtgtttaaccttgttagctga

SEQ ID NO: 47063 - DNA, 815 bp, Heterodera glycines
  Genomic contig location: Contig_ID=SeqID_12653; Location=1030..1844; Strand=-
  SCN-specific regions: Sequence locations=1-8,30-452,477-493,516 -647,682-761,784-815
atgttcaaatcaaatgcttcttcctctgtcccttcagcgcgtgatcccaattatgcaactcttggccaattggacccaaacatttttgtgaagaataatgcaccaacaaaagcaacgtcaaatcagcagaagcagcagacaaaggaaggacagatgatattcgtttcgagtaaaaccattttttgatcagagaatgttcaattcaaatgctttatctctttttcagcgcgcaatcccaattatccgacgctggccaagcttgacccggacatttttgtgaagaataatgcaccaacaaaaacagcgccaatcaaacagcaggcgaaaggagggggacggggttatgcgacaagtaaaaaatgatggataaattcgttggatttacctaataattctttttcttttcagcaactgatcctgattatgcgacgcttggccaagtggattcgaaaatctttgacaagaataatgagaaggatgagaagactggtaccgacgacgacagcgaaagcagctaggcacgccactgatgtgtctttattatgaggaaatcggatggaatgatcaatgttatatatgctgtgtatttgtcatgttattgtctgtctttgtcgaaacagtattaaaaaaagttcaattaacggataatttatcgaaggggggaggggtggatttggttttatgcgctggatctgcaatcgcaaaaaatttgctaaattttaccgaccaattaattcaacacataaaacattgtgtaagaaatttgcacaaagagaaattttcctttatcttggaaaacgcaagcaaaaaataaa

SEQ ID NO: 47064 - DNA, 570 bp, Heterodera glycines
  Genomic contig location: Contig_ID=SeqID_1846; Location=768..1337; Strand=+
  SCN-specific regions: Sequence locations=1-173,195-348,371-570
  Gene Ontology: Mol. function=protein binding; Cellular component =cytoplasm; Biological process=G1/S transition of mitotic cell cycle
atgtccgatgctaaaatggaaattgaggagagtgcgacgtctacttctgttgcttcattatcagcgattaagaagcgttttgaagtagattgatacaaaattcgatttggttaataaaatatattaaggtcaaaaaatggaacgcagttgcactttgggcatgggacattgttgttgatacatgtgccatctgccgtaaccacataatggtattcaaattttgctaagttatttctgacattttacatttaaggatttgtgcatcgagtgtcaggcaaatcaggttattatatatcaacaataataattataacaattattggtaatcatcggttttactggtcccataaaaaagaggtaaaaaagagattttgaggtgctcttgggggttttcgggggcgctgaacacgaatatgacatccatttcgacctatttcgaaacccggacccgaattccaacaatttttttttgcatttttcactcggaatttgcgtaaaccttctttattgtatgtaaaaacaaactgtctatgcgctaatataatccaaatgtaaacaaaagatgaagaa

SEQ ID NO: 47065 - DNA, 3256 bp, Heterodera glycines
  Genomic contig location: Contig_ID=SeqID_1847; Location=615..3870; Strand=-
  SCN-specific regions: Sequence locations=1-224,246-656,678-1101,1123 -1211,1234-1401,1423-1698,1723-1914,1941-2475,2498-2660,2684-3256
  Gene Ontology: Mol. function=serine-tRNA ligase activity; Cellular component=cytoplasm; Biological process=tRNA processing
cctcgttcgaaaaaaaaattcaaaatttttttctcgaagcagtcatttaactcgctttgaaaattaagcggaaataagttttttttgcgctcctctcgataagtgctacccacagaaaaatagataaccccagttattagtcctaaaggtacctaaccaactcacatccgtcacgggattgtattcttgaaagtattttttgtgcaattccgaggggacgtcagtattatccatttacattcaaggcagataaaagcaacctgacgagtacgaagccaacgcgaaatgcaatggaaatggaaagcgtggttgcagacgccccaagcaacagtacactcctcattggttgaagaagccttaacgtgtacataatttaaatatattttatgttacaaaaactagaccaaataagtaattttgaatcgaaaaccccagaatctattgcactttttcttcaaaaaacaccatctatagtattaccccgactttgttttagtttgttataaattgtgctttaaaaaaaactcaggggtggattggttagattcataaaatgtgattggaattatagtgcaatagaatcgaatgtggggggaggaagacagagtcgcacattgtgttaataattgggtaatcatcggttttactggtcccataaaaagaggtaaaaaagagattttgagcgattttgaggcgctcttgggggttttcgggggctctgaacacgaatatgacatccatttcgacctatttcgaaacccggacccgaattcgaacaattttttttgcatttttcactcggaatttgcgtcaaccttcttaaaaattagctaaacttagttaaaaaatgaggacgggtgggtggtcaaagtgtaggtgaggtgattgagtcgtcgacgctgcattcaaatgaccgacaacccccccccccagctacagtcgatgtttttgtttattccgctacatgaaagtcaatcaacaaatcttcattcgtatttatttcttcatcttttgtttacatttggattatattaacgcatagacaaagtttgtttttacatataataaagaaggttgacgcaaattcctagtgaaaaatgcaaaaaaaaaaaaaaaaaaattgttcgaattcgggtccgggtttcgaaataggttgaaatggatggcatattcgtgttcagcgccccgaaaacccccaagaacacctcaaaatctcttttttacctcttttttatgggaccagtaaaaccgatgattaccaaaagtcgcatttggaatttgggtggaattccttgcaatgggaattcggatttagaagaaagagtcggctggtgactccgatgccattccggaaggacaaatcaaatcacttgcagaactgaaaatggatgacatcaaagtaaaatgactgaacctttctttgtaccgactgattttatttggtattttaggaaatgaaaatttcgcaaattaaaacagtcaagggaatggtggacgaagaagtcagacggaccaaactcagaatggaaacgcttgagggggacagaaatgagcatttggccaaaattgggaatttgctgcataattcggtgcccatcagtgacaatgaagacgaaaatcgagtcgaacggacatttggcgactgcgcaagcagaaaaagttattctcatgtcagtgatttgactcatggttcagtcattttcctcttttccaattgaaaaacaggttgacctcgtggtgatgtgcgacggatttgacggagagagaggcaccaatgtggcgggaggacgaggctattttctgaaaggaccgttggtgttccttgaacaagcgctcatcgcattggcattgcaaatgctcaacaaaaagggcttcacgccgctttacacgcccttttttatgcgcaaagacgtaatgcaggaggtggcacaactcagccaattcgacgaagagctttacaaggtgtacaaaaggttcaaaatgttcggattccttctttactattgagattgaccaaccagggagggcataacgaaatttttgaaacaaaattttagattttggctgtgtttcttacccattttaagcccgagccattactagagaaattatgagttaagtctattttaagaaaattttggcttttcaaaatcaccttctttcactttgcttgtaacttttatgggtaagtataagtttcttttaggtgaccaccgcaaaaaagacggacgcagccaatgaagacggctctcccgacgagaaatatctaatcgcaacttctgagcagccaatcgccgcctttcatcgtacatttttatccgtttattctgctcccctcaactttgccatttgtaaggtgacgaatggcttaacccatcggatttgccaatcaaatatgccggaatgtccacctgttttcggcaggaggtttgtatattctgccaatatttgtttctttaatcccgtggcatcgtcaccttttattttcacttttttaaggtcggaagccatgggagagacacccgcgggattttccgtgtgcaccaattcgagaagatcgaacaatttgtcatctgttcaccatttgacaacgaatcgtggaagcacatggacgaagttagtggacttttgaaaatatagtccattaaatttaattctttttaaaattcagatgattggcaatgctgaagagttttgcaaagtgctcggccttccctaccgaattgtggccattgtttcggccgaactgaacaacgcggcggcaaagaaattggacctcgaggcgtggttcccgggcagcggtgcatttcgggagctggtttcatgctccaactgtacagattaccagtcgagacggttacgaatacggtacggacagacgaagaaaatggacggagaggtaaaaagtgatttgaaacgaaaggatcagccggcaatcaattaataaaacggataatgcccttcatccttgaccatttgtcctgttcttgggttcagcttttctgcggtttcttatttgcatttcttctcttttaggtctttattaatgtcaattccaggtcaattatgtgcacatgctgaacgcaacaatgtgtgccaccacgcgagtgatctgtgccattctggagaacaatcagacggaggatggcattgtcgtgccggaacccctgcggccgtttatgccatcgcaatattcgcaacgaattccctttgtaaagccggcgccaattgagcaggaaaaagtgcagaaaaagaa

SEQ ID NO: 47066 - DNA, 288 bp, Heterodera glycines
  Genomic contig location: Contig_ID=SeqID_1847; Location=4466..4753; Strand=+
  SCN-specific regions: Sequence locations=1-288
atggacaagccaatcaaactcgcgaaagtcacgcgtatccttggttcgttttataacatttagctgatgtactctctttttaggacgtactggtagccaaggccagtgcacgccagttcgtgttgagtttttggatgacacaaatcgttcgatcattagaaatgtgaagggccctgttcgggagggcgacattcttaccttgcttgtgagcaattaaatttgttttcgtctaatgtttaacactgaaatttttaggaagctgagcgtgaagcacgtcgcccccgataa

SEQ ID NO: 47067 - DNA, 800 bp, Heterodera glycines
  Genomic contig location: Contig_ID=SeqID_1847; Location=3514..4313; Strand=+
  SCN-specific regions: Sequence locations=1-112,134-562,585-800
  Gene Ontology: Mol. function=protein binding; Cellular component =ubiquitin ligase complex; Biological process=protein modification
ggcttcttcaaccaatgaggagtgtactgttgcttggggcgtctgcaaccacgctttccatttccattgcatttcgcgttggcttcgtactcgtcaggttgcttttatctgccttgaatgtaaatggataatactgacgtcccctcggaattgcacaaaaaatactttcaagaatacaatcccgtgacggatgtgagttggttaggtacctttaggactaataactggggttatctatttttctgtgggtagcacttatcgagaggagcgcaaaaaaaacttatttccgcttaattttcaaagcgagttaaatgactgcttcgagaaaaaaattttgaatttttttttcgaacgaggaggggggggggtggcaccatcggcactgtaaccttttagatttttcacgtaaaacatacacgttatggctaaaaataaaggtcagattcttgatcagcatcaaaaattagcctagaaaaaattattagagaaaaaatttcaagggggtgacaaaacccggaagtacccaattttattcactttcccgaatgtatacattgaaatattttgaaatataatttcttcaggtttgtccgttggacaatcgcgactggtaagttcgtattctttgttcctaaaatttttgtaaattattagggagttccaaagatatggacattgagttgccttgcggttattgcacacggctgaatatttgggatcacgatcattatttaaatatgtgttttgttaggtacttgacaaaatcatgactttgttttttctatgaaagtattaaaaag

SEQ ID NO: 47068 - DNA, 1348 bp, Heterodera glycines
  Genomic contig location: Contig_ID=SeqID_12660; Location=866..2213; Strand=+
  SCN-specific regions: Sequence locations=1-69,106-136,165-325,347 -1058,1080-1197,1219-1348
  Gene Ontology: Mol. function=ubiquitin-specific protease activity; Biological process=positive regulation of body size
atgtcagcgcaaaaaatcgccagcgattcggagtggaagaaaacggtgggttttgggggatttggccggaaattttttatttttaaaattaattcatttatttttcagcccatcggacaaactggccttttcaacatgggaaacacgtgcttcatgaacgccactcttcagccactgttccatacgcccggattttctcaactgttccaagaaaagagcgcgcagcgattcgtcaatgggtgcgtccgcagtgccggggccgtcttcgaattttcataaaattcacaatttgttttctttttcaaggaacaactcgtttggcacgaaaatgtcttattttaaaagtaaggcaaaaatgccttaagtactaagtattttcaaaattagagccgaaaagaaaaaaagtaaagccaaaaatctttctttttcaaggaacaactcgtttggcacgaatggggtgatctccggctcattctctgcgctcaacgacctgatctggtctggcaagttcaacgcacttcggcccaccgccttcctggtgagtgactctgtgcctttgatcaatccattctaatcaaatttttcctttttttcccaaaggaattctttgctcgccgtgtcaacgccgaaatggccaaccgacagcagcacgacgcccaagaatttcaactctatctgctggatgcgcttcacgaggacaccaaccgggagagttttgccattttatgttccatttttcacgctccccccctccccattttcaggtcaacaagcgacaatcgtttgaacagaactacgacgacaccgacttgggcgccagcgcttcggatttcaatgagagggcgaaactgttctcttcgtcgccggtcaacgatctgttcaacgtgagtttggagccataattcattttgtttttccgccgccaatttctaatcattttcccctttgtttcagctgacaaacatctacagggtccaatgcagcacgtgcaatacgacgagtgctcgcttcgaggtcgtcaaccaactaaggtgggtttgagtcacagacccaaagaaaattccctaatttgaatttccctttgaatttttcagcctcgaaatgctgaccaacatcgacggcctgacgctcaaggactgcctggaggcgcacttttcatcagcagtgagcagcaccacagcctgaatttgtgtctgatcccattttcccctccctttttcagagtctcgaggataaatgggagggattgtccgaagtgcaaaaacaaacagccggcgacacggagcacaaaaatttgggagattccgaaggtgctgatcgtccatttgaagagattttcgctgattga

SEQ ID NO: 47069 - DNA, 1315 bp, Heterodera glycines
  Genomic contig location: Contig_ID=SeqID_12663; Location=1101..2415; Strand=+
  SCN-specific regions: Sequence locations=1-77,99-669,712-956,979 -1070,1092-1199,1221-1315
atggagtcggaaaatgggaaggaggaggggccatcttcgaccaccacaaagcccgccgttctcccatatgggcaattcccaaaaaatgtgtggtttttgcgcgaaaattacgtgctcgactgtgacgagttccttgaaatggttggtccatattggtttggtatcatatttttatcataataattagctaattgtaaccttctttgaaagtccggtacccaatttaaaaaaaccaagccttctcttggtctatgtatcataggcgtaactgaatttcacatgttacttttaatcatcgacatttttcgggaatgccatgggtttttattggttgacagaaattcgaatgttccccaacgggtcattaattgtcaatcaaatttgatattagaaaacattttcagtgtttgtttttttctaattttctccgccccaaaggttcgcgaggagtacgacgtgattttggcgctgagcatcaccaaatgggtacatttgaactggggcgacgatgggctgaaacggttcttgcgtcgcacctttttgaaccttcggccgggcggacgactgctgttggaagcgcagccattccccagctattacaaaaaggcaaaaatgacggtgagtaattggagaatttgccactaattggtggcatttgttttttgaaggcttgtcagtatgtttgattttttacaaattggtattttcattacagtctgatatgttcgagacgtacaaggccatccagttcaagccgtaccagttcaaggacttcctgctgtccgacacggttggcttcagcgagtgcgaagagttgggcacaccgacggcaattagcaaaggtaaagaagaggagacagtgtttagtgcataatcattgtcaattgggcgtcttttaagttcttgggttcggcacttttagaagcgcgggaattggttttgcaaattgctcattcgaaagcgctcctcctctccgcttaaaacttgaaattactatgactaaaatagtcaaatttgttacaggttttgaacggccaattttggtgttcaagaaggcgtcatcgtcgactacaccaacaacaacaaagcggaaaagggagagatgtcttcgtccgtaaagggcggcgccgagtagttcatcttctgcagacgatcagacacgggaattgtgacgaatttatttcacgaattggacatggatttttctcccgcctcaaatcgatgtgtgccaaaactccattccatcccatttattttgtttgtttgttaaacactttgttcattttaccatcaccatttttctatttttatttga

SEQ ID NO: 47070 - DNA, 1010 bp, Heterodera glycines
  Genomic contig location: Contig_ID=SeqID_12682; Location=73..1082; Strand=+
  SCN-specific regions: Sequence locations=1-4,26-413,436-449,471 -819,846-1010
atgaaaaaagaatattttattaactcacaaaggatttcagaatcggataatgttcgtgacttgggaattataattgactcgaaactgaatttttcagaacatattagaaaaattgtacgaaatgcatatcttagaattttccaaattttgagagtgttgaaaagcagggaaataaaaactctaacagcagcctataaaacttttgtacgacctcaattaaaatatgctactgaagtttggaaccctaatcttaaaaaagacatagataaaattgaacgcgttcaaaagtttttcacgagaaaagcatttagaaaattcggtttttgtacaaaaaatatggggaaagactaaaaatcacgggtttacacaaattggaagaaagaagaaaaatcaattatttaacaacatcttttaaaataatcaaagggttcaccagcctcgattctgggaaaagtttctttttctcaaaaaggctcaggaggcctttacttttacgggtaaagcgccacacggccaaaactcaaaataattttttcaatagaatagtaaaaaactggaataatcttccagtggtagcggtacaaattaataaggcaaaggaattcagggatttactaaaagcaatgagttctgagtaggattttccatgttgccatatttacactatatttttatcacctgtgaatttttaacaattgattgaattattttattcatttttattacggtattcattttgtatttttaatttgatcaaatttatttgttgttttctttttggcaccatataagagcactaatgtgcctttggtttgctcgataaattaaattatttatttaaaaaacacaggattttttttcctcactttcatcactttttgtcgaagattttctctaaattattttcttttcattattttataaatgcaaaattgcatttttcacctcattcatttcgagcaactcgcaaaagcgtctttttctgcacaaatttgcacattataattaaa

SEQ ID NO: 47071 - DNA, 2511 bp, Heterodera glycines
  Genomic contig location: Contig_ID=SeqID_12684; Location=529..3039; Strand=-
  SCN-specific regions: Sequence locations=1-215,255-310,332-350,386 -826,863-1021,1051-1127,1149-1165,1188-1327,1380-1457,1494-1793,1816 -1884,1921-2096,2121-2511
  Gene Ontology: Mol. function=5'-nucleotidase activity; Cellular component=cytosol
atgaattcttcagcagcaattaatgcaaaccccagcatgagtgtgccatttcatctccaaaaacagatctcgatcatcaacaaacgggagcccgaaaagcggtacgacacccaaaaaaaaaaaatgacccatgaaaattttttaaaaaaaatgcgtttctttacggcaccgccgtagccttcgcttcaacttttttgggcctaatttaatctatgacaattttttctcccaattttcattcaatttccccttttccaaattgcagaatattcgtcaaccggacggttcggcttgagaaaattcaattgtttggctttgacatggactacacattggctggtaaggcgacgttttttttaattagaaaatttcattattttttttacaatatacccagcgtcggtgagaaaaaatggaattcgtaacccttttttactcgtccgaaatgattattttggctgggggaattcacccctccccactaattttaaatacatttatcccaaattcataaaaaggtaaattattttcgaaaaaattgggtactaatactgtgctcatttcggacaagttcgaagcctggacacgaattcgaactaaaatttttgttcgagtttgggtctgggattggaattggtcgaaatggatgccgattcttgattttggaatttgtttttttttttgaaaaatcgaggggacaacccataaaattacgcaaaaaattctaattttgtcaaatttttcagagtacaagtcgccaatcatggaggccgaaacgttcaagttttgcatcgactatctgatccgaattgggttcatcaaattctaatttttttgattttttttgaatttttaaattttagttaccccagagaaattgctgaattcgaatacgacccgatgttttccattcgtggcctttggtttgacatcaagttcggcaacctgttgaaggtggacggtttcggcaacattttgcgcgcgtcccatggccgccgattcttgacatggtttttcacacaaatttttcaaaaaaaaatttttttaattgcaatcaatcgatgtgattgtaaaagaactttgttgttgttttttttttcaaatcctcaaaaaaaattggctctattccattttaggggtccaatcggtgacggtttttaggtcataacttttgtttcttaaacacctcatcatttttaagtgtttcatggatttttattttaagaccataaattttagcgttttatgcctttttaagtgtcgcgaaaatttttttagatttttttttgtaagaaaatctcatgattataggaaaatcgcatggcgctaaaaaaaaaatttcttgaaattttctaattttgaaaattttttaaaaaattcgtcggcaaaattttggggtgcacccgatttttttcatgtaataaaagttatgcctacgatattaacgctgaaattggaattttttttttttgaaaattattaaattaaaatttcaatgcatatttcggtccaaaaatttttttcaggaaagaggttgaggattgctacccgaacaaatttgtgcaattgtcggaacgccaaatttacgtgctcaacacattgttcaacctgccggatgcatacctgatcacacggcttgtcgactttttcgacaaattcgaacagtgcgttgtagtttttgtttgtgttagggtttttcgccatggcaaaaaggggacggaaaggaggcaaattctaaaaaattgtatgattgcccttaattttagaaattctttgaatctatccctcgtttccaagccgaagcaggaacaaatgttgcaagaaaattattttcttggcttccttacctgaatccggttacccgacattttattcaaaacttcgaataaattttttgtttaatttttttaaacaatttttcggcgagttttttttttaaataacagtcctatttttagaacgccagacagaacgggcgtccgatacagtgacgtgacaatgtcgtacaacgcaatttaccaggtacacattttgattatttttcgataagaggttgcatggacggtcccagttttcgcggtgccgtcggtgacacgaaaatattaaaaaaaaaaaaaattgggagctgcctgccataggtttatttaatttttttgctgaaattccaaaaaaaatccatgacggtgtttgcccttataaattttctttcaaaaatatataaaatctgttttgatgaaaaatgtacggcatttttgccaagcggcgtgaaaaattcgattttggctgtcccattattattttttcatttattttatcattttgtaggacattcgtgccgcaatggaccatgtgcacggcggcatcagtgtggggcaattgaagaaaaaaattttgacccgaattggcgattttgtggagaaagacgaacgcattggcgttctgttggcccaactgcgggccaccggacggaagacatttctgttgaccaacagtgactacgagtacaccaag

SEQ ID NO: 47072 - DNA, 2143 bp, Heterodera glycines
  Genomic contig location: Contig_ID=SeqID_12706; Location=1017..3159; Strand=+
  SCN-specific regions: Sequence locations=1-237,261-840,863-1272,1294 -2143
  Gene Ontology: Mol. function=ATPase activity; Cellular component =nucleus; Biological process=protein complex assembly
atgaacagtgccaacgatgtgggcaagcgtctgttgccgttgggcattcgttcggcattcactgaattttttgttgccgaaacgagcgccgctgaccaactgcggttgatcatccgtggccaaatttctacaatgggcgaacaattggtggaatccgttctccaattttacaccgatgttcgggcacaattccctggcaaattcaagtgggttgaattttatgtataattttttcgcaaatttttaaatatatattttttgtcatggatgacgccaaccctccaaataatttagggcatccaataagaattccgctatcttaactttattggtattacaccactttactaccacgccaaacttaccgggttcaaaattcgagtccgattgtccaccgtaccaagctgtagccagaaaaaaaaattcggatggttgaatccaaagattactaatttttgccattttaggatcaatttaaaaaaacgaaaattctttgacgacttgacttattgcctgactaaaatttttttgtaagttgtatttttttttagtttacgcacattgagccgcgcactggcggttgcgaatgatcagctacagcaacgtcactacggcactgctcgacattgtctttgccgtgcatgttcagttgcatttgtctctcaattggacattgaacaacgcaaccgaatgcaattggtggtgaccaaatggcttggcgctgtgccgtccactgcgcgcaatggcaaactgagcgaggacgatgcgcgaaaatttgtgtaagcaatttgttgagttcgattcaagaaaaaccttgacatggatttcctgggcataaatccaggcctgggttcaggtcctggtcgaactctagcattttggtacaaaaccagttccatttcatttttttaaattgtcatgcatatatattcccttttttacataattttttttgaaaaattgccaattctattatttttttagtttaatcgaaggccacaaaattcctcgtggccccctgcctgtgctcacaaatgatgacaatgaacagcaacaaaaacaacaatacattttcacgcagtctgtccgtgccaacatggctcttttggccagcgtggtggccaccgggcattttcccgtgctgatggagggcgaaacatcggctggcaaaacatccatggtgatgcagttggccaaaatgagtggcaaccagtgctttcgaatcaacaaccatgagcacactgatgtccaggttttgattttttgatcttatctctcacctcaaagaaagtaactcgacaattaaaaaataactggaccaacaccctaacaaagagtactaaaaaatcgccggaaatttagaaaaaaaatttacaataaatttcaaatatcaaaaaaaaaccttcgggaaggaaatgatatcggggggggggggagagaagaagcttctcctattatagttaagcataaaataaggcattttatgtcagtatctgctatactcttaaacaaatacatattttaggaatacattggcagttatgcgccagatgcgtctggtcgtctcgaatttgtggaaggcgttctgttgcgtgcggtccgcaacggtgattggattatcctggacgagttgaacttggcgccaagcgcagtgcttgaagcactcaaccgggtaatgctttcggggtgcacactttaaaaccttgaaaattattaaaaaaaaattgggcgattttttggaaatcctttgaaaacttagaaatcatcataaagttgagaaaatcgctgaattttcttctggttgcataaaaacaattattaagttgcttgacgacaaccgcgagctgtttgtgtccgagttgaacattactgtgcgagcccatccccggtttcgtctgttcgccacccaaaacccggtcggcacgtacgcgggccgtaagcgtctgtcgcgcgccttcctctcccgcttcatgtgcctgcaatgggacgcgttgccacacgccgagttgcccaacattgtgcagcgacggtgcggcgtgtcgccccgtatggccgaactgatggccgccgtgcttgccgagctgaaagtgcggcgtgcaattggtggcatttttgcttcgtcggacggtttaatgactctgag

SEQ ID NO: 47073 - DNA, 563 bp, Heterodera glycines
  misc_feature (554)..(554): n is a, c, g, or t
  Genomic contig location: Contig_ID=SeqID_12708; Location=1468..2030; Strand=+
  SCN-specific regions: Sequence locations=1-5,27-205,247-521,543-563
  Gene Ontology: Mol. function=ubiquitin conjugating enzyme activity; Cellular component=proteasome complex (sensu Eukarya); Biological process=mitosis
atgacgttgtttttcaatttgaaaaagtcattcttggcggcatctcatgaatctaatcaaaatccgatcaaatccaataaaaatgcaaattttttcggagtttatgcaactgccaaaaagcgaaatttttcggaaattgtaattccgaggcccaaaaattccctggaaatctgttcttccagggcaggactgtctgtcatccaatgctgatttcttttttccttttccaggaactcaaggacatggagaagaacccactgcctgagggatgcactgcacggccacttgatcaacggaccatgaccccctggacggttaccatccgaggccgggccggcacaccgtacgaaaacggcaacttccaactgagcatggcatttccgagggactacccgttcaaagcgccgcaagtcacgttcaccacgcgcatcttccacccgaacatcgacacacggggcaaagtgtgtctggacattctgcaaacgtactgggcaccgacgctgaccatcgaaaaaggtggcgtggatttggtggtggatttgatcatgttttanatggattga

SEQ ID NO: 47074 - DNA, 1500 bp, Heterodera glycines
  Genomic contig location: Contig_ID=SeqID_12712; Location=348..1847; Strand=+
  SCN-specific regions: Sequence locations=1-145,167-362,384-902,924 -1330,1399-1456,1478-1500
atggtcttcaagaaaattgacaaggaatcggtaaattctataacttcagctttgtcaatatttactcttccaccaactaatgtgtcagtgagtagttcttcagtgcgggaatatttaccgctcaatcctttaacggacattccttttcattttaaaattctccctaccgccagtttctttgatttgaacaaatgttacatcttaaccgaaatgtcaattaaaaagctggattttgacacaaataaatatgttaatttgaaagtgaatgagcaagcggcaacaattaatatgattggtgcgacttggataaagaatttaaaaatcactgtgcagggacgtgagatttatgactctaactcactttatgcttataaagcatacttggatgccgaactttcttattccaaaaacgtaaaggagtcagacctacaggcgagcgggtattatgtggacagtgagaatcaggacggcacggatattactcagcagggttttgaactgagaagaaaattgttttcacaaagtcaaactgcacaatttattacaaaattggatgcagatatttttaatcaggacagatatatggtgaatggagttgagattgatatacaacttacccctaatgacaatgagtttatggtaatggcagcggccgacgataaatatagaatagaaattaccgcttgtaaattatatgttaaaactcttgaagttgttgatggttttgcattagacatacagaaaaaacttgaaaacaaagaagcaaaatatgcccatagattaactatgatcaaatccatatttataagcgagaatcgaactgaatacaatggaacgctatttacgggtcaattacctaaacgagtcattctcggaatggtggagaacgctgcatacgtaggcaaccaaaagaaaagcccatttaattttaaaccatttgatattcgatccgtcacattgatagcaaacgggaaacaatggcccgcagcgccatttgagcttaatttcagtaaaaacttatatacccgggcattccacgaaatgaatgaggcattaggtatggccagttcaacagacagtaacggaatttctcttgagaagtatagaaagggttggacaatttttgcgtttaatatgactaatagcatggaggacaacgagggtattgatcttattacagaagggacgactaccgtgtgcattcaatttagatcacctgtcccatcgggtgggatcaccctaatagccatgagtgaaatggactctattttgatattggataaaaatcgaacagtaatgaccgatacaaccatttaatgtatttaaagtgatttattatttatattttataattttttaaaatgtttattttgtttgttttatttttgataaatttttcttcgagttataatagccctattctctaccctgaacgatccagggacaccgaaatgactgacatttattataaaatagcctcctttgaccattcctacttga

SEQ ID NO: 47075 - DNA, 814 bp, Heterodera glycines
  Genomic contig location: Contig_ID=SeqID_12731; Location=1290..2103; Strand=+
  SCN-specific regions: Sequence locations=1-814
  Gene Ontology: Biological process=embryogenesis and morphogenesis
atggtttatttgtcttcgcgtgccattggacagtcccactacacgaaaacgtacctgcagaacttcgcccaggggtccaggactttgcccgacggacccgtccttctctcgccttcttccgttctgatggcattcagaaagtactgtctcattatttacttacatttcacattgaattgtatatccagggaggtcattgaacggaaacccgaggagttcaaaatcgcatgtctcaccgacctgaaatcgctgttccccgtaggacagccattctttgccggatttggcaatcgcgaaacggtcggcagtttgacaaagggactaaactcactcactcccccctcccctttcaggacgttaaatcgtatcttgcggtccaaattcccccggaaaggatcatgattattgacccgcaagggtcgctcagaagggcggacaacaaagcgggtggttacgtgtccgattacccaaccttggccatggacagtgtcgactacgtgttcccgcctcgggtggacatggacggcatcgacattaggacgaaagaggacggcattttgaggtgggcaaatttccttcgtccggcttatctttttgagccttcaattacaccccctgatgaattcttttctcgtgcagtgaattcgtcgcatggcgaactgacgctgaacaattcgatgcgctggtggacgcggaattggaacagtacgaagaaaggagcaaacgagcgaaagcaattgtcgcggggacgacggatggacgaggggcggacggaaagaagaaaatgtataggaacggaagacgggcaaagtga

SEQ ID NO: 47076 - DNA, 1171 bp, Heterodera glycines
  Genomic contig location: Contig_ID=SeqID_12738; Location=37..1207; Strand=+
  SCN-specific regions: Sequence locations=1-184,215-243,269-304,340 -413,435-571,595-1171
  Gene Ontology: Biological process=embryogenesis and morphogenesis
atgttcggatggattaacatttaccttttcttccacaccgccttttcgttgtgagttggggaaggccattctgatttatttgagtgtaaactgaactgaagaggtatttttagctagattttccttatttgtgatattaacttgaattcttcaaattggagtttagcggtataccgacatcgcgttttattttaaaaaccaaaacctttttaaatatctttcaagtcggaaacgttaaattgaaatatgtgtttgtttttcattctaagagttattaaacattttataaaggttaatttcatcttcaaattttcagttcttcaaataaaatcatacataagattagtttgataatttgttcaaattctttagataaatttgaaaagtacgtatacaaagttacccgtgaacgatttggcaaaatgaaggcttacattgacaatgaattgaaggaagccatcgagttccgcaaggttagcaagtttattacaaagccataaacgctcacaacaaactgttaaaaacaaacattgtcgtgcgaaatttttgctgcagcattaagaaaccgagcaaaaataaatggtaaattttaagacttcaaaggagcaggccgactcgttgaaagcagtgcatgaaaactttcccacaattttccaagagaatttggcgctgcaacttgaagcgacctaccgaaaaaatgtggactacgcctggcaagagatgaagcgtcggttggattacctgcaggaagtgcaagcaatcaaagaccgattcagcaaggaaatgatggtcaaactgatcactgatggcgtaagtaccgacattcttactacaaatcccccccccccccccccctctttgcttaattttcattctttatttttttaaatcatagattggttttaagcttttaattttgaaaacaaactcatgtccccgattgaatcgaattcctttaggtacgaaaacaaattgaaatgaatgagggcggaattcgcgacaaatatttggaccaatgtatcgaacaacttcgcgttctgtcagcgaaataggatttaatttggatactttaattataatagaaagagaaagacagccatttctatgcacaatttgttgtaatagggaaaattcatttgtttggtttgactatgactataaagccgaccga

SEQ ID NO: 47077 - DNA, 3059 bp, Heterodera glycines
  misc_feature (182)..(182): n is a, c, g, or t
  Genomic contig location: Contig_ID=SeqID_1868; Location=360..3418; Strand=+
  SCN-specific regions: Sequence locations=1-1128,1153-1306,1328 -1538,1567-2075,2098-2111,2142-2437,2459-2930,2957-2963,2987-3059
  Gene Ontology: Mol. function=G-protein coupled receptor activity; Cellular component=integral to plasma membrane; Biological process =body morphogenesis (sensu Nematoda)
atgaaatttggggaacaattagctagtcacttgacgccagagtggcgcaagcagtacatccgttatgaggagctcaaatccatgctttacgatttgatgttggaggcgccaacggaagcggacgcgcgtgatcagtaaaaatggcctaaaacatttaattgggaattaatgttcaccatttntaggtacgttacccaaatggacgagacattttttgcggaatgcgagaaggaattgacgaagatcagcctgttctttagccaaaaaatagcggaggcccagggaaagtaccacgagctgagcgcggagctgaaccttttcaaggagtcggtcgaccaccggcaaacgcccctcactcagcgcaaaagtgtgcgggtgcgcttcaattcggccacgaaattggccccgtccagcaaattgcaaaaggaacaggcgaagacggcgcagcaattgaaactcgcgttcagtgaattttacctcaatttggtgctgctgcagaactaccaggtcataatttttggaaaaatcaaacaattatatgacagaactcaacagttaaaccgttaaagtattttttaaagaattttcctggatataatggtccaagactaacctatttgcggtgtcaaaccttcacccgaaattaaaaaaaaagttgctgttgacaaaattcttttttttaaaatttcgttttgatgttaaattgttttggttttagcaattgaatgccaccggattccgcaaaattttgaagaaacacgacaaattaatgctgaatgaccgtgggatggcttggcgaataaatcgggtggaaaagtcgacgttctttctgaacgctgacatcgagtcacttatcaacaatgtggagacgactgtgatcaacgaattggaggggggcaacagacaagcggggatgaagcggttgaaagtcccgcctctgagcgaaaaggtcggcccggaaagagttttataattgggcatcttttagcaaagtgccggaacaaccttttcgcttggcatgttcatgggcattttcatcgttttggcgattgccatcgttttgtccctggtcggactgcagccaaaggacaataaccagccaaaatgggtcgctgttcgactcttccgtggcttcttcctcttcttcctttcgatatttctttgtggtttaaacatgtgtgtattttataattgggtttcccttcatttttacctttaaaggtacgggtgggctgctgcaggggttaatcatgtgctcattttcgaggtacatttaaatcggtcatcaaaatataaaccaaataaattttttgaaaactctttcacttttacaatatggaattcgttaaattgaatacttccaatttgaaatgctttgcaaatttaatttttttaaaggttttcaactcccctccttcaaattgcaggtcgacccccgcaatcacctcacctatcagaccatcatgcaaatctcctcctttctgatgatgctttgggctttggccgttctcggctttctgtacgcccattggcttcttctgccgcccttccttttccccctgctgttgatgttcgtctgtgtgctgtttctgctcgcccccttcaaccgtcccactcagttattccaccgcaattcgcgcttttggtttctcaagcattgtttcaactgtttcaccgccccttttcattttgtcactttctccgacttttggctgggcgatcaaatgaattcgctgacgttcgtttttctatttttcatcaaaattgcatgcctttttctaccatttagtacttgttttctcgacttacagtatttcatttgcttttacgccaccgaagttgactattccggcgcccaacttcacgtccgcacgctgaatgttaccgaggggtcaatcccttggggttttgtcgacgtgaacaccggccaggacatgtgcatgtcttccgttggcattcgatccgtcgtctctgtgctgcctgcgctcgtccgttttttgcagtgccttcgtcgctaccgggacagtcgggcgtggcacccacatttggtgaacgcgggcaagtacgcgaccacctttttggttggtttccacttttaatgtcgactttaaattgtttcaaattcataatgtctttgttttcggtcgtcgccacgaattcgctcagcaaatggtgggcagtggaaaagccgtctgacaccacctcacttttcttctatctgtggattgcctcgtacataatcagcttcacatacacatttttggtacagaatcgagggcaaaatcagcttcaatctcaatttcccagtgggacattttcatggattggggcttaatcgacccgacggcaccgaaggaggcgccttttttacgcgaggaaatgatttatggaagcaaatggtattattacttcgcaatcctggaagactttgtgctccgactctcctgggttatgaatgtttcgctggctgaagcatggtcggcatattttgtatcatcttttttttatcttttcggtttttcaggactttgcaaggcgactttctggtgtgcattatggctccgttggaagtgatcagaaggtattttcggtgcattttgatcattaatctttcgataccctccgatgccattcaatctggatttactttatgaaataaactgcaccgataagtatcacgtcattttttaatcttcaggtttatctggaactattttcggctcgagaatgaacacgtgaataattgtaatgctttgtccatgctgccaaaaacatttcaatttgatcatttacaatcccctaaaggtggccaattccgtgccgttcgcgacattagcgtaaagccaatccgaaagggcgacttggagtcccttttggccaagatggaccagcaggacggggtcacccatcggggccaggacttgcgcgacagagtgaagaagcagaagaaggcggcccgggacaaaaagcaaattctgaaaaagaaccgaatcacgcggatcagtctgcctgcaattcatccccaaccgagcaacacactgctggagacgatgcattga

SEQ ID NO: 47078 - DNA, 2175 bp, Heterodera glycines
  Genomic contig location: Contig_ID=SeqID_1870; Location=1..2175; Strand=+
  SCN-specific regions: Sequence locations=1-100,122-670,697-891,915 -1012,1034-1441,1476-1571,1593-2175
  Gene Ontology: Biological process=regulation of protein activity, epigenetic
aaggtcccataatttacgtcgtcgaatgaaacaggcaaaacctgaagaaagcaccaaagaaatcgtcgttggcacggacgacgagacacagcgccggatgaaggaacaaaacgcgaagaaggccgagtcggcacgtcaacgttaccaccgaatggttttagtcgctgtataattgatgctttcctaactaatttaacaaccgtttgcagagcaccgaggagaaaaagctgtacaaccagcggagaacggaggcattccgacgtcgccgaatggaggaggaggcactgttggcaatgccaattgggtgagcgacgaaggagaagaagcgcattactcctaattaaacaaattcagaagaattaatggcgaagcgcttgaccgagcccaacaaattgtcatccgaaacgccaaacgggcggaggctgcgcggttgcgctatcagagaatggtgagaaagactaattgtaagtaatgagtttttcctttcattatcagacgccggaacagcgtcgagcatacaatcagaagaggtatatgccgaagcggaagagagacatggacatgatgatgagcatggattcgccgcttgggattgacaagaccgacaaaatggaacgtgaggaggacgaatttggtaggttatgcgattcaattgtccattgtttttggaaccaaaatgtaattctgtgtgcaatttaagacgctctctcgtcattggaacgcgacgtgcagagacgaacacaacaggcgcaacagacactgcgtcaacgccagtgggtggtgcaacagcagacgccgagcgcaacgacgggacaccattgaaatacctaataaagcaatgttgctgcatacaaagcattcgtcattataattcactgtttattttctgagaaattcatctttaaaaagtaatttgcgttttaattacacttaaatcgcattcgaattccgtattatgtggctcttcaatatttgtatttttgtttgttgatttaatgttattttttgtccactaattattgctttagtcgacctatgagttcaagcaaccgtcagcaaatttactaccaaagccgtcaccatccgcagccccaccgtgtccccggcttgtcattgccaattgcttcgtcctctcaccacgacattggctccatcagtcctcgacatgaccatcggcagatggtcatcgtgtccgggagtgactcgtgcacggattgcgtggccgattaccattcgtcgtgcgactgtcccgcttgcgaatcgaaaaatgtattttgtaatgttacaatgtttattcaagtcatccttttaatttttgcagcttgcttcggtcggacatgacgctgggctggacgaccaccagctgtactcgtactcactggaaccgacacagttggaggacgacgacgaggggtaagcaaacaacgaacgaatgtgatacttagtttattgaaatggaaatgccattcaaaacaggattgtgcacgaattcacaacggactctggcgaacgccatgtggtgatcatgacgaagaatgatgagcatttccaggagggcatcaccattcaagaaaggcaagttttgaagttgttttgatctgcttacatcgaattgattgcttgttataaaccgcatcaccaaactagtggaacattgcctctcgccctcccaactaacaatttttgtcccaccattttatagagttcgtcgtcagaaattgtctgaagccgcccgtagccgatacgctcagctcagcgatgaggagaaacgagcggtcaccgaacggagaatcatcatgcgacaacgacggaagcagaaggaacgcgagatggaggagttggaggcgatactccgcgcaagcaatggtgtgacaaaaagcaacgatttacatattaaatatcatttattaaagtaacacagtgtttaaataaatttgtcattgctcatattgtttgaatatttagacatcaccgacgatttgattcccctggatgaggtggttgcccaacggaagcgtgccaaaacgagtcgttaccagagcatgagcttggaagagcgtcgtgagtacaaccagaagaggcgtctgcgacagttgggagtgtcgtccgagaattttaaccaaattgagcccatcaaattggataatatccggagacaaattgcggatgtaaacg

SEQ ID NO: 47079 - DNA, 1517 bp, Heterodera glycines
  Genomic contig location: Contig_ID=SeqID_12758; Location=608..2124; Strand=-
  SCN-specific regions: Sequence locations=1-234,264-299,321-439,461 -682,705-1517
atgcgcgagttcgcgacaagtcgcgcccggcaaaccatcgtcgactttttcgtccatgacattggccaccattcgagttgctatcgccggcgccttctgttggacattgtaccgttgcttctacagtacttcagccgtgaattttttatcgacaaatttttgcccgcggtgctcaaactgtccgctgacccaatctcaaacatacggttggtatactgtacatttacagcacacaaataaaaaaaattaaaaaaactaaaaatgttagattctgttagaattaataatataattgattcttttgaaattttatgcttgttcccttttttattagtttaaaaatgcaaattgctaaaaaatattcagtgaaaattcccccccccccctccatcattcgtattttgtctttattacaccttttttgtaattttttttttactaattttaatttccataattttaaggctccaactgtgccggacactgccgaagatcaagcagtatttgatgttcccgaacaatgacgagtcgttgtccaacttggagcgtgttgtgcgcgaattgctggcatccgaacagaacgcactttcacgacaactcatccaacaggtgggctaaaattgactcttttttttaataatttcggtggaaaattcgtgataacctccgatccaaaaatgcttatcatattcaattccattttcgtcctgtttcagttcgcttgtgaactgtcgaggacagaaatggacaagaaggagtgccgtgcaaaccgtgccaaattggccgaggaaaagcgactgtggaccgagcatgaggaatccacggacgaaactgatgaggctgaggcgggccagcagtacagtactgagcatacagtaaccgggagcgatgcgataggctcgcccgaaagcggcatcttcttcgaggaggactgttggcttggcactgtggtcggaaacggtgccagacctaacaaccaccagcagatgggcggtcgcctgtgccgttcggctaccaccacaagcatatcgcaacacatggagacggaggtggacaaaatattcaaataaaaatatattggcaaaatgataccattaaatttttttaaaaactgaaaggaagcgattaacagaacccaaaatcaaaaaataaaaaaggtgaacggaactaaaaaataatgataaagataaaggaaggaaaaaatattgttcgatttcgaccattaattaacgtatttttgagagaaattaaattttttgccatttattacaattgaaattcttttctttcaaatattttttccattttatttaattatttcccctttttagcatttgatatttgctaaattggatcgcattttggtcagttgcaacaatttgatgaaagggtccaccggctcatggcgagcccacgaggcgtatttgaatggcattgcagtgttgcgaaatttggtcagcaccaaggatttgctgtccaactttgtgccattgctcaagcaggaagtgctaaccgcg

SEQ ID NO: 47080 - DNA, 1176 bp, Heterodera glycines
  Genomic contig location: Contig_ID=SeqID_12759; Location=1991..3166; Strand=-
  SCN-specific regions: Sequence locations=1-892,914-995,1017-1073,1105- 1176
gttactaccgtgacactggtggtgtgcttgaggtgggagacggatgcactgcacgacgcaacctgtttgtaggcagcagaacagcacaattcattgccaaaattgacgccgatttgtttaaccagcctctctacttgatcaacttttgtgagttggacattgaaattttgcccaacgacaacgactttgtcctaatcacaccacccggtgttgctgcagccactcgctaccatttcgaagttgtcggtctgaaaatgtatgtgaagaaggtgtccctgatggacggattggcgttggacattgcgcgaaagcttgagttgaagccggcacgatatgcagtgaggaaaacgctgatgaagtcgctgttcatcagtcatgggcgttttgaatttacgtctaatttgttcatggatcaaattccccggcgcatcacaatgggattggtggccaatgctgactatgttggcaccgtttcacgcagccccttcaactttcagccatttaatgtgcgtgaaatttctataattgccaatgggcgctcctaccctcaagcagcctacgacttggactacccaaacggaaagtatgtgcgccccttcaacgacatgaacgaagcggtgggattcgccaactcatcggaaagcaacgggattacactagcacaattcggcactacgcattgcatttacgtgttcaacttgacgagcagtggagacgaccaagcggcgctttttgatctgataaggaacgggaccacagcagtgagcatcaaatttaatcaggcggtgcccgctggaggaataatgttggtggtgatgggcgagtgcgactcgctggtgatgttggataaaaatcgatcgatcagcactgacatcactatttaaggcacttttgttttcattttttgcaataataaacatgtattccaaaaaagttggcgttattttattccttcttcggatttctcttcccgtagtgtcatgtagagaggaaattcctgagtattcagaatatataagaagaaaggcaatgcttacatcgacaacaactaaaacaattccgtctacaacaagcacatcaacaaccaccacctcctctcccccaaaaagtgacaagttaattgaagagcaagtgtcagctggtctcacgccactcatccaattgtgcaaagactaa

SEQ ID NO: 47081 - DNA, 923 bp, Heterodera glycines
  Genomic contig location: Contig_ID=SeqID_12760; Location=109..1031; Strand=-
  SCN-specific regions: Sequence locations=1-55,77-413,443-923
  Gene Ontology: Mol. function=pre-mRNA splicing factor activity; Cellular component=nucleoplasm; Biological process=mRNA splicing
atgcctcgttatgatgcgaccgatgacctgtcaggagctgaatatttggccagtatttacggcacagaaaaggacaaagtgaattgctcattcttcttcaaggttgataacattttttcaattttaaaatgccaaaaaaaaatttttggttttttttagattggcgcctgtcgacacggggacaactgtttgcgggcccaccacagacctaccttctcaaatacagtgctgctcaagcacttctaccagagtcccattgtgaacccggcacaggcggacgctttcgacagtaagcaattcggaaccaaaattttgaaaaaattggagtgggaaaggtccgggctttgatgacggtccggtaacggggaaaccaagcaaaattggcacgttttattggcccaaagtccctgggttttccccaaaaatggcttttccgggaagtccccggcggtacgccatccgttttccattattaacttgaagagcccagacgggatcggtttcgatgatcctatgatcctgacaatcccggccaatccgggatttggtcctggtaaccccatctcgacctttttcctgatgccgactatttcaaaattccttactctagtggactattaataaaacattcattgattctttgtgactaaatttcataacttttcagaggtcggtaaaaaggatgagcttgagcagcgccattttgatgagttttacgaggaagtattcaccgaacttcaacgcacttatggtcggcaattcaaaattgcttttttctgagattacaattttttattttcaggtcccgtggaagaattgaacgtaaattgggaacgaattttcgcttaatttacgaaattttacttttaggtttgtgaaaacattggcgaacacatggtaaaaattggcaggttcacaataaa

SEQ ID NO: 47082 - DNA, 1189 bp, Heterodera glycines
  Genomic contig location: Contig_ID=SeqID_1871; Location=44..1232; Strand=-
  SCN-specific regions: Sequence locations=1-504,527-730,752-1031,1053 -1189
atgacttgcccacaaaaaatcagcgacagcagtccactagcaattaacactggtctgaacattttcttagttccaccgaccaatgtttctgttgtacgttcattctttcgtcaggtgcttccgctagcaacaatcacgcaagaatcaccgtacctgtttcgactgtacagtgacaatttgtggactgatttatctcggatatatctttatctcgaactgtccattgaaaaaccgggagcaaacgataaatgggttgcgatagatgatgcggatactagtgtctctgccattcaagggattggtcaaacatttgtccagcaactaaaagttacggttggcaatacggaagtatacgatagcggaaacctatacccattcaaggcctatatcaccaatgagttaagctttccaataaatgccaagaaaaattttcttggttcaacagggtattatcacaccataaaccaagatgactcaacagacgaggggttcaaagagcgttgtaaaattttcaagggtggaaaaaatgcacaattcctctctcgtctcgactttgatctgggaaaccaggagctttatcttttaaacaatttggatttgctgttcacaatttacaaggctaaagatgtctttcttttgcaaactttaaaagcaaatgattcaaccaaatatcgtttgacagtttacgatgtcaagatttatgccaaaatggttgaggtccaaccctcactaaacatgaacctttacaaaaaccttgaaaaacaacccgccacgtacgcagtacgcaagaccgaaatcaagtcgtcattcatcagtgttggtcgatacgaatttgagtacaatgtattcagtgcaaccattcctcgacgtgtgacaatagcgttggtaggaaattcagcatttcatggtgattacaaactgagtcccttcatgtttgagccgtttgatttgcgtgagatttcggtacatgctggtggcgtagtttacccagctgttccttataaactaaatttttcaaatgatcactttgtcagcgcctttgttgacatgtatgaggcactcggaatggctaactcggaacgttcatttgacatttcaatggcccagttcaaaaaagggtggatcttttttgtcattccattgacttccacgcttgacgacagttgtggatttgagctgttgagaagcg

SEQ ID NO: 47083 - DNA, 1440 bp, Heterodera glycines
  Genomic contig location: Contig_ID=SeqID_12792; Location=151..1590; Strand=-
  SCN-specific regions: Sequence locations=1-587,609-718,781-964,986 -1005,1027-1199,1229-1440
  Gene Ontology: Mol. function=superoxide-generating NADPH oxidase activity; Biological process=morphogenesis of an epithelium
atgctttttgcagattatcgctacgaaaatgagcaccgcgacttgcgccgcgtgatgggcgttggcattgcgatcactcgaggggcggctgcggcattgtctgttgatctggcattaattttgctgaccgtgtgccgaaatctgctgacaatgcttcgcgagacatttgttggcgaagtgaaaattcggaaatttaaattattttggtttttgctttatttatacagtatttaccgctcgactcggcaattactttccacaaaattgtggccatcaccgccggcactttcgctgccattcacacaattggacattgcgtcaacttttaccatgtggccacccaaagtcaggagggcatcgcgtgcctctttcaggaagtacacaaattatttaattaagattaaaaactttgaaaccataaatgtccaaaatgttgcgatggggagggcgaaaatcatgctccaaaaatgaccaattttgtgggatttaactgtgttttcgggggtccgggatgccgacagggttttaccgagttaaaaattgaatttttactcatcaattagttctcatccacctaccatccttatcccccccccccccccccccccaggcggtgttcggctccaactttttgccatccatctcatattggttcttcggcacattgaccggaatcaccggcattttgcttgtcgctgtcatgtccatgtatgatgtgatttttattgaaattgtttttgttaataatgtattaaaattattattataaattaaattttagaatttacgttttctctgcgcctgctgtgatgaagcgagcctatcatgcatttcgcataacgcatctgctcaatgtgttactgtatgctcttaccatactccacgggcttcccaaactgttggacgtgagttgacagagtcaaatacaggagccccccttgaattagagccccccctctgaaataaagccctccttttgtgaaaaatagagccaccaagggctctattacaataaatacggtaatgaataaaaacataataattaaaattctggttttcagtcacccaaattttggtacattgtgcttggcccggtgattatttttattattgatcgtattattggcatgcgcaaacactacaaacagttgagaatcgttgatgccgccattttaccatcaggtcgaattttctacaacaaatttaatttttaattgattataattaagttttgtctaatttattttccaatttcttttcgttatctgcccccgttcagatatcatctacatccaattcaagcgtcctcattcgttcaaatttcgttctggccaatgggtgcgcatctcgtgccccgccttctcctgcactttcaacgagtcccatgctttttcattggcatccgcgccacaatcgccaactcttgagttattcattaag

SEQ ID NO: 47084 - DNA, 1191 bp, Heterodera glycines
  misc_feature (5)..(5): n is a, c, g, or t
  Genomic contig location: Contig_ID=SeqID_12825; Location=60..1250; Strand=+
  SCN-specific regions: Sequence locations=1-458,481-610,633-675,698 -811,858-1090,1112-1191
atggngctgtggaatacggggcgttcaacgggaatccaaaattggaccccttttaacttcaagcactttgacataagagacattgcggtgcacgctggcggtttcatatacccaatggtaccgtacaaattggctttcaaaaaggacgcatttatgcgagcgtatgttgatttgtatgaggcgctcggcatggcaaactcagacagatcttgtgatattacgcgccagcaattcaaaaatggatggacattgttcgtcatccccctcacatcaacactggatgacagtgtgggctatgaactgttgcgaagcggcaccacaaccatacgtgctagcttcaacacagcaataccaggtggtggggttgaaatgattgtgctcggcgaatttgatcaaatgataatgattgactacaaccgtcatattgtttcagactctaaactgggttagtttttgcctatacaaatatataaatatattggtgtgtgtaaatggaagtcgttaaatgacaatgaacattacaaccaacacgacaaaaaaaccccttgtccaaattttgaatggatatgatgttgatggaccatcatcatcacttgaaatgacaaattttgaaaaaattatcttattttttggtctctaccttataatatttccgatgtttcttctctgctggttttcgttaattaattttttaaagcgctttggccatattagtcaaagtgaagcaaacggtatggtcaatggactgcaaaacatacctttaccaagaatacgatagtttacaagggaaaaataattctgaatgttcatttcatcattatcattattatcatcatcatcatcatcatcatcatcatttattagtcagaaagtgtctgctcaaacctgaaggaaaacaatcattagcctgtagaagtggggtggtatttaccccacaaacgcataaggtcccatgctttccaacaaattttcatgaactgatttgagcagtgcctctctatcattgttctcacttgggcatagtgccaagaacgtgacttttcgctgatttcggcatatcatcaatacacattgcagacgctgggtaaaagcttttagaaaaaacaaaattgctgttacatcttccacacattgtagtttatggtggtacatctctgttaattaaatttatctcaaaaaatgctacaaaaa

SEQ ID NO: 47085 - DNA, 2411 bp, Heterodera glycines
  Genomic contig location: Contig_ID=SeqID_12830; Location=675..3085; Strand=-
  SCN-specific regions: Sequence locations=1-446,468-568,590-1227,1250 -1442,1465-1752,1778-1948,1970-2006,2028-2241,2271-2310,2337-2411
gcaaaatatgacgcattccgtcgccgacatccgctggcacacatgaaagtcaacgtgaacgattatgaactgctgccaatgcattgcgaatatttgatcatcggcgggggactgaccggctcagcggccgcttattggcttaagcagggctttcgtgacgaaaacttaacggtcacagtgttggaaagcaccgaaaatgtattcgttttcgtttatttttttgggtaatattatcgacagggttcgtaagttttttttttcaaaaaaaggacaaacgatgctaaaacaaagatttttagcatttttatcagcgaaataaataattaagcacaaaaaaatttaaaaagtttagggaagcctaaaataaaggacaaatctttaaaaaaaggacacttacgaaccctgattatcgatgaaagcccccattttcgagaaaaaaattgttgaaattttttcttaaaataaagttgttttataggttttcggggccggagaaaacggttctggcattcattttgactaaattcgtaaccacagaacccggatttgaacaaaaactcgaaaatttaattttcggcaaactacaaaatattcaacaaacccggttcaaatgcatgaaatattcgaaaaggatgccaaagaaacattaaaaattgaaatggattgggtcacaatcacttttaattacgcgataaatctaatgtgaattcatatcccaaatttcagtttgccaaaacgcgttcattgcttggcagtggtgtgatcactcagcaattttctacgcccgaaatgatcgatatggcaatgttttcctcagaatttttgcgacatgccggggaacatctaaaaattttaggttcaatttaatacagaaaggtgttttaatccattttcaaaactatttattttttagacaacgaacccccggatattcatttgcttccctgtggtgttatgcatttggcccggacggaggaggacgccgagcagttcagaaatgcttggaaacttcaagtgtaatattcaatttttttttcttaaattacaactactcgaagtttttgattcaattttagtactttttttataaaatttaactatgttttgttttttaagtgatcgtggggcaaatgtgattctcatcggcagagaggagctgtccagcagatttccgttcatgaattttgacgatgttgtgcttggaacagtcggtatttaattgcaattttgcaaattattatgaaaagtcagtgctcgcaattttttccagataaaaatagaataagtcaaaaataggattttggacccaaaaaaagcatttttaaattgctttttgcaggaatattaaaaaaattaaatagtaaggctcggggtaagtgcagccgaagaaaaaattctcgagcaaatggttactagcaaagttaatccaaaaaaaaagaaaaggacatttttgaggaaaaataagggggagtcgaaaggcgccgtttgaaatttttttaaagaattttggcgcaaatagttgcttcaatgggtatttcaggcctcgaaaatgagggcattttcgacacttggcaactgttgtccgcgctgcgcgagaagaacatgacgttgggtgtgcgctatttgaagggcgacatggagggcacagtgacgtaccggcaccgcggcatgcaggagcacgggcgcaccaccgacacggccgatgcggacgcggcggagcagtccatgcagaccattcgcggggccattgtatgtgccatttttggggttttttaaagtggtacccgtctaaaatattgaaaatttggacaaattttttttttttgatgttggagggaaaaaagtttttcttgcagaacttataaaacgaaaaaagctctatccacgccctggcattgtgttttattcattccttttattttggcttttgtcgcaaaacaacaaaaattagcaatgcattttttgttttgccttaagttttgatggaattacatttcccacttccttttttatgcttttgttgtttaggtgcggccccaaatgactggcgcaacgcctcgtcgcatccaaagcttcagactcattgttagttgcttttctttcaaattcttggttgagaatccaaggatgacttctaaacgacatttttttttattttagtgggtccaactgaaaaaccgcacgaagacggaccctttcgatttgaaatttcatcggaccctcttattacactagtaaaacaaaaataatgccacaaaaatcccaatattccgcaaatcttttatttgttgtacttttcattacattgtcaacatttgtttgtttgttttcagaatgccgctggtccatgggctggtgaggttgccagacgggctggacttggttcgtttttgtgcataagaccatattaa

SEQ ID NO: 47086 - DNA, 681 bp, Heterodera glycines
  Genomic contig location: Contig_ID=SeqID_12862; Location=3729..4409; Strand=+
  SCN-specific regions: Sequence locations=1-681
  Gene Ontology: Mol. function=casein kinase I activity; Biological process=signal transduction
atgacggattcattggtggagctcagcccgggagcgctcgtctccggccgttggactgtcatcaagaagcttggagcgggcgcgttcggtgccgtctacttgtgccaagaccaagatgggattacaaagggagcactgaaaaccgagccaatcaacgcgccattcccacttctcgcgctggaggtagagtttgagtttgaggggggaacacaaaatttggtgtaatttttgtttccctttatttcaggccatcgtgttgcgcagctttgacacacttcgagcgagcagtggaaagcatttttgccgttgcatggaccttggacgcgaccaacagccggatgctgcttctggacgtacgctggagttcaacttcattgtgtgagctttgacagggccggatgtgtggagtacataaatctttgtccccccattttcagcatgtccctggttggccgtccattcgacaagcttttgcaagaatccggcgactgcttcagccccggcactgccatcggcgccgcactccaactgctcaaagcgctccaggccctgcacgatgttggctatcttcaccgtgacatcaaaccagcaaattttgccatcggactgccggaaacgaacgagcagcggcttctctacctcctcgacttcggcatggcgcgcaaatacctcaaagacgac

SEQ ID NO: 47087 - DNA, 1238 bp, Heterodera glycines
  Genomic contig location: Contig_ID=SeqID_12894; Location=71..1308; Strand=-
  SCN-specific regions: Sequence locations=1-15,45-105,128-340,362 -391,414-475,498-1238
  Gene Ontology: Mol. function=ATP binding; Cellular component=Golgi apparatus; Biological process=two-component signal transduction system (phosphorelay)
atgatcacaattgacggaaaacaaatcaaattgcaaatttgggacactgcaggtcagcgagacaactttttgactgggtaagttgactttgcttcttaaggccaggaatcctttcgctccatcacccgttcctattaccggggcgcggctggcgctttgctcgtttacgacatcactcggtccaagaaataccaaattagttggtttcatttttacccttttcagacgcgacacgttcaaccatttgacctcgtggctggaagacgctcgtcaacactccaattccaacatggtgataatgctgattggcaacaaaaggttttgaaaatgcaatccgtcaactaaaaacatgcttttaatatttgcttgattttaagtgatctcgaagcgaggcgtgaggtcaaaaaggaggagggggagcagttcgctcgcgagaatggacttgtctttatggaaacgtcggcgaaaacggctgccaatgtggaggaggcattcattgatacggccaaggaaatttacaggaagatccaggagggcgtgtttgacattaacaatgaggtgaactatcattatcaataggtgatcgatccccattttctttgagaatccgctttgaaattcgattttttaaatttattttcttttttgtaactttaaaaaggaattttcaatcgtaggccaacggcatcaaactcggtcctcaacacccgcccagttcgccaagctctcccggtggtgcgccgttaggacgtgcgagcaactgttgctgaatttgaccaacggaatgcgaaagtgaaaaaagaccgcaccgtcagaaactcacgccccttccccccccccctcccctccctctgtggataaatcaaagatttctcacaaatctgtatctttgacaaatttgtcgatcaagtcagcatcataaatacctattaaagaaaacataatctaatttctgaccctttgaatattatctgcttctgtcagcctacctaatcaatttttttccattcgatactttttctttggctttcagttttgcactctatggcatcggctttatataaaactttgtgtaaattgggtgataatgtgagtactttactatttctccatgctgtgttcgatgagccttgaatggtttttcagctcgtctatccgattctgccagcctttgccaaacccgcgtggaatcacccagcagggccaaaaacggtgttcttttggtcccccacaataaa

SEQ ID NO: 47088 - DNA, 2255 bp, Heterodera glycines
  misc_feature (1681)..(1682): n is a, c, g, or t
  Genomic contig location: Contig_ID=SeqID_12901; Location=998..3252; Strand=-
  SCN-specific regions: Sequence locations=1-50,78-166,240-555,577 -763,785-1400,1467-1806,1828-2255
  Gene Ontology: Biological process=reproduction
atgctgacgaagatcgccgggagcgggacaggggacgagaacagcgggagcaacaccaccatcatcaccatgaacatcgacggaaaagtggacggagaggaggaggagagggagagccaccgccgggcggctgggacaagccgaaatggggacgacacggtcaaaaaggaggaggaggggggaggagaagaagcggagaagcagcaaaagcgcaggggagaaggggaggaggagaaggaaaatccgtcatttgtgcccagcgggaagttggccaaggacaccaacacgtacaaaggagtgttgatcaaggtcaggggcgtatctagaaaaatttttcgggggggggggacgacccgacctgagaccgttttttttttgctcttcaactgaagacctttctatttacccaatgaaaaaaaaaattttcccgctgctgggtaaaaaaatccactttttcactaaaaatgacggaccgggtcgactgggccccgccgactgggccccaagggccggtcacattttccatttcatactgtcaaaaattatttgatctctcaaaaatttattcataaaattctaagcatccatctgataatttacagataaaaacatttttaagccattttcccttggattcctgtactttttggatgctcggttttcgacctttcatttctccatgtagaaaagttgtagagacatggaatcttttgcttttgtaacaaattttgcgccctttctgtctgtcatatttgcctttcatgaaaaatttttccaaccccctaggatggtttcaagccattttacggttttcaggtcaccccgaatgagtgatctgatcacgttggtgcaatggactttttttgataaacatcaaaagttatacttacatgaattttttcagattttttcttgccctataaaaagttacatgttttcaatttttgaacgtataattttggaacagactgtataactaacagtgaaatgaaacatttgctgaagaaatattaaatatgtatttacataaatttgcacccttaattatcataattgttgagtatttgacaatttgaaaagaaaaatgtgaccggcccttggggcccagttgacccccaccgaaaaatgacccaattttggccgttttacggcaaaaaaacatgtaaaaaatagtgcaaaatggaggtacggcggtgccgataggcgccgccgggaaaaattttgaaaatctaagtgctatttgttacgaaaatagcctataaaatttttaaattttcgtttggggggggaaattcgaaaaaattttccattatttgttggaaaattttgtaaaattttcatttcgggggggggggcaagatccatctcctattcatcataaaattatgcaaaattcgttgaaaaattaaaaaaaaaaaattcttggaatttttttaatgaaaaattttagacttttttaaatttttgacaattgtaaaaaacaggaaaaagtacactcaacttgagtttggaccgaccaacccaaaaatgggtttccccatttgtttttttttgtatccgacaattcagtctcgccagacttggacactccatcccgctgccaaaactcaaattgacgcaaatgccgtttcgtatccaggaaaaaatttttcgtggctgggtggacgataaatagacactnnaagacaataatggtccgctggagtcgaaatataccgctttggaaaatttccgaaatattgggaatttcatggaatctttaaaaagacttggtttatctccatatgcaaaatttaggtctccctgttatttgtggtctattaatttcacttttttcagtacaatgaaccaccggaagccaaatttcccaaactccgctggcgcttatatccgtttaaggtaaaaacaatgcgttttcattttgaaattcagccagtttttttcaaaaataaattcaatcccatggattggcacaattttacatttctcaaaaaaaaaaaatttcgctgatttttcctgcctcctaaatttgtgggtctggtgacaatcggtgctctgtcacttattcattcacttctccccagggtgacgatactttaccggtgttttacatacatcgtcagtccgcttatctgatcggtcgtgatcgcaaaattgccgacttccccgtcgaccatcccagctgctccaagcagcacgccgcgctgcagtaccgctcattgcaatacgagcgctcggacgggtccatcggacgg

SEQ ID NO: 47089 - DNA, 1538 bp, Heterodera glycines
  Genomic contig location: Contig_ID=SeqID_12922; Location=1946..3483; Strand=-
  SCN-specific regions: Sequence locations=1-124,146-379,401-465,488 -565,587-673,710-817,855-897,1028-1248,1270-1310,1332-1366,1388-1538
  Gene Ontology: Mol. function=glutathione synthase activity; Cellular component=intracellular; Biological process=neurogenesis
atggttgagcgctttttcccgaaccctgaagatgcgccaatggtcacagcaattcgcaaaacattcgccaaaatgtggggactggaaaatcctgatgatgaggaaacgaaaagagtgattcaggtggttaaaataaatggataatttcatcaatttaacaaaaaaatttaaatgcatatttaggctaaaataccaaataaattgctttattaaaaattatgaaaagaaaattcccattaatatgtgctttatatgaaaattattaaaatcaattatcattaaattgaatgcatttgataaattagacaaatatgttattaagaattattgcaatgaatcataattagaattacggcattcgcccctttttccaaaattcgcaaaaaacaaaagtaaaatataatttctatgaaatcagtaatgttaaattaaagaaaaagcatttttaaaaaaggtccaaaaatttggtggcattttatgttgcctttacccaattaattaaggatgccattgcccaccccgagcgttatgtgatgaagccgaacaaagaaggcggtggcaagaatttttgggaacaagaaattgtggacagattgaaaaaattcacgtcaaaacaacgtgccgcttacattctgatggaacgattgaatcctctggttgctcaggtgtgaacaattaaaaagaaaattgattttaataatttaaatttcctttaaaatgcgtgatttattggaaatttatccaaaatgtaaaaactaacataagctaacgagttttttgatgacaattcaacgcatttgagcacaaattatcgtactttaaaaaataaaatataattttttcatttaaattaactcacaaaaaaagaatattgcaaaatatcattttttagctaccaattttttaaaattatttttcttacaaaaaaaaaaattctaaaataattatacaatcattaaagttaataaaaatacaaattatacaattaataacaaaaaaaattaatgcaatattattttttaattttcagaattatttgatttgggccaatgaaaagccgatcttcagcgatgtgatcacggagttgggcgtgtacacctactgtgtttatgacaccaaggcaggcaccctggtagagtacacacagcctggccagatgatccgtaccaagtgcgcatccagcaacgagggcggcatcggggcgggtcttggcgtgttcgattcgctttatctctactagacgacgagcattatcattttcattattatgaaatcattattatgaataattatttatggcatattctaggccaaaaatttttgggtttaaatcaaaacaaacaaacaaaaaaaaaatccgaatgttaaaattttgttttaaaaaagggaatgtttctatttttggaattttaatggtttaaattttttaggaattttgtttatgaatttttggcccaaaatttgttttatattttattcatattatcatgtagaaattagagctccctttgtaatacacaaattttatttcaaataaa

SEQ ID NO: 47090 - DNA, 1279 bp, Heterodera glycines
  Genomic contig location: Contig_ID=SeqID_1905; Location=1780..3058; Strand=+
  SCN-specific regions: Sequence locations=1-368,391-801,825-897,919 -1076,1105-1113,1143-1148,1170-1279
  Gene Ontology: Mol. function=cleavage/polyadenylation specificity factor activity; Cellular component=mRNA cleavage and polyadenylation specificity factor complex; Biological process=mRNA polyadenylation
atgtattcacttttgcacgagaccgatggtgccacatcagtgaatttcagtgcctggggtaattttttgccgggtcctggcaagcagctggtcactgtttgtgcaaaatgcatcaaattctaccgactgaacccattttttgtgccaacggatggtttcgctggtcaaccaccaacagtccgtttggaatgccttctttccttcactctgatggcacctgtgcgcagtttggctgttgtgcgattaaaatgtgtgtgctctaataacttgagagaattggtcgagaaattgtgttaaatggcggccaaattcatagaattcgttttggatattgaaaaagttggaattttttacaggtcttcagaaagtttcattcattttttcctgtttttagtcagtgccgattgttacgactcgttggcgatgacttttgatgatgccaaactgtcaattgttggcgtgaacccggccacaatggcactgacaaccatttcgctgcattccattgaggacgaatttttgcgcgacggttacaccgatgagaacattcatcagcccgaacttcgtgccgaccctgaacatcggtgttgtgcatttacaggtgcttaaattattgtgtttttcaaaactgaaatgtctagaggcttttaggggacgacgatttaataaatgtgtcaaaattcgaacaaattcgaattcttatgaaatactaatcttttcatcgtttttttaatccgtattgactgacaaattatacaattctggcttttcacattatttgaatacatgggttctttacgaatataaaattttcaatccaagattcgtccgaactttgatttccaagggtttattttgctaaaatttcaaatatcaacattttccaaattttttggggtgttcgtttttggtgttttgtcaacccccagtctcatctctataaatttcatggactaattggacatgattggatacgtttttttttcgtatactcctaacttacatctccctgttcagtgtatggacgtcatttggctgttgtgccgtttaacatcgtcgaattggtgcgccaacaatcgtctgcagtcagcagcagggaggaggccaagctgtacaaccagcagcaacaacagcaacaaatgttgttgcaaagttacaccatcaaaatgcgtttgttggacgaacggttggacaatgtgctggacatgtgctttttgcatggttattatgaaccaacattgttgttcctctacgagcccatccaaacaaccgcgggacg

SEQ ID NO: 47091 - DNA, 2025 bp, Heterodera glycines
  misc_feature (2025)..(2025): n is a, c, g, or t
  Genomic contig location: Contig_ID=SeqID_12952; Location=28..2052; Strand=-
  SCN-specific regions: Sequence locations=1-360,382-1081,1103 -1207,1229-1268,1297-1711,1735-2025
  Gene Ontology: Cellular component=mitochondrion
atgactgattgtcgctggatggcgtcggtgccaatggcatttgagcagaaagtgtcgatggcacaaccacaacaatccatggcatatctcccggacatcgaaactctgaggaagggaaaagtcagtccgacgattctcaagtcagtcgggggtggaattaaaaatgtaactgaagttcgaatcggcaccaatgggttaacccatttggtacggtttccctggtcttaacaaaacaaattcagaccttacattgacccgactctgtgctcttccgacccaaattccttttgagagtgaagtgaccgtcggaagaatgcttgacgcgcgtgtccatttgggccataaagtaatttcatccttcaaatgcttaaaattaactaaactttactaatttccaaaaaaagcagaacattttgcagaataacatttccgttctttttgatgttgtaaattcataaatttttatgaaaatctcaatcattcgctgatattcggacattcgattaaggaattgttgatgtgtcgatggactaaaagttggttttttaggttggcactctcaacgataatatgaaatgggcattgtatggaggtaaatggcatcgaaagaatgggaaattaaaagggacatatctgtaattagccatttgtcataaattcttaaaaatttacagttagtcgggaaaaaaataaagcgccgaacaaatgagttcggaaataccaattagcccctattttaggttatcccatcggatcatttttgggtataaattgttttccgattttttccttttcagaacgtcttggcatttgcgtctttgacttggaaatcactcggcattatctgctaaaggcgttggaatttgtccgatctgtggcttttttgggcggtcgctttctcttcgtctcgaccaataagtgctgcttcccgatgggctttccatttggtggcatttgccttttcaggtcctcaatgctaatggtggagacaatggccgacgaattgggacagtacgcccacacgcgccattggcagcccggcacattcaccaacacaaagagcgtcttcggagggcccattcggctgcccgacactgtgattctgttgaacacgctgactagcgcgatggaagcacatccggcactggtcgattcggccaaaatgtgcattccaaccgtggcgatcgtcgactcgaacagcggtgagtggcaataggaaatgaaagaatttgtccaataatccgtgcatcagagcccaactacgtgtgctacccaatccctggcaacgacgactcggttgaatccgtcaactttttcatggaaatgtttgcaaaagcaatccaaaagggccgagcggagagcgacacttttctggagggcgcgaaagagaagaagcatcagcagaaaaggacgatgggccagcggaggcactgaacgaacaaacggagggcgacgaatgatcggagggggggggggcgaagacggactgattcctctgcttattctttgtttctgtccactttctatgtttaggttttctgaatacacttttacccttttaaattattttgagtgttttcccataaaagtccgctgctatttctccttatttctttttttttttgattcaatttgttttctgttcgatgtcttctccgcttggtgtgaatgtgtttatcaccggcgccaaccgaggcattgggctcggattggtgaaggaaatgttggcggttggtggactgaaaaatgtgttcgccggttgtagggacgtcgattcggctgcggtcagtggacgaacccttaggggaaattgaaatttttaacctcacaaatcagaccaaaaagggaaaaagagctttaaggaattgcaacaactgcacgacaaaaatggaccattgcgactgatcagaattgacgtcagcgacgaccgaagcattcggacggcatttggccaagtccaaaagcaattgctggacaaaggcggactgaacttgctgatcaacaacgcgggcattcttctcaaan

SEQ ID NO: 47092 - DNA, 1005 bp, Heterodera glycines
  Genomic contig location: Contig_ID=SeqID_12974; Location=3250..4254; Strand=+
  SCN-specific regions: Sequence locations=1-129,270-288,465-477,499 -610,632-762,784-1005
  Gene Ontology: Mol. function=helicase activity; Cellular component =cell wall (sensu Fungi)
atgttttatcaaacggtgtgccttcttttgctgttgagcgcatcgaatgatgttgcggtttttggacaggaagaaacaaccacaacatcgactagtagtacaagtacgagcacaactagttcaaccagtacatcgaccacaccaactacaacatcttcaaccagtacatcaactacaccgagcacaacaacttcttcaaccagcacatctacatcaactacgccaactacaacttcgtcgactagtacatcaactaccccgacaacaacttcttcaaccagtacatcgaccactcccactacaacttcttcaaccagtacttcaaccacacccactacaacttcttcaactagtacatcgaccacgcccactactacttcttcaaccagtacatcgaccactcccactactacttcatcaaccagtacatcgaccactcccactactacttcttcaaccagtacatcaaccacacccactacaacttcgtcgactagtacttcaactacatcgagtacgacttcgtcaaccagtacatcgtctacatccagtacaacttcatctaccagtacatcaactactccgagtacaacttcttcagcaagtacatcaaccagcagttcatcatcaaccacgaccaaaccatcgtctggcgatagtggttctggagcgtccaccagctgtaccaacgcggctggggacagagcttgcaatgcttacaaaaatagatgcggccaattttcggcatggctgaaaaagaattgtgccaaaatgtgcaatgcatgcacgtcatcggacagcagcacttcaactacaacctcaacgtcgacgtcgacttcaacaagtacctcgtcaactacgaccaagtcatcgtcaggtggcggttcttccagcagctgtaccaactcggctggtgacagagcgtgtaacttttacaaaaatcggtgcaatactttggcgggatgggtgaaaaagcattgtgccaaagcatgcaacgcgtgctga

SEQ ID NO: 47093 - DNA, 456 bp, Heterodera glycines
  Genomic contig location: Contig_ID=SeqID_12975; Location=759..1214; Strand=-
  SCN-specific regions: Sequence locations=1-74,98-456
  Gene Ontology: Biological process=proteolysis and peptidolysis
accagtcattacatgagaaattcgccctccatgaggagcacattcctctcaggtgaagtgttaatccaatgcgtaaaaaatgggtttttatttgtataagctaaatcgtttcagactcacgcgtagcaaaaaacttcttgccacaatcaacaagaacttcgggactttggcattttgtcgccggtggttggaccgactgggcgaaaccaaatatttgatgtcactcagagacctttgcggtttgtaatagcttctattgcacactttggcaacaaaaacttttcagagaaggacattgttgcgccttatcctccgctctgtgatcaggtccaaatcccatggcaaattaacgcctttttcacttttctacagaaaggctgttacacggctcaatgggagcacaccattctcttacggccgacatgcaaagaagtggtgagccgtggcgaagattat

SEQ ID NO: 47094 - DNA, 1880 bp, Heterodera glycines
  Genomic contig location: Contig_ID=SeqID_12982; Location=2320..4199; Strand=-
  SCN-specific regions: Sequence locations=1-694,716-1337,1374-1880
atggcatttcacaaaaacgacaacgactccgtgaactcaatcaccaatgctttggactttttccgtattctgccgaccaatgtgagtgtgtcgtcatcgaaagtgtttgagcttctgcccagcaaccctctgaccgacacaccataccacttcaaacttcattcaagtcaaaactatattgatctgtccaaatgctatttgctcactgagtttcgaatccggaaggaaaacgctaatggacaactcattaacctaaatgctgatgatataaatattgcgccaattcaaatgatcggacaaaccttcattcgcaacgtaaaaatgagtattaatgggcgcgaaattttcaatgccaacgctttaatggcctacaaaacatatttctcgcatgaactctcctattcaacgacagcaaaagactcccatctgaatgcaatgggctattatagggacacggatgatacattggagatgggaggcggatgcacagcgcgacgagatttgtttgcgggtagcaacgtagctcaattcattgccaaaatagacactgacctattcaatcagccattgtatctgatcaatttttgtgaattggacattgaaattttgcccaacgacaacgactttatgttaatttcgcctatcgcgggtgcaccccgctaccatttcgagattcttggactgaaattatatgtgaagaaggtgtctctgatggatgggttggcgctggacattgcgagaaagttggaggtgaagcctgcccgttatgcagtaaggaagacaatgatgaagtcaatgttcatcagtcagggccgttatgagtttacatctaatctgttcatggaccaaatcccccgtcgtgtgacaatgggtctggtggccaatgctgactatgttgggacaattaggcgcagcccgttcaattttcaaccatttaatgtgcgcgaaatttccattgttgctaatggacgatcgtacccccaagcgccctatgacctggattacccaagtgggaaatatgttcgcccattcaatgacatgaacgaagcggttgggttcgctaactcatcggagagcaacgggataactttttcccaatacggtaaaacacattgcatttacgttttcaatttgaccaatagcggggacgatcaggcggcattgtttgatctgataaagaatgggaccacagcggtgagcataaaatttaatcacccagtgcccgacggaggaataatgcttgttgtgatgggagaatgtgactcactggtgatgttggacaaaaaccgatcaataagcacagacaccactatttaaagtccgcttgtcatatcattttgttccataaaataaataaaatgttctctaaaaaattgggccttattttattcttgctccgagtttctcttcccattgtttcatcatcatcatcatcattgcgagaacaacataccgaaaacacatactctggttatctaaaaaatttgactttgtctcgacatcaacacgagccagattattaatactcggaatatttaagaagattgtctttattcaaacgtaccactgccattgtcagtacaacaactgcaccattaacaattacctcaccaaaaagcgacagattaattgatgaacatgttgctgctgttcttccaccacttatccaattgtgtaaagatagaccagaagaggaaaactttttccatcaagctgtttgttgggccctcttcactctctatttaatgcttatcatcagtcttgtgttgcaccaactttgctcaattttttggttgaaaaatggacagcatacaaatcacaaagattttgagcgaaaatcgtcggacagagcgagcatttcggggctgcttcgcctgtga

SEQ ID NO: 47095 - DNA, 3079 bp, Heterodera glycines; identical to SEQ ID NO: 13000
  Genomic contig location: Contig_ID=SeqID_13000; Location=1..3079; Strand=+
  SCN-specific regions: Sequence locations=1-110,139-443,465-473,496 -1171,1193-1792,1814-1853,1876-1897,1919-2055,2078-2548,2570 -2876,2898-3079
  Gene Ontology: Mol. function=transforming growth factor-beta receptor activity; Cellular component=integral to membrane; Biological process= TGFbeta receptor complex assembly

SEQ ID NO: 47096 - DNA, 1823 bp, Heterodera glycines
  Genomic contig location: Contig_ID=SeqID_1919; Location=775..2597; Strand=+
  SCN-specific regions: Sequence locations=1-871,894-960,983-1065,1087 -1209,1231-1270,1292-1823
  Gene Ontology: Biological process=embryogenesis and morphogenesis
tgaatttttcgagaaggactttggcgcttgcacgttcgactttgtcaaagtgtcccctgaccgtaccaagttgtacattgcagtccgatttgacagcaaagcggcggcacgtaaagtcatggaaaagtcggcacaattcctcactgattagcgtctctatttccacacaatttcagcttttccactgacggagaattactcggcttcaaggttgagatgacatggttccgtgacattcgccgctatttggcccattgtgctaaacaaggttatattgtttgctgtcccttcttttgctctcacactctaaacgcgttccgttttgaggaattcgtccaagccgttttcgtggccgttccgactatcgccgggatgacgagcagtacaaagggcgcgggcgttcaaggcaagttggaggcacaaacggggacgtgctgcgtcatccaaaaatatttaaaaaccgaatttggctgctgaaaattttttccagcggaggccccctccaagtcccaaaaatactcattgtcaaacctgcgggttcgtcacatttccagacaaaaattagctggcaattaactcaattttgattctgatgcactcgttcaggtcacctactcggtcccccgagcgtgaagagggcgcgcgcagtcgctccgcgtcggccgcttcgcgccattccaacgccaaccgccgtcgttcgcagagccgttcacactccgcccactcacactcgcacagtcgttccctctcgtcgggcggcgaagtgcgcggggctcgcgacggaaatgcgtcgcattcggagcgcgagaaatctttggactacagcgacattgaagaggcatattttgaaattctgtttttttttggcaaactttccccccattttttgtagaaaaaggtccgtctttcgccgccgcgcgttctttcgccctctccgccgcccctaaaaaagtcgaagaaagagaagcgaaagaaggagaagcggcagcgccgcagcaagcacatgtcgccttcgttggccgtccaccgccagccccactcgggctcggacatggaaatgggcggggaggaggaggacggactgtccaacggcggagggcgcaaaatgctcaaaatggagtcatcgtcgcccgtcaacaacagcaaggcatgtggtcaactgggggaaaacgagccgaaccgcggaatgggtggagaataccctcttgcgttttcagatgattttcattggtccggtcaagcccattgtccaacagtcgccgactgcaccacaaaagctgcccaaggtggagctgcgcaaccagtccatcatgttggacctttccgatgttggttgggctaggggagtggaacagactttattaattggcatacaaaatcaatacggacaaacccctaaaaaattaaggccaattggtcacaaaaacagctacttaaaaaaaagtttttgccagggtcactttttgccgatttttttctttactttttaaaagtaaactccccgtctgaaaatgttgcactttccaataaactttttccagccaaggactgtttcgccaccgaaattcaaaccgattggcgaactgtcggactatcagcagcaaatcaacggatcaaaaggcatgcaaggtttgtctattctttttagtactttgtactatttttcttgaattttagaactttccaacattcgattggccactcctccgccacaaccgccgccggtgcttcgcaatgttccgttgcctcccgtgacgtcgaataacaacgaaatgatggtggaccgcaattacattgcaaaggtgccgttgccacttttctaa

SEQ ID NO: 47097 - DNA, 1118 bp, Heterodera glycines
  Genomic contig location: Contig_ID=SeqID_13017; Location=2191..3308; Strand=-
  SCN-specific regions: Sequence locations=1-24,52-183,205-799,857 -1033,1103-1118
  Gene Ontology: Mol. function=structural constituent of cuticle; Cellular component=extracellular; Biological process=reproduction
atgaacatggtacagcccaaatgcccaccggggcctcctggaccacccgggccagccggtacgcctgggcttccgggaagccctggaaacgcgggagagccgggccaaccgggacagcaaagcgggccatgcccacctgccgcagcggtcggctgtcaagtatggtaaaatgaatattttagcaataaaattaaattaaattttgtaagaaatgccctgccggaccgacgggacagccgggagcccaaggacagcctggcacactgggcaatgacggcacgcctggccaaccgggacaatccgctggaccaggagcagccggaccgccgggtgcgcctggcccagcgggagtgccgggcccaccaggatcgcctggtcagccgggacaacccggtgcatcggcaacacaaaggtagggagtgaggggactagggatgttagccggcgcctaatcccaaattttcactataaaaaccttttgttaagcacttttgtgcctggaccacccggactgcctggcaatgccggacctccgggccaacccggcgcgcctggacagccaggaaaccccggtggccagggactgcccggcgtgccgggtgcgcctggtcagcccggcactgccggcacgccgggacagccgggtcagccaggcctgcccggacagccgggccacgacggtgcctattgccagtgcccgccacggactgcacttttgttgcaccggttccatgcttaattgagtgttgagcagagaaatgacgaaacaaagaacccattttgcagagagatagtgcaaatttctattatttttttctttttcttttcattttattttttaaattttatttatgttaacaaaatttttttttagttggatttaaaatgttttcatattttaattcctaatcttggacggtttgtctgttaggtattagtccaatttttaatgaaggcaaataatcaaaaatataattattgttttaatcacttaaacaatttaaaaattatgttttgtatagaattcaaatgctttattaatatttcttaacaaaaaaaaattagtttaaatttggataattaaaaaattaatcaattattagtgatgtcaaaataaa

SEQ ID NO: 47098 - DNA, 1974 bp, Heterodera glycines
  Genomic contig location: Contig_ID=SeqID_13029; Location=293..2266; Strand=+
  SCN-specific regions: Sequence locations=1-56,98-201,223-317,339 -347,369-419,444-470,532-553,576-585,611-625,675-675,711-799,824 -877,899-920,951-987,1011-1024,1061-1131,1153-1156,1185-1352,1388 -1664,1689-1762,1797-1828,...
  SCN-specific regions: Sequence locations=...1850-1851,1876-1908,1944 -1974
  Gene Ontology: Mol. function=non-chaperonin molecular chaperone ATPase activity; Cellular component=intracellular; Biological process=reproduction
atgaacccatccaacaccgtgttcgacgccaaacgtctcatcggacgcaagttcgacgacccggcggtgcagtcggacatgaagcactggccgttcaaagtggtgcagggagagggtgctcgtccgaaagtgatggtggaagtcaaaggcgaggacaaagcgttcttccctgaggtttgtgctgtttgctaaactgctccatccccccgccccagttgaaaattttgaatggaggcaatttcgtatgcttgattctttttcggaaaatctacaatctgaggaattaaagctttcagaaaaatgaaatttgggagggaagaggactctaaaagcaaccaaaattggcgtttgttgagtgtttgcttgttgtacttaaatgtgtttttttttttgcaggaggtttcgtccatggtgcttatcaagatgaaggagacggccgaggccttccttggccagactgtcacggatgcggtggtcacagtgcccgcttacttcaacgactcgcagcgtcaggccaccaaggacgcggggaccatcgccgggctgaacgtgttgcgcatcatcaacgagccgacagccgccgcgattgcctacggcttggacaagaaggggcagggtgagcgccatgtgctcattttcgacttgggcggtggcactttcgacgtgtccatccttaccatcgaggacggcatcttcgaggtgaaatcgaccgccggtgacactcatctcggtggcgaggacttcgacaatcgaatggtttgattttcgaatttgccagcaattcaaaatggttcgaactaaggtttaagaaaaatgaaaaagatagtttggtcgaaccaacacttaaaatgaatgaaaagcattttcttttgcttgtttgaatttaaactgcttttccttcaggtcaaccactttgtcgcggagttcaagcgcaagcacaagaaggacctcagttcgaaccctcgtgcgttgcgtcgtttgcgtacggcctgcgagcgcgccaagcgcactctgtccggttccacccaggccaggtttgtttctttccctttttggcgggtcatttcacaaactcatttgccccatgtaaaactaattccttcaatttcagcatcgaaattgactctctcttcgacggcatcgacttctacaccaacatcacgcgcgcccgcttcgaggagctttgcgccgaccttttccgcaacaccatggaccctgtggagaaggctttgcgcgacgcgaagatggacaagtcccagatccacgacattgtgttggtcggcggctcgactcgaattccgaaggtgcagaagcttctctccgactttttctccggcaaggagctgaacaaaagcatcaacccggacgaggcggtggcctacggagcggctgtccaggcggccattctttccggcgacaagtcggaaactgttcaggtgaacgattaagcctacctatcttaaatttcgaattaaattttgtttttcttgtttgttttttttgactgttgtgtattcctttctttttaggacttgctgctgcttgacgttgcccctctctccctgggcattgaaacggccggcggcgtgatgacttcactcatcaagcgcaacacgaccattccgacaaagacgtcgcagacattcaccacctattcggacaatcagcctggtgtgctgattcaggtaaagcaacggcatttccccttttgattgtttctgtgtgaaaactgttcaatttgaggtctacgaaggcgagcgcgcgatgaccaaggacaacaacctgctgggcaagttcgagctcagcggcattccgccggcgccacgaggagtgcctcaaatcgaagtcactttcgacatcgacgccaacggcattttgaacgtgtcggcccaggacaagtctaccgggaaacagaacaagatcaccatcaccaacgacaaaggccgcctttacaaggaggaaattgagcgcatg

SEQ ID NO: 47099 - DNA, 1834 bp, Heterodera glycines
  Genomic contig location: Contig_ID=SeqID_13031; Location=33..1866; Strand=-
  SCN-specific regions: Sequence locations=1-313,336-479,501-647,669 -859,890-1169,1192-1674,1696-1834
  Gene Ontology: Cellular component=spliceosome complex; Biological process=mRNA splicing
atggaggaattggtcggcaacatccccggcgcacggcaagtgttcgaacggtggatggagtgggagccggatgagcaggcgtggctgacattcatcaacttcgaaatgcgctacaaagaagtggacagagcgagggacctttaccaggtgaagagggagcaaagggaacggaaaccgaacaaacagaacaacgcgaggaattcagcgttatttgcatgtccatgggcacgacttcaaaaattgggtacggtacgcaaagttcgaagagcgcaacggattcactggaaatgcaagggcaatttacgaacaaatgttggagttttttggggaggagaatctgacagaaaacattttgatcgcctttgcgcaattcgaagagcggcaaaaggaattcgaaagggcgcgcgtgatttatcaattcggcatcggtacgaatttgggagggggaggggggtaaatggtcctaccgttttgaattccttttttgcccccttttcagaccatttgccaactactcgcaccactgaactgttcaaatgtctcacaatgcatgaaaaaaaatttggcgaacgattgcgaattgagggagtcattttctcaaaacgccgtcaccaatacgaagaggtcggagtggtggcccatcacttggccaaatgtcccttttcagcaagtcaaggagaacccattcaattacgacgcgtggttcaattatgtgcgactgttgatggcggaggaggccgaccgggccgaagtggaggaatgttttgagagggccatttccaatgtgccgccttatgtggtaggtgggctaaataatagacatttcgggtaactggtttctgtgaccaagaccctgacgaattttttaatttacaaaaataagatttaacagaatggtgggcttacatccgaatgcattttcttttcaacctttaggaaaaacggttttggcgtcgttacatttggctgtgggtgtattacgccatttacgaagagctcgatgttgaggacgtgggaaagtgtcgtgaagtgtggcgtgcctgtttggacatcgtcccccacaagcagttcaccttcgccttcacttggctgatgttcgcccaatttgagctcagacaactcaatttaggctccgctcgtaagattttgggcacggcaattggaaaatgtccaaagaagaagcttttccgcgagtacattggagatggagttgcagctgagggagttcgaccggtgcgttggcacttcaaaacgaatttattgttttttttcacagatgtcgaaaactctacgaaaaattcctcgagttctcacctgacaacagtatcagctggatgaaatatgccgagttggaaactctgttgggcgatgagcagcgggcacgtgccgtctttcaaatagccgtccaacagcccagtttggacatgcccgaagtgctgtggaaggcgtacattgacttcgaaattgagcagggcgaacccgaaagagcgcgcattttgtacgaaagtttgcttcgacgtacccaacacttaaaggcatttccgggggggagggctgtgccaatgcatttcgatgtccttttgctaggtttggatcagttgggtcgaatgggaggcgagcaacggcgaattcgaccgcgcccgtgcactttacaaacgcgcgaaccaagcacttgagggagcgccggcggaggaacgtcttttgttgttggagcagtggcgcgactttgaggcacagcacgggacggaagcggaacgaagtgccgtcgaacgaatgatgccaaaacgggtgaagaagcgccgacagataaccgcgacggatgggacggacgccg

SEQ ID NO: 47100 - DNA, 1802 bp, Heterodera glycines
  misc_feature (9)..(9): n is a, c, g, or t
  misc_feature (28)..(28): n is a, c, g, or t
  misc_feature (49)..(50): n is a, c, g, or t
  misc_feature (52)..(52): n is a, c, g, or t
  misc_feature (56)..(56): n is a, c, g, or t
  misc_feature (60)..(60): n is a, c, g, or t
  Genomic contig location: Contig_ID=SeqID_1933; Location=1691..3492; Strand=-
  SCN-specific regions: Sequence locations=1-90,112-139,161-282,304 -659,681-899,921-986,1008-1134,1156-1299,1321-1418,1451-1802
  Gene Ontology: Mol. function=3'-5' exoribonuclease activity; Cellular component=exosome (RNase complex); Biological process=35S primary transcript processing
aaggccaanacagcgccaaaacgcgcgnggcacgaaaaaaacacgccgnnancaanaaancggcactgctgcgtcggcatcctccgccgaagaagagggaaatgaagaatttggtagaggaaacctacaaaaagtcggagaacatttgccaatattcgttcaattaaggtggacaaatgcgccctcctcggcatcaaaatcaattcaattagctccaaaacgttggccgactcgttgaaagtgtacgagcaccgggaggagtacaggtgaataaattataagatccgggcatggagtaaatgggagactgatgaatcttgggagtgcactttttcaaggacagggcgagaaaattaccaaatatgcacccaattcattagttttatacctgctttctgtcacaggtacggcgtgattccggcgctgaaccaaatgctgatgaagtgcatgcacttggcccagtacttttgcaccggtctggtggagtcggagcgcgagtttcggcactacgcactcagcgtcgatttgtaagttcggtagtttaacatggaaaattgggtttcttacggacaaacccgaagacatagccattgatgggtttacccccctcccccttaaaattttgtttttgtgccaatacctcttcaaaaatgccaccatttctctgttcagttacacacatttcacgtcgcccattcgtcgttaccccgacgtggtcgtccaccgattgttggccgcctgcctcggctacgccgcgtcgcccgactattccacggaacaagtggacaaaatcgcgggccgtgccaacagcaccaaaacgggcgccaaagtgtgcagcgaattgagcggcgaaattttcttcggcgccattgtgcgggtgcgtgaagaaaaacggaatggaaatagatttaatgccaaaagtgtggcattttcagggctccgagggccatttcgaagcgcttggcattgtgatgggcatttatgacggctgctttgatgtgctgttgctcaaatacgcaatcatcaaacgcgtttatttgaaggtgcttgcttacacatctttcctccggaccatttggtgtacaaactcggataattcccataaaatgttggtggtaaccctctttttccgttaaaatttcggttttttgaaaatggggttataaagcccgctctcaatcagtcgccccggcttgcccttgccaagatggacaattcatccgaccgtgttttcttttcttaaagcggcaaaaggcggtggtgcgcacttactacggcaagttggacagtgaaggaccgctcactttggtgctgctgctggcgaatgacaacgacgggacggagacggacagtggcaaaaacaaaggcggagacgcaacagaagcaatggaaaatgggaacgaggaccaagcggacaacgacgaagaagaagaggaggaggacgaccgaatggaggttcgattattacgacgatttctaattcgtgaaatttcccgggtttttttgagggcgttttcccggtaaaagggcattttcgcacattacactccttctccctcgccatgtcacaggtggacgaacttccagcagagattggcgaccaggagggcgccgtaattgcgccggacgcgcagttggacgtgcccacgtgggtgagcagcagcgaggaggaacagcggcaaacggtgcgcatgatgagcattgtgtcggtacgacttgtgcccgtcaaaaacacagtcaaatacgaggtgagaatgggggacggtggaatgaatgccttgtcgggttgcattaaaaagttt

SEQ ID NO: 47101 - DNA, 1656 bp, Heterodera glycines
  Genomic contig location: Contig_ID=SeqID_13085; Location=96..1751; Strand=-
  SCN-specific regions: Sequence locations=1-167,189-270,296-351,376 -420,444-473,495-635,658-693,763-943,1000-1119,1150-1400,1422-1656
atgaccccaaaatatccggggataaaagccgaaagtgcgggaacaatcaaatcggacgaaggaccagcgaaacggtaggccaagtaaagctgaaaagggaaaacgcaaaaatttttaatttttagcctaatttttataaccttgactaatagtaccaaataaactaattgataattgaaaagcaataaattcccattaaagtttccattcggcaaaatcccaaatttcggcatcaattaacacaattaacgtgtgtttatttttgcgagcattaatttttaaaaattttattaaacctttttgaataaatttatgatgcttttaacgagggacaaatatttatgagataacccaaaatagaatttgaatttctttaccggaaaatcggagctggtgttaatggacatcaaattttggaaggaagtcatattaaaatttaaaaagtgaattgataagaatatcctttttatctatgaaagaaatgaaaacataataaaaattgaattggattttttattaccatgtcgcttaaggaaaaattaaatgctttcataaaacgaattggcacaaacaaaaaccgggaaataaattttcaaaatccgggaccgggaaccgggaccggacctcagaggaacgggaattcccggcccggtcccggtcccgctcaactctactttaaactttaaaatgtacaaatttatatatttaaaattatgctattttttaaactgattgatttaataattttttcaatttttttttcttgattttcagattgtcccattttcatgatcaatttacaaaaatcttatgatttgcatgacattttcatgctttgctcttctgccgtctgttttcacttttttgcatccgatcggatatcctttttatatgcgtaatttctcaaaaatattatcatttgtttatcggataattgattttcaattaaaaaagaattataaatgcttaaatgaaattaaaattttttattttattttaggcttttcaataaaatgttccccataaaactgattcgcctcagtgttttgctggtaattctcttcgaatttgtttttattggtgtcaaatgtaacgcgccaaaagagactaatgaaggtcattaatttatttttgaaaattaaatattaacgaattttcgtatttaaaataattcagacgtaaaaaataaacaaaatgaatatttggacacaaaagcattggtggaagacgcaattgactgggcccaaaagatttcattagtttggcttccaaagcaacacatgggaaggttgctgctaaattaatgactattaattaattaaaaagggagtattaaaaaacttttagaagcgatgtgactgagatagtgccattcactcttttcccgtcaccctttccacgaaaaatgtttgaatttggacaaaaagtgcaaatagttagtttgaaaaaaaacattatttaaattcataaatttaatcctttccttaggcttataatttgttgtacttccgagtttcgaatgattatgagttcataacaaaagcatatgaaaaagtggcggaaacaaatatagcaattcgacgactgcttacgattttgaaggccgtaacagcggaagggattaagcagacgaaatcactggtattggcacgttcg

SEQ ID NO: 47102 - DNA, 3701 bp, Heterodera glycines
  Genomic contig location: Contig_ID=SeqID_1935; Location=882..4582; Strand=+
  SCN-specific regions: Sequence locations=1-375,398-1098,1120 -1154,1177-1422,1454-2139,2166-2176,2199-2301,2323-2744,2767 -3279,3302-3348,3370-3701
  Gene Ontology: Biological process=nonselective vesicle transport
atgtcacgtgtgtttgccacacaaagtcgctttctgcggcacattttgccggatggacaacaacaacagcaggaagatggtgatgatgatgttggctgccagcggatagaggaaggaatgtgcggcaccggtgggactccgctggcgaacatcgaccagcaacagccttttgcctggcgcaaaattggtacgctgtccaaaaaactggcagtggataagttccgctaattggggcctatttcagttccaaaaatgctatttttttcataatgacccatttaataaatttgaatgcattttcggcttttttatagtttaaacgacaccacaatttaatacttcgcaacttttttatagaatcacccaaatcaatcatttctgatctccattttcagtagttcggagtaatccgttgagcggtggcgactgttcgtccggttcggccagcattgacatgggcaacacccgggtgatgtgcacagtgtacgtaattgtcactaattatcaaaaaaaaacttggaaaatttactttttattgcacggatcggtgggggagaaaaatgcgattggcctagcataaaccagctccacttttgcaggaatgggccgcgtgaactgcagcaacagtcggtgtccagctcggcggacgcggccgcctccatggaggagggtgtgctgtgcgtcacactgcgcggctgtgacattgacgcatcgctgcgctacagtgtcgagcgcgcactgcaggcggcggtctgtctgcgcaaattggcacgggtcagtggcccggcatcaaattttgtgacaaaattcatcaattttttgggtgaatttttatagaaattgtccccctataatttagaccgaaactgcgattgagctgaatgtgctgtcggatgatggcggcgcatttgccgcctgtttggtcgccgccggtgtcgcaattgcgtcggctaacattgaaatgtaataattcccaatacttcttcgacatttacgaatccggaatagttccccctccccctcgaccatcctattcagaaaaccatttgttttatgtgccaggatggaattcaaacgcccaaaaatttttctggattttctgaaatccgatgctccaaatttttaagtttcaccggaattacgaccctaaaaatgttggaaaatctatttcatctctgataaggatagcaaaatccacaaatcttgggacactatcaagttgaatatgtttattaatcaaatctttttaaaggctcgacgttctgttggcttgtaatgtgttgctgattccgtccaattcgttgacggcaccgcttcgaattgtgttcgacccggacaaggccacaattgctgcacacgttggcaaagcatccgccctaacaatgggcgtcataccaaccattggccaggcaaataattcaatttttggcatttttaaaaattgtttttgtacgaaatatcgattaaaatcatttgcgggcacgcgggtttgaaccaccactgtttgtggtgtagtggtctatactctgggttcctcgttgtgccagcgtgggttcgagttcgcgtgtctgccaatgatttattttttgctcgtctaatggatccaaataccggattcctaattagacaaaattaatgcgaatttgtgattgatatgttaatcccatctaaaaaaaatttctgttttaatccaaaaaagaataccccccaaagaaaaggaatatgaattttatcgtctacattcgattacagccatcccagccattttataaatataaatttcgtccttttccacaggtggtctgtgccgaactgagtggcgacgcgtgtccgttgcccgcccatcagttgcgcggtgcgctttccgacgtgtacgagcactgtttgacactgtacggcacagtgcgagcggcactgttaaaaagcgtcaccgagggggcactttgacgggcaaaataaaaatcactttgttgttgttttttgtttttgtatattttttcttttattatctgttatttttgacatggaattccgacaaaactcattgacggatctcgtcgaataaaaataaaatgttggcgattggcacagccaccaaataaattttgtgtggcatttgtcgttgaacattcaattaattacctaattatttatttattttgttgtgtccattacatttctgtttgttatttgtttgtatattatacattgaaattgcgatggacactttgtttgacgtgcgaaacaacttttatttgggcgctttccaacaatgcatcaacgaagcacaggtttttgttttataatggggggaaaaggccgatttatagggaccgaaaaacgaaaaaatggtgttggaatgtgcaaaaaattggtcacaaaaatgtgttccttgtgacccatgttttaaattcagtaattcatatggtaaagtgcaatatcctgtcccgccctcttttttcactcaaatttgatgaaaatcattcattttaaactcatttttggttgcatggtttacatttttttacaaaagtatgattttacacttcagaaggtcaaatgcaagtcggaagaggagaaggagctcaaggacgcgttcatgtaccgcgcttacattggcctgaacaaatgttccgtgccgttgggcgaaattgacgccaccgatggcaatgggtcggccgcccttatggcaatccgacggttcgccacgtttatgagcggtgcgccggagaagaggtcgtttagggaattaagtggggttttccaattgtttagtaaggggtccgtcccctgttttttttttttttggatttccgtttcaattgtggcattttaatttaggtcagagattgttgaccaggtggccaaagaatttgaaacgaaaaagtacgctgacaacgaaatttgcctgctgatcagcacactcattttcatgcacggagaagtacggttttcaaaaaatagggttccgactttcgactcgtttgcgccatatttctgtcgatttctttacgttttatctaacaagcagcaccaatttttgaaaaatcaattctcgactcgaaagtctcgaacctaattgcactctcgagcagtactcaatagacacaaaagcaaaggtaaaattgtcaattccgtcacagaaaattgaggaggcattgcgcgtgctgaaccgcacggcgtccgattcgttggagtgcgccgcgttgcgcgtccaatgtttgctgaagctgaacaggggcgacctggcggccaaggaggtgaagcgaatgcaggagatggacgaggatgccaccatcacgcagttggctcaggcgtggctgaacatggccatggcgagtgaccaccggggaaagggcggggcaaaaatggatcactttttttgtaaattaagtgatcgaagtggtaggatttaatggggttaggtggtccggtatcattgtaaataccataattcggtatgaaatgtgtactaccgagaaaaggaaatttcaacaacaaaaaaaaaatggaaaaattttctaacgcttttacagggtcgtgacaagctgaaggacgccttctacatttaccaggaaatgttggacaaatacggggccaccccactgctgctcacttcgcaggccgcctgtctgatcatgcaacaaaaatatgaggaggcggagaaattgctcttggtactacaaaaaaaaaaacactga

SEQ ID NO: 47103 - DNA, 1758 bp, Heterodera glycines
  Genomic contig location: Contig_ID=SeqID_1936; Location=2849..4606; Strand=+
  SCN-specific regions: Sequence locations=1-359,382-473,495-611,637 -949,974-1758
  Gene Ontology: Biological process=gametogenesis
atgggcgattttggcgagtggtatcgttccattccgttaatcaccagatattggttcaccggatcaacagtgatcccattgttgggccgactgggcattttccagtgagtttttgttttcgttttattacttttaatttgcatttttcttttcagtccgtatttgatgttgctcagttgggagctgttcttctacaaattgcaggtgattgtcaaaatttgataaaatcatttggcgatgggtcaggcaaggggtcggacagattgaaaaatgagtcccattttgcgattgaattttataaatatttttcattcaaatgcctctataatctggccatccattcagaaggagtttttcactttttcattaaaaacttatggccatcgaggggggggggggcataattttctttaaatatccccggaaaatgggatttttccaggaattccggtcccgttcatttcaaattctgattttgtgattttgaaaaaatcgtgtccatggctgctttagcaagacaaaaatcccatttacttttcccagtctggtcccctcccattgcctaaaaaatggacaaattccctggtccgattctcgcttttcccagttttgactcctgtttttaaaactcaaaatccaaagattgttttacatttgccccctgccaatctctccccatcttttcagttatggcgtcctctcagcgcactgttctactacccggtcaccccacagacgggcttccactggatgttgatgtgttatttcctgtacaattactctaaagatttggagaccagtcaatttgatggacggccagccgactttttgtttatgctgattttcaattggatttgttgcacggtttgtgaaacaatttttgtgtaaagcagagcacccgccaatttgggtgtctaaaaatgacaatttagaaaccggaattaccggaaattcgttagcctttacaaaaaaccatgacatattttttgggtttttttggtacactaaattacgatattttttcaaaatacggcgtttcaattccgtccatccgtttcaattggccttttttcaacctaaaaacaaatttttttttttttttgcgtcgaatcaaaattgattttaaagaggcattttataaatgtagtcatctttcacagattgtgtgtttcgttgccgaaatttacttcttgctcgaaccgatggtgctcagtgttctgtacgtgtggtgtcagttcaacaaggaccggactgttcagttttggttcggcatgcagttcaaggtttgcacagtggacggtccaaagtttttttggccatttaagagtggattttgatgtcatgaaattgtgccggttcatgagtcaatttaagactttgccgaatttgtttcatgagtcgaaattgatcggaatagatgccgaattcgttcgacgacctcaaaactcctccccatccccgagtttcacgacttaaaattaccgtagaattttttaagctgaaatttctccaaaaatggcaaaagcaaacaaaaaaatctaaacgattgatacttgtaacccgtaccataatcaatcaaaacccatttaggccatctatttgccatggattctggtcgcgttcagcatggtgttgcgtggtggcggaatcaacgaattggttggcattcttgtcggccacacctactacttcctggcattccaatacgcacttgactatggtggctcggtgctgttgcggacaccgcaattcttgtaa

SEQ ID NO: 47104 - DNA, 2269 bp, Heterodera glycines
  Genomic contig location: Contig_ID=SeqID_13102; Location=255..2523; Strand=-
  SCN-specific regions: Sequence locations=1-41,63-343,380-415,504 -598,620-637,675-683,706-1093,1144-1248,1287-1387,1425-1521,1546 -1626,1648-1684,1708-1717,1768-2130,2157-2269
  Gene Ontology: Mol. function=chaperone activity; Cellular component =vacuole (sensu Fungi); Biological process=protein folding
caaatgggatcaaaatctaacgcaaaattcgacttctgcaattttttgttacgtaagaaaatcaatcattaaaaaaaagttagcttaaattttcttcattaattaatgatataatttaaataaacaagtatgatttatgataactaatttacaaaaatagaaaccattgtactaaatgctttttaaaaattttcatcactctaattaaagaatcagagaatgagaacataattttatgattagctaatattctgctcttttaataaataaaattttgaggtctgattcatttagaagagatcagagtgatgaaattttactaatgaaaggtgcctaggtagggattttaattaattaatgattcattaataatattaatcttaagcatttataggtaaaattcaaaaaaagcaacaataatattttaaataatatttttaatgttttttttgacaatactttattttaatcaataaacaatatatttttatttctaaaaaaatgcgagttttagccagttttaccaaaaccacgttgtcatatcacatcaactggcgcaattttattggctgacatcattccatcacttatcatcaaattgttttctccctttattattgaccgagtgccatttgggtttataattttatttttatcaatcattaatttattaactctaacgctaattaattaatttatttattagttttcgacatttacttgtgtgcataatgcaggcactcagctttgtcattgtggcattttcccaatcattcacactgtcattaattggcattatttttgcatcattaggcaatggtttgggcgaaaattgcttgctggccctctcatctcattacaaacggtaaaaaaattcatatgggtaaaattcatgaatttatgatgtttaattaattaatgattattagatcaacaatttcggcatggtcatccggcacgggcggtgccggaattgttggctcagtggcatacgctgcacttacagagccaaaattgttcggattgtcaccacgaaatgccctactttccatgctaattgtgccaatcatttttgcaattgcgtcagttattgaattttaaaaataaaaatttaatttagtttaatatcttaaaattttatttggctgtctttgcggggtgataaagaaagaaaaatgttgaagaaaatattaaatatttcggttaattaggaaaactcattaccacgaattggtcggggaagtactctaatttttttttgaaattcattttatttaaaaaatttagttattgggggcttctgactccttcaccaactgttcacagaacaaaattattaaacccatcaacgtggattatacaagtaaaaagaaaaaaaaacattcagaatttaatttaaatttttttaatgttaaaattttatagatgaataatagcgaaatctctgatggaagtgtgaaagttacaagtgaactgaactttggttccaaaatgcgtcaaattattgtccgtttgaataacaaaaaaataaaaaattattaaattcatttagcttttgcttcatctgatggtcccattgggaattgtgtattttgctgaatatctgatcaactctgggcttgtaagtttgatttcacatttactaaattaattttagcttataataaaattgaattcttttaagtgttttccaaaaatattttttaagcaaaaaagcaattatttgtttaattttgaaaataaattaattgatttaaattatttaaagcatcaattgctgcatttcgactgtgcccatgggttcggactcagtgaggccagtcaattccgttggtaccaaacactttaccagctgggcgtgttcatctcccgatcatcggttactgtgcttgcactgcccacttatgtactttatctgcttgctgtactccaggcaatcaataataattaagctaattagggtaattaaattatttgttcatttttagtgcgggaatattctgatcttttatttccaatcgctgttcaattacattccgcacattggcattgtgttcattgtgatttttgtcgaaggtctgctcggaggtgcctcatatgtgaacacattcgacaagattcacaaaaaggtaaattattttaaaaaataataatttgacattttatcttttttgatcagcaattttcatttttccaccgattttccattttttatttccttcttccaataataaatgtttatgatatttgtgtccaaatgttttttttc

SEQ ID NO: 47105 - DNA, 767 bp, Heterodera glycines
  Genomic contig location: Contig_ID=SeqID_13104; Location=1961..2727; Strand=-
  SCN-specific regions: Sequence locations=1-767
  Gene Ontology: Mol. function=structural constituent of ribosome; Cellular component=cytosolic ribosome (sensu Eukarya); Biological process=protein biosynthesis
atggtttactacaacaacgcctccagctacattcaggtaaggaacggtacacagcttgttttgtgctttatcatttgttttttcagtggcaagtcatccgcaaaaacagtgccttcctcaaacgtcagcgtggcatcccgaaacacttcagcaccgagccgttcaacatggcgcgtctgaacagcattcgacacaacggaatgatcaacaaaaaggcggtggacatttctgctgcgaaggacggcaaaggagtggttatgagtgtaaagaagcacaaaaatgtggcgaaaccattgcaggtgaggctgaatttacttttccggtttattgttggctctagtcattgattggacgtgtcttattgcgtttaacatcaaacaggcagttgccagcacagcgttgacaagagacagtcgccgggtgatctctgccgtcggaaatgcggtgaccgcctacaaaccgtcgcacgcgaagctggcgcagcgacgcgcctcgcaaatcctccgctcgcaaaaaaccaaggccaaaccagcgacagtgcgcaaaggaaaggccgaatgaacgaggggattttgtggctgaaagacctttaaatgatcgaaaaatgttgttgtttttgttgaaattaattggaaaagaaccattcccgtgggaaatctttgttagttttattttttggcatttaatgagattgttatctattcgatgattgacaatggggagggactccggttggggtcaactggctccatagaatgcaaattaaa

SEQ ID NO: 47106 - DNA, 760 bp, Heterodera glycines
  Genomic contig location: Contig_ID=SeqID_13108; Location=2616..3375; Strand=+
  SCN-specific regions: Sequence locations=1-760
atgtgccgatttggccaatttgtggaggaaaactgcaacaacggacatcgcttcaacccaacagtcagtggacaaattgccgagataaaacgaaaagtcattggggtgggggagaaaaagccaagcaaagccatgggaaaaatgcgagcggtgaataaatcgcttatccaacggatttggaaagtgttcatctccctttacgttttgaagatcggccgttgcgatccgtccttcgcttgcccggaacatcaaaagccgccgtgttttgagggtcaaatgcgtgtcacggaaacgccgtccgccgcgccaacggccaaatgcacgacggaatatgagctgtgccgtgacggacgatttaagcgcatcagttgcccttacggagaacatttcgctggggggcgttgtgtcgcggggaattgcaacggtgggcaaagcggcagtggccaaggccaaaccgatcgaacggcgatgtgtaaggtgagaaggcatgtgctaattagtggcatttgccttgattatgcccaggaatcgcccggtccgcaaggctttcgatctgacagcaaaaattgtgccaagttttaccaatgtgccaatggaaaatgggtgccaaaggactgtgccaaaggcactgtgttcaatccggcattggccgtctgcgattggcctgccaatgtgccgggatgctaagaaatggcaaacggagaaaggaacagacgattttaaatcatcggcacaaagacaaaacgccaaaatttaaaaa

SEQ ID NO: 47107 - DNA, 186 bp, Heterodera glycines
  Genomic contig location: Contig_ID=SeqID_13114; Location=551..736; Strand=-
  SCN-specific regions: Sequence locations=1-145,173-186
gaaatgcaagaagcgttcgaaacacagagcatggcaaagatatttgaagtggcgaagagcatggactccgaggtgttcaagtaccatttggatcgctgcactgcctccggactttggattccaaacgcaaaggaagccgagggacatggacaagaggaggaggagaaggaaacggaggagaaatga

SEQ ID NO: 47108 - DNA, 2666 bp, Heterodera glycines
  misc_feature (48)..(48): n is a, c, g, or t
  Genomic contig location: Contig_ID=SeqID_13133; Location=1..2666; Strand=+
  SCN-specific regions: Sequence locations=1-4,32-51,82-489,530-642,664- 681,703-1310,1332-1683,1708-1741,1763-2101,2125-2666
  Gene Ontology: Mol. function=DNA-(apurinic or apyrimidinic site) lyase activity; Cellular component=mitochondrion; Biological process= base-excision repair
attttttggaaaaattttccaaaaaacttagtaattcatcataatttntggaaaaatttcgagtttttaaaattcttttttgctaacagattttgctgaaaaattgcattaatttagaataaattaaataggtaacttacaaatcggagaagaaagtaagttgagggaaccactaacatattatttaacatagcggccaaaaaacgacggcgaacatttggcagataactgaaaatgagataaatgtccaaaaataaaaataaaactggcaaaactaaagaaccaagggcacccggtgaaggacttgacaaaatactttcatcaaatgttctttagctttgcctaacttaaaaaatactcgcgagaatgttgtcggttatcaaacgcgtaaataaagcccacataactgagtggcatcaaaatggcactgcccacatagatgagacattcttgcatagaaagtacctgtacggcaggaactagctcaagtattaaaatataaatatatgaaaattatttttataaaaatgcgggaaaacagactttttaatttccgatacagagtcaatttatataatacacatactgtatgtacatatgtataggtaaacgaagcaatttttcgccagtattttgccatttgccacaaaaatcctagccctagggattagtaatcccgcggcatctcgtccacaaaaaatttgagttccattccagccagtgatcctcaagtttgaactacctatccgggctccatctaatacttaattacttaacagcagagtcaagcaattatttatatgtattaacacaccgtttcaatttatcttggtatcattcgaaagcccttgatggggagaagctttttctaagcaaatgctaagcaattggattgattaggaaaaaatatgagggttcgaaattttgtttctcgaataactttttagttaaccctttttttgcttttaaaaacccttacattttgttcgtaatttttttctctatcggtgtgcaaaatttgaagaagatttaacatcagagaaaaaagttaaacatcacgaagtgaattcggtttttctctattaacagagataaagaaatagtacgccaaaaagagagatgtttttttctctgcgctctctctttattggttcatctctcgttttttgaaacggtgttaatttgacatttccaatggttgaaccaaaaattccaacaacaagcgattttaacgaagaaaaccctgtaaaatcgacgccagaatcacattcgttaatcaagaatggattttttatgagtgaagaatatgggatgacaacgaaaagtgtctacacttcacaaatttcacaatctgtgataaaagctggactttattctaagaaaaatctgggagtgcatgtttctgcggcgggtaagtaatatttttggttgatggtgtggcacttcacctttcaggtagtctggaaaatgctatttggaatgcaattgaaatgggttgtcgttcatttgcgttgtttgtccggaatcagcgtcgttggaatgcaaagcctatggatgagtcagttgttgagcggtggaattgtgcaattaaagtatggcaaattcgtagacaaagtgaccaattgagagtgggcggttaagcaaatttaagcgcataaattcccaaaaatatattttccattctttttatttatttatattttttaaggtgggatatggaattccccgggtccgttccctgaaatggtacagaaataaaatttattcagaagacaaaattcccgttgcaccaaatcgtcccacatggctcgtatttgctgaatgccgggtcacccgaccaaaaaaaattggagatgacacggaaagcgatgctggacgaatgtcagcggtgtgaaaggctgggaattcaattttacaatttccatcccggtatgattttgaattcccaactttcaaagaattaattaaataagcagtaaattgaaggctccacaactggaaagtgcacgagggagcaaagcatcagcacaattgcggacaccataaattatgtgctggaaaatacgcatcttattacgctcggtaaattgggttttgttagtatttttatttttaaatttaaaagtcgtggagacaatggcgggcagtgggaacacaatcggtgcgacatttgccgaacttcggtcgatcattgacggagtgcagaacaaagaaagagtcggcgtttgcttggacacgtgccatctttttgctgctggtagcgctttgtttttttttggtcgccttccctattttttataaaggctatgacattgccaataattataagggcgtaatggaagagttcgcttcaacggttggcttgccttttttaaaggcgcttcaccttaatgattcgaagggtatttggtaaaataaataatttttgacctttcatttttagagtgttgctcatcaaagctcgaccgtcatgaaaatattgggaaagggaaattgggcacaaaagcatttgagcaaataatgggggacgaacggttagacggcatcccaatgattcttgaaacgcccgaagggaaataccccgaggttttttgtttataattaaggtttgaattattttaatttataaccaggaaatgtcacttctttacgaattggaacgaatt

SEQ ID NO: 47109 - DNA, 636 bp, Heterodera glycines
  Genomic contig location: Contig_ID=SeqID_188; Location=5410..6045; Strand=-
  SCN-specific regions: Sequence locations=25-91,142-377,399-456,478 -523,545-606,628-636
atttttaatatatatatatttattgagcaaaccacaggcacattagtgctcttatgtggcgcataaaaaaaatcaaaataaataatgtcaaaaaatacaacaatatgaaatgtaaagtaaaataaaataaaatggaatgaatgtcaatgcaaatgtcaataaatcccttagaactcatacatagcttttagcaatgccctgaattgatttgccttatctgcctgaattggaacaattggtaatttgttccaattcttggctatacggttaaaaaaattattcttactttttgtggttgtgcgccgcattctcaaaagtaatggcctacgagtgggtcgatcagaaaaagtaaaaagtttactagcatcaagactcgtaaaacccttcataattttaaaagcggtagttaagtcagcaatatttcttcgcttggctaattctataagctgacaaatttcaagtctttctgaatatgatctatgtaaaagtccgcattttttaaaggcttttctcgtgaaaaatttctggactttttctattctttctatatctttttttaagttagggttccaaatttcaacagcatattctaattgaggtctgacataagtcttatacattcttataatagttttt

SEQ ID NO: 47110 - DNA, 2918 bp, Heterodera glycines
  Genomic contig location: Contig_ID=SeqID_188; Location=3105..6022; Strand=+
  SCN-specific regions: Sequence locations=1-228,251-277,310-456,478 -505,527-571,593-720,742-782,817-974,996-1020,1051-1192,1214 -1343,1366-1954,1976-2047,2069-2232,2256-2314,2336-2397,2419 -2464,2486-2543,2565-2800,2851-2918
atgccttggattaattccatattaataaatgcccgttcaatcgcaaacaaaatagctgatttagaatatctaattgagacaaataaacatcaaataattttgataaatgagacttggttaaataccaggaatacaattacaactgagttaacacttaatggtaaatttcaaactgttctagcaaatagggacaataagagaggcggcggatgtgctattttggttagcaatgaaattccatttaaaataattttatcagaaagcagaaaccaatgtgaaatcattcatattattttatctttaaaaagtccaatacatattataaatgtttacagacccccaaattgcacaacacaaaacactaaaaaaatgctaaaatatttaacaagtgtaaatgaatcaaatagaataatttactgcggtgattttaacgccccaaatattgattggaacacaaataaattattagcaaaaaatgacccagttgcaaatgctttcattgactttattgaccaaaatcaattattacagcacgtaaaagaaccaactcgagaaaagtcaattttggatttgattttttctggaaagccttccattgttaatgatattaaggttttagaacatttttctacatctgatcacaaaatgatcagctttaaagtttctcaagaaataaataaaacccgtgaacccaaaatttttgtaagggactttagctacaaaaactttcaaaaattaaatcaaatgatcttactaaataggcttagttgtgtcattaatacgaaattttatttagaagaaaaatataacacacttttgatagagttaatgaaagcatttaatcatactattcccaaaaaaccacttaaacaaatagttaagcaatcttatccacaaaaaattagagatttatacgatgaaaagcttaaactacacaagcttatcaagaactgcaaggggaatgaaaagtataaattaagttacaaaattgtttccagggtgcataaaaagcatttaaagcaattttgggataaaagggaaaataatattatctcttcagggcaaaaagcattaacaaattatgtaagaaaaaaattaaatccaaaaaactccattccttacttaatcgataacagtgggaatatttgctttgatgaaaaggaaaaaagtaagctattagcagaaacattccaaaaagtatttattaaaaacaatcaaattttcgattattctgaaaataattctccaagggaaaagcttctgatatagaaattaatgtgggaattgtatggaatttactcagaaaactgcctgggcgaaattccacgtctccagataatattccatatattctacttaaaaactgctcggaaacactagcagtaatattaagtgatatattcagactaacacttgattctggtcaaattcccaaaatttggagaacttctatcattgttccaatatataaaaagggtgaaaaatctaatcctgaaaattacagacctatctcacttacgagtacggtctgtagggtatttgaaagaattttggcaaggaaaataattgaatttttgaataaaaataatttcttttcgaaagagcagtttgggttcttaaaaaacagatccacgacaacccaactattacagacattacatgatttttacgaagccatacaaaatcaaaaagaggttgatgtcatttatatcgatttttccaaagcattcgattctgttcctattgatttgttacttgcaaaaattaaaaatgctggaatagttgggaaaattttggtgtttttacgtaacttcttgtcacaaagaagttttagggtaaaaattgaagaccattattctgaaagctataatacttatacaggggtaccacaagggagcgttttgggtccattattattcctaatatttatcaacgatttaccggcaaatatacctaaaaatgtaaaaattaaaatgtatgcggacgatgttaaattgtatattttccatcaaaatgattcaaatacaaatgatctatctgaagctataaaaattcttgaaaaatggtccaaatctaacggccttgaaatatcggtcgaaaagagtcaaacattgtatattggcaaaaataattcaaaaaaagagtattttctcaatggaaaaattattccaagcttagaaaaagtcaaagatttaggagtaataattgactctaaattatcttttgctgagcatataaataaaataataaaaaatgcttacttaaaggcataccatattttgagaataatgaagactagagagctaaaaactattataagaatgtataagacttatgtcagacctcaattagaatatgctgttgaaatttggaaccctaacttaaaaaaagatatagaaagaatagaaaaagtccagaaatttttcacgagaaaagcctttaaaaaatgcggacttttacatagatcatattcagaaagacttgaaatttgtcagcttatagaattagccaagcgaagaaatattgctgacttaactaccgcttttaaaattatgaagggttttacgagtcttgatgctagtaaactttttactttttctgatcgacccactcgtaggccattacttttgagaatgcggcgcacaaccacaaaaagtaagaataatttttttaaccgtatagccaagaattggaacaaattaccaattgttccaattcaggcagataaggcaaatcaattcagggcattgctaaaagctatgtatgagttctaagggatttattgacatttgcattgacattcattccattttattttattttactttacatttcatattgttgtattttttgacattatttattttgattttttttatgcgccacataagagcactaatgtgcctgtggtttgctca

SEQ ID NO: 47111 - DNA, 381 bp, Heterodera glycines
  misc_feature (332)..(332): n is a, c, g, or t
  Genomic contig location: Contig_ID=SeqID_13161; Location=1..381; Strand=-
  SCN-specific regions: Sequence locations=1-16,189-332
  Gene Ontology: Mol. function=DNA binding; Cellular component =nucleosome; Biological process=nucleosome assembly
ggctcactctttccattttgtgttcacgacaactttcattgctctctctccaaatggcacgaaccaagcaaactgctcgcaagtcaacgggaggaaaggcgcctcggaagcagctcgcgaccaaggccgctcgcaagtcggcaccggccaccggtggagtcaagaagccgcatcgttaccgccctggtgagaaaaaaagacaaagttgatttaaaaatcctattttgattgggtgggctaacctttgaaattttgtattcattttaattcatgtgcttttcccacataattttgtgtcatttcccttcgcaggtaccgttgcgcttcgcganattcgccgttaccaaaaatcaacggaattgctgatccgcaaactgccat

SEQ ID NO: 47112 - DNA, 821 bp, Heterodera glycines
  Genomic contig location: Contig_ID=SeqID_13188; Location=302..1122; Strand=+
  SCN-specific regions: Sequence locations=1-468,490-674,696-821
  Gene Ontology: Mol. function=ATP dependent RNA helicase activity; Cellular component=nucleolus; Biological process=35S primary transcript processing
atgacgatttttgggaattatttttggaggtttttaccaaccaaattggtccatcatggtatcattcgaaagctcctggtgaggagaagctttttctaagcggatgctaaccattttgaagcattagaaaaaagttatgggcgtttgatttttgttttttgaataacttttctaatcgacccattttcaaattaatctgacctatcattagatgcagaaaatttttctctatcgatatataaaatttggttggatttaacaagtagaaaaaattttaaacaggatgaagcaaattcggtttttctctattaatagagatgaagaaatagtacgccaaaaagagagatatctttttctctgcactctctatttattggtacacatctcgctttttcggacggtgtgtggaggaatcatatcattcttaaaaaatcaaaattcccaggtccgtgtgctgatcgcttgtgatgtcctttcacggggcatcgatgttttggacgtcgattgcgtgatcaattacgacctgccgataaacgaacgcattttcgttcaccgagctggtcgtactgccagagcaatgaaagaaggactactcgtttcactgacaacaaaagaagaagtgtgctaagtgactacattttcacattttactttcccacatttttttccctttagaaaatgaaacttaaaaagttgctgtctccgcacaacctttgggagagcattcaagaaacaaagtccaatgactcggactttaacgaagaatgcatacagttgtatgaaaacgcgctaagaaagttgaaaaaacgatttgaacaaaa

SEQ ID NO: 47113 - DNA, 1637 bp, Heterodera glycines
  Genomic contig location: Contig_ID=SeqID_13200; Location=514..2150; Strand=+
  SCN-specific regions: Sequence locations=1-38,63-155,178-539,561 -808,830-1119,1141-1163,1185-1259,1282-1282,1304-1512,1535-1637
  Gene Ontology: Biological process=locomotory behavior
accttttcaatttgcgcttcgcctccaaagaattgagcagaaatgccaaaaaatgtgacaagcaggaaaaggaggaaaaggtgaagctgaccaatgcgctgaaggtttgctttttgatttgcgtttggtcagattttgttaaagtctccgacaaatttctaaattttgtattttttcattttggggtgtcgtctttaatgccaatgcattttttcgcagaaaggcaatcgcgaggtggcgcaagtgcacgcggagaattccattcggaagaaaaacgaggcgctcaattatttgcggatgagtgcgcgcattgacgcggtggcggcacgcgtgcagacggacgcgacacaaaagcgggtgtccagcagcatgcaggggggtaagacggggagagggggcggggaaggaaaatggaaaaagagggggggacggaaatgggatgaaatgcgtacagaattcggcctatcaccaaagacatgccaactttctcatatttgacggactttgtgctgctgtttacactgctatatctgagatggaataaataaatgaatgaaactggtttttgggacttcacaaaagaaaatggggagggtaacccgaaaactgactaattcatcgttgcctctccttttccccattttggaaaactaaggaattggctaactggcggaaacgcatcggagaaacaaaaaaagggacggagtaaacatttttgtttagcattttttgcactttaattttattttttcatctgcacttttcagttgttaaagcgatggagtcggcaatgaaatccatgaacttggagaaagtgcagaatctgatggaccgattcgagaaggactttgaggaccttggttggtccattctcgttaattgaattgtgttcatcttcacaaagcacttttttgcagatgtccaatcggcgacgatggagggatcggtgagtgggcagagagtaattcattcaaacacaaataatggagtttttataaatacatgaagtcgcgaatttccttaaactaacccaaattccttcaaaattccacatttataaaaacgtttcattttttggccccccctttgcctgttcatgttccctttgaggagatgttttgatttattgcttaaaatccatctttgccatcttacagatgaatgccaccaccacactgaacgcaccgcgaagcgaagttgacgcactgattcaggaagcggcggacaaagccgggctcgaactcggtgagaaaacacacatacttttaaatataaaaccttgtttgattttaatttttattaattgatgaattggaaaacaaacaattaaaatcggaactctcaccgaatgcacactttaaaaatttgtcatttttctcgttttcctttttaggcatggaaatgccggcggcgcaaactggccaattggacacggtcagctcaaaggcatccgttgcggacaacgacgacctgtccaaggtggacaattggagttgttagaaagacaaataacaaaaattttgcccatttattatctctttgttgtaattttcaaaatttcagcgtttggccgccctgaggcaaacttaacaagcgaatggaccgacagaatgacgccatttgctaaatcattatga

SEQ ID NO: 47114 - DNA, 1815 bp, Heterodera glycines
  Genomic contig location: Contig_ID=SeqID_13201; Location=1373..3187; Strand=+
  SCN-specific regions: Sequence locations=1-139,161-528,550-830,853 -940,963-985,1008-1060,1084-1815
  Gene Ontology: Mol. function=delta DNA polymerase activity; Cellular component=delta DNA polymerase complex; Biological process=lagging strand elongation
atgcagtttcagcggtggataaacggggaggtggaggtgtcaaaggacggcactgatttgagtgatgagggcgaggacgagtcggacactttgcgcaacatcgccagacttgtcattgctggtgattttgcgcgttttgcacagaatgtgcggtgtttacgaataattacaatattcccagaaaatttcacaggacattgaaactcagcgagtttcgatgattggcgccgaacttgactcggacatggactctttttcgcaatttgacaaatttttggccactcttttggtaataattcttctctagcattttaaaattaaaaggtttagcaaaatttgagagttgacttaatgccaggagccagtgatcccgtccagtgcatgatcccccaacagccaattccccccgcggtgttcactttggcggcgccgttccaaccaatgcttaacacagtgaccaatccctacagtttcgagctcaacggagtccgttttttggggacatcaggtaatttggcaaataccttcacaaaccatttttaaaataaaggtcaaaacatcaatgatttgcggcggttgacacgcggaaaggacacattagcattgatggaacgcacgttggaaatgggctatattttcccgacagtccccgacactcttcccggatttcctttttctggacgcgacccgcttgttttggaccaaattccgcacatttatttcgtcgggaatcagccaacctttgaaaaacgaatcgttgaatttggcggaaaaccaacgaaaaggtagccaatgaagcaccaatcattttcatgtttaatggtcaatttaagatgttgccttttggctgttcctaagttttgcaagacaaaatcagttattctgctgaatttacggactcttgaatccaatgaatactgttttggtgcaaatttcaatgaatcgggtcaatagaagttcgagaagggtcatttgatctcaattttatgtttgcatttatttaaaaacgattggccaattactccaaacgtgactttcattgataaacacataaaattgcattattattattattaataataacgacatggattttccatttattatattttcattttcaaaaatgactgattttatcaactttatttttcagtcagaaaatgccatttgttaagtttaagcccggaaagcagtttggtcgctacaacaccaggctgttcaaggagattgtcaagagcaagaacaaagagccaattcctcgcatagttcccactgattcaatagaatcgatgggatttgacgtgttggacccacaggatgcggggtttctccaaaaaatggctggtggtccaaaacagccgaattttcaattgccgccgcatttgcgaaaaccggaaaaaatggttattttggttgaaaatttattaggagcgtttggctggttcttgataattaattatgttttgttagctccgagtgtttgactattagttgtaagtccttttcttttcaggagcatccgttgttcaaatcggaggaatgtttcgccttcgagggcattaccggaatgactgatgggattgacgaggcttgtgctcttatccgggcgacgaaggcacagcccgtgccggaccgtgtttggaattcgcttcctcgggattttttaccggctgatttcgagcatagcgttgaggatgctatttgggcaggcgaacgttttgacccgacattggagaaattgccgaggaaattcgaccccattcttttttggatcaaatacaaaatgtgttatggaacgccagtgacaaaaagatg

SEQ ID NO: 47115 - DNA, 1255 bp, Heterodera glycines
  Genomic contig location: Contig_ID=SeqID_13223; Location=1142..2396; Strand=-
  SCN-specific regions: Sequence locations=1-353,376-474,615-809,836 -1255
  Gene Ontology: Biological process=body morphogenesis (sensu Nematoda)
atggcttcttcagtaaatggaactgaatctccaacatcggtgagaagaaataattgggaatcggacggtgaagagggcgacaattggaatgttttggcacgaacggaagccgaagaccggcaatggcgtaggtcggtggtccatttgctgaacaattggtcgatgtggtgttggcttttaccttggctttcccttcagtcgtcgggaggagcgcgaacggctcggggcggtcggagtacggcacatttggggctattcgccaactcacaacgaattggagcgagtgtttgaggaacatcgaatcgcagaacgaatgctcaaggaggagctgaagcgggacgtgatttcggaaaagaatagaagtgagaagaaaaggaagcgaaaggaagcgagggaagagcaaaatgatcagtccacgaaagaggaaacatccgacgagacgacggaagagtcatcgaaggacagcgaatcgtcggaagacaaaaagcgaaaacggaagaggggcagaaaagagagggggaagaagaggaaggaggaaagcaagcggagaaagaagcacaaaaagtcaaagcgaaagagcagcacaacgaggtgagagagcgaaaagggagggatcggtgacatcaaaggggtaattaatggacagagaaaggggttatcagagggaggcgatatttagcataattgaaagataccacctaaaagtgttgaagggattcctctcctcttttagtgggtcttctgacgaaacttcaaagggtggaggaaagggcgacgaatgggtcgaattcacgaaagaaatgcaagtgaagaagagcaagaaagaggaggcagcgatgattggcccccaaattcccgaagatttgctgcagaaactcaacccgacgatggcacccgaaatgaaattggacgcgaggtgaaaatggagcgcaaattcaaccaaacattgctgttcagtgcccgtaacaatatgttgcgcggggaggccgcagcgatggccgcgtacgcggcgcagggaaagcgcattccgcgccgtggtgaaattggactgtcttccaatgaaatctcaacgttcgaatcggtcggttacgtaatgagcggaacgcggcacaaagccatggaagcgactcggctgaggaaggagaaccaaattctgactgcggaggagaagcgattgctcagcacgttcactgacgaacagcggacgaggcgcgaggacacggtgttgaagcagttcaaggacctaatcacgtga

SEQ ID NO: 47116 - DNA, 1285 bp, Heterodera glycines
  Genomic contig location: Contig_ID=SeqID_13253; Location=1..1285; Strand=-
  SCN-specific regions: Sequence locations=1-189,211-231,270-1285
  Gene Ontology: Mol. function=potassium:chloride symporter activity; Cellular component=integral to membrane; Biological process =embryogenesis and morphogenesis
atcaaacccgagctgatcagagacaagtgggagatatatttcactgaaatttcacctttcgtgagcgaatttctcaggacgatgtgggagaagagcgtggacaaagggcggggaaatggtcatttatggggatacgatttttaggtgctaaaaatgcgaaaataggtggtgaaaatgggaaaataggtaaaaactaaaatcatttcattccctcgccccctctctcgctgcttttctcccccgcgtccttttttaaaagcaattcatttttcgaatgaatgtttggataaaattgttcgggggtaggcccacttcccattcacgcttaactcgtccaaaggaccggcctctcattggacgggcgaatggtcgttgcgttgttggcatggcccactgaatgggttgtcctggtcgggtccttcctgtccactttcggtgctgctcttcaatgtctttgcagtatggaaatgttttttgctcgtcaccatttgtccatcccaaataggtgcgcctcgtcttttgcagagcattgccaaagatgacgtcattcccttcctccagccattcgccaaagtgaccaagaaaaatgaggcatgccgattgcccgggttgtcttccacttggacagttttagcccttcttcggcttgctgctcaccactctcatcgccgaacttggcattttgatgggcgcaatggacactatcgcggctgtgctcgactttttctttctgatgtgttacgccttcgttaacatcatttgtgctttgcattccattttgggtgctcctaattggcgtcctcgtttcgtttactatcactggtcccatattagccaaaattggcgacactttcttttcttttaggtcgttgtccgtcctcggggccgctctttgcttcttcattatgttcagcacacattggcactatgccattttgtctattgttttttgcattgtcatttacaaatatgtcgaatggaaagggtaattcgtttggttgatagttcaattttctaattccgattacccccaagtgccaaaaaagaatggggcgatggcattcgcggtttggcactgagtacggcacaatacagtctcatgcagattcccgagaaggacccgcatccgaagaattggaggttcgggatgcgtgccatcacacaatcggacattgccgtttcatttagaccgcaactgctcatccttcagtcgatgccctggtcaaaggaattggtcgacctgcgttacctgaaattgtgggactttgcgtcgcaactgaaggcg

SEQ ID NO: 47117 - DNA, 617 bp, Heterodera glycines
  Genomic contig location: Contig_ID=SeqID_13263; Location=19..635; Strand=-
  SCN-specific regions: Sequence locations=1-49,73-243,277-310,341-617
  Gene Ontology: Mol. function=heat shock protein activity; Cellular component=centrosome; Biological process=reproduction
atgtctttttcccatgccgcactgcttttcatcgtgttcgccatttttgctggaaaatccggggaaacctttgcgtttcaatcggatatcgcgcagttgatgccaaagttggacaacactacgggcaaggtttgtttgacagaattggtggctaattttttacataatttttgtgaaactttttttaaaggcgcatgacatcgaaaacgacccgagcaaagccgataaaacatggaccatcattgacactggcattggcatgaccaaagccgacctcgtcaacaatcttggcgccatcgccaaatccggaacgaaggcgttcatggaggctcttcaggttttgtttttcgtttgatccccccccccaaatctaaaaaacacttttgtttcttaagactggcattggcgctttaatgcccgggcattttggcgccgctttctactcggctttctctgtggccgaccgcgtcacatcaaagcacaatgacgacgattgctaccaatgggagagctcagctggtggctcgttcatcattcgcaattgtgccgatcctgaagtcacccgcgggacaaagatcgtcctccacctgcaggaagaccaaacggcatatttggag

SEQ ID NO: 47118 - DNA, 2955 bp, Heterodera glycines
  Genomic contig location: Contig_ID=SeqID_13264; Location=1..2955; Strand=-
  SCN-specific regions: Sequence locations=1-65,87-548,570-976,998 -1672,1694-2608,2630-2638,2776-2955
atgagggtctcttgttgaatggccattttgtgcgtttagcacttttgtcggaatgccctgcgggcgattcgcctgttttcctcctccaccacaacacttccgtcgcctccggcactgtccctctccgatcggcgcccgtccccggagggtttctcgaatgtaccgaactttgttccgtcgcaaatgtatgtttaatccactggcgtaagttcattgttttgtttgtccctctttaggattgcgttggcgtccgttacacccaattggccgccggcgggggaggacaatgccaattggtcggtccgaagtcggcatctgaaggtgccgtggcagaatttggtgaagaaatgacgacacggacggtgacgaagaattgtgtgaaggtgggtgaaagtgccaaaataccaagggaaattgccaaatggtattaatgggaagggccatgccattccatccctggggcgtttgttttggttttggcagagtcccctcggtcacatctcaatccgttttcattatgccactgattcctcccccaaattttctgcagagtgagcgcatctgttcctcgcctttccatttcgacgttcatgaacaaaagattttggtgggtttcgcgcgtgaggtggtctccgccgactcagtccaccgctgtctgtccgcttgtctgaatgcgttcgatacgttcggcttcgaatgcgagtcggtcatgtattaccctgtggacgcggaatgcattttgaacacggaggaccgattggatcggcctgaccttttcgtggacgagcacgaggacacggtcatctacttggacaacaattgcgccggatgtgagtgccattggcattttgacaatttcaaaacaagcggcattttgaacgaccaacaattcgcaattgcagcacaatgttacgcaccgtacgtaacgcaatacgtggcggtggaaggacgccaattgtcggacgaattggaccacagttttgaagggttggagctgagcgaatgtgaagagttgtgcacgcaacggttaagtgttacggtaacaaaaaaaccgaaaaatggacgaaaaaagagaaaaaggaacaaaaaacggacaattgggcgaaaagagagaaaaagcaacgaaaaacggacaaacgaatcaatgaaaatggacaaatgaggaagtgttggatgaccccttccctcaaaaggcaaacgacttcaactgcaaatcgttcatgtacagtaacttgacgcgcagttgcgttttgtcggacgaacgctcgcgccctttgggccgtgccaatttggccgaagtgccgggatggacttatttcgagaagaaatgctttgcctgtgagttcgctattcccagcctcaaatgcgctcctttcttagccccgcgtacgtgccgcggcgttccgtcgtttacgcgagtgccgcaaatgcttttggtgggctttgcctcttttgtgatggaaaatgtgccgtcagtgacaatgtgtttggaccaatgcacaaagtcagccaatgaatattcattaattaattgacgagtcgaagctgttcattgttcagccctcctcctgagacgggacaaaactttgtgtgtaaatcggtgatgtattattacaacgagtgagtccgtcccccgcccccccccctcctttcctcttccaatttgtccccctaggcaagaatgcattttgaacgcggagtcgcgccattctaagccggacctgttcattcctgaggaggacgactttgtggtcgactatttcgacataaactgtcgcttggagtcggaacagtgcagcgccggagagggggcgcgaagtccgaaaatcgtgcggacattaaatgcagcactgcccgaaggggacggtgccattcacgtagtggaaacggtgcaggcgaatgtgcgcgaatgtgcccaaaagtgagtgaatgaccggcactttctccggccaacgaatgatttgcctttcttagatgtgccgctcactctcccgacaaatgccgttccttcaacttcgacaaatcgtccggcatttgcaatttgctttatttggacggccgcggttcgctgcgccccgagccgaagggacaggtgggctggccaagtgctgactggtcgagattgatcatgctttgttctgctgaaggtcgatctttatgacctccactgtttggagacatcgcccgagggccaatcaatgggatgcgtcgaccccgagggggccgcgttcaggtgacaatttccaatttcggaaatgacaaactataccaattttacccacaaagtcgccatttgtattcccaatgggtcgggggcgaactgagcaaagaattgcattctgtgcctctctccaaatgtttgaatttgtgtgccggtgccggacaacggtttttgattaaaaacattaaaatttatgaaatacatttcagttgtgaaggacttaattacaatcggcgaaatggcacatgcgcagtgatcggacaattgggcacagtgtcgggggcgatgcagaagagtgaacaagtggacttttatcggaatgtttgtgcactgaaagaagtccaatcggaggaatcaagcgcagcgaatgtgccaaaaagcaaagtgagaaagaaaagaaagacaaactgagatagaagagagagaaagagagataatgagggagaggagagagagaaagaggagagagagagagagaaagagagataatgagggagaggagagagagaaagaggagagagagagagagaaagaaaggagggagaggtgagagaataaggggaagagggatatgggatgaggagaaatgaaagggatcaaatcaaaaattgggaaattaatgtaaaaaaaggaaaaaaaggcattggtgagcggcacttctgaaggaaaaggcgcaaaagaggacaaaaaagttggactgaacgaacgaacgaacggcgcacttaacaaaaagg

SEQ ID NO: 47119 - DNA, 1218 bp, Heterodera glycines
  Genomic contig location: Contig_ID=SeqID_13276; Location=102..1319; Strand=+
  SCN-specific regions: Sequence locations=1-1218
  Gene Ontology: Mol. function=ATP dependent DNA helicase activity; Cellular component=cytoplasm; Biological process=DNA replication
atgtcaaatctcgacaacccgcgcattttctaccaagaccgtgtgttcagcaatgatgcagcggacaatgtgttggatggagcacgtgaaatggtcgctgagtataagcgactcgatgaaatttaccaacgctttattcgcgagtttagcatcggtggattaaacttcaaatatcggtccatttagtttgtctttgcatttgaatgcctaaatattcgcttacagtgaagaattgaagctcaattacactctgggcaattattcgctgattgtcgactttaatgacctcgcaactttcgacgaagatgccgcgggcaaaatcaaacgctacccaaccacatttttaccagcggtttttacccatcagaaaattgaaaagataacggttcaattacagctcgagtctgccgtgaaaagagtcgtcgacgacattacacacccgcgtccgcctggagaggaggaaatccacgacatccaagtcattgtgaacctcagcgacaaagcactcggaattcgcaaaattaaggtactctctcatcatcctttattcgttttattacaatgccatgttcagtcctcagatgtctctcaactcgtcaaagtttcgggcattgttgtggctgcgtctcaagcgcgttcccgagccaccaaagtcacgttgcaatgccggacctgccgacatacaattgtggaccgcgaaattcgtgccggtctcgagggctttcaattgccacggcaatgtcaatcagcgtaaaaactgaccaaaaaaaattacttacacgtcttcgacttgcattcttagcaatcagcaggctgccgtgggtggccaacgatgtccgctcgatccgtacatggtgttgccagacaaatgccgctgcatcgatttccaaactctgaagcttcaggaattgcctgaggacgtgccgcacagcgaaatgccacggcacatgcaaatttatgtggataggtaaatttggaaattgtgcagttttacggctttgattataaaacgcattttgcagatatttaacggacaaagtttctcccggcaatcgcatcacagtcactggcatttactcaatcaaaagagttactggagggaaaaaggtcaattgtgtgtcattacgatttgtcgttattcaattcttaaatgtttagggcggtaaagaagacggaaaggcgggcatgtccggcattcgaactccgtacattcgagcg

SEQ ID NO: 47120 - DNA, 1235 bp, Heterodera glycines
  Genomic contig location: Contig_ID=SeqID_13287; Location=433..1667; Strand=-
  SCN-specific regions: Sequence locations=1-259,282-409,431-462,493 -792,835-856,881-1128,1172-1235
atggaggcacaaaattcgaatttgcctctggtcgggacaaatgttggtacatccgagcatctcgagccgagtattgctcgttttggtgattggcgaattgtgaatgcattcggtgatttgagtcccgaaccggaaactcgtttcgatttggccgttcattgtttcggttaagctgcgaattcacaaacacgcgagggttataaatatatcgcgccggatcttggcgattatgattatgatcgagtcccaaaacccccaagtaccgaagtttctttctgaagacacaatttgatgataatggaaaaatccaatttaattttttcacatcaccgatggtggaatttttctcgatatgaaataactaaaaaattccaaaaattaaaaaaaaaatgggggcaatggccgtggagggtgaataaaacacagccctaatttttagtctaaatttctaaattttttttggttcctccaattcaaagtttcatttcagcaacgcttcgtcgcctttttcgagaagaaggagcgcggcgtggacatgcacgcgagcatcaaacggcgcaaggactacatcaacccggcactgtacgaggcgttgcgcaacgcgtacggcatcgacgagaagggcacctgcttcgcccgcgccgtgtacgacccgaacgcattcgccgctgacgacttttacgacgcattgggtgagagagcgtaggacgtgtgtgataatattgcccttaacggattcgaaaaatcggacccggaagcacttctttaccgcttatcccccccccccccccgaaaaaattaattgaaaaaattttttctaagtttttttaatttgttttcttgctctttcaaccgcaaataaaatttaaattttataattgggctaatatcttcgaaaacagctgaaaaattttggattcgattctaggcccaaaaaacgcaaatgttttgaagtatcactattacaaattcatccctaaatgtaccttgggttttttgagggtgtgacatgaacaaaaatcaaattccatttttttttttgcgttttaatggattttaaaattattttttgtccaatttgaaggcgatcaccaggcggtgctagagcaacgccggaaaaagatggtccagcaacaacagcagcaggagcaacaccaacacagcagcagcaaaaggcccgcctcttttccgaccggcggaggaaaagcgaaatgatgccgaaaagaagcgaatga

SEQ ID NO: 47121 - DNA, 1917 bp, Heterodera glycines
  Genomic contig location: Contig_ID=SeqID_13288; Location=101..2017; Strand=-
  SCN-specific regions: Sequence locations=1-245,267-305,328-388,410 -447,474-495,524-592,614-626,650-663,685-897,919-924,957-998,1020 -1063,1086-1432,1454-1917
atgaactctttgttggcctacggctcggacagtgacgaggaggggcagcaccagcaaagccgacatggccaacctgaacctgatcaacaaccgcgggaggagcagaaacagcgaggaaatgggggtgggtatttgggccagggtggcacgggtcgagtcagccgggcacgcttccgggtgccgcaagtcctaaaaagattggcaaaattttagaattggcatttttaaagagggaaaatcccgatagaaatgaaaaatttaaaaatggccgccatcgggagaggggggaggggtctattggcagttaaaattttaaaaaatccaaaacttcatttactttccaggccttgctggccaattgtcttcatcgtcttcgtcgtcagcgcttgcggcggcggcggtgccgttggaggagccgtgtcccccgcggcgtcagtcggacatgttcgacgaggacgacgacgaggcggacgtgttcggcagtgaacgacggcggaacgatgaggacgacgaggaggaggagttggacctgttgctggagaaaggggccaaattttcggtaaattttcagcaatttttgttgggaatgatgaaaaattttcatttgaaatttcccaacatgtcctcctcaatttttgggcaaattttgtaccatttaatgggaaattttttacttacctttgacaacgactgcaattagcataatgatgatgctttcgttgacattttggctcaaatagcgacttttatgccacataaacaattgtgcgcgctaccattggcgccttttttctcttttttaaaatttggaggggtgtggccgcataaccgaaaagtacccaaaaaaatttcaaatttttttttgtgttcttgaaattttgcaaattttattttcagtaacaccatttaggtttttggattatgaaattattaaagaaatttttttatttttttttgtggcgaaattttgttctgcatccctaagacaccgatcctaataaaacaataaaatacatttttctcaatttaaattgtttttcaaggactccgccatgctcgacgtcggcggcagcagtggcggcggcggttcaacgccgggccccggctacacgccccggtcggtgtgctcggcggacgagccgatggatgaagacatggcggccgagtcgtcggccgatgccattcagcaccgcgacttgccgccctcaccccgcggcgagtgcgaccccgaattggcggttcgttggacaaaaaacatgggaattttgggtttttgtgggctattaagtgtgcgagggcttagaaatgacgatgcgtttttttaaaaatcgaatccgactgaaaaaaaaatttttttttttgcttcggcccaaaatgcgacgtgtttttcataatttttcatataggatatacaaaatttttcttagttgcatctgctgcttttgacccaaaatgaataatttgcgggtttttgagtcgattttgatgataatggaaaaatccaatttatttttttcacatcaccgatggtggaatttttctcgatatgaaataactaaaaaattccaaaaattaaaaaaaaaatgggggcaatggccgtggggggcgaataaaacacagccctaatttttagtctaaatttcgaaatttttttgggttcctccaattcaaatcattgcactggtaaaataataattcaaaaagtttcatttcagcaacgcttcgtcgcctttttcgagaagaaggagcgcggtgtggacatgcacgcgagcatcaaacggcgcaaggactacatcaacccggcactgtacgaggcgttgcgcaacgcgtacggcatcgacgagaagggcacctgcttcgcccgcgccgtgtacgacccgaacgcgttcgctgccgacgacttttacgacgcattgg

SEQ ID NO: 47122 - DNA, 4055 bp, Heterodera glycines
  Genomic contig location: Contig_ID=SeqID_13311; Location=301..4355; Strand=-
  SCN-specific regions: Sequence locations=1-156,178-324,346-572,594 -1097,1120-1628,1651-1761,1796-2538,2560-2983,3005-3147,3169 -3471,3509-3830,3852-4055
  Gene Ontology: Mol. function=ligand-dependent nuclear receptor activity; Cellular component=nucleus; Biological process=signal transduction
atggaccatcatcgcttcgcccctcctatcaaccattcccattcctcgtccaaaaccgcgctttctcctcccatttcatcggcgatcacatcttccgatacagcttctgtagcggcaccgtccttttcatcgctttcaattcgaatccatggcgatcagcaggcgcaacaacaacaactcagacattcttctcatctgttacttttggatgacggccttagggcaatttcaaatattaaaaaggcgaaagtgccaggcaaaaccgcgctgtccatcgcttcgacatttcacgagctgtcagagcttaagcagaacatcgctttgccttctcccaaacctcagccgcactctccgtcagcatcaactgtttcggcattcgctgtctcagaaggaggaagcgatgtttccggtgcgcttttccctccgtcgtcgtccgctactgtccgtgtcgttgagtcggctgctgctgtcatttacccaatttcctcgtcggcacattcgtttcagtcatcgacggaattgaataataaattgcgacaacttgacaatgccgcgcaaattgccgagtcggccaaacataggccaaagtgttccccgacggtattgcccgggggagtgttgtccacaacttacagaaaaaagtccaacgaacgcattgtgcacccgggaggacccggcgaggaacgtgcgtatttcatgggaaagcacagaattaccccataaatgattagcaatgggtgtgcttatttatcagtaaaattgccctttgggattctcccgttttttattattaaaatccgattttttttgtgcattttttagtttcaattctgttggttttttccacttaaattcatcttcctaacaataagtgcatatgtaaatagttttaaatatttagcgcaaattgaagtgatcccatgcaaagtttgcggcgacaaatcctccggcgtccattacggcgtcatcacttgcgaaggatgcaaagtgcggaactttatttaaattggcataatattcccttactttgaatgacctcatcaatattaattgtctcttcattactgatttgtcaacttttcagggctttttccgtcgttctcaaaatgccccggtgaattaccaatgcgcgcggcaaaagtgctgcacggtggacagagtcagtcgcaaccgatgtcagttctgtcggcttaaaaaatgtttggagttgggaatgagccgggaggcggtcaaattcggccgaatgtccaaaaaacagcgggaaaaggtcgaagatgaggtgagtgagtgataagcgaacgatagctttaaagatttgtcgcattcgtggcaatgatttccattcatttgcttttacattggtaaattttcatcccaaatggtttaggtccgtctccataaacagcgaaacggcgaattctgtgctctgtccacgttgccggccggttcttccgtcattgccccgcccggtgcttttcctccccaacagtcccacccaaatttgtccgctcctccgtctgtcggaccgagtacacccgttggttcatcttccgccagttcggctggttgcagggatttcaaagtgagtgatcattttcaaattcatattgcaacattcctttgctttgcttattttcatgttttattttagcaggaatttaaatattcgccgccctcaaacaatgcgcagaatgtttcctccgcttctttgcctctgccgttgtattacggccatcccccgggcacccatccccaccacgcccaccaccaactgcaacaacatcaacaacaacagttggtccatcagtccaacgcgtaccacgaggaggaaatgccctctttccacacaatggacggtcagtgcgaaaatggcgtccttttggccttatttttgccactgtccaggccaatccagctcctccgccatgccactgctctaccaacagcagccccatcatgcgttggcgcccatttcgtattcgccaaatgcggcagtgttttcccagtccggtgccatccatcactccgctgccgtaccatcgagcaggtcagcgcgtcggcatttttttaatcttttgctatcatttgcatatttttcgtctgattaagtggggggtatccggtgactgctgattcgtcgattgcttccgctccgttgaacaaccaaagtttggtctcctcaactgtggacgacgatctgatcaaacgcgtggacttcgcctacgagcaggcgtattccgcctatttgaaccaccatttgccgattgatgacgaccctttcggcacaatggtcgacccgcaacagttggaccggctgatgaacatggtcagttggtccgtttggccgtttttctattttcatttttgtttgtcttttgccaattcgtattttttgtcatttttgaatttgcatgcgattcgatttgtttgatttgtgttgttttgcttgtggtggtggggggtgattttggcggcggttttcgctgtttgagggcggcgttggtgataaccatcattcaaaggtgcgctttggatgggcccagagtgagtgagttccagtgcgtgacagagcccttttggcagtgggagatcagacagcgcgaagggataaatgcgttttgggaaggggaattgtcgcgccaccctccgactgttggtgtccttgggcggcaattttggagagatttcgatgagttgagctggagaggcgaagcgggggatgtagggggggggggtgagttcgatcttgtggggatgcgtttatgtgatgaatggaggcgggcgaagggtgcggttggaaaggcgccttctcttaggggggggggggggggtcttatcgtttacagagggaaaggcaactgcaagcaaagattctttttcaaaacatattgtagtccaaatgactaaattctgcaggagcaactctttccccccccccttgccattttccccgaaaaattaaaaaaaaattcaagaaaagcgctttttcaaaatttatgataaattactaaattttttcaagttccaaaagatcgctgcattgtttttctattttttttatttttcagaaccgtgccgatgggtggctgaagttcgccaatgagttgaccaatgttaccaaatgtatcatcgaattcgccaaaatggtcaaagagtttctggagttggagcaggaccacaaaatacacgcattgaaaaagacaacgttcgacttggcaatcattgcaatggcacaagtggggaaagggggaaattgcgtaaaaaattaaatgaaacgggacggaaattcagcactatcatcagcaaagtcaaacattgcatgtgaacaatttggtgctgcccgtgtaccaatttcgctgttcggacagaaaggacgaggaatttggcaaagaggtgggaaaagcgactcgcaaatgttcaaatgttgttgtccatgggtcaatggcagttttcgaacaatgggcaacacacacaatttttaaatttcaattaaaaccattctaaaaaacaacaatgtattttttttcgaaaaagctaaaatttatatgatttttcaaccttctggagaaaaaatccatccctaattttttggaaaaattctagattttaattgaaattattaaaaaaacaaactatacgaattggcatttttacaaacacaccgttgtccaatatgccatttgtttctttggcgtttgtccttccctttttgtcatcccatttatttttttcctccttttcagcttatcagtcggcttcagtacctcagctcattccaattgacttccactgaaaccgcccttttgtccgcctttgtgctgatggaccaatcccaggcgcccggcatggaagcgtttgtgggacagttgaagagctgtttggggggtcagttgcaccagcggatgccggacggggacgaggcattgcgccaactgctcgagttccttccgcgcctgcgggaattggcaaaaacgcatcgcaaatgtttgggacgcttccgattacaaatggtggaccagcaaagcgaacaccaaacggacagaggcgccgcggag

SEQ ID NO: 47123 - DNA, 539 bp, Heterodera glycines
  misc_feature (8)..(8): n is a, c, g, or t
  Genomic contig location: Contig_ID=SeqID_13367; Location=2742..3280; Strand=-
  SCN-specific regions: Sequence locations=1-539
  Gene Ontology: Biological process=growth
cgaagaanattatttgcggaccttcgctccgattatcccgcattgattgggcagaatttcgatgtgaaatttgtgcgcgacttgacgacaggtgggccatttgaggagaacgaattgccaaaacaaaaccacggaagggtatttttgcaggttatgacaacgctcaaccggatgacagggccattctgccgctgagcacctcctccgaaatggtgacgttcactttggtcgacggaagtgcggtgacactgcgggcgagcggaacggagccgaaagtgaaatattacatcgaactgcgcaccgaaccgggcaaagaagaaaagtgaggcggacggagagaaagccgaaacagtgccaatttagaagagagcggaaaaaacaataaacggaagaagaaagggcaattagctaattaaccaacgcacttgttatgccaattaagggatctgagttcggtgcttgagcagctcgaccaattggaatccgacgtggtggacactctcctccagccgaccaaatacggactgatcagtcgaatt

SEQ ID NO: 47124 - DNA, 3343 bp, Heterodera glycines
  Genomic contig location: Contig_ID=SeqID_13396; Location=514..3856; Strand=+
  SCN-specific regions: Sequence locations=1-48,72-109,131-226,248 -745,767-1477,1499-1605,1627-1822,1844-1878,1900-2111,2133-2247,2269 -3343
  Gene Ontology: Mol. function=protein kinase activity; Cellular component=spindle pole body; Biological process=embryonic cleavage
atgggcatgaaggaaggcgagcacaagaagaaaattgtcaagtccatgggcatcctgggctctcaaagtattcaatggcaaaggaaagattcaaaacggacttgcgaatggttggacttttggaaattggtggtgagttgggtagtcgggttttcgaacaaattttaattatctcataacgccggggtttttttggagggcaaatacagcaaagacctgaagatggaaggagtgatggaaaatctccaccggggtcggccacttcaacgcacagcccgccttttatctgatgtgggccgaacatggggccgcactgtacaaccgagccaactttgacaagatcttggccatgtgtgaaagcaattgcaatgtcaatgcttttgaatgcgtggaattgttcaggttgcaatttcgaacatttacatttattacttgctcctaattttgtttagaccgctgagcagcaagtactttggcgaatcttccgacgagactgacacagtggcactgatcaaagtgatcgcggatcgtccggaggatgtgcgcaggactctgacaatgttcccggctaaactacaggagcagcaacaacaccaccatttgcatgtcagtcctcgggacgaattgccccaagagcagcagcagccaaaccctttgcccacctgccgcgaagagtttcctcaggagcagcagcagcctttgcccgtctgtcgggaggagttttccatcttccgcgacccggccaaatccatggtccatctcctcataatgctgccctttcatcggctccccaatgttcagatttgttgcgaccttgacgacgtcactctcgctggtgcgcatggaaaatttgctcccacagttttcacttcgacgcctcgtcgttcagtggctttttgcgccttcgaaccgccaatgatggaaatggacaacgatgggctgatggggcctgcaccgtccgaagacagagaggaacgggttggcggattgtttgcaccggtacccgagacgggcgtgtccaaattgcagcgtcggcttagtctggttgggtggatgttccaattgtttaatgcgtttttccctttcgtccaggtgggcgattttccgacacacgcagaaaagggctcacaatcggcgaagaaaaataccggagtcagttcaatggggttactgtaaatccgatggtcgttggctgtttttctgatttgaatagagcataaataaatatatagcgtatcactttttctgcctatttatcccttaattatggggtgggcggtggtccgtcagcataggcttatttccgtattaattatttcctatgccatttcaggggaagaaaatgactacgaatgacattgtgaaggcgttgccgaatttgaagatcggctcgaccattatggaggagacggaagaagacgaaaaggaaaattctttcgcttcgccccaccggaaaaaggcgcgccagggaacgaatgcttcgcatccgccttcacttgttcactcatcaaaacagacatcgcaactgaatgacgtttctcacaaccagccaaaggccgtttcggcagaaacgccgacagaagagggacagcccgaccccgacaccacccatttgggcattgtgtgagacataccttttcatactattgtttgatttttggaattggaaaagataaatttgaaccaattgtgtaaattaccatttagcgaacaaatcaaaactgggactgagaacccatgggacgaagaaaagcgcaatcagattctccaaaccgcacatgtgatggtcgaaagtcacgcatttatggtaactcaaatggtccccatttaaagctttatttttcttcgattttattagacggaaaagtgtcctcgtttcgagttgaaccgaacaatccatttgggaggtgaatcattctcgattgaagacctgttgggccaaggcggatttgcgcgtgtttacagggccaattcacgtgaagatggttgcacttatgccatcaaggtgaattggatttttagtgtatataggatggacataaggacaaatataattttaaatccgtacggaaataccggtcttaaaaaaaattcaaattcgttttaatttctcatgcaaattactcctccatttcagtacgaatccccggcttgcccatgggaagtgtacatttgtagcgcactcaaaagacgcattccatcccaattcgctgcttatctaatggaagtgagagacgcgtacattttcaaaaatgccagtgccattgtttacgaatatttcccaaaagggacacttttggtagggtgaaaggcattcggatgacctgatgagaattttcaggatcttaccaatgtctacaaaaagaacggaacggtggtgggcggtcttcttgctacttttttcggcattcatttggcacgtgcgctgcgccaagtccacgagacggccaacataattcacgcggatgtcaagccggacaacgtcatgctgttgacggcgtatgtttcggattgaaaattgtgattcatttctctcttggccccattaaatgtcccattttggcacatttattcgattttagtcaaatacagtgcacctatttttacagtgccttgaatgcacatgattcgctggacaatttgctcaaaacccccgtgctgaagctaatcgactgggggcgatccatcgacatgaaccatttccaaggagtcgaatttcacggaaaagcgggcaccgaaaatttcgattgtgtcgaaatgaaggtggttaacatcatgaatttaaaaaaccgccttacttatagacgggcatgccatggactttccagactgatttctacggtttctgtgccacaatgtacgtgatgatgaatggcgaatatctggtgaccttcaaatactcacaaacggacaaagttgttcccgtgaagcagctgaagaggtgaggttgccattttacaacttgattttcggtgcttttctttaatcaattgttccttccgattctttttccccctaatttttccactttgaggcgcatggctctgtacgacgtgtggacgcagttgttcgatcagttcctgaacattcccaactgcaaacagctgccaaaatggttaaatacattggaccaaatggaaagccgactggccgaggctgtgaaaacggagcctttggagtggaaaagagcgatcgaacggttcaacgaattcgtcaaacaacgggggtgaaagaaaagggacaagacattggatcggacttttgtgcaaatgatataacctatcccaaaatgcttttctgcttcatttataaaaataactgtccaccccacatcaataaatga

SEQ ID NO: 47125 - DNA, 1563 bp, Heterodera glycines
  Genomic contig location: Contig_ID=SeqID_13407; Location=23..1585; Strand=-
  SCN-specific regions: Sequence locations=1-47,71-288,310-1115,1140 -1442,1464-1563
  Gene Ontology: Cellular component=nucleus; Biological process=DNA repair
atgtgcattgaattggagaattttatgtgccataacaaactcagggtaagaagaattagcaaaagaaaagataaaacaaaatcagcacgcttttcccccattcagctgaattttgacgtggacagcaacaactgtttctacattattggcccaaatggaagtggcaaaagtgcgttgtttgccggacttaacattggccttggcggcaccgggcgctccaatgaacggggtaaaacgttgcacagttacatcaaagacgggaagaggtcggttattatttgaattccaacaattttgtggttttaaattattattttgtttcaccggcatttagtttatttaatttgagctgtttttagcgatgctcatatacgtatttatctgtctaatgaggggccttttgcctgtgccaactttgacgaagtggtcgtggtcgaacgccacatcaccgagaaggcgactaattttacgctgaagacgagtgccaaattcggcggtcgggaacgcgttgtcagcaggaaaagggccgagttggacgcattgctcgaacagttcggcattgagttggacaatccgttggcctggctttcccaggacagatccagacaatttctgcaacaaatgaaaccggaaaagttgtaccaggtacttttcaaatatcttaccataaaaatgctcagcattttgtcaaaagtcggtccttcggattagtcaaatcccggactctaaaagcaatgcaatattcgaatttctcctaaaattgtaatcaagtttatacaaaaacaccattctttttcctttgatcattttagctgtacaggaaaaccgccgagatggacagcaccgatttgatgttccaaagcattgaagcgcattttgacgaattttgcagagtttttgattcgctcgctgcagaaaaaaaagcgcgtgaggagtgagtgacggactgatcaaattaacaattcatgatcactttaaaaattgaaatttgccagaaattatattcaaatgaaaaaccggcacaaagcgtcgcgagagatcaaagacaaaaaagtggagcgacaacgccttttgtggtacaacttttgggccccaattcgggacaatatcaccgtgagcagagacttacaaaattaaaaacccattaaacgcccttttcaaattttcagagagtgaatgggaatcgtgccgaagttggaacactttcaacggaaaaggtcgaccttttggaacagattcagcaacacatggtaaaacatttacaagtttttttcaaccttaataaaagtcaccaaaaactgcaaaaaaaaaattcgttgaaattaaggcccaaaaggacaaactgatccaaaagcaacagagccttttgccacaaaaggaggaggaagtgaagaagtgcaaacaacaacatgagaaaatcatggaaatgaagaggaaagtgcgtgaattggagtttgaaatcaccgatttgaaacgcgaccttcataagagaacacaccaaaagatggcatttgacaaggacattggggaggcgaacgcgaaattggcagccattattggcga

SEQ ID NO: 47126 - DNA, 666 bp, Heterodera glycines
  Genomic contig location: Contig_ID=SeqID_13411; Location=370..1035; Strand=+
  SCN-specific regions: Sequence locations=1-39,63-156,182-182,205 -270,292-444,466-666
  Gene Ontology: Mol. function=heterotrimeric G-protein GTPase activity; Cellular component=heterotrimeric G-protein complex; Biological process=phospholipase C activation
atgaaaactcgtctcatttgccagcggtccgaacgtcgaaaatggatacactgttttgaaaatgtgacgtccattatgttcctggtcgccttgtccgagtatgaccaagtgttggtggagtgtgataatgaggttggtggttcttcgtgcctagcattatacatttttattttataaaaagcgtattttcagaaccggatggaagagtccaaagcgttattccgcaccatcatcacctacccatggttccaaaactcttcggtgattcttttcctcaacaaaaaggacctgttggcggaaaagattctctactcgcatttggccgattacttccccgaatatgacggttcgttgtgccgtgtgccttgttttcacattgcattttcccacttcttcttaggcccgcctcgagacgagatcaccgcgcgagagttcatcctcaaaatgttcgtggacttgaacccggacgcggaaaagataatttattcgcatttcacttgtgccacaggtgggcttttacatcagtaattctccaccggcttcccctgatcgactcgtgaatgaattgtgcccttttgttcagacacggagaacattcgcttcgtattcgcagcagtcaaggacacaattctgcagcacaatctgagagagtataatctcgtgtga

SEQ ID NO: 47127 - DNA, 1692 bp, Heterodera glycines
  Genomic contig location: Contig_ID=SeqID_13447; Location=281..1972; Strand=-
  SCN-specific regions: Sequence locations=1-691,717-902,924-1032,1061 -1110,1137-1370,1393-1492,1514-1692
  Gene Ontology: Mol. function=CDP-diacylglycerol-glycerol-3-phosphate 3-phosphatidyltransferase activity; Cellular component =mitochondrion; Biological process=gametogenesis
caacgcgttgagtccgcaaagcgtcgcgttgtgctgtccgccctctatttgggcaccgacgcgttggagcagcgattggtccatcggttggcggtcgcggcaaaaactgtggcgaccaaacgccccgtcaaagttcgcattttgctcgactttttccgtgccacacgcggcgcaaccgccgacggcaaatcgtccacgacaatgctggcaccgctgtgcatctacgacaatgtggaggtgtgtaaattttcatttgctaccctcccccccccccttttcctttttttgaaaaatttgctgaattttttttgaacgctccgcataaaagtagagtgaaaagcaaaaaatataaacgaccaccaaggaccagggggttcactacatttcaccctgttacccgacatttgcgcctatgacccaaaaacgggttcaaacttaagtttttttcaatccctaatggaataaactgctttaaatactatcagcagaaggggttgaaaaaatgtgagttttttttggttttaatcaaaaattcctcaatgcttttagcattcattagtttttatgccttaactccgcgaattttcaagttttgctctaacaaaattgcttcttttttgtattgacattcagtgcattctttggggatgatagttgcgtttttgggctacgaaattgcatcaaaaaaagttgaaaaatttcataaaatttcaaaacgctcacatttttatcgttggaaattattttttcgacatttctcaggtccgtctctttcatacgcccaaattgcgcggcctcctcaaaagtgcgttgcccgaacggaccaacgaaattgtggggttacagcacatgaaattcttcgtcttcgacaactctgtgctcatcaccgggttcgtttttgccctatttttgggttgtgttatattttttacaccccctaaaaagaaaagttaaaaatcaaagattttattccaaatttctgacggcaaattcggaaatggcacctccgagtttcctaaagtttagttttggtttaaaaaattaatttcataaattttttgttttcaagtttttctgtggtttacgaggttttttcgagtccaacgggaaaacacaagggaaaatttaaaatttttgaggccccataactttttagttttactttacacctcgctataaaaaattcaaagtcgaaatcgacctgcgctatccagtaatacatatgtattctccaacttataattcgggtggtttttttgttggtcttaaattcgaaaaaaaattagaaaagaattttccgaaaaatgggtgaccaaaaaatagtcccgacccattaggctttcgaatgacaccacgtatggcaagaaaagtctgaaaatttcaaagacaatatttatgaaacgacctaacgctttggttttttgaaaatttgccaaaattcctctctcttttttttgattttccatcgaatttttccaaaatctccccattgttttttcagtgccaatttgtccgaccaatactttgtcaaccgtcgtgatcgctatttgctgatcgaagactgtccattgttggccgacttcttcgtcgacctgttccacctcgtcggagacaattccttccgtcttttggcggacggacgcgtcgaattcaccgccggcggaacgctttcgccgatacacccggagacag

SEQ ID NO: 47128 - DNA, 1007 bp, Heterodera glycines
  Genomic contig location: Contig_ID=SeqID_13459; Location=8..1014; Strand=-
  SCN-specific regions: Sequence locations=1-108,138-174,197-210,234 -273,306-604,630-824,859-870,893-1007
  Gene Ontology: Mol. function=structural constituent of cuticle; Cellular component=extracellular; Biological process=cuticle biosynthesis (sensu Nematoda)
atggtcgattttgacaaaaatgctgcccagcgcgaggcggagtcgctgcgcacattggcattcttcggcgtttgcctgtcaaccgtggccacggtgatcgctgtgctgtccgtgccgttcgcctaccagcacttccagcagattggcgcccaaatgcaaaacgatgtggacttctgcaaaatgcgctccggcaacatgtggcgcgaggtaaaatcaacgaaggcgaagggcggaaagacccggaaaatttcaaacaaaaaattctaaaaacttaggtcacccgcacccaggcctactccaaggtgacgcacgacagccgtcacaagcgtcaagtgggcggctgctgtggttgcggagtgtcgccgccgggcctgcccggtccccctggcccacagggacagcccggcggggatggccaacccggaggctcaggacaacccggtgcaccaggtccacaaagggtttacttggaatttcatgaaaccgtaaattcttctctaggccaggcagcgcctcgcccgtacccgcccagtggcggatgcgtgccgcaatgtgatgctgcccagcccggactccccggtccgcctggaccccctggtcccgagggacagcctggccaacctggacagtcggcaccgcccgcatcgcctggccgccccggacaacctgtcagcatttcctgaataatttatgcatgcttttgtaaatcccccgctgtttttagggacctcctggacccgacggacagcccggaaatcccggcgagtccgggcaactcggtcagcccggcaaactcagccagggtccgcccgtcgtcggaccgcctggcccacaaggaccccctggccagcctggacagcccggcgagaatggacagcccggccagcctggcggcccgggccctcaaggataccctggcgacggcggaaaccccggcgcacccggcaacccgggaggcgttggcgagcccggacagctcggagcacagggagccagtggccaatgct

SEQ ID NO: 47129 - DNA, 787 bp, Heterodera glycines
  Genomic contig location: Contig_ID=SeqID_13464; Location=388..1174; Strand=+
  SCN-specific regions: Sequence locations=1-3,50-248,276-370,393 -396,418-445,468-599,621-744,767-787
  Gene Ontology: Biological process=regulation of protein activity, epigenetic
cgttgctgctgctgctgctgctgctgttgttgatgttgctgctgttgcttgttggccccggtgttcggatgttccgtctccaaatgccgttccaacttttggtaggaggtgcaacggtatgagcacacatcacagcttcaaaaaaaaccacaggaatgattagagtgtcgttttatttttatttttatcaacgaatgatgcatttaatttgcttgcccattcgtcgagcgccacccctcggtttttccaaaaaaaataaataatattttttttttggaaattccgtttctaacattcaaaaaaaaaaaattttttgttatttatgtgaattaattttcaaccattttgtttgaacaacacacgccaaccaacctgtacattatttctgctgagcaaagcttaaaaaaggaagaaaatgtatttggaaagccaatttactaaaagcaattaaataaattaaattatttgcaattataaacatgtaattagcatactttaatctggtgatcggagaccaaatgttgcaaaatgttgaaggcgtactgcttgctgcacagcttacaccgtcccgagtccgccttgcgctgcgcttttgccaacaaatcggcagtgacgagcccatggaccatgaccaaatgccgttccaaacctaataatgtgtagatgatgtacaattgtaatcaagggagtaggacatgatggacaattatagatttaaatcgcggagcaagtcgtttaccgccctattttttttaaatttttaaaacagaaaattgaaagaaaagga

SEQ ID NO: 47130 - DNA, 1221 bp, Heterodera glycines
  Genomic contig location: Contig_ID=SeqID_13464; Location=379..1599; Strand=-
  SCN-specific regions: Sequence locations=1-82,106-349,377-446,469 -592,614-745,768-795,817-820,843-937,965-1163,1210-1221
  Gene Ontology: Biological process=regulation of protein activity, epigenetic
tgccattaaaaaattgtaattcattttagctaaaggcaacatccgccgccgccgccgctgcgcactcggccgccaccgccgttggtggtggtgctgctgctccgaccagccacccgcaccaacaccaacaccattatgtgtgcgaaatttgcgacttggcacagttgaccgaccgcgagcagtaccgggtgcatttgcagtccgcacatcgtcaactgttggggaagaacaacgcggaaatggccagcggtgcaccgttggcgtgctcacgctgcagagaccgtttctggacatacgaaggtgctgctgctgaaggatgaacttctttttctccctgtcgcttctccccaaaaattaaaaaataataaaaaatttagcgctttagaaaaattttttttggaaaaatgctggaaattttaaaaaaatccttttctttcaattttctgttttaaaaatttaaaaaaaatagggcggtaaacgacttgctccgcgatttaaatctataattgtccatcatgtcctactcccttgattacaattgtacatcatctacacattattaggtttggaacggcatttggtcatggtccatgggctcgtcactgccgatttgttggcaaaagcgcagcgcaaggcggactcgggacggtgtaagctgtgcagcaagcagtacgccttcaacattttgcaacatttggtctccgatcaccagattaaagtatgctaattacatgtttataattgcaaataatttaatttatttaattgcttttagtaaattggctttccaaatacattttcttccttttttaagctttgctcagcagaaataatgtacaggttggttggcgtgtgttgttcaaacaaaatggttgaaaattaattcacataaataacaaaaaattttttttttttgaatgttagaaacggaatttccaaaaaaaaaatattatttattttttttggaaaaaccgaggggtggcgctcgacgaatgggcaagcaaattaaatgcatcattcgttgataaaaataaaaataaaacgacactctaatcattcctgtggttttttttgaagctgtgatgtgtgctcataccgttgcacctcctaccaaaagttggaacggcatttggagacggaacatccgaacaccggggccaacaagcaacagcagcaacatcaacaacagcagcagcagcagcagcagcaacgctaggaaaa

SEQ ID NO: 47131 - DNA, 721 bp, Heterodera glycines
  Genomic contig location: Contig_ID=SeqID_13477; Location=516..1236; Strand=-
  SCN-specific regions: Sequence locations=1-289,311-342,364-435,457 -522,544-691,716-721
  Gene Ontology: Mol. function=structural constituent of ribosome; Cellular component=cytosolic large ribosomal subunit (sensu Eukarya); Biological process=protein biosynthesis
atgttgcgcattgctgacccgtacattgcgtggggctacccgagtcagaagatcattcgccagttggtgtacaagcgtggttatgccaaggagagtgggcagcgcattccgatcacggacaatgccattgttgagcgaaacatgggcaaatcggacgtgatctgtgtggaggacatgattcaccaggtgaacaaacaactatgggtttttttcactgtttttttttgtttgaaaaagttttttataaaaaatttcatggggagcggggcggggaatgaatcgcaccaatataccaaatttgaaatttctttaatagcccgggcggttgtgtatcaattgtgaaacactgtttgatgcatgtctcgtgtcttttagttcaaatgttttgtctcggttcagatttggacagtcgggccccacttcaagcaagtgaccaactttttgtggcccttcaaactcagcaaccccgtgggcgggttcaagaagaagtccaaccattttgtggagggaggcgactacggaaaccgcgaggaccaaatcaacaaattgcttgaaaaaatgatctaatttcggaaacaattgcgatgagttgatgtgcagcggacggcacgcttttgttgttgttattttacagataaactttttttgtttgttgtgtttgaatattttacttcgagtcgaaggagaaatataaaaagaaaaatgcatttatttcaataaa

SEQ ID NO: 47132 - DNA, 768 bp, Heterodera glycines
  Genomic contig location: Contig_ID=SeqID_2020; Location=1..768; Strand=-
  SCN-specific regions: Sequence locations=1-165,188-768
gatctcattctcgaataaaaaagtttgctctggcgtcccccagggctctgtcctgggccctttattatttttgatctatattaacgatcttcctgatgctttgccatcaggagtgagaattaaattatatgctgatgatgttaaattgtatatttgttataaagcgagagctgacacagaaattatgcataaagcattgcataatttatcagaatgggcaaataaatggcaaatcagaatctcaattaaaaaaacttttgtacttcatttagggaacaaaaaccccaaagaaatatataaaattgatggaaatataataaatgttgtggatacaattagggatttaggcataaatattgataataaattgcaattttccaatcatgtcgcacaaataataaagaatgcatatttacgtatgcgttctttatttcgggttattaaatcaaaatcttctaggatttggattattttgtacaaaacttatgttagaccgttattggaatatgctcctgaggtttggaatccatctcttctaaaaaatattaaaaaaattgaaaaatgtcaaaaatatttcaccaaaagagttcttttcaaatgcagccttccacccattccataccaacaaagattagaataccttcaactgccgacacttgaaagcaggcgaaagctgtctgatctgttcatggctcataaaataatttatggccgaacagatctgaatcccaatgaaatattcaaaccttctgaacgctttaacattcc

SEQ ID NO: 47133 - DNA, 1103 bp, Heterodera glycines
  Genomic contig location: Contig_ID=SeqID_13491; Location=1356..2458; Strand=-
  SCN-specific regions: Sequence locations=1-297,327-1103
  Gene Ontology: Mol. function=protein phosphatase type 1 intrinsic catalyst activity; Cellular component=bud neck; Biological process =cell cycle
atggcagaagctccgagaccattccccgacaatttgatccaaaaaattgtacggtcgaaacaaatggagtttccgaaagaggtgaaaaagcgagttttgcattgtcaatttcatccctttttgcaggtttccagcggagaaattcaacaactgtgcgctgccgcaactgacgccttcaaacgccaaccatcgctggtcgaaatccttccgcctgttatggtctgcggcgacgtccacggccaatttcctgacttgatgagaatcttcaactgcctcgggaccccgccggagaagaaatacctgttcctgggcgactacgtggaccgtggtgcgcaatccgtggagaccatcatgctgctgctttgctacaaggtgtggtttggctttttcagccaatactaaagaaacgtttccatttttaggtcaaatatccgacatcgattgtgctgctgagagggaaccacgagacgagcaacatcaacgcaacgtgggttttttttctcacacttattcatatttaaattttcccccctctttttttaggtacggcttcaaaaaggaactggaggaacgctatccggcccattcgcaagccctgttcgacagcttcaatgacaccttcgcgtggatgccgctgaccgggctaatcggccaaaaaatattatgtgagatgctcttttttttgttcattctccacctttcaattttcaggcatgcatggaggcatcagcgagaaaattcgaagcattgaacagctcaaacaattggaacgcccgatgctgctaccgccgaccgatagtctgcacattgaccttatgtgggccgacccgatggaagcgcaaggacaactaccgaatccacgaggcgcaggtgtcctgttcggcgaagatgtggttatcagaacttgccagctgctgaagatttcgtgcatcatccgagcgcaccaagtgagtttaagcggccttcgttttaatcagaaattaatgtttccccatttgcagttcatccaatccggatttgagccaatgttcaaccaacgactcatcaccgttttctctgcacccgcctacacaggccaaacaaacacgggcgcggtactggaa

SEQ ID NO: 47134 - DNA, 965 bp, Heterodera glycines
  Genomic contig location: Contig_ID=SeqID_13495; Location=1..965; Strand=-
  SCN-specific regions: Sequence locations=1-285,318-402,424-435,457 -605,637-762,784-965
  Gene Ontology: Mol. function=endopeptidase activity; Cellular component=signalosome complex; Biological process=glia cell migration
ggtggtgggggtaacagacgtcatcaatacaatgttttctgcactttctattttagatttttactattttttcaaattttcaaaatgaccgactccatgttcaagtatgaccagcgggagcagcgaatgatacgcaatgttaagcaatgggagcaggacccgcactatttcaaggttttactgcgggttttcatttttatggggcggcactccgacattcaatgcctttggaaaactacaaaatgtttagtgactttttaaggcatttgtgtacaattgtggttttcacattttccaaaaaatttttaaaagaggggcctaccaacggaggaattattaccaattttttaaaattttttggggtcaatttacgatttctgtcattttacgctcaatttgttcaaattttaggaagtctaaatttcggccttgatcctgctcaaaatggtgatgcacggcgcagcggcgggaacatcgaaattatgggtctgatgaactgccgggtggacgccaacacaatcattgtgctggacgcttttgcgctgccggttaaaggtttctttagaggaatggaaaatggaaattttttaagcaattgttaagcttctgaatctcttttttaaaaaattggagttttaaaaggtcgttgattgcggggttttttggtaactgaacaaagtgtaatagttttttcacaaattttctaacaaattccgtatggtttgtgggttgaatatcactaacccttgaccctttttactctattttaaagcccggaaaaaattacaaacaaatacaaattattttttgaaaaaaaaaattagattttttgtctaatgttcaaatttttggcacaggtgttcagctggtaccacctccatccgggctacgccttgtggctgagcggcattgacgtgaacacgcagtccatcaaccagcaattccaggttaggagctcacacaca

SEQ ID NO: 47135 - DNA, 882 bp, Heterodera glycines
  Genomic contig location: Contig_ID=SeqID_203; Location=186..1067; Strand=-
  SCN-specific regions: Sequence locations=1-538,560-882
  Gene Ontology: Biological process=gametogenesis
atggcgaacattttcgaattttacgggcttttacttcccatttcagcgactgatccgaactacgggaccctcaagaacttggacgccgacatcttcacgaagaatgcgccagcaaaaccggcagcggcaccaaaggcgggaccggcgccacatggaggcggcggacaggcactgacaccaagtgaaaaaaatggcgaacattttcgaattttacgggcttttacttcccatttcagcgactgatccgaactacgggaccctcaagaacttggacgccgacatcttcacgaagaacgcgccagcaaaaccggcagcggcaccaaaggcgggaccggcgccacatggaggcggcggacaggcactgacaccaagtgaaaaaaatggcgaacattttcaaattttacgggcttttccttcccatttcagcgactgatccgaactacgggaccctcaagaacttggacgccgacatcttcacgaagaacgcgccagcaaaaccggcagcggcaccaaaggcgggaccggcgccacatggaggaggcggacaggcactgacaccaagtgaaaaaaatggcgaaaatttcaaattttaattcctttttaatccccttttcagcgaccgatccgaactacgggacgcttcagaacttggacgcggaaatttttgtgaagaagtagtgccatcgacagcgttcaccccggcaaggcgtaccgatgtgtgatattatgaggaaattggattgattgatgttaaatgtttgcctgtattaattattgtaatctgttgttgccgtatattcgctgttgtacatatgtatgtatattgtgttgtacacactgtaagttctcatcatactgtaaatttcaccgccgaaaaataaa

SEQ ID NO: 47136 - DNA, 1530 bp, Heterodera glycines
  Genomic contig location: Contig_ID=SeqID_205; Location=4120..5649; Strand=-
  SCN-specific regions: Sequence locations=1-1391,1413-1530
  Gene Ontology: Mol. function=general RNA polymerase II transcription factor activity; Cellular component=transcription factor TFIID complex; Biological process=gametogenesis
cccaaagccggagcagcggtgccaacgccacaaacatcggcagtgggcggaccaccgggagcagcggaagcgccctcgtcagtgaaatcgtcagagaaaagcggcggctcaaaaaaaggtggacgaacgaacgactttttaaataaacaaatttgccggctttaaggaccagcaccgaagaaaggcgccgctgcaaaaaaaggtggcacaaaacgcgaacaattttgggattcaagaagaatgctaattgtttttcaggacctccggcagccgccgctaagaagccgtcgcccaaaggaaaagcgccgccaccgcagaagaaatcgggcaaagggtcggcgaaggggccaatgcctcccgcagcatcgaaggaactcgtcccacgtaaacaaatgaatccgaaatggcttagacaaatgattcattgctttttccccccatttcagaatccgagccgaactacggaacgcttgtcggtttggacaaggaaattttcgcgaaggaacagcaggcgaaaggtgggggtcggaaacgaacgaacggcacggcgcaatcgcaaatccattgaaattcccccatttcaggaggcatgccaccgccaccgatgggagccccacagccgcaacagcaggcgcccggaccggcaatgactccaagtgaaatgaaaaagctgaaatcttcaattaattgccttttccccccatttcagcgactgatccgaactacgggaccctcaagaacttggacgccgacatcttcacgaagaacgcgccagcaaaaccggcagcggcaccaaaggcgggaccggcgccacatggaggcggcggacaggcactgacaccaagtgaaaaaaatggcgaacattttcgaattttacgggcttttacttcccatttcagcgactgatccgaactacgggaccctcaagaacttggacgccgacatcttcacgaagaatgcgccagcaaaaccggcagcggcaccaaaggcgggaccggcgccacatggaggcggcggacaggcactgacaccaagtgaaaaaaatggcgaacattttcgaattttacgggcttttacttcccatttcagcgactgatccgaactacgggaccctcaagaacttggacgccgacatcttcacgaagaacgcgccagcaaaaccggcagcggcaccaaaggcgggaccggcgccacatggaggcggcggacaggcactgacaccaagtgaaaaaaatggcgaactttttcgaattttacgggcttttacttcccatttcagcgactgatccgaactacgggaccctcaagaacttggacgccgacatcttcacgaagaatgcgccagcaaaaccggcagcggcaccaaaggcgggaccggcgccacatggaggaggcggacaggcactgacaccaagtgaaaaaatggcgaaaatttcaaattttaattcctttttaatccccttttcagcgaccgatccgaactacgggacgcttcagaacttggacgcggaaatttttgtgaagaagtag

SEQ ID NO: 47137 - DNA, 1378 bp, Heterodera glycines
  Genomic contig location: Contig_ID=SeqID_2035; Location=442..1819; Strand=-
  SCN-specific regions: Sequence locations=1-665,687-1378
atgacttgtgcgaagcgcatcagtcagcagagtgcgctagcgttcaacagtgcgctcaacatttttgcggtaccacccaccaacgtgtcggtggcgcgctccttttttcgcgaactccttccattgtcaacgatcagccaagagggaccgtacctattccgcatgtacaatgatagcctgtgggccgacctgtcccgtgtgtacctgtacctcgaactgtccgttgagaaggcaaatgcgcagggcatcatggagccaattgacagtgtggtggacaaggaagtcggcgtatgccagagcatcgggcaaacatttgtacaacaactaaaggtgggtaacagcagaagccctcgcagacgcacccatcagtattcaggttgaagtgcaaaacatggagctgtacgacagcgggacactgtacccgttcaaagcgtacatctccaacgagctgtcatttcccgcaaatgcaaagagccatttcatggcttccaacggctactacgtaagccggacacacgatgacgcaaatgatgatgggttcaagaaacggtgtgcacgattttcgggcggttgtaaggcggagtttatctcgcgcctcgactttgacttgggcaaccaagaactgtacctgctcaacaacatggacgtcctgttcaccatctaccgttccaaggacgcattcctggtccacagtctgggcgccggggctgccggcacttcgtacgcactccgagtgcacgacatcaaactgtacgtgaaggtcatcgaggtgcagccgtcgctcaacatctccatctacaagaccctcgaaaaacagccggccacctatgctgtacgacgcacggaggtcaaatcctgctttctgaccgctggccgcacggaaatggaccacaacatattctcggcagccatcccacgccgactcaccatcgcccttgtggcgaaccgagccttcaacggcgcctacgcccacacaccgttcaacttccgtccatacgacatacgtgcaatcagtgtacatgctggtggaaacacgtatcccgccatccctcaccgtatgaacttcgtcggagctgcctacgtacgcccgtttgtcgacatgtacgaggcgttgggcatggcaaactcggaacgctccatggacatcacgctggagcagttccgagacggatggaccttctttgtcgtaccgatgacctcgacgctggacgacagctgtggctttgaactgctccgctcgggcaccacaagtgtacgccttcagttcaacagagagataccgcagggcggcgttgaaatgatttgtcttggcgaattcgatcaactaatcatgattgattacaaccgtcatattgtgaccgattcaaaaattgcataa

SEQ ID NO: 47138 - DNA, 1607 bp, Heterodera glycines
  Genomic contig location: Contig_ID=SeqID_13543; Location=1188..2794; Strand=-
  SCN-specific regions: Sequence locations=1-37,59-72,94-825,847 -1117,1139-1509,1547-1549,1573-1607
  Gene Ontology: Mol. function=asparagine synthase (glutamine -hydrolyzing) activity; Cellular component=soluble fraction; Biological process=asparagine biosynthesis
tcgcatttcacaattctttcaaatcccttcaattgtcaattattccatcagtgcttttgatgcaaaagtcagcaaatttagcattataagaaaggtttcacgatgtttaggcaattatccgcaaattgttggttgaggcggtcgaaaagaggctaatgggcaatcgccaatttggctttatgctctccggggggttggactcgtcgctaatcgccggtaattgtgccatttgtccgcttcttcaacttccgttcccttcagcgttggcaactcgcttcctccactcgaatgacttttgcgcttctccgatcgcattttcagttggctttgaggactctcccgaccttgtgaatgctcgtaaagtggccgagtatttgggcatttgccacagagtgttggtgatcagtgctcgagagtgtgtcgaggctatccccggtccgctttttgctctgtccgctttatccccccccttccgttcagaagtcgtcttttccttagagacattcgatccgctcgtcgtgcgctgtggagttgcccattttctgctctgtaagcacatcgccgccagcagtgaagtgaaagtgcttctctcaggtacgcttaactctcccaaagttcgcttcatcgcttttccaggcgaaggggcggacgaactgttcggctcttacgcttacatgcagcgggcgccgtccgcgccccttctccagcgtgagatcgtccgtcgtctccgactgctccaccaatacgacgtccttcgctgtgatcggtgcttcgtttgttccgctttccctttgctaatttgtcattcagttgcacttcctgccatgggcttgaaattcgggtccctttcctcgacaaaaaattcgtttcttttgttgcccaacttccgccaaggtttttccatcaatttgtccttcatttgcccttaaatttcagtttcaagctcatcccgggcaaaactgagaagtttcttctgcgcaatgcctttcaaaaccttttgccgggggaagtgctttggagaagcaaagaaggctttagtgaagcattggggaaggtgttaatgctatccgaagagtcccgtgctgtttaaccgatgtttcttcaggttgatcttggcgaacttctgggaaagcacgcagaaggactcattggggtaaaagttaaccgttcaaatcatttggccatttccgcttttgggacacaaacttcgcaaatcggacaatgcttttcccactccaaacaccgcaaacgaaggaggagttttggtatcggatgatatttgagcagagattcaatttacggaagctgaacaacgtaattcacaccaaagtgtacaggtgaagaacaaattgagcataaaaagagaaattgaaacaattgaaacgtttagaacggccgcttggcaaattggcgccggtagtttggactcatctttgagcacatcggacgaagaacggacatcgacggaagacaacggaagtggagacgaaagcaaagaaaaccaccgcccattgggagaggaaagaagggaaagggaggaaaagcaagagcgaaagggggaagagaaaaggatcagacggaggtcgacgggaagtgccaaattggcg

SEQ ID NO: 47139 - DNA, 1474 bp, Heterodera glycines
  Genomic contig location: Contig_ID=SeqID_13545; Location=715..2188; Strand=-
  SCN-specific regions: Sequence locations=1-70,92-196,221-265,287 -763,785-1014,1037-1320,1343-1474
atttgttacagattttcaacaaaaaaaggttggtttttgggattagtaggctcaatttgtatggattttcatttaaaaaatgataaaatatgtgttgattaaaactatgagtaatcatattttctctataggaaacccacgagtatacaaaaagaaaattcaaaataatttaatttctgtagagggattgaactaggggaaagaagaagggaaagtcaaggagactagccattaggccatttgcacacttgggcaatgttacttttaaagaatatataacaataaaatttcagaatcccaatttggttttgtaagaaataggtcaacgacaaatcaattaataacagttgtcgaagattggtacgaagcaattattaacggaaaaaatgttgattgtatttatattgactttcaaaaagcatttgattcggtacctcataatttgcttttggataaattgaaaaaaattggtatacagggtaaattattaaattggataaaatcatttttaagtaacagaacttttcgtgttaaaataggggatactctatcctctgttaaaaaagttggctctggcgtcccccagggctctgtcctaggccctcttttattcttaatttatataaatgaccttcctgatgttataccatcaggagtgaatattaaattatatgctgatgatgttaaaatatatatatgctataaagcaagagctgatacagaaattatgcataaaacattgcataatttattcgaatgggcaaataaatggcaaataaaagtttcaattcaaaaaacttttgtattatatttgggttcaaaaaacccaaaagaaacttataaatttgatgggaatacaataaatgctgtggatacaattagggacttaggagtaaacattgataacaaactacaattttccgatcatgtaaatcaaataacaaggaatgcgtatttacgtatgcgttccttgtttagaataattaaatctaaatcttctaaaatttggattacattatataaaacttatattagacctttattggaatacgctccggaagtttggaatccgtctcttcaaaaaaatattaaaaaaattgagaagtgtcaaaaatatttcactaaaagagttttttttaaatgcaaccttccaccaattccataccaaaatcgattagagtaccttcagctgccaacacttgagaataggcgaaacttattcgatctgttcatggcacataaaattgtttatggccgaacagatctgaaacttttctccatttttagaccatcaacacgattcaatattcctttctaccgatttaatacaaaatataaattaggcaaaaaattcattccctttgctgggagggcaaccaaattgtggaatcaactcgataaagagctcattaaaacaaactcttttaacttattcaaaaataaaattaaaaattcttgagtaatgcttatgatt

SEQ ID NO: 47140 - DNA, 653 bp, Heterodera glycines
  Genomic contig location: Contig_ID=SeqID_13563; Location=1..653; Strand=-
  SCN-specific regions: Sequence locations=1-65,87-653
  Gene Ontology: Mol. function=isoprenoid binding; Cellular component =mitochondrial inner membrane; Biological process=electron transport
caattttcacgcagattcgagagtgaccgcagttattccgtggtccctctgttcaatgggtcgcgtattcattcttatttgaaattgatacgtgcagacaagccgattggtcggttcaatttcctagggatcaatcaatttaaaaaatttgcatctgtaatatattaattaccacttcttccaagtttaggtacttggctactctattggccatgtgcctggtcaattgcattcgctgctcctccgggttgtcttccaagtccatattttttggctctcttcggaggcggagcatttttgatgagaagtgccggatgcattcttaacgatctttgggaccaagacatcgataaacgggtaagtagctattcgagcaaccaaattggtataggtttatcatcctatagcttcagcaagtccgtaaccagaaatactcgtaagggatgagaatctgaagccctttttttcttattcgcatcactaaacttaaacaattccaatgaattatcggcattttcattactgaaactcaaatctgacaattctcttcgattttcttcatctggattcaaatctcgtcaattattctgctttttcatcatcggtattcaaaacaatgcattacaattaggcacaagcatatgtgatggagg

SEQ ID NO: 47141 - DNA, 269 bp, Heterodera glycines
  Genomic contig location: Contig_ID=SeqID_13564; Location=337..605; Strand=-
  SCN-specific regions: Sequence locations=1-269
atgtcgaagcttcgaaattacacagaggaccaattgcagaatttgttacaggatgagtcaagattgaatgcgatggtggatagtatgccgcaggtgaattagttatgaagtcaacggtcatttaagttcataatttctaggtttcgtctcttcctaatgacaaagagatcaaattggcccagagcaaatccttggccgagtacaatctgtccattgagccacaactgaataaggctcttagtcatttgcgcgaaacgcatgccaatgcc

SEQ ID NO: 47142 - DNA, 2294 bp, Heterodera glycines
  Genomic contig location: Contig_ID=SeqID_13576; Location=237..2530; Strand=-
  SCN-specific regions: Sequence locations=1-9,31-172,203-313,337 -392,416-608,648-740,762-951,974-1408,1434-1467,1494-1759,1800 -1981,2003-2096,2118-2258,2280-2294
  Gene Ontology: Mol. function=glutathione synthase activity; Cellular component=intracellular; Biological process=neurogenesis
atacaaagcaattaattaattacccaaagagagcgatgccgactttgaaacgatagtgcaagaggccgtcgattgggcacacactgtcagtttggtgaacagagtcaaggaccaattggaacggtgagcaaaacaaagcacgggaagagagggaggagagggaggagggaccttttaatttttaaaatttaatcattttttagttaactttcgatttggcttttatgtttttctcggctttgaatattcagtcttttgagttgcaatttgaccatttgcttttcctttttacagaagcgatgtcgttgagattgttcccttcgctttgtttccttcgccttttccgcgccgtctctttgaagaagcaaaagctgttcaaaaagtatttacacaatttaataaatataattaaattgaaaaaagcggaaacatttaagacgttccaattgctttactttcgcgtgtctcagaactacgaatttttgaagagaacgctcggagaggcgggcaaaggcgacgcttacattggccaccttttggacattttggacgacgttcagcagaggggcaacaaacagccgatcagtctgattttgcaacgagcggtcaataattattaattaaaaataaatttaattaattaaaaaggcacctttacctctaagatataataaattccctcaatttttaggattatatgtgccatttgaatgcggaaagcggagaatatgaactgaagcaggcaaacacacaaaaccaaattgtttgttcgaactaattgttgtcttaaggtcgaagtgaatatgggcgcaattggcggaaacgcgcggacggagggcgtcagcaaagtgcacaggcgcgtgttctcgaagttgggactgtccaccgccaatttgccgccgaatgagtcatgcgcaggcgcagcggaagcactggtcaaagcatggtcagtaaaatggacataataataatagagtaattaaacacttaattcattagttattaaaaatcaggaaacaattcaacgaccctttgtccgtcattgtgtttatgagttacacaaaagtgcagagcatttttgaccaacggctcgtacaatacgaaattgaacggatttcgggaaataaaatcgaaattgtgcgccttacattgcaggaatgtggcgaaaagtaaacagacagacatacaaaatagacaaaatgccaaacaaatccaatagactcagttgactgatcagaatttggttgattttttcttcttaagactgattttggacccaaatgattcatcactttcgtacaaagggagaaaagtggcgataatttatcaacgaaattttctgtttgagaaggattggcagacggaaaaggaatgggacattcgacgaaagttggagcgatcaaatgccattgtaagaaaaagtgttaaatggactaaattaataataattcaataaatgccattggcaaatataataaaaataataaaatattcatagggacaaaattgaataaaattgctttcagttgacaacaaatgtccgcatcgatttggctggaacaaaaaaagtccaacaggtcgaatggcacaaaaagaaacagctgtttagcaattagttcagactttggcactgccgggaatgttggagcactttttgcccgaccaaaaagctgaaacaatcgccgccgtccgcaaaactttcgccggtctttggggcctggacaaagacgacaaagaaacccgtgcgataattaaggtggatttctaaaaagattttaaaacaaatacaatttacaggaagccatcgaaaagcccgagagatttgtgctaaaaacgaaccgagacggaggggggaacaatttctgggacgaacaactcgcggacaaattgcgaacgatgacgcggaaggaacgcgggggactcattctgatggagaaattggagatgccccaagtgacggtaaaacaattcaagtgttaaatttaaatatcaaaatcaaatttgatccgcttttcccttcagaattattcaattcgcgcgagggaaaagccgaaaatgtacgccatggtaagtgaaatcattgaattaattggtgacaaaccaattaatggttcttttccatttcaatttagaccagcgaattgggcatcgtcggttactttttgggcaatgccaaaacaatggccaccattgacaatgtgcagcgtggccatatgctgcgctcgaaggcggccgaggcgcgggagggcggcgttgggatcggcattggtctacacgactcgccctatctgttc

SEQ ID NO: 47143 - DNA, 2171 bp, Heterodera glycines
  Genomic contig location: Contig_ID=SeqID_13589; Location=17..2187; Strand=+
  SCN-specific regions: Sequence locations=1-937,962-1338,1360 -1487,1510-1948,1970-2000,2022-2171
atggaatcgaggaattggcaatctcaagatggtgaagaacacccacacaaaacgcaccagtcagggtgtcgtgcaagcttggacatcgtgacaattacgtccggtgatgcaaacactgacagcgaatgggtcgaagagattgtcgttgaacggcctcccggattggcagcgcattgtccggaagagtcgttgaagcgcatctttcccaatgataagcaagctccacgctatggcatcgaagaaatgatacgcgatgcattccacaaaaaccttatcagcgatgcttacaacacgcggaggatgtcccaggccaggggagtcggccaacccattccaaaggcaccgattggacgtccgaacgcaaatggaccctcctgtttgatgcggcgacctgacgaacacgtcagcgtgtttggagtccaggagattgacagggcgtacaagaacaaagacatggacacagcgtttaaggtttgaaaattggaatctatggaaatgaaagtgccttttaagctatttatcgtcacccgatgcattgatgagtcgaatgagaagaacgttctgttggccgagcaacacattgccgccactcgacagaaacaggcacaaaaggacaaggagaagtcgaacaaaatggagcaaagacagcggaagctcggcccgacttcgtccgcgactgctcaatctgtcggccacttggactcaggcagtttaactctcgcagattctccccatggtaactgaactgcttagttcccttggagttgcttttctcctgtttcagcaagttgctcctcctcctcgtccatcgccgtttcgtcctgtgcttcgtcactttcttcccagtcgcagctgacggcgacggattcggcgtcgacttctctccacaatttgtgttttccgaattcgctggaactccgccgttccaacgaagacccgcggctgagtgacccgcacttgcggaagtttttcttcaggcaaaggctctcttctcagtctcgacatccgcatattcaccaccagtgcgtttgttcaatgacttaacaatttataacatcttccaagtttcagttgttcattacgttcacctgacccgcgcatttgtgccaaatttgcttgtgatggcaccactgatccaatcagaaatggccaatcatcgctgtttcaacaacgaagaaattatgagaatgtaaattcaacaacattttgtgcaccagcaacggaagaaattgaggaagatggaatttgcaaaacggacgatgactctttcaatgactacgaatttttccatccacgacaaacgacgtgcagcacaattcggggcgaagaagcggaggcgaaaagagagaagaaggggacggaggacaacaacaatttgtcatcgtcatcttcggtcagcacaatcaccgcaatgacacggacaaaaacattgccaaatggggcgaaacaacacgaagaagggcacaagaaacggtctctccaccaggaacccctttcccggaaaaaggtcggagactaatactgtataaggcacacggacgttttctttttaagagcagcaaccaagttttggaaaggagttcgctcatatcttcgccgtcctccgatcacacagagctcgaagtgttccacccctccgactgtagcttggcaccctcaagttcttcatgttcctcgtcagatgtaaagaaaatcccgaatatgtttgtattccaatcacacctttatttgtttagagccttgaaaaccaccggcagtcccggcattgtcccgagttggcgaacaatttgcagtcccagtcccaccatcagcaccaccggcacagtcataaacatagaaaccatagcagtcacaaaagtggggacagtgggagccgaagcagcagagaaaggaagtgacaggcaaactctcgcatttccacgtttatttgtcgccaataacctctccttacacttcacattcagtcagccatccacaaaaagttctccaaattgtcgtcgttgttttgtttataattatttgtatatttgcatttaattctctcttctctcacatatcgaaaatcacccactcatttcgatggcaaattgtttgtctcgtaaattcagttcgcaaactttttaggtataggtacactacaaaatattaatttgtgtacatatatttataaa

SEQ ID NO: 47144 - DNA, 2372 bp, Heterodera glycines
  Genomic contig location: Contig_ID=SeqID_13597; Location=1..2372; Strand=-
  SCN-specific regions: Sequence locations=1-211,241-266,289-334,365 -372,394-1704,1755-1962,1986-2176,2198-2314,2337-2372
atgccgagcacagccattcaaaaacttttgttggccgtttccatttttctgatcatcgccggcatcgttttgacagtcgccggtgttttttcgcccgcttggcaaggcaatgccaaaaaaacatttggcccattgattcaaattaatctaattaatcatttatctttagttgttgacattcgcgaattccgagctgaacatcaggcaattctaattaattaaaagataattttaaattaagggcactctatttaaagcttgatgagatttattgcttaatccatttgaagatttttttcattgaacaaaaaaggcacagtttaaaagaattacctattaattttaagaaataattaaatttattcgaaatattgaagtaaacaataagcacatttagtaagaattcgtttttcttaaacatgaaagggtttttcggtaataaattgttgaaattatatcccccgagggggatttccccgccctccaccgacttttcccctcatttatttattcccccattttttgctttagcacggcctttggtgggattgcattcgtgccgaaaaggttggctccgttttagctgatcaaattgcctttcgatgttcgtttgccattctttttcagcatgtggtggcggtgggcgacttttacgaggaagcgccgctccattgcatgtacaaattcgacgagtccgcggcattagtcatcgaaagagcgctggtcgggtgggagagggcacggcaaaacaaagcaaaaaacggcatggcattcactttcagaaccatgtcgacgaggacggggcagctggagaagctgagcaccaccgattctggtaggaaaagcattggccatctctgctggtctttccatttgcccccaggggatcaatgacgttgcctggggggggggggctatgtggtccaccctttgtttgttagctcttttgctatgtctttgccggggatgacatttgcttgtgccgtctctgatcatcccattcgtccccaggggatggcataaggtcgtcctttcgctgatccttctctcccaattggctgcgtttgtcgccgtttgcaccggcgtttgtgcgccttgttttgccccgtccaccttctgtttcgccatttctctgttcatcgccatgcttttgtcggtgctcgccgatggcattttcttcttctccgctaatcgcgtcgacattcgcttcgtcaccggtaaaaaggcacaaaataaatgccaaattcgaaagcattaattaattgagggggggggggggagggtgaccattcaacatcgggtgatgagtaattaaatatatttttgctcttaaggaatggtcggcacttatgtaagtttttcacacattctaccgtggcttgtcctaccgtatttgtttgccgaatcggtcgactccttctacagtacccttccacccttaggagcaagtgatcggctacgccttttacctccatttgggcggtactctctgctgggcgttcgcttttgtctgtgccattgcaaccacttacaaatttctcacttccaatggacagcaaaggtacggtattctccgtggtacggtagtgggagttttcccttttttctgtcctttcttttcactttttctctcctcagttttctgttgctttgccttaattttgtgtttcgcaattgtgcacaaattgcactttaacaaagcactttttaaatatttatattattattattattatatatgtttttatttattaccgaaattcgtttttggttttgtttttcgtttgtttaattttcccccgtcattttaaacaattcaaattttatttgtccctttcatctgtcataattgcctaattagccatacgctattaaaatgaattgatcaattttgagggaggggggggggggaaagtgttcaagcggacattctgataacattaatcattttactccctttcctttccatttttcactcttttcctcttctctacagtatcccttttgctattacctacagtactcttcccctctaccgtatgaatttccattttctcatcacagaaaactgttcgatgacggcccacggctccactcggccaacctcgcctcggtctaccgacgacccgtggtcgaatggtccagcgatccctccggcgaaatgccacaaaaggcagcgggcagaggcggggggacgacgcgactgatcggggcgaatacgcaagtgtgaccgatcaatcgataactgatcgatggccattgattatttttgatcgccgattcagccaccgccaattcgttctttcattttgccattttcacttcaaacacaaaaactctcccttcgttttcttcttttttgattgtttatc

SEQ ID NO: 47145 - DNA, 3647 bp, Heterodera glycines
  Genomic contig location: Contig_ID=SeqID_13640; Location=775..4421; Strand=+
  SCN-specific regions: Sequence locations=1-300,341-748,774-929,951 -1037,1084-1112,1134-1361,1386-3324,3346-3647
  Gene Ontology: Mol. function=cyclin-dependent protein kinase, intrinsic regulator activity; Cellular component=nucleus; Biological process=regulation of cell cycle
aatccgagtcgaagagattggggaaaatgcggaagaaacattcgtcttggccatcttctgagtcggaagccatcgaagcacaaagcgactcataaagaacatcactcggatcaaattggaactcattcatctgaaaaatgcgtcaatttgttggttattcaacggatggatcatgccctggcaattagtcgcttcagaagtgccctgaaccattcactctttggcgggaagcgaacactcgccggagaacggaagaccaacgcgtccaaattcgggaattgttgcatttgtttcaaaaatttgtccagtttttccacggtgatcggcgaagaagcaaaaaaggaggaaagaaacgcacggaaagtgacattttcagtgagttcagtcggaagagtttccgcgagaagcggcggacggaaggaatttggaagagatcggagagcggtgaagagtccgctgtttggccgacttggaagatgagtcgacatctgacgggcaaaaagcgatgctcaattccaaaaacggactaaaaccgaccgaaggaagaacgaggaggcaaataaaagggacggtcgtagggaatttggtaatgacaggcgatttccagacgcttttcggcttccttcagcaattcactaatcttttcagggtccttctccttaagatgatacgattgggttttttagtctttatttctctttaattacgtttttgtacgctttgaaccctttttgggcctcttctctgatgtatttttgttcttcgtttgtgttcgtcggttcttgggccacccaatcctttgaaaggcgaattatgcgtcggtataatcgtaaaacttcacttcttttgttcatagaaaatcttaaaagataaaaactctattagcatatccagattcacaaagatttgactacctgcaaaaaaaaagttataaaaaatgaaaatattttgactttttttcggcgctacttgcccgcctgtttttaatgttttttctctttggcgtaaaaaacaaattcccactttttttatattcgaatttttttttactaaaaaattgataatttaataattttaataatacataatccttctttcatttccaagcctaacaaaattatttgatattttatgggctttcatttgctttagcatcgtttgctcttcgattgttggccatattttgtttgatgagattcgatttctcgagtgttttcacccattttaacccatagtttcactgtcatgaaaattggacatcggaccccgccgaggcagaaaagagccactgaccctcccccacagttcgattcttccgatttgggctctccgcaaaaggttcttaacttgaataatttgaatgcatataacaaaataataataattgcatcaacaaattaaggtttggtcactgttatgcgagaaggacgagaaattgcgccgagatccgcacgtattttcgcgccagaagaaaataaacgccaaaatgcgtgccatgctgctcgactggctgatggacgtgagcggaattgtcattaattagcagtcaattaacgcgagaccaaattgaaaaggtctgtgccgacaaacagctccaccgcgaaactttccatctttgcatcgattacatcgaccgtttcatcgcattgagtgaccaccaaatgcagccccagcgattgcaactgttcggctccaccgccctggtaattgcgagcaaagtcgaggtccgtttgtcttttccgaagctttttcccaacgacgaaatttccaggaaatttatcctccgaaaattgcggagattgccgaatacacggacgggtcagtccctcattttgttgggattgaattccgaattgtattcagctgttgttctgaggctgacattcgaggcatcgaagagattatgctggagaagttggattggacgtgttatccggtgaccgctgtccattggctcgcacttttcatgcagctgatgaacacggacgaagtgatccccgcccagcgagtggtcatttcagccggttggtcgtcttctaacagacaaaaatgattaacacattggaaataattgggcctaatggccgtttgcctttgtgtcgctcgtattttccttttattggcactttctctcattgtcaggcaaacggccgctagacactccgtcactcaacggcgactcttcgttcgtcatcggtaaaccgtcgctggaggtgagcattgagtcggcactgcccaacgacgagaacaatcagccggacgatgcccagcgggcggagtcgcgtccttccgtgccgtccgtttcgtccccgtgcccttcgccctcttcttgcgcagttggcgaagatgttcagctcgaggttggagtgttcgtccatttattgtttgttcctctacaaatgtgcccatttccaggtttcgtccgtcgttttcgccggtgcgtcgcgcgtccgtcgcatttccttcagttgcgcctatccgcggatgcaactttgccacattggctcctccccacgcgtgctgctgcacaccacgctagcggacattagttacgtcggccataattcgtacagcagtggccacatttacccggaccagcgctgcaccgtgccgaaacttatgcggggcgaattcgtccgaatggccgcggtaaaatcttgcaattttttccgcttttccatggcgaaatcatagtttaagtaacaaaaagggggagtttgtacagtttcgtggtgatgtttcagattttggacttggccatgctcgactcgggctgtcttcgcttccgttacagtgaattggccactgctgtggtcctttgctgctatgagcccgaacatttgatttgccaactcaccggtgccgccccgaccgattgattgcccttcataaatatttctttcctttaggtttttcgcctgaaaaggtgcgcgatgcccgcgcttacattgagccgttcgtccgcgtgttcgacctcagcgagcccaccggcacagccattccttgcctggcggacgtgccccacggcgaccgacacaacattcaaacgtacacatcgaagtgtctcgaacatttggtgagcgaaaaccccttatggagatgggaccttccgaaaaacttttttgtaaccaaaaagaggcctggtccgttactattagcctggtctactctttggcaatctttttttcgttgctccgttttttacctataatttatcatttttaggagactgtgcagcaaattcgaaaagagactgagtcgcgtcgcaaggcggtggaattacgggtcgcggctcgggtgcgcaaacgcaaattcggctcggcaatgaatctctaatgatattcatcaataaatatctaatttattctcttatttcatctctttctcacacggaaaaatttgccatgtgtaaattgtttgtctgcgattgttttggatcgaactttcgctactggcttttgattccaatcccacagctacggaaattgtcaggctcacaaccagcagttttttattagtaaaatgcggtgattacaaaataaaatttacacaagaaaaaatggtaatttcgtgacttatacgttttgagcaaggatgactgagaaaaaaaatgagtgggtgtaaacggacataaaatcagcacaaat

SEQ ID NO: 47146 - DNA, 922 bp, Heterodera glycines
  Genomic contig location: Contig_ID=SeqID_13650; Location=363..1284; Strand=-
  SCN-specific regions: Sequence locations=1-133,168-395,417-621,648 -685,707-874,896-922
  Gene Ontology: Cellular component=integral to membrane; Biological process=proton transport
atgtctggtgacaattcggcacttattgcagcggagcaagcggcgtatggcccattttttggctcacttggcgtcactgcggcgatgattttcaccgcggccgggtcggcctatggcacggcaaaatccggcaagttttttccgcgcgggagggggagggttggaattttgaaaatttgtgagcgcttgacgcagccctatacctgaaaaacttgcgattttctttcgccagattttgccttccaaaattgtttttagagcttttttgttgagaaaaaagaatttaaattattatgaaatgggcattaattacggagctgatttatgcgccttagggaaatatcaaaaaatcatccaaaaacttaagctccctctcaaatttttaaatcttcatgaattttttaaattttactaaattacattccaatttttgtgcctaatttgacgccccctcctttttttcaggtactggcattgcgtgtatggctgtagcaaggcctgacctcgtgatgaaggcgatcattcctggtactctgtgcattttttgtttaccaataatgtccatttaaattttttttccgaaactttactggatttttttttggtgttatggcagcgaaaagagagagagaattcattttttccaaacgaaatttacaaaaaaaaattgcgatttaccaaatgttatacttgaaatttgttaaaaactacgggccggtacgactgggggcataaaagtcatcagagacacccctaaccaatcataaaatgcaattttcgtgcttatctgtgcgtatcaagtgtgcagaaatttatgtattatcgcatccctaataatgactatggctgcgaaaaatatgtacaaaaagtggtccaaatatgtacataaatatgtaagaaaatcccaaaatatgtaaataaa

SEQ ID NO: 47147 - DNA, 2372 bp, Heterodera glycines
  Genomic contig location: Contig_ID=SeqID_2056; Location=3551..5922; Strand=-
  SCN-specific regions: Sequence locations=1-512,591-723,745-962,984 -1034,1061-1292,1315-1417,1439-1833,1855-1957,1979-2372
atgggggctagtaaaccaatagaagaagaaattgaaggtgtgaaaacacgtggagaatcattaaaggatttaattgtttcaaaacaaattgaaacagtcttatttaaatatttgaaggagcggcggaaattttcaattgattttaatgaccaaagaattgactttattgaattgtcggctcaactcggctacattctaggattcgaagacccgacaaaaattctgagtggagctatagcaaagtattattgtgacttgaaaggtggtatagacagcctttgtgtgtacattaatggaatcactgagaatgtaatagtaggggaccaactcgcttcacttttgcgaattgttgtcgttgaaggaaaatttggagacgtgattgagaagatttataacacaccaatgtacattaaggtggtagtaaaggaaattaatgagattgaaattgaaattaggactagggagggaaggcttattccattccaatggggtacaacattacttgtattagcatttaaaaaatctattgtattttagtatttaaatattcattttcacattatagtatatattaataattgaataaatatggtgcatcaaatatttgatccaaactcagttagttttgatgattttgttgtagtagagcagattggctcgggagaagcctttaattattttcgcgggatacctccataccaacgaggatatggaagacagcgaggtggaggagtaggagatgtgttgaggtttttatggagagcacttttaccaaaattaaaatcggctggtacattattaggtagagaggcattagacactggaacacgtgtattggatacaatagagaaagctgaaacaccaaacaaacaagtaataattaatgaagtaaagaagggaatggataatgtactcgaaaaaggtggggttgggcgtcaattcggaacgggaagaaaaaagagtattaaaaggaaaagaattattggaaaaactatacctaagacagtaataaaaaaggcgaaaaagatcagacgtatttggaaaattattttaaaatggtcttcaagaaaattgacaaggaatcggtaaattctataacttcagctttgtcaatatttacccttccaccaactaatgtgtcagtgagtagttcttcagtgcgggaatatttaccgctcaatcctttaacggacattccttttcattttaaaattcaccctaccgccagtttctttgatttgaacaaatgttacatcttaaccgaaatgtcaattaaaaagctggattcttacacaaataaatatgttaatttaaaagtgaatgagcaagcggcaacaattaatatgattggtgcgacttggataaagaatttaaaaatcactgtgcagggacgtgagatttatgactcaaactcactttatgcttataaagcatacttggatgccgaactttcttattccaaaaacgtaaaggagtcagacctgcaggcgagcggatattatgtggacagtgaaaatcaggacggaacggatattactcagcagggttttgaactgagaagaaaattgttttcacaaagtcaaactgcacaatttattacaaaattggatgcagatatttttaatcaggacagatatatggtgaatggagttgagattgatatacaacttacccctaatgacaatgagtttatggtaatggcagcgtcagacgataaatatagaatagaaattaccgcttgtaaattatatgttaaaactcttgaagttgttgatggtcttgcattagacatacagaaaaaacttgaaagcaaagaagcaaaatatgcccatagaaaaacattgatcaaatccacatttataagcgagaatcgaactgaatacaatggaacgctatttacgggtcaattacctaaacgagttattattggaatggtggagaacgctgcatacgtaggcaaccaaaagaaaagcccatttaattttaaaccttttgatgtacgatccgttacattgatggcaaacgggaaacaatggcccgcagcgccatttgagcttaatttcaacaaaaacttatatacccgggcattccacgaaatgaatgaggcgttaggtatggccagttcaacagacagtaacggaatttctcttgagaagtatagaaagggttggacaatttttgcgtttaatatgactaatagcatggaggacaacgagggtattgatcttattacagaagggacgactaccgtgtgcattcaatttagatcacctgtcccatcgggtgggatcaccctaatagccatgagtgaaatggattcaattttgattctagataaaaatcgtacagtaatgaccgataataccatttaa

SEQ ID NO: 47148 - DNA, 2789 bp, Heterodera glycines
  Genomic contig location: Contig_ID=SeqID_2057; Location=252..3040; Strand=-
  SCN-specific regions: Sequence locations=1-616,638-707,730-856,1037 -1038,1060-1129,1168-1562,1641-1773,1795-2060,2082-2083,2110 -2466,2488-2789
atgaaaaaataccaaggagtaacagatggtagaacaattcaggctctgaatgaggaagcattaagaatgagaacagcaatgaaacacagaagaaaaaatttgaatgcttttaacaaggctgtattgaaaaaagatttacaaatatcagctgaagaatatgagaggacgagctatgaacaaaataaggattacgttgagccattttttgatagtcatccaacagattactgggaacatattcataaaaaatatgaagggcttcaagacgattacaaaaaaattcgcgaattaagagaacaacaacaatttttgactgatgaacagaaaaaacagtcaattcaggatgaaattgatcaacttcgtcgtcttgtcgattataggaaaaaaagatttgcagcgctagagtatgaagctaaaaagagggacgcactccaacaacaaccaatggctttagccttgactcatggtgaagcactgaaggaacggataggaaaaatagagggaactaccaccacagcagacggggaagagacaaaaactcatggaaaatctttggtagagttaatagaacaggtacagaaagaaagagatgatagcaaggccaaaactgagggtaagacacgaggagaaattttaggagataaattaaaagccaaaattgatgaacaagacagtagtgcagatggtgcaacccatggtgaagtactaaaaaataaaccagaaacaactattggtgaaaaagtaatgacaagaggagaaattttaggcgaaaagttaaaatctaaagatgaagaaaagaaagaagaaagaataacccatggcgaagcattgaaaaatagaattgaacaaattcccgaagaagaaaaaacaaaaggaaaaacaagaggcgaaatattaaaagaaaaaattggggctagtaaaccaatagaggaagaaaaaacagaaggaaaaacaagaggtgaaatattaaaagaaaaaattggggctagtaaaccaatagaagaagaaaaaacagaaggaaaaacaagaggtgaaatattaaaagaaaaaattggggctagtaaaccaatagaggaagaaattgtaggtgtcaaaacacgtggggaatcattaaaggatttaattgtttcaaaacaaattgaaacaattttatttaaatatttgaaggagcggcggaaattttcaattgattttaatgaccaaagaattgacttcattgaattgtcagctcaattagggtacattctcgggttcgaagacccgacaaaaattctgagtggagctatagcaaagtattattgtgacttaaagggtggtatagacagcctttgtgtgtacattaatggaataactgagaatgtaatagtaggggaccaactcgcttcacttttgcgaattgttgtcgttgaaggaaaatttggagacgtgattgagaagatttataacacaccaatgtacattaaggtggcagtaaaggaaattaatgagattgaaattgaaattaggactagggagggaaggcttattccattccaatggggtacaacattacttgtattagcatttaaaaaatctattgtattttagtatttaaatattcattttcacattatagtatatattaataattgaataaatatggtgcatcaaatatttgatccaaactcagttagttttgatgattttgttgtagtagagcagattggctcgggagaagcctttaattattttcgcgggatacctccataccaacgaggatatggaagacagcgaggtggaggagtaggagatgtgttgaggtttttatggagagcacttttaccaaaattaaaatcggctggtacattattaggtagagaggcattagacactggaacacgtgtattggatacaatagagaaagctgaaacaccaaacaaacaagcaataattaatgaagtaaagaagggaatggataatgtactcgaaaaaggtggggttgggcgtcaattcggaacgggaagaaaaaagagtattaaaaggaaaataattattggaaaaactatacctaagacagtaataaagaagagaaaaagatcagacgtatttggaaaattattttaaaatggtcttcaagaaaattgacaaggaatcggtaaattctataacttcagctttgtcaatatttactcttccaccaactaatgtgtctgtgagtagttcctcagtgcgggaatatttaccgctcaatcctttaacggacattccttttcattttaaaattcaccctaccgccagtttctttgatttgaacaaatgttacatcttaaccgaaatgtcaattaaaaagctagattctgacacaaataaatatgttaatttgaaagtgaatgagcaagcggcaacaattaatatgattggtgcgacttggataaagaatttaaaaatcactgtgcagggacgtgaaatttatgactcaaactcactttatgcttataaagcatacttggatgccgaactttcttattccaaaaacgtaaaggagtcagacctgcaggcgagcgggtattatgtggacagtgaaaatcaggacggcacggatattactcacggaggttttgaactgagaagaaaattgttttcacaaagtcaaactgcacaatttattacaaaattggatgcagatatttttaatcaggacagatatatggtgaatggagttgagattgatatacaacttacccctaatgacaatgagtttatggtaatggcagcgtcagacgataaatataagattgaaattaccgctt

SEQ ID NO: 47149 - DNA, 2577 bp, Heterodera glycines
  misc_feature (56)..(58): n is a, c, g, or t
  misc_feature (60)..(61): n is a, c, g, or t
  misc_feature (63)..(63): n is a, c, g, or t
  misc_feature (67)..(69): n is a, c, g, or t
  misc_feature (76)..(76): n is a, c, g, or t
  misc_feature (79)..(79): n is a, c, g, or t
  Genomic contig location: Contig_ID=SeqID_13664; Location=1..2577; Strand=-
  SCN-specific regions: Sequence locations=1-247,270-1065,1089 -1554,1578-1616,1638-1652,1674-1735,1770-1809,1831-1838,1862 -1928,1950-1996,2018-2292,2314-2379,2401-2403,2428-2577
  Gene Ontology: Biological process=embryogenesis and morphogenesis
cgcaaattgtgctctcaagtgctcggttcgctgcgccgccttcctaagggggagannngnnanattnnnggaaggngantccccctaaagacaatccccacacaacgcaaatcggacgtaaaaacattggacgcggcaatagatcaggtggggaatgacagagggattaccgtataccggggagatactgtaattgaaattcggagaatggcgaaatagtctctgaatcatttaatgggcgaaatcgatttaaataattaatattatttgttctgtcaacagtcattcctttagttttccgagcctttggtcaaatttgccactggcgccactccgtccagctccgacgtcggcaaaatgctttcttcaatccccgatttggtggtcaatatccccggctttggcacaatggacgcaagcaaagtgagtgatccacggctttgcttataattcaatgcatttgattttcacttctttcagctccatccttctctggttgaacacgtgctgaaagggggtcaaatccccggcattcccaaggagacgttggaccacattgtcaagcagtacatgcagcgtttgtatgtcgctgcctccaacttgcaaggccgtccaacaacggaattgccaccccttccgccgggcactgaccccaccaaattgcttcggccaatttccgaattgcccaacgaaatggtggagaaagttgtccagaacaaaccgttgccgcaccttacgcaggaacaaacggaagtgatcaaagtaaggggaaaattggcataaatggttcattaatttcaattttgcaatgcttctcttttagcaatattacatgcagcaaatgccatcctcttcgggtggcgacatcggcaaaactttcggcatcgccgtcaatggcaacgcctctgagccgctcaatctgacaggccttttgccaccgaaagtcttccaaatgatgaagcttttgcctcccaattacaatctgagcaaacttccgccggagctcactcagcaagtgatgcgcggtgaaatgcccgacttgaccaagttgccgttggatttgcagcagtggatcaaagataactttgaccggcttgttgcttcgttggagaacaatgtcagtctcacaatcagtcattcgtcgcaaataattaggagacattttttccttttgttcagcccgatctgagcattgacgaaatcatgaagaagttgcccacgttcgagcacccgcccatgtccaccttctccccctacgacatcaacaaggtcgacgccgatttggtggtccaacagcgcaacgaggaggaggccaaccaccgtttctggcgcattttcgccgccagcgccttggctttggctggtgccgtgacgctgggcgttctcagtgccttcttctggtacctgaaacggagcagacgcctggcggacccgccgatggcgccgccgattggcattgacgggggccccgagctgccctcggtgattcgtgagcagtacttcagaccgtctgcctcttcaacgctcaagtgatcactgatcagtcgcgatgttcttgttcgggtgtgattgattagacttttatttagtttccgctttttatttccttaacattcctaaaaagtcatctgttcattcctgtgccgacttccataatttatttcccatttccatttttttgcttttttttctcaatacattccttaatcatttgatcagcaattattgtgaatcgaatacatgtaaaataaaaataattagtatatgtagtactgttgttaaataattcagttttagtataatctatcttgacatacatatcctgtgtttaatcagttttatcataaaaattaaaatagttcaaattggcaaaaatggttcaatttcggcgtttgagggaatgcgtcaaaacggcaaaatttgctcataccagtttgggtttttaagaactttcaacgcatttcattttcaatacaaatgtcaaacagagttagtggcattaaatttaaatcttaaaatgaaaaaacgaatggaattgcacgaaaaagaatgaattgcgggaaggaaattctgtctgaatatattcacgtgagagagagagaaagagaaataaaaaaactaaaatatgtgcaaacatttaaagctgaaccagagaaagagaaaagggcgagagagagtgttaatcagcggcaacagcaaaatcaaagaacaaaatccctttcgagtggagtgactcatcgcactttaccccccctcccccggcgacctttctttcaattcgtccgatcactctgtgtctgtctgtcctctgtcatacggtgcttttggctgatcgctgatcatccgccgccctttccgacccttctgatcaccgtccgtccctcggcttcctcctcctctcgtctttgctgctgctgctggtgaatcagttgggcctgcaactgggcaaacagtgccattgggtggcaattgaacgcggccatttgttgtgccgtcgaagaggcagcacaattcgctgctgctcccgccgctttgcatttggccgtcgcttcgtccgctacggagggcccctcgtcg

SEQ ID NO: 47150 - DNA, 1172 bp, Heterodera glycines
  Genomic contig location: Contig_ID=SeqID_13689; Location=234..1405; Strand=+
  SCN-specific regions: Sequence locations=1-24,46-818,847-852,874 -893,917-965,987-1001,1023-1172
atggccgacgaaagtgccacgaatgcaggaggagccggcgccgctggtggtgctcagcccgccgagtacatcaaactgaaggtggttgaccaggtctgtttttgcattatgtgatggcgcgacttcaccgtcttaattgtacatttttaggactcaaacgcggagcggactggcgtacaggtattaacaaatttgggattgggtgttgggttttttgactgacaaaatcttgtattgaaggggcaatttgttgtggacgagtttatttttttggttgtaaacacaaacgccattcttttcaccccatttcaggtgacttctctgcgctttttgtttgatggccgctccgtcaaagacgaccacactcccagatcactggaaatagaggacgacaacatcatcgaagtgtgtggggtgatgggttggaaaacattcccggggggtggggtttcggggtcatatacacgactgaattttttcctattttcaacgatcagcggatagtttttttgcactttaaagtagcattattgtattttaggtgtatcaaggacagatcgtaggctccattttggatgattgaagaagattttgttcctcgtgtttctttttttgaccgatcattatatgatctgataattgcccctcacatttatttgttgcttctttcgtttgataatttaatttttgttttggaaaaaatggaaaatcttcaaaatttcattattttttcccaacgaggaataataatatgtagagatatcttatctctatatatttttttcgtcataaattaaactgaattttcgtaaatagtctaaaaattaaattttaagatttaaaaaagagaacgaaatattgagaatttttatgcgcattggcaagtttttctctatgagaaaatttaaatttctgtcagaaatgcaacatagaaaatagaaaaaaagaaaaacttaaagaaaaacttttctcattgaattaaatattttctgcggttcaacaattattttttattgtttttctatgcaagcaataagtgcaagcagttcggtaacgacacatggatatattaatacaaaaaaaccttttccgaaaaaagcgaagaagaaaataattaatattgatatatcaaaaattgggaacttttctggtaaaatatttttacttaatta

SEQ ID NO: 47151 - DNA, 304 bp, Heterodera glycines
  Genomic contig location: Contig_ID=SeqID_13729; Location=6..309; Strand=-
  SCN-specific regions: Sequence locations=1-304
atggtcatcaaatccaattcggtcatttcacgttcgcattctgatcattttcaagaagcttctggctcattgtcagcaacttccggttccgaagatgcaattaagcactggggttggtggaggcattttgtcgcaggtgccactgctggttgtgtcagccgatcagtgacggcaccgctcgaccggctaaaagttttccttcaggtaaatatttttgcttttctcgctttgtttttttagtgtaatttgtaggttaacgccaaccataagactccacacactttgccatccgcagtcgattatt

SEQ ID NO: 47152 - DNA, 1339 bp, Heterodera glycines
  Genomic contig location: Contig_ID=SeqID_2065; Location=80..1418; Strand=+
  SCN-specific regions: Sequence locations=1-191,213-723,745-808,831 -843,865-1015,1037-1339
  Gene Ontology: Mol. function=calcium channel regulator activity; Cellular component=integral to membrane; Biological process=synaptic transmission
ccattcccaaacgccggtggtcaaagcatcggggagggagctgagctatgtcctgttgttctcctgcttgctctgctattcaatgacttttgtccttctgtccaagccgagttggacagtttgtaccattcgaagaacaggtgaacttggaggggagggagggattgggaagaaagcccccgggggagagaaatgggcagagggaaggaaaagccaaaatgggggggggatcggaaagtttgttgtctgttgacttcatcacttgctcatgttaaggcatcggcctcgctttctcctgtctgtactccgcccttctggtcaaaactaaccgaatccatcgcatattttcccaggtgttctcactgctaatgaattccttttaattactaattaattgactcattaattgccctctgtccatttcctcctctaaggccactcggactcgacgtgcccctccgctgatctctcccatctctcaactgttgctcacttccgcctttattggctccaaaatgatcttctcattggtttggcttatcattcagccgccgggtaattccgctgggtgtccattcattaagccctaattggcaacatttaattacgcaactgtccttccctcaggcactcgccactttcatcccacccgtgccgaagttgtgctcacttgcattgtgcccgaccaccactttctctattccctcgcctatgaaagccttctgttaattatgtgcacagtttacgccgtgaaaacacgaaaagtgccggaaaatttcaacgagacgcgttacattggcttttgcatgtattttaatttttgtgtgatttggcgtccgttcgctttttcaatttttcccttaaggtacacaacgtgtgttctgtggggctgtctgattctgttctttttcggcaccggcagtgacttccaattgcgcacaaccgcactttgcatgtccacttcgatgagtgccaacgtggtgacaaatgggagaaaggcggggaaagggacggaccaatgccaatgccaatggcaaatttggggctgcaaatgccaatgtccaaaagatcaattccctctcttttcaaggcgttggtgtgcattttttctccaaaaatttacgtgattttgttcgaaaaggacaaaaatgtacgcaaagaaggaagtgggagcatgctgaacaaaaagagaatggggtcgaggtgagcgaagaatgaccactcatccattggctaatcgggggtaattaacgcactaattagggacggtgattaaggaaggagtggtggggactgggccattccgttgatcacattcagttattacgccaacaatttg

SEQ ID NO: 47153 - DNA, 895 bp, Heterodera glycines
  Genomic contig location: Contig_ID=SeqID_13734; Location=14..908; Strand=-
  SCN-specific regions: Sequence locations=1-261,285-687,723-783,815 -822,844-895
atgccaacaactcaggaggagcgaaaggccaagtcggaagcgaataaggcaaagcgcgaagaggagaagcgcaagcggcagaatatgatggcgggtgcgtttgtcggagggttcggcgaagaaaagccgtcgggacgcaatttcgtcgttcaaaaaagggaggagggcagcgacgcattgggacagaacgcggagtcgggcggggggccaaagctgcgcggaggcccaaacaaagcgcagcagcaagaggccaaggtgggtaaggggagggaggggtggggataagcaagggatatatgggattaccatgaggaggacatccaattcagcgcaattacatgtccattgtgaaccgaccggtggacgtgtcgaacatgttgcccaatgacatcaaggcaaagatcaagcagttgcacgcgcgcattgtcaaattggagggcgaaaagtacgacttggagaagcagaacgagcgccaacaatacgatgttggcattggcacacaaataaatgccaacagatttgggccccctcttttaattcagttgaaagaattgggcgaacgtcagaagcaattcgcgcgtcagaaggccttggaaagcggaatggacccgagcgaaatggaggagaattcatcgcttccgcccaaagtgcgcgtggcgtccaaatttgatcggcagacggacagacgcggctatggggagagacgcaacaaattcgaacacgtaggacagcctgcgccggattgaattttgtaaaacaatttcagcctccgccgaagccggagccaaaaattgcgcacggcagcggacgaccgccgccggaatggggccgcaaagagttggaagagttggagaacatccggaagaatttggaaccgccaaagtaccaagagcag

SEQ ID NO: 47154 - DNA, 437 bp, Heterodera glycines
  Genomic contig location: Contig_ID=SeqID_13736; Location=186..622; Strand=-
  SCN-specific regions: Sequence locations=1-413,436-437
  Gene Ontology: Biological process=mRNA splicing
cgttgaggacacttcatctgcacgtaatcttgacgctgatgaaccatttgatgagctcaacgaggacgacaccgacttggacgaagactctgataacgaggccgaacttatggcggaactcgagcgcattcgcaaagaaagagctgcggaaagggcctcaaaagaggcgaaagaacgcgaagaacaggtgagacacaaataacctcaaaaagaaattgaactcccaggaacgcattcgagaagagaacattctccatgggaatccgctgctgaaccccgcatcgtcggagtttaaggtcaaacgccgttgggatgacgatgtcgtcttcaagaattgtgcacgaggaattgacgaaaggaagaaaacgccttcattcataaatgacgcaattcgatcggagttccatcgcaaattcatggagaaatacattaaatga

SEQ ID NO: 47155 - DNA, 2155 bp, Heterodera glycines
  Genomic contig location: Contig_ID=SeqID_13788; Location=1..2155; Strand=-
  SCN-specific regions: Sequence locations=1-494,516-574,602-1565,1593 -1987,2013-2061,2083-2155
  Gene Ontology: Mol. function=extracellular matrix structural constituent; Cellular component=extracellular space; Biological process=histogenesis and organogenesis
atgttgacgagtgtcttctcctcgttgacgactgtgccgagacgcaacggtgtctgaatacggtaggacagtttttgttattggattttaaagttgcatttagcccggaggattcaaatgtattaggactcagtcatgtaaataaccaaatgcattgtttcggtgattttaaattttgaggcggcacgggctatgccatggacagcgaaacggagcaatgcgtcggtgtgtctttatcatataaaaaatttcggcacctcgggtattgtccccctatcaattgttgacattgcatttaccattttactcccccccccggcgattgtcccatttgtcctggtcggttcagatgtcgacgagtgcgccctcggggcacacgactgtggaccgatgtaccaatgccgtaacacccagggcagcttccgttgtgtgccgaagcgatgcgcagcggacgaagcgatggacccgaacagcggagaatgcaaagtgacggagcaaagggaaagccgaggaaagggttcggaaatattcagtcggtgaattgcccggtcgggtacaaagccatcgacggacgctgcgaagacatcgacgagtgccgggaggagacacgccattgtgccatcttcgaagagtgtggggaaaggggaggataatggcatggtttaaatgaaccgcgcaggtgtcaacaccccgggcagtttccggtgccaagagcagggcaatgtgtggtcaaatgggtaccacatggacaaggacagcggcttttgcttaggtaaaacgaaaagcattcgaaaattaaaccgaaccgaacacaaaaatggaagacaccgacgaatgcgcacggaaaacgcactcgtgcgaaacggacgaacagtgcacgaatctcccgggcacatatcgctgcaattgtggggcgggtttcgaattcaatgagttgacaatgtgaggagggaacggtgggtcgaacggtaggcagagacagatactgtaagggacagacagcctactgtatcgcagcagcaaatacgcatttgccatagattagcaaaacgggcgaagggcggtggaggggaggcgtttcggggagggggggagggaagggcgggttcgttcccccccgaggaccgctcttttgccaggcgttgtgaggacgtggacgaatgcgtcaagttcggagcgcacgcgtgctccctccaggcgcaatgtgtgaacactttcgggtcgcatgagtgcctttgtgggcccggctttaagttgggcgccgacaatcgcagctgcgacggtctgtgaaagtgttaaatggcaaagcactcaaaaagatccgcttttagtcggcccgtttttgctgtttttttgtttttgtgcatttttaccctttgagtgccttttcagacatcgacgagtgcgcctcgggggtcgctcgatgtcagcaaaaagtgagcgaagggctgcaattcggccctttccaactcagtcccaatcggtgcctctctcaattagtgcattaattcgcccggctcctaccaatgcatttgcgagaggggctttcagctgggcattgacgaggtcacctgcgaggacatcgacgagtgcgcaatttgggcaaagtcaggtgccgtgccatgccattccctgtattagttcaaccattttttggcatttcaggcaatgatttgtgcatgggccaatgcgtcaatttgcccggctctttcgcctgcacgtgtccgcttggctacgaaataatggcggatggcatcacttgcaaaggcactaaaaataattgctaattttgaaatttattcgggtctctccccttgagacatcgacgagtgccaatcggagaacatttgcgcccctgggcatttgtgcattaatttattgggcaattatcgctgccagcgaatcgaatgtccacgaaattattttcccgacagaaattacaaaaagttcgccttttctttcattaattccttttgccgtgccaaaagtgtttttgtttaacaacaaaaactaaccaaattttgtcagtcgttgtgtgaaaaggcccgggttttgtgagaatttgctgctggaacggtgcaaaaagttgccaattcacatctcatggcaaaacatcaccattccgaaggtaaattaacgcgaaaaagggaaaagg

SEQ ID NO: 47156 - DNA, 488 bp, Heterodera glycines
  Genomic contig location: Contig_ID=SeqID_13817; Location=1269..1756; Strand=+
  SCN-specific regions: Sequence locations=1-395,420-488
  Gene Ontology: Cellular component=mitochondrion
atgctgtatcaaaatctaagaaaaattgtgccatcagcagattctcaaccgttatcctccttcattcatgatttattacgacggaagttattaagctgcactcatcccgaatttccatacaaacaacagggtgtataatacattattgtgttctttaaacctttcatttttaaataccttacagatataactgcatattcttcgacattgccaaacgtgctttacgcgggtgttgatccaacagctgacagccttcaccttgggaatctcctcgtgctcaattccctgattagagcttccttttttggttgttctcctattttattaattggaaaagcaacagcttccgtcggagatccgagcgggcacaaaagaggtgccagacaaaacatctaatgaattattgataattttaattagacaggaaattgttattacatgaatttatctatgcgaattcaaaggcgttgcaaatacaggtggagaaa

SEQ ID NO: 47157 - DNA, 3364 bp, Heterodera glycines
  Genomic contig location: Contig_ID=SeqID_13821; Location=1..3364; Strand=-
  SCN-specific regions: Sequence locations=1-58,81-571,601-765,787 -1036,1063-1386,1408-2277,2299-2300,2322-3040,3089-3165,3242-3364
  Gene Ontology: Mol. function=ethanolaminephosphotransferase activity; Cellular component=endoplasmic reticulum; Biological process=growth
agttggtttttgaggtttattcttaataatctcacccttatgaatgataaattcattcgaattttaattggtttaaaaatgcattctttgcttaaagataggccttaatttcaaaaatttaaagattttcaaaaaaaaaactgccgttgcccctccctcctttttggtagaaatttttttagggtgttgtaaaatgtgaaagcatgtttagggggatttttggagcgcctcacggatttgacatttatttttgccctttccgaatcacgaatttttaaaaattgaatttctggcattttttgttcgaattcgggtctgggaatttggaataagccaaaatgaatatcagattcatgaccagcgaccccgaaaacaaccataaacatgttttcacgacttttaaagcaacttttaacaaaaacgggggggggggggctccgcagtattaccaaaaccggttctaccgtaaataattaacagacctaagggcctacatgaccgaattttggtgctttagtccaattttgaaaaaaccaattaatttggtcggttcagtgcgcccaaaatttgcaaaatttttcaaaaaaattttttttttttcagttttacccccgttggttggcccccaatgtgctgacatttgccggtgcactgattgtgatgtgttgctatgggctcgtggtgtgctttgaccccgggctgagcgccaattcggccaccgggccggccgagctgaacatcccgcgctgggtgtggctggtgtgcggggttggcactttcttggcccacttgttggacggcacggacgggaagcaggcacgacgggtgggtgccagtggaccgaccggggaactatgtaagtacgccgtgctgtggtggacggggtcggtacccggtcaggttacaagatcccgaaccccggaatccgggcgggtttttaaatgatgaaacggatcggggtcccgcaaaaatcaggttttaatttcaaaatcctgtccggggcatccagaattgtcaaaattccggtctcaaggcgaatttttttaatttttttttttttttggttttatttttccctcattgaatttttcaaggcttggtaaattgtggccggttcggcccaggattgaaccccaatttttcattccatgaatttttattaaaattgctgcccttcctgaaacaaaattgggtggttgccagagatttatagaatgccaaagaccggcggggcacttaaaattactttccgggctattgaggccaaaaattcggctcgaaaaagccaaattggtatcagatggggctagggggcccggttttgaaattccacgagatcagaaatctctggcggcttaacccgacacttttttttacaaatatctattttttcttaaaaatccaattgattttcaccggagtttcgtaaaatcctggaatttttacgaaattttctaaataaatttatttaattctctgagatttacctaatttttgccttcccaacatttcgagttgaccacggattcggtgagcgtttgtctgctaacaaaacgcattttgccaattgtttttaacgcgttccccgcacttttcggtctctcctcgccacagattcatggtcaaccgtcccatttacgatcaccattttctcactttttggacggggccaattcaggtaacaactaattagctgattgccgaccgacggtactaaaaaaaaaaaaattcaagccctttttataagaaaatctcgaggaaaaaaattgtaaatatctaaaagatttaaaaaatcagaaaatttctttccctaaaaatttttaacaataagttcgaaaagtaaaaatggttgcatcttaaatgaacttggaaacacaaaaacattttctcccagagtttttctgtcaagaaatcgttaacggaatgttttgatacgaaatagaaaaaaaattcttagccagatttccaataattttttttttaattctagagtggtaaggccaccagaaaattttttagaattttgccctttttaaggttttttcaaaaattgccgattttgggtaaaatttaaaaaatgcttttcaggagtttcccattttcatttaaatttttcatttcgggaggaggcttaagccccctcagcccctccccctgcctacgcctttgataactgcaacatttctaagtataaaaatgctatatttttccccacagtgttgagccgctcactttgctctccgttctgatcgcggtccaactcgtgttcattgccagccactgggagaagtacaacacgggcgttctgttcctctcctggggctacgatgccagccaatatgtacggtacagtacagtacaaactgtccatgattttccggtttagaatacgaaaccaattcatttctttgtaacttgttttcgaggaaggtgcactacgccttccccccccccagaaatttttttatgagaaaatttacaagaaaaaaattcgaaaaattttttctatagcaatttttttttgcaaaatttgtgatgaattgctaacaaaaagttttttttcaaaaaattgttgaaatttttttcactttttttcttgtgattttcatcatttttttttagttttttaaaaaatttgggaggtagaactgattcggggggagggatgagctgcatacatgtacaaggggtgtcaaaattcaaaaattttcccggcggctatcggcccgcccgccccacccccttcctaaaagtttttttttggaaaaaacgcgtcgcaaaaaaggtactttgaatagcaaaaaaaaaaaaggtgtcgacgccggagaaaaatttggaccttcgtatggaaaatcggtcccgagacacctccccccctgtcccaatcgtctgtcgtatggcccttgggctgagacaccccttgtgcatgtatgcttctgatcagtactgttgtgatcactgggcgccttttccctttccctcattttcgctgtttttctcttccgtaccttccactaaaattgtgtctccgccccgccgttctctctccgcctcgtcgtcttccgtctcttcgtctccttccgcatttacagtaccctccatcgttgtttgaataccataccgccttttgaaattgttcagccaccgttccgagaattggcaccgctctttccctccctctgcttctctgtcctcccctctctgttcctcgtccattcgctctttttccctctctttttctttgtcctctttcatccgttttccattggcattctctgtacccactgttgtcaatttctttaccatttttcgtatccatttgttcgacgcgcattcccccgccgtcaattggtgctgcaccaat

SEQ ID NO: 47158 - DNA, 3900 bp, Heterodera glycines
  Genomic contig location: Contig_ID=SeqID_2084; Location=340..4239; Strand=-
  SCN-specific regions: Sequence locations=1-107,132-188,210-298,327 -410,502-535,557-2416,2438-2547,2569-3900
  Gene Ontology: Mol. function=voltage-gated chloride channel activity; Cellular component=membrane fraction; Biological process=transport
cctaagaatcgaccgaaaattttttcaaaaaatatacccttaagaatcgactcgaaaatttcaaaaatatacctatgaacaaagaaaaatttctcaaaaatcattccaaaatttatttgtttattttcttggcgagaattttttattttgaaaattatctatctcattaatgatttggcataatatttttgctttttgaagaaaattttcgattttacaccccaaattcggaactttttggctcctattttcccatttttagcacctattttgggggttttttagactgaagcattcgttttaaaaattaaattttcaaatatattcatttcttagggtggaaatttcgcatttcgcgccaaaaagcgaaatgcgaaaagcgaaacctcggcccatccctggaaagtatcctttttcttcactctctcttttttttgtcagtgtctctgtttttcactgttttttctctctccttcactctcttttttgatcactttctcttccataattttctgatcgttccctcccattttcacttcccccatttttcccttttcaccttcagaccgtgccattctgttcgactttgcccgtgattacgatgtgatgttggtatgtctctttcggcattcccttagtcccaattgccttttgctttcctttgtcgggattcgtctcttgggtcggctttcttgtcgtttttgtcggtgccgccgctttggtctgcaaatacgtctccgcccaagcgatcggtcgtttgctccgtccattttggcattacaatcgcccgcttttgttcagggtccggcatccccgagatcaaagtgatcatgaatgggttcatgctgcagaattacctctccttccgcactttggtcgccaaaatgctttctctgacgctcactttgggctcagggcttcccgttggcaaagaagtgggtggtctttgattcttcaatttcttggtaatgaaatgccaatgccaaagggtcccttcgttcacatgggcgccattgtcggcactttgctgtccaaagtgacgcgtgcctggcagagcagcgccttcttctccaacgaaggccgcgagttcgaaattctctcgtccggctgttccgtgggcattgcgtgcacctttagcagtccggcgggcggtgagtgccaccaaaatcggccgatgccaaagcgttaccgtaccccgtgtcaattggcagccgtcctttacggtatcgagtgcacccacaaatattttgctgtgaaaaattattggcgcgccttcttcgccaccacatgcgccgcgctgatcttccgcttcgccaacgcggtgatcattccgccgcacatcgcaggtgacgcggggaaggaacggatggacaatccatgacaaatgcggttaatttggaccattttgattgattgattgtttggaatgggcaagtgataagaccagtcacattggacggtctgccgatcgcaacttttgaggatgagtgatcagattattcacattggccagactcaatccggtcggcttttgcttaatcatctaacggatcactacggtcacattgattaggatgtcccatggatcacacacgtaatggggcttctggttttttgatcactttaggctgagtcactgatcagtccgttgatcagttgtttcataactctcttttccgttcctttaaggcaccatcactgcttactaccagaccagcttccccaatgaagtgtttctggtggaggaaatccccgtcttcggttagctttcgtccgcttttccctcccaaccccacggaaatgccttctcttgcagttttggttggccttctcagcggtcttttcggtgctttgtttgtcgtcgtccatcgtcgtattgcctatttcaaacggcgaaatcgcacttttcgtgccatttttggcaaaaagtctgtccatttgggtccgctttgtcccatctcccactatccttggcatttagctctatgtccttcaccattttcatggcactgattgttggtattgtcactttcccggatggttttggccgtttcattgccggaaaggcaatttttattagtgccttttgaccgcttggaaattagccgtccatttcagtacactttccgcgaaacgttgggcgatttcatctccaactgtaccatgactctgtacaatgtcacgtcgatgggctgcggtgggaaggtcatccaacggtggaccattgaggacctttgggaggaggagggtccccgcagaagtaattgcaacattttaccagcgtatcatgggaatcatttggataattggcctattacgttagttctttttcctttaccatactttgccgttacagaatccgttttggactccatcgacgaaagtaccgacaccaccgcttttatgtgtgcctttcttgcccaccccgcccccgcccaaattaatgccaatgttttccaagtttaggcccaaccctttccctgttctgttcggctatttgctggtcaatgttcgtctcttttgcctttccccctccctaatttgttcttccatttgtcagtttttcctcgtcgctatttgcataactttggcacttcccgccggcattttcgtcccctcttttgtcatcggcgcgtgcggcggacgaatcattggcgaattggtcgactaatgcgtgcgacgactgattatgttttggcactttttgttcagatggtcgttgtgtttcccgagggcattcgcggttcggacggcccccaaatttaccccggcctttacgccgtcgtcggtcagttctaaaaggcaaaatgcaactttgtaatgaacaattctctgctctggcattttcccaggcgccgccgcgtacaccggcgccgtgacgcattcgctttccattgcggtgatcgtctgcgagaccaccggtcagttgtgcgcccttctgcccgtcctcgtcgctttaatggtccgttccgatcgcttgaggaaaattgatcaaagggtggcggtggcaaagctacaccgaatgtccccagttaaggtggcaaatgcggtcagttcatttctccagccgagcatttacgagtccatcatcaacatccgaaagttgccccatttggccgaattgcccccctctcggattaggtgtgccgtggcattgcttttgcaacttttaatttgcttttttccctttttcagtgtccacactttgaaggttgaacaggtggacaacaattgaaacagcttatctgtggaaaattgtaatgacattttgccattttagattatggtccgtgacgttgtgttcgtcaccaaactgaccacttacaaagagttgcgcgagttgctcatttgcacaccgcacctccgctcctacccattggtcaccgacgaaggcaatgccaaatcagtcccatcagaacactaattgttactaatccaattcaaatcatgcctgatctgaccattgtttgatcaatatattgacttttatgctgggtaattgattaggtgtgaccaaatttaaaattgattgtgagctgatcagattcattattctgatcacttaaccgtccaacttaacattgctcactttgaatgcctaaaattaagaggagcgcattttgttgggctccgtggcgcgcaaatatctgcactatctgctgaccagtcacctcgggcccgacccggcacttcttttgcacgggagcagacggcgcaaaagtcggacaatgagcggcttctccgagggcactttccatcgcaatcccacgccgaataacacattggctacgactgcggtgccggcaaattataaaatgtcgatgatcaatgatcggaatttgtttggcaacactttgctgtccatcagtccgttgcacgacgaccaaagcagtgagttgg

SEQ ID NO: 47159 - DNA, 2178 bp, Heterodera glycines
  Genomic contig location: Contig_ID=SeqID_13835; Location=1220..3397; Strand=-
  SCN-specific regions: Sequence locations=1-11,51-234,261-652,676 -1137,1159-1471,1493-1782,1804-1836,1859-2178
  Gene Ontology: Mol. function=transcription co-repressor activity; Cellular component=26S proteasome; Biological process=embryonic cleavage
atgtcattgaacttttggatcttgaagagcaacaggaagaggaaggagcaaacattgaccttgatgcccacaaaaccaaagtgtgccgtcatcaaaacatccacgcgtgccacttactttctgcccgttgttggtcttgtggacccggaagaaatgaaaccgtccgatttggttggcgttaacaaggactcttatctcatcctggaaaaactgccacccgagtacgactcacgcgtgaaggccatggaagtggacgagcgtccgaaagaaacgtactcagacattggcggatgcgatagtcaaatcagagaattggttgaagcaattgtaagccgaatttcacatgccgtatcaacacaattactttttaaggttcttccgatgactaaaaaagatctcttcataaacattggcattcagccgcctaagggcgttcttatgtatggaccaccaggtgttgtctatttgttgttcgaaatttaaagccaatttccaaggtacgggtaaaacgatgttggcacgtgccgttgccgctcaaaccaagtccacttttctgaagctggctggtccgcaacttgtccaaatgttcatcggagacggcgccaaattggttcgagatgcttttgcactggccaaagagaaagcaccgtccattattttcattgacgaattggacgcaattggtagtgcattttgacaattatctaacttgggcatttttctattcagggacaaaacgattcagttcggagaaggccggcgatagggaagtgcagcgaacgatgttggaattgcttaaccaactcgacggcttccagccaaatgacgacataaaagtgggtggcgaataatgaggagaatttgtcgatttcgatttgatttttcaggttattgctgcgacaaaccgtgtcgatgtgctcgacccggctctgctccgttccggcagattggaccgcaaaattgaactgccagcgccaaacgagaaggcccgggcgcacatcgtccgcattcactcccggaatatgaacgttgagtaagttgttacgactcggaaccaatcgaatgccatttttgcagtaaggatgttaatttcgatgagttggcacgttgtaccgacgattttaatggtgctcaatgcaaagctgtttgtgtggaggcggtgggaccaattttttttaagaccttttactgcttcgattatcagggtatgatcgcgcttcgtcgtgaatctcacatcattctgcacgaagattttatggacgctatccttgaggttaattgccgcttaaattttgattggtaccagaaaaaatttaggtgcaagccaagaagaaaacgagtctgaattattatgcctgatcctttgtccgaacctgccctaaatggcgaaatataattgtttttttttgtgatttggcgaaaatgaatttgataaagcgtttaattattttacaaacagaaaattatacacaaatatttgctttttaaaaaacataagaagattttggaactggccttttgtattcgtccgttagtttttgtctgcattttgtaagcaatgcttttgaacagcagttcgcttgtctcattaatttcggataaaaattatgagcggagaatccacggctatgtcagtgttcttcaggtgcgttttgtggtcggtttaccattaaattttattccctttttaattaggacgagcgatggcgcagattatacgccgttttgaaggccaatttgttatttttatttgagtcgtccgaacgccttgaaatccccgtgctgttaattgtaatggaagactttgtggtcgaattggccgatgacaatacgatgggaaggcaaaattcgttctccatcaaattcaacacgtaatttggagaaggggcacaaataatcattggaatttcctcttttaaattctcatttttttcagcaccggccacaattacataatggcggccaccgattatgacgctttgcagaattggatttctgttttgacttcgtgctcatttgagtttatggaggcgacacgacagtcgctagagagtgtagaggaaaagggtacggaaaaagaagaaaaggaaggggagaagagcgaagagagcacggaaaagggcgggacagagaaaaatgactgatcacaacattggcacatctgtgcttaaaattaaa

SEQ ID NO: 47160 - DNA, 2493 bp, Heterodera glycines
  Genomic contig location: Contig_ID=SeqID_2087; Location=600..3092; Strand=-
  SCN-specific regions: Sequence locations=1-222,256-362,385-567,594 -691,725-733,756-1140,1162-1505,1572-1572,1603-1677,1705-2127,2155 -2170,2200-2443,2466-2493
ggacggctcctgctattggacgtatacgcttgagcaggtgctatcaccaacaccgccgccctcgccaccgctaccaacagccgttgaagggacgccgcagcagcaaaacggaccggtgccaattggtgagaagctgacgacggacaacaacaacgaacgccaaattggacaacagcaaattcttctcggccaaacattcgattgggcacaattcaaagtgagtggaaaattgggggaaataaatgaaaatgaaacatttttcgaaaacgggtttgcgatctggaaatttttgctcgatttggaaaagcgcagtaaaaaattaaaaattttgtcgtccaaccaaaattcttcactgctgtgtcaaaattttaaatattaaaatttcttcttaaaattcatccagaaaatcgctcatttttttgaaaaatttgtaaaaaatagaaaattccctccccgttttgtcagaatcgtctcgcgttggatcgctgcgtgtgcatgggccacagttttggcgccgcctcgtcgctgtccgcatgtgccgaatatccgtcgctgttcaacgcctgtgtgctgctcgacgcctggctgtacccggtggaacgacgaatgtatccggcgactgtgcaggtgtgtgaaatgcgattttttggaaaaaaattttgaggaacggcggaagggtgccgataggcgccactggaaatttttaattttgttaaatttgttcaaattcaaaatttgtcttctttccccccttcatcggcacacacacccaatgggattcgaacccgcgccaataaaacccatttttgtgcaaaaaataaatttggcccgtttccagaaaatttcgggttttttttttttgctcatcacctttccccacttttttagcccgtgctgatgctcaacgccagcaaatggcaatggccacacaatgtgcgacgaatgcagcgactgttagcgaaggcgaccactgccaccaatgacgacaaaacagcaacggagacgacaacaacgacggcaccgcagcaacagtcgcaggacggcgccgcaacgacagcagcaactgcacagccgagtgtcaccaacacggacagccgaatgatgttcacgataaagtgagtggtcgaagaagcggtgggaaaagcaaaaatatacatattttcttggttagaaacaaaaaattttctgttatttttaatttttttgctaccctgttctttgcaaattggtccgtgtaaaaacaaagaattcacccactctttttggcattccccgaattgcttgctcatatttatttgaacatttgtttcctttgcaggggcattgtgcaccaatcgttcagcgactttggcttcctggtgcctggccgtgtcgcccgttacatcggcgttcagagcgacttggacccgctgttgaccggcacagccgtattcgagatggttctgcagttcttggagtcgcaatttctgcaccagcaacaacagaaggaggacgaggaggacacggaagatgaagaaggagaagaagacgagtcggaagaggaagaaaaggaagaggaaggagagaaggagtcaaaagagagggaggaggagggcaaagcgatgtgcggactgagcaaggggagcaggacgaagtggcgagaaggtgaaaaacggcattacctttaatttggagttcattatgtttcctccccaccccccgaaaaaatcaacaaattttcaaacttaagagaatttttcggaaaaaaacaaaaaaaaaatttccagcgatttcttgaaaaaatttagtaatgcatcataaaagtaaaaaaatcactgaaaaattttcgtttttttgaaattttattagaaaaaaattttcgggcgggaaacgagctctgctctccctaatttgtaaggtggagggggagtttgaatccaaaactaacaatttttgatacaatttgaccaataatatgggaaatccatgcattttgtcaaattttccccaaatttacagcaatgcctccgcgttggaccgtttgcgtcgtttggtggcggagaaatacgcggcttttgtggtggaagggacggacattccgcaggtgaattggggtcgtgggcatattggatggccatttggggcgcctttaacaattttggaaaaattgttttcacactaacatgttttcaaaaaataaaaaatattttttcttaatttccccaccttttattaatgtttttttattttcgccgaaaattttaagaaattgcaatttttcaccgtctaaacactgtgccctaattcaggccaaattggacgaggtggccccccttgtggaagcggaacaacagcaggcggtgtccgcggaggaggagcgcaaagtggccaatgacagcggcgtggacacaccgccgacgactgagacaacgacggaggaggcggccgagaataataatcagcccagtatttaaagaatgaagtgccaacagtgtgatattgaattcaaataaa

SEQ ID NO: 47161 - DNA, 1088 bp, Heterodera glycines
  Genomic contig location: Contig_ID=SeqID_13839; Location=1..1088; Strand=+
  SCN-specific regions: Sequence locations=1-162,184-576,598-607,630 -973,995-1088
  Gene Ontology: Mol. function=DNA binding; Cellular component=nucleus; Biological process=DNA replication
attttatttttgttcgagttcgggtcaggggttcgatattggcaaaaatgggtgctatattcgtgatcagcgaccttgaaaaccccttaaaacttattttcattaatttctaaaacacatttataggaatctgaaaatgtatgtttaaaataccctgtaaacttaaaaagtacccatttttctcatacaaatcccaaattggggcattttctcatccaaatccatagtttcgacatttttctcctccgattcctgcatttttcacatccaaatcccgaattcctgcatttttcacatccaaatcccgaattcctgcatttttcacatccaaatcccgaattttttttgtctcttcccttgcggcaacactgttgttttggcacccatcgcaggtgttgcgcaaagggtccggcacactgtgcgaggcgttgctgatggtgcaggcgcagcgcagcaacatcattttccccaacaaacagacggccaaggagcagcggatgaccgacgccggacacttgattctcagcgatacatacgtggtgagagttgacaaatgatgagcaaaacgagccgaggaatgggaggggggacctgaaaagcgaaaaactaaattaaaaattttcgtcccattcggtgcttggacattactcaaaaaccatcaaaaagggcattgttcagaaaaccatcaaatggaaaatttttgacaaaaaactcttcattaccttgcttaagggtaaccaaatttttaaaaactcttggtatcattcgatagctttaagtgttctttattagcctgcaaattttcaaaaatgttcgttaactttcaaaaagttatggctagaggaaccaaaaaaaaacaaaacaggtttttcgaacatttttgggaacttacaattagctaaattttttgaaatttggcgaacaattgaaaatattaataacaccgaaacatccttcgggcagtgcataaaattgaaaattgctttccttaaaagggtggccatgtggaggcggtggagtcgggcgtgttccgagcggacatcccatgccgattcaagctggacgtggaggcattggcccaactcgtg

SEQ ID NO: 47162 - DNA, 1716 bp, Heterodera glycines
  Genomic contig location: Contig_ID=SeqID_13850; Location=775..2490; Strand=+
  SCN-specific regions: Sequence locations=1-190,212-213,241-516,538 -546,572-690,712-726,748-859,888-1545,1567-1716
ataagaaacaacaatttgattttggtaaaagcgaacagaaacaatgaccacgcaactaaaggtaattgattggattcaaaaagatggaaaattaactttttacatagattttgaaaagattatgctggataattcctcacaaacagcggaacgcattaatagccatattaacaaacatttaacttctcatgaaaatgaagaaagtgacacttcggaggacgaagaggaggaggaggaggaccaaggggacagcgatgtcagtgaagaaaggtgggattggacatatttcaggaagggacttagggattttggaaaatgcaatttatgggttaaattcggatatttaagcctgtgaaatataggaaccctgaagatctgatcaactctgagctttctgcggttaaattgcccgactctgagcagcagcgaccggacgacgccgtgtcgattataaacagtgcattcagcaacagaaaatcgttcagctgtccaaaaactaaaagcgaccttctaaccggtataaaaattaaaatatttgtccaaaaattcattcaataaaatgacttcaaatgaaggcacttcgacggcaaatttaagtcccgaggacattggcattatcgcatcaatgggcgactcattggccaccggtgccgggctttggccgcggacggacatcgaattccgcggtgccgcctttcccattgggggtgatgcgacaattggtgggaaagaaaacaaatattgaatcattcattgttgccctaaggaagatacaaataaatataaattattagcccattaaaaaacgatttggtcaagaattggtagattttgggcaataagaaaattattttttacttaatcctgtaaaaaataataaaatttcacaaacttgccaaattaatgttcaaaatgggctgaatgataatactttttcggattgtttggctaattataaggtagttgcttcttttttaaagcttcgcttgcattatttcctaatatatttcattcataaaagatggtctcgtcaccgtccccaacattctgcgcgagttcatcgactccaatttgctcttcggagtttctcacggaatgggccaacgcgaccaattgcccgaaaaccaactgaatgtggcagtcagtggggcgagcagttcttcgatgcctggacaggtccaagttgacgacgcaccgtgttttatatggaattcttccgtgtttaggccgtcgaattggtgagacggatgaagcgacttcgggaattggatgtgttcaacacttgggctttgattattgtcaccattggaaccgaagaggtgggtaaaattagccatttttgcaaaaaaaaaaaagaattagattttcaaaaggtctgcaaaaattgcacgggtccaaatacaaaggcactcgtccaggcattggacattttgaaccgtgggattcacaaagcactggtgattttgttgggtattagtgccattcactgcaatttagacattttgaaaatgactttcaggcccaattcacgtcacttcgctgtaccaacaaaagttcaatttgctcaagtccgtttaaatattttattgtcttttttgaatttttccaaggttttttaaggacgcgttgtttatgctctcagaataaagacgacaaatttatgagtgcactgagcgaagaatgggtaaaggcatttgaggagattcagacgcacat

SEQ ID NO: 47163 - DNA, 1208 bp, Heterodera glycines
  Genomic contig location: Contig_ID=SeqID_13851; Location=561..1768; Strand=+
  SCN-specific regions: Sequence locations=1-504,527-1208
atgacttgcctacaaaaaatcagcgacagcagtcctctagcaattaacagtggcctaaacattttctcagttccaccgaccaatgtgtccgttgttcgctcattctttcgtcaggtgcttccactcgcaacaatcacgcaagaatcgccttacctatttcggctttacagtgacaatttgtggactgatttatctcggatatatctttatctcgaactgtccattgaaaaaccgggagcaaacgataaatgggttgcgatagaggacgcggatactagtgtctctgccattcaagggattggtcaaacatttgtccagcaactaaaagttacggttggcaacacggaagtatacgatagcggaaacctatacccattcaaggcctatatcaccaatgagttaagctttccaataaatgccaagaaaaattttcttggttcaacagggtattatcacaccgtaaaccaagatgactcaacagacgaggggttcaaagagcgttgtaaaattttttaagggtggaaaaaatgcgcaatttttctcccgtctcgactttgatttgggaaaccaagagctttatctcttaaataatttggacttgctcttcacaatttacaaggccaaagatgtctttcttttgcaaacattaaaagcaaatgattccaccaaatatcgtttgacagttcacgatgtcaagatttatgccaaacgaatttgagtacaatgtattcagcgcaaccattcctcgacgtgtgacaatagcgttggttggcaattcagcatttcatggtgactacaaactgagtcccttcatgtttgaaccgtttgatttgcgtgagatttcggtacatgctggtggcgtagtttacccagctgttccttataaactaaatttttcaaatgatcactttgtcacagcctttgttgacatgtatgaggcactcggaatggctaactctgaacgttcatttgacatttcaatggcccagttcaaaaaagggtggaccttttttgtcattcgaatgacatccacgcttgacgacagctgtggatttgagctgttgagaagcggtacgacaaacgtacgagcaacattcaattcaccaattccgcttggtggtgtagagatgattgtcttgggtgaattcgaccaaatgattatggttgattataaccggcacattgttaccgattcaaagcttggataa

SEQ ID NO: 47164 - DNA, 796 bp, Heterodera glycines
  Genomic contig location: Contig_ID=SeqID_13855; Location=632..1427; Strand=-
  SCN-specific regions: Sequence locations=1-606,638-693,718-733,776-796
  Gene Ontology: Mol. function=transcriptional elongation regulator activity; Cellular component=nucleus; Biological process=locomotory behavior
catgggacagtgctcacaaaaatccaaagtggagagggcaaagtttgaaatgaaaggcgaattcgaccgacccaaaaagcgaaggcgtctcaccggggcacagaaaaagcgcttcttcgaaaaacagcaaaagtaacaaaaaatcgataaaacgcaaaaagaaaaaatttgtaaaagaaatcaatcaaatgcaacgttttaaggattttcgagtggaagccggaaaaaccgcggaactatcggccgccctgcgagtgcactttggtacttcgcggaatgttcaatttggaggaaattgacgcgaacgcacagcgaattttcacgcttaaagaggcaaatttccgttggatttgaggaggaataatgccaaaggattaaggacactcaaaaactatgcgaacgctttgggccggtgaaaaaagtgacggtttacgatgtgagcagaaaatatcaaatcgaaccaaaacgaaagttaattccattttcagaccaatccggacggagttgtgacggtcacttttgacaacgtcgaacacactgacgccgctgttcaagcaatcgacggacgaattgtggctgggcgtgttgtgcaggtaaccgacggccaaataaatttaaattacaaaatacattttacgtatttaaggctaaacactgggacggtaaagaaaagtttaaaagggctgaaactgcgcaagagaaagagagaagggaaaacgcatgggaagaatttttgggaaacgatgaagatgaaaaggaaatggaggaggacaaaaaggaaacggaggaggacaaa

SEQ ID NO: 47165 - DNA, 1200 bp, Heterodera glycines
  Genomic contig location: Contig_ID=SeqID_13864; Location=254..1453; Strand=+
  SCN-specific regions: Sequence locations=1-232,254-355,392-637,659 -857,879-1200
atggcatttcgcgcactttctttcgcccgtcgtccgtttacaacttcgtccatttgccgtaaagaaattgacctggtcgccggtgtttatctgaacaaagttcgggaagtggttggcaaacaaaggttcgttattatgtaaaaagtgggttctaatcgacttctgggagtctaatcaatgaccgtcatcagtttctttgaccattaatcttttcttatccagtcaatgcttgcttacatttttgggcataaaacggaagcttaaagcctacggaatttgtttttttataactaaattatgggctaataacactagacaaaaagttgaaaatttggtgttttctcattgtaacttctttcttgatttcaactttttctctcttcttttatttataaattcaagagactataagctttagtttgataccaataatgtatactttgtcaaagtaaaaaaatttatggccacaaaaacaggatggttattgtttggacgtaaaaaggtagtcggagaatggacctttttttgcaaatttcaattgaaaaaggaataacctggaactgggttttttttatactgcctaggacctgcattttttacacaaaaacccaagaaaatccagccgaactgggctgacaatgaacctggaaccagaagaattctgttttggatccagacccgccgaattttggtttttggcggaaaaaaccaattgtctccacccccctcaagcgggccttgattttttttttttttgtaaattttcgaatccctttacaaaattaattgtttcatgtttcagtgagattctcaattcgcctcagttgaagaaggagttgaacgaccaactgaaccgtttggcccaaaaattccatttgccggatgccgacgcggttgccaagttgggccttcagtttaaggttcgttggtacctcggcgacttagagacaaagacttttgaacaaatcgggatcgtttactgatccctgcctttatcaaaatagtcgggatcggggtctcgatacccccccccccgacttttgtcgaatatttccaacaaatttttgcatttttgaaaaattcgttttttattggtttttacttttcatctagtaccagggtggctatattataggaaatacggtaagtgccaaattttaggttttctcgggtttggggggacgtcgacctactctcgaa

SEQ ID NO: 47166 - DNA, 1327 bp, Heterodera glycines
  Genomic contig location: Contig_ID=SeqID_13880; Location=1..1327; Strand=-
  SCN-specific regions: Sequence locations=1-143,166-220,243-348,373 -583,606-634,656-840,869-962,986-1299,1323-1327
  Gene Ontology: Mol. function=aminopeptidase activity; Cellular component=cytosol
ttcaggggtggcgggatgcaaaaccctgacttttgatgccgcatttaattgttttaaaaacgccatccttttaggcgccatggaaaattggggtctgatcaccgcgcgggagagcagcgttctgtacgacccggcaaagagttcctcctcccacagacagtggctgaccacagtgatgtcgcacgaagtggcccacttttggttcggtaacctcgtgacaatggtcagtcagtcaatccgttggggggggggagagaatttttctcgaaaaaaggggacaaatgggcgacaatccgagattttttgggatataactcctttaataattgtccgaattgaaccaaattgtttaaaaatatttttaaattttttgagaatgctttaatttattggaaatatttcttgaaatctcttaaggagtaacattgaatgaatttattttttatttgagttttttttgcatttttgctccctcaactcacccctgctgaaatttttataagtaaatttcaagaaaaaaaagtttaattttttttatggtcaatttttgacaattcatcaaaaaaattttgtcaaaaattggtaaaaattttttttttaattttcattttgttgttgtacatcatatctaattattgtatataataaaataatctatttttcgtcgtgttcagaagtggtggcaggacctttggctgaaggagggcttcgcctgcttcatggagtctctgttcaccgccaaaaaataccccgagttcaaagtgtggtccacctttgtggacaacacggtggtccgagccatgggcatggattcattgcgcaattcgcacccaatcgaggtaaattttcaaaaaaaaattttttttttgttgttacgaacctgaaaaaacttgttttccaaataattttgtatacaaacagagaaatttgccaattcggaaaatgcggccacctaaaatgacttaaaaaaaaaaaatttttttttccaattaatttttgcccttttttattgaaaggtgcccatcgaaaatccgaacgaacttgacgagatttacgacgaggtcacctacgagaagtcctgctcggtgctgcgcatgttgttcaactacttgggcgagtccaccttccaaaaggcactgcgcgcctatctgaagaagcaccaatacgccaacgcggacactgacgacctgtggcactgcatgagcgaggcttcggacggcacagtgcgtttttcaaaaaacccgctagaaaattatcagaattttttttccttgaaattttaacacaaaaaatttgaacttaaaattataaatttaaaaaaactgga

SEQ ID NO: 47167 - DNA, 519 bp, Heterodera glycines
  Genomic contig location: Contig_ID=SeqID_13893; Location=536..1054; Strand=+
  SCN-specific regions: Sequence locations=1-236,258-519
  Gene Ontology: Cellular component=mitochondrion
tctctccatgaacaccactgaaatcgaccgacatttacccactgcgatgactttgcttcaacctttcgacggcgtccctttccgcgaattgcccgtcgttcacatcaaagcgtcgtccaacaacacaatcattcacgcgttcaatttcattacggtttcgcctcgccttttctccttcaaagcttcgctcccttcagaagagggccattatctatacttcgtgccgcaaggagggatttaaaaacaccaaaaagaagtcgccgttggccggccaaacgacgggcgtagcggcaggtcaaaagctgttgaggcgaggcgtttcgactgtccgcgtgatcattaagggcattgggccgggacggatcagttcggtgaggggattggcgttggctggtgtaaatgtagtttcggtgagtgtggtggcatttggccaaatcttcggaggaatgtctttttcagatttcggatgtgacgccaatccccgaattggggcctcggcctaagaaaatccgaagggtg

SEQ ID NO: 47168 - DNA, 2748 bp, Heterodera glycines
  Genomic contig location: Contig_ID=SeqID_2098; Location=62..2809; Strand=+
  SCN-specific regions: Sequence locations=1-333,356-558,604-658,681 -818,872-942,964-1659,1681-1716,1739-1804,1826-2748
atgcactcgtcctcatttacgctgccgttgcgcagcaacaatagcaacagcggcggcggaagcataatgaatttgcaccagacatcgggcagcgaggacttcggcacgcgacggagtgccatcaccgccggctccgcggggggaggcggcggaagcagacagataagcgttggcagtgccgggggcccaacaatcagcggcacgtcgacaatcagtgccggaagcggaatgaccaccatcggacggaagggcattttctttgcgcgggtaaaaaggacaaaaaaaaattaatgatttaattgagtcactccttttgctttggctattaaccaattaattaattatttgtttaatttcaggaaaaattgactttcgcccatttggaaaaaatttatgcgcaagcgatcgcaaatcgcagcaacgatttgagcattttggagttggaagcacattggacaaattttgtgcacatcaacaaactgttgaacaaaagacagagcgatcagcaagaagcaatttgggagattattgtaattaatgcaaaatgaatgaaaaacgaaaataataattaaaaaataatttttaatcgaatttaatttaattccagacaaccgaacgccgttacattttgcagctgcaaagtttggaggacatggagtggtgctttgtggagctgcaaaagcaaggctttatgcgtgatgtgaatcggcagtgtgtgttcctgaattattcacagcttttgcgttgcaacttggcattttggcaatgtgccattgtgccaatgctggagcgatcgcggtgtgcatttaggaggagggaaaattaaagaaattattaaagacgggaaaagtgtttaataactcttcattttattacctaaaatcggtgatactgtctgctgggctttagccaataggaaaagcataaaaagctgtgcccataaaacgaaatcacaaaattggcaaattcaggcaaagccatgagccgctgaacgcgctgctgatgcagcccgggttcgactccatcccggactggtccttctgctacatcgacttcaacattggtcacgcggacagtcacgcgtatgtgcagaagcggcagaaggacaacgaagtgttcgcggagtttgttaaatgggcggagcagcacacgatgctgaaccggcagaagctagtggacgtgctcagctcgccgatgcaacggatgacgcgctattcgctgctgctgaaggcggtccaacgctgcgcggcggacacggaggagaaaatcggcattcaggtacggtttgtacttctttggcacaactttgcccatttcatcccctcagggcatgatagaatgcgcggagacggccacaattcggttgaattacgagctgaacaacaacgacttgcgcctccaattgtccgagatcatgaagaccatcgagagttacgacgtggtggacagcgacgagttcgaacggcttttccctttgcccacggcgccggcgcccgtccaacagttggcccagcagagcaaccagcaccaacaattgctggccgctatgagccgtccgccgccccacttcaacctgatgctgccaatgccgttcatcggcgggcagccccggttcaggcggatgtacacgcggggcgacctgaaaatgcgcgagggccgacagagtcccaaggtgggacagcgccgtagggcagccattaggggcaattaattaataagtccattggtacaaagccatttgcccagcatttgaacgcgctgaatttcatggaaaaatatttttccattacagcaagaagtgcattgcattttgttcacggacatgctgctcatttgtcgaatggtctcccgaagaaatgaccgactccgtgtcaccaaacccccaatgcacatctccaacctccgtttccaccacttcagcgaaggaagtgggcatttatcatttatccactcacttaaatgctccttaattagcttccacttggtttaattgcctaattatctctccccgttttctttattaatcctaattaatcttaatttacttgtctcatttcccaaaaaaggcggcttctacttgatttgcatgaacgagttcgaatcgccgtcccaatttctgttgatgttcaccgcaagtgttgaggaaacgaggcgctggttggaaatgatggtgatggcacaggaggaatttcgctccctgcgcacagccaatgcgcagaacaacagctattattatggtaagcccaagtgattaacattaattcattattggttaagcctcgagaaaagcctctagggcttttgagtcagtctcgactcattcattcccgagtttcggataatttccattttttattggcatattattatatattctcgagtctcgagataactttctcatgcatcgtttgtaaaagcaatcaatggcattcagcagaaggctgtttcggaagcgttgaacggctcgtggcgcaaccgccgagttgcaacaaatgctgtggtggtggtggtcacaatgctacacaccgaaatgccaccagcgtcgacatttgtgcatcgcatttgcgacggggcgaaacgctgcgcacaatgcccgtccatcagaaacaattggcacaaaaaaatacagcattggcacagtgcaaagggtgtgccgaagcggggccgaacaacggcgattttgagggggtggtccatcggaagagcagaagcatggactcacaggtggccatttggggtgctgtatag

SEQ ID NO: 47169 - DNA, 868 bp, Heterodera glycines
  Genomic contig location: Contig_ID=SeqID_13894; Location=235..1102; Strand=-
  SCN-specific regions: Sequence locations=1-284,306-516,540-770,793-845
  Gene Ontology: Mol. function=protein serine/threonine kinase activity; Cellular component=spindle; Biological process=chromosome condensation
atgaagcagccagaaccaataattaacaaagaaaatcttcgcccagccaatcagccaagcaataaaatgcatgaaggaataaattattcggagttcggaaaggaatggaagtaggtgatctttaactaaccttgtaataaattaacactagcgaaaaacaatggaccctttctgactttgacattggacgtccgctcggcaaaggaaaattcggaaatgtttatttggcgcgcgaccgaaagtatcgcattccggtggcgcttaaggtaagagaaaacatattttaacacaaaatggatgaaaaaatcctttgagaacagttccatggatttgcagttaatttgtctttgggcatgtgccatttattgcactttttccctcagattctcttcaaatctcagctggtcaaagggaatgtggagcaccaattggtccgtgagatagaaattcatgcccacctcaggtgagttcatttcttttgttagctgaggtcactaaccctctctgagctgatcactttttgaaaaaatggttattattatgtatcatggcctggttttttgcggaagcaagaaatctttgctgttctttcagacacccgaacattttgcggatgttcaactattttcacgacgataagaaagtgtacctcatattggagtacgctcttcatggcgaattgttcaaagttttgcaaaaaagtcgtcggttctctgagtcaacttctgcccaggtaatcacaccgaagctgttcattgtcagttatgttcttctgtctgttttctattcattgtttcagtacatctttcaagtgtccgatgcgctcaattattgtcactcaaaaaaggtcatccatcgtgacatcaaa

SEQ ID NO: 47170 - DNA, 2461 bp, Heterodera glycines
  misc_feature (2433)..(2433): n is a, c, g, or t
  misc_feature (2461)..(2461): n is a, c, g, or t
  Genomic contig location: Contig_ID=SeqID_2101; Location=1508..3968; Strand=-
  SCN-specific regions: Sequence locations=1-1335,1387-1827,1850-2461
  Gene Ontology: Mol. function=protein binding; Biological process =activation of JUNKK
atggaaaatcaaagcaacaagggattgttcgcaatatttggactgtttttaatgcgtttttcgctccctttccaggccaaactcgagcgcgtgttcggcacccccgcatgctccagctccttgtcggtcgaccccatttccggcctcgtcgcttaccctgccggttccattgttgtggtgctcaacccgcgaacactttctcaagcgcatttggtctgtgccagcaaaaatcaggtggttgaattattgtaatttaagcacaaattttttctcgaaaatctcaaaaaaagagggaaaatcttcaaaaaaatccagcggcgcatatcggcatctccggactcctttttcctaattttttttttttttttgaaaagccgtaataaaaaggcgtgaaaagcaaaaaataccccgcatgccgaaatcctaggaccgtcccttgaaaataaatattcaaaaataaattcgaatttaaaattgatgaaaatgttttcatggtttcttttatttatcatggttccttgtgttttttctttttgtagcaaaaaatgctttaaattgtatggtttttaattcaagcaattactttcagctgaccagtttggccttttcgcccaatgggcgttacattgtcaccggagaatttggtggtgacccaaaagtgcgtgtgtgggaattacggcacgagaagcacacgcacggggagcaacgagttgaattggaaggccatcggcttggcatcagttgcgtggtcagtttaaaagaaattttataataaaaatcgtgcattctacggattcgtcactaatttaatgtttcagagcttcacaaaggattccgaccaggtcatctctattggcaatcagcacgacaagtccgtttgcgtgtgggattggcggacgagaaaaaaattggccgaaaccagactgacttgtcaggtggggaacattcaccttttgtttacaaaatgtaccaacaaacatcacctcctttgccaggttaatgcgatggatgtgagtgaatcggggcggatgttcgtcaccgtcggtgtgcggcacgtcaaattttggtatttgggaagcaattccaacggtgaaaacggcagcgccggtgttgttttgcacggtcggtccgccatcctcgccgaccaacgcaacaacactttcgtggacgtttgctgtgcctcgaacaatcgaaccttctcaattacggtgagcggacgaaataaaaaaacatggcaattttattcaattgcagatctcaaagttactggttgaatttgttgataagaagcttacgaatatttatgagctcggcggtgaggtataaaatatacacttttatttttaatcttaaaactttaaaaaaaattttttttgtttatttttaggtgcctttctcattgtcaattggcgcctctcaccaattgttcatgggtttcggaaatggtgcaatccgtgccatgaatttggaacgaatggagcccgaacttgagttgtgccgtcctcatgccttacattgtgacatttgtgcgatgggcgatggcacggggacggaagaaaaccaagcgaaaaagtgggagtgattttgttgacagggcttagagtgcattccccaaaaattcattttttgaaaaagcaaaaaaaaaaaagaccttcggttccagctctcagatttttttggatacgggcttgcttagtttattaataaatactttttttgattatatcaattgttgcatttttcagattcccggatgtccattcaattgtcttccattctcattccaaaacactcactgctctctacaggtattctcaaaaattccataaaaatctgctttgcaatttgcgattgatcttgtaaattatttatcacaatacaacaaattgatcgtgttcagtgatcgttccatttaccattggtctgtccaaaacgcgtcttccaaaacgaaggtcttcaaaataaagttggtcatttgtcttttcgcaatgagttttccttcattttcttttttctgttcagttcccaacttttccatgttggccctgtgttcgatattgaggtgaatatcaaatagatttttacgaatttctctaaaattcccattttaggtctctaaatcacagccccaactgtttttcaccgccggagccgacgaaactgtccgcatttggtgcatgaacaacagtgacaccgccacggcacattcagtgacgacggtaacggacagcaacgggtcgccttcgcctcccattttggacattgggccgcccaatcatttctcattggaattgcgcaaaattttataccttaatccgggcactgacacgctcagcgaacagccggacagtgagtttatttaatctaattaacataattattccgtgactcatttacagaaaattttggcggcattatgtcggacaccctcgnactccactacgggagtgcgttgcattan

SEQ ID NO: 47171 - DNA, 1843 bp, Heterodera glycines
  Genomic contig location: Contig_ID=SeqID_13913; Location=1059..2901; Strand=+
  SCN-specific regions: Sequence locations=1-421,443-642,664-747,769 -1843
  Gene Ontology: Mol. function=protein binding; Cellular component =nucleus; Biological process=positive regulation of growth rate
atgcctcgcatttggatcgactattgcatgttgatgattcgtcgtggccaaataacggaaacgcgtcgcgtgttcgaccgtgccattcgtgcacttccaataacccaacatatgcgcatttggcccctgtatattgactttgccacacgacacaacgttcccgagacagccattcgcgtgtaccgtcgctttctgaaggtataccccggcgggcgagaagactttgtggagtatttgaaaagtatcgacaaattggacgaagcggcacaacagttggtcatcttggtgaacgaagacagaccgatcagcgagaagggcaagactggccaccaggtcgaataaatttttatatttaggcccgtatccaggggagatgaggggcgcgcactcccattcctaaaatgaaaatatttttttttagaagaaaatgcagttttgaaattttcagccattttcttaataaatatctcgttaaacatgactaattcctttaaaatggtaagaattttaaactaaaaagatagccatttagtcgttctgtaaaaaatggtgctacttttaattttggacaaattacgctgaaaaaaaaattgtgagactgaagagcgaaaacaaaacaaacttttcgtccgttggtgcctcctcaaaaattattttctgaatacgggcgacacgtttataaaatatcgatactttacaatgtgcagttacttttagctttggactgagctgtgtgatttgatctccaaaaacccaaataaaattttcacgcttcgcgtcgagccgatcattcgccaagggatcggccgttacactgaccaagtgggcggactttggctggcactcgctgagtattatattcgaatgccgaactttgagaaggtcatcatcaatttggccaacaaataataattggtttcatttaggctcgtgacatcttcgaagaagcattgggtgtggtgaagacagtccgcgacttcacccaattgtttgacgcctattcaaaattcatggaacgactgacctcactgaaaatggacgcgttgtcctccgcccggccaacccaagttgatgagcgcgagttggagttggaattggttatgacacgctttgagcatctgatgaaccgacggccattgcttctgaacagtgtgttgctgcgccaaaacccgcataatgtgcacgaatgggtgaaccgagtgcaaatttacgagggcgaccccgaaaatgtaagaaattggcgtatgggaaaattgaaaaacatcgaaggaaatggcatcaaaaacaaaaaaaaaagaagttattattttatttgactcttgcgccaaattccaaagctctcaaaatttggtctgttttagtcattattttaattcatttttacaatcattatattttaaaaacatttcgttgtattttttttctcttgctgctgaatttgtgttaaataatcctagcggaattattttagcaaattgcaactttcgaaaaagcggtggctaccgtggacccgaagcaacaagtcggccgactcggtcagctgtggattgagtttggcaagctgtacgaaaagttagacaaattggacgaggcacggaaggtgttcgacagagcggtgcaggcaaattttgttcgtgtggacgaattggcccaagtatggtgtgaatatgccgagatggagcttcggcacaggtttggcattttttttatttcgataaaaaataaattgctttccattgttcagcaattacgaattggcaactgctttgcttcgtcgtgccactacgcctccaccagtgcgtcgtgacagttactttgatgattcggcaaagtgcagaaccgc

SEQ ID NO: 47172 - DNA, 1578 bp, Heterodera glycines
  Genomic contig location: Contig_ID=SeqID_13943; Location=118..1695; Strand=+
  SCN-specific regions: Sequence locations=1-281,304-689,711-1130,1152 -1578
  Gene Ontology: Cellular component=mitochondrion; Biological process =polar body extrusion after meiotic divisions
gcttcgcttcgttgtttggcacagcacggacgctttttggaaattggaaaggtcgacttggcacaaaactcggccttgggcatgtcgctattcttgaaaaacgttactttccacggcattctgttggatgccatcatggaccaatcggtgggcgacatggaggactggatggagtgcgcaaggctctttgagcagggcatccaccggggggtggtacgaccactcgacgccaccgtattcccttctgacaaatgcgaggaggcattccggtaagaggagccgttccgccgccggcgacacaatcaaaaattttaattgacctctttttctaaggtttatgtcggccggcaaacacaaaggcaaagtgctgatccaaatccgcgaggaggaacaacaactgttgtgcgcgccgtctccgatgcgcgtgagggccgtgtgcaggacactgtgcaatccagaacatgtttatctgatcactggggggctgggcgggttcggattggaattggcgcagtggctgatcaacaggggcgcgcgtaagctcgtgctcacctctcgatcgggaattcggactggtgagtacctttgggaagactttcaccacaactaaagccccccccccttaggctatcagtcgcgatgtgttcacttttggcgacgtatgaaagtgtcagtcgcggtcagcacacttaacatagccaaaaaagtgaggagggaaagggtttttgtcggcactcactgatcactcaccgccacaggaggacgcggtcgagctggtcagaagttgtcttgagattgggccgttgggcggagtgtttcacttggccatggtgctaagggactgtctgttcgagaatcagaaccagcaaaacttcaaagacgcggcggaggcgaagtatttcggcacgattagtcttgacgaggcgacgcgcaaaggctgcgagcagttacgatggttcgtcgtgttctcctccatcacttcgggacgaggaaatgccggacagaccaattacgggtggtccaactcgacaatggtcagtcatgggaaaggatttggctttcgctagagtgccattggcgtcgaaagtgtcgagaagactcgttttttgagtggcattgtgttgtaccctttcacctcctcccttttaaggagcgaatcatcgaacagcgccgtgcggatggtttccccggcattgccatccaatggggcgccatcggagacgtgggcgtaatccttgagaacatgggcgacaataacactgtggtgggcgggacactgccgcagagaatgccgagctgtttggggtctttggacctgtttctctcgtggaaccatcctattgtttcgaggcaaaacgcgggcaaagcggcgaatgacttactctttctgcttgttcagttacatcaaagcggacaccagtggaaagaagcagtcgggcggcggcaatttgttgcagacgatcgcccacattttgggtgtcaacgacgtctctcagctgaacccggacgccaatttgggcgatttgggcctggactcgctgatgggtgtggaaataaacaggcactggaacgcgacta

SEQ ID NO: 47173 - DNA, 811 bp, Heterodera glycines
  Genomic contig location: Contig_ID=SeqID_13956; Location=66..876; Strand=+
  SCN-specific regions: Sequence locations=1-92,282-429,460-668,690-811
  Gene Ontology: Biological process=positive regulation of body size
atggacgccgaagatgcgaacggaaaacgcgaggctgaatcgttgcgcgttatcgccttcttcggcgtgtgtctgtccacaatgtgagggggaataaaatttgtttattttttttaattttctatattaatttcctttaattttatgttttatttagaaaaagcaaataaataagaccaataaagaaaatataattaatattaaactctttttcatttttttaaattaacaaatttttatatcaaaatattatttcattgtttgtttttaaaattaattttcagctccatgatgatctgtgtggtcactgtgccgttggcgtaccaacactttcaacagattggttcgctgatgcaaaatgagctggacttttgccagtcacggtccggcaacatttggcgagaggtccaccgataagcgaaagaaatgattaatttataaaataataattttatttttctttgtttcaataaaattattcttttactccattaattaattcatatacacaaaatccctttaatttaattatgcaaatttaatttgaaattcccataataatcaattaataataataaccaatttaagattgcccgtacacaagcttattcccatgcgtccggcggtgtacggtacacgcgtcaagccgctgcttcgggttacggtgccgctccacctccaccagcggcaccttcgtccgcaaccgctggaggcggttacggtggcactgctgctgtctcagccccggcgccgtctcctccacccgctagttatggtggcattgcgccggccgccagtgcaaagccatcat

SEQ ID NO: 47174 - DNA, 456 bp, Heterodera glycines
  Genomic contig location: Contig_ID=SeqID_2115; Location=571..1026; Strand=+
  SCN-specific regions: Sequence locations=1-23,45-293,320-456
ccgctttttgtgctgctgctccatttgctacttgctgctgttgttcggtcccaggacagctgctacgtgaccgattcggggcacacgtgctgtgacaaggcactcggtgagtcatccattgccattggcacggaaagtgacgacaaatcactctttggcggcacactatcctaaacaatcgcagaatcggccatgaaatcggcgatgagcggcaaagatttgttgtcctcggccgatcggatccaaaagtcggcggagggagcaatcggcggaaaattcgaaaccgtaagaaaaaacgaaacaaaacattgaaacaaaggcatcaaaacgatactttccatgcatccgccaaaaaaggtagtggcatttgacgactttgcgcacaaatcgcacttcaaagacggcaaatcgtgcaaagtggagaaggacggacaagtggcattggcatggcaaccg

SEQ ID NO: 47175 - DNA, 4207 bp, Heterodera glycines
  Genomic contig location: Contig_ID=SeqID_2116; Location=284..4490; Strand=-
  SCN-specific regions: Sequence locations=1-1160,1188-2107,2129 -2570,2593-2781,2813-3075,3097-3602,3632-3639,3672-3709,3733 -4017,4040-4123,4145-4207
atggaaatggcatcagaatcagcagttacaacgacgacctcagcaaatttattgcttgatcagcagcacttaaaaaacagcacaaaacgtgagaccattgccaatgcaagtgccgactcagtcagcgaagactcggaagaacaagtggggagagcagactcaacagtgccaagcaacgacgaagaggaggaaatgcgagggtacaatttaataccacccgaagcacggccaagctcaacattggagaaagtggaatttgagcgggtaattctcaaatcatttaaatgcaatgcttaataactgagcctggtataggggtcgcacaaccgagtgaaactttacgtgctttgcgaccaaaggtcgtgggatgaccgagggactggacacgtcgcgtgtttgcaatcgttggaaaacaacaacacttggtgcataattgtccgtttggaaacaaatggtatgctttttatagacaattcggaaaaaacgtaatattgcatttgagtttatttagaaaagaatgtgttggagtcaaaaatacaactggacacagtgtaccaaaagcagcaaggcactttgattgtgtggtcggagtcggacacttgcgacttggcactcagcttccaagaaaaggccggctgcactgagctgtgggagaaatatgcagaatacagggcaaagaccccgagaccgacgctgaggtgggtaatgaatgcttaatgccaatttgggtatttctgattttttaggaagagaatgagagcgaggagaatgagccgagcgacagcaggtaaattcgagaatttggcaggttatcagtttgaggtcttacaattagcacttcgggcatttcaaatgcgtgctctacgtcaagcgtcagcataccgccgtgcaccttgcaaaacttgggcgatttggagcaggccttgtcgaacaacatgttcgcgaacagtttgcgcgagaagatggccaccgcaattctgcagaatgggcaagcgaaatgaatgaattacaatttttttaaatttggttgttcaacagttacattaacaaactttgcgaattgttcgaactctgtgaagatttggagaacacaaaaatgctcaaccaattggcttccatcgctaagaatttgtttcttctgaataacaattccattttgaatgaacttattgaagacaaatatttcaagtgggtggcctttcatttctaaactctttgctttcgtcgtcacatttattcaatttcaggggcattgtcggaatgctcgaatatgacgcatcattcgatgagccaaaaaaacatcgtgaattcctttgggaacgttcaaagttcagagaagttctgcccatcagttctgaagaactaaaagccaaaatccatcaaacttttcgactccaatacgtccaggtgcattctttcttctcatctttgataagatttcttaattttcccattttaattaggatgtttgtttgccggccccttcaatttttgaggagaatcttctgacggtgttaaacagccatttgtttttcattagagccgaaattgtcaactcacttttggtcagtgaattgtttatttgggatgccttctaaatttctgaattgcaaagcacatttttaagaatgacaaggatttgctgcagcaactttttgaggaattgcgcaactcgtcaattaaccccgaaaggcagagagacctcactaactttctgaaggagttttgttcctttgcccattcgcttcagccgagtgggccgcaggggaaggaccaattctttaaagtgcgataaataaatcttcaaaaatttgaattctttgtttagacactaatcgataacaatgttctcggaacgatcgacccgtgcattagcagcccgttgccctccactcggacagccactgtcgaattgctgaccatcgtcgtcgacttcaacccgcaattgttccgtgattttctcatgaaacagtcgcgacaggaggggagaaatgtaccagtgcttttgaattgtgggttaatgcttatgcttttccattttcccaaaggattctctgctcatcaacaaactcgtcaaacacatgctcagtgaccgcgatgccgagttcactgctggcagccaaatgtctcaagttctgcgcgttctgttggaccccgagggcgttttggcggtttgtaatgaatttggagcgcaaaattaatccattcaaattagaaagagaaaggcgaatttcttcaaatgttttacaaacgcgcaattcaaacgatttatgcgccgattgttgacaatgtgaaggacgggcgactgatttgcggtgattttcttttatttgaatggaaatccaatggaatttaattcattttcaattttcagacacttattatatagcgaataggaccagtcaaatcatcgatttgctttgcttttttgtggaacatcatggcttcaatatgcgaacttgtaccatccagaagaatttgctccattctgtgcttatgaatttgcaaagcaagcatcacttcttggcattatgtattttattttttttgcttgggtcaagtttcttgaaaaacattggcgtttctctttgaggtgcgttgcgattgataagacggatcatcggtttgaaggacgacacgtacattcgacacatttgtgacaagggcactttggaccaaattgtgcagtgtttcgtcgccaatgggcagcgttacaatttactcaattcgtctctcattgaacttttcgaatttataaaaagggtcatcggcatattgttgattttttaattgtttaaataattccttttaaggaacggatttatccgctcattgagtacctaatcaacaaccattgggagaacacattcagcaaagtggactatgtgcaaacttttgtcaaaatgcacgacatttgggaggctcatttggccaacaaatctgacgagggcgaaaaagtgaaagaaaatggccagacgacgccattggccatgactccgccgaatgcccaatggcgcaaagagagagaacatgacgacgaggaattgttcttcagcaaggacgatgatgacgaaatggtgtgtcgagttggccctggcatttcatttttttactctgtttagccgaccgctcagtgtcgaaagtcgggcgtcgaccccctcttcccgtctcttctcagaaagcggaaaggtcatctctgaatggcactcttcccctcgtacttttacattgtgtttcagctaatgatgaggacggaattgccagtgttttcggtgggaatatcactccgccagcgggcggcgcagtgtccgtcagcaggatatccaaaatagtgattcgaatgagcagcaaagagccatcgtccgccgctgtcccattggtaaacggcgatggcggcagtccaagcgcagcacatacaaatgaccaaaatgtttggcttcaataattttggcattttgttgtgacttctttcttcagcttccttccacgtccgtcggccgatcgtccgaaaatgcttctgctgtggcggatggaccattggtgaaacgacctttggtggactacgacgacaggtcaaataattaattacacagaggaaacagaattttataattattatttttttaatttagcgatgacgaagaagaagaatctgaaaatgggcccagcagagaggacaatgcgaagggttcgccggaaaaggagcagaggagaggagaagcggagaatgggccgagcaatcggacgggtgactgaaggcggacggacgaccgactgtttatttccatcctttcggtctctcctttctttcacccattttcttgtgatttcgttcgaatgatcgtatcttggagatgtcgagaactcctttttgtccacctcttcccaatttaactatcgaagtgcctgaacatgcattttccatttatttgtggtcgtgtccggttgaaaggaatctcggattttggcattgtcaaaacattttcttttctttttttgcgatctccgtacaaacgaaaaatttaatattgtttctttattctttgtgattttattctgtaattaatatgcttttgtatgttatttacaattaatacaactaacagcggaaggtccaattacctatttaaaaaagaattcttttggaacccaaaaatactttgaacaaattgcattttctgtgttttggttttagtgacacaataaa

SEQ ID NO: 47176 - DNA, 1079 bp, Heterodera glycines
  Genomic contig location: Contig_ID=SeqID_13962; Location=6..1084; Strand=+
  SCN-specific regions: Sequence locations=1-56,83-416,438-453,482 -507,529-1079
atgggcaccagacaacgttgccatttcctaacgttttgttgcgtcgcctttgtcacaattgtctttcttttgttccttttcccgagcgatgaccagcggagagaggccgctgacagtcgaacatacgcccaaaaaaggcattccgccgacggcggtgcgtcgtctgccgccgaggtggacaatttggccccgttcattttcattggtggcattccccgttcgggcaccacactgatgcgggcgatgttggacgcgcatccggaggtgcgctggtgagagggcattggaggagggaagggtaaatgcgtctcaatttttgtggtacagcggagaggaaacgagagtaatcccgcgaattttggcacttcgagcccagtggaagaaaagcgagaaggagtggcgcaggctgcaggtgaacccttttgaatggcggagacacactttcgaattggcctatccaaaaaacaaataattgcctttttcgtcgtctccgaatttcactgctggtttttaaatattttattttttggtgtccaatttgtgtttacgattaattttgctaaaggaagcgggcgtcggtgacgaagtgctcaactcggccatttccgccttcattgtcaatgtcatcgtcggacatggcgccgctgcgccgcggctgtgcaacaaagacccattcacactgaagtcgaccatttatttggcgcagctgttcccgaaggccaagttcattctgatgatcagagatgggcgcgccactgttcattcgatcatttcccgaaaagtgaccatcaccgggttcgacctgaacaatttccggcaatgtatgcagaaatggaatgccgggattcaggtaacggacaaaaaaaaatcgagtcgaatttgcaatggttttgtactttttcagataatgtacgaacagtgcaacgcggtgggccaagccaagtgtttgcccgtctattatgaacaggttggcctaccgtttggaataaatttctctatttcagctgatttcagttggttttgcatcccatgcgggaaatgaaacggttactgaacttcttggatttgccgtggaatga

SEQ ID NO: 47177 - DNA, 2662 bp, Heterodera glycines
  Genomic contig location: Contig_ID=SeqID_2117; Location=14..2675; Strand=+
  SCN-specific regions: Sequence locations=1-155,178-529,551-1131,1167 -1236,1258-2042,2064-2662
atgcgactggtccacggcaaggacctgacccccgacgttcattatctgcacgagaaggatgattatcactttgtgaatgctgtgcacaagtacattgtgcgacatccggaacttccgtgggactcgccggagtttaacccatcagcaaacattcaacaaaacatcgcagaattccgggaaatctttgagcgcgaagttttcgacgaaaattatgagctaaagacaagagaggagaagaatgagctgatagagctggtcaagggatttcgattctatttcgcggacgagcttggacgttttatgctaaggattttcagcgacaaaatatcacacatcactttgacggatcagctggcctacgtgttgggctacgaacagcagcaagaaattcataacgaagaccaagccaagtacgctgttgacttggccggtggtgtcagtcacctgtgcatctacttaaacagcggaataatcgagagcatgatttttggcaactccttcgccaatctcctccaagtgattgcggtcgagggtacgtcgggcagtgtggtcgagaaggactttaagtcaccgttgttccacaaaattgtggctagagaggtggacgtactggacgttgagattcgtacgctcacaggacggtagtgttgtgattttcaaaatattttccctacttttttttttggtttaagagaggtgccttttgaatttggccaagttgtgctgactcttcagtttaaaaaagtcgtaactttctgatacaatggtccgagttatattcaacgggtcgaacttgcggttggagaattatcatcagcagggtggaagcatttcgtactttgagggagctccgaccttccagcgtggctatggctacttccttggaattccacggcagaagggagcgggggtgggagccgtactgcggaacctttggcgttatctccgccctatgatcgctgcggcgaagccctacgcaaccaacatagcagctgaagttggcaaagaggggcttgagcggggcgcgcgagtgcttgctgaggcagccaaaggcggcgacgtaaaggaagcgctactcgcagagggaagagaaggcatgaaaaccttgctggacaaggcgtccgcatcgctacagaagggcagagggagaagaaggaggaagagagggacgaaagccgagatcattttaaaacccacagacattgttggacaaactgttccccagagagctctgttgaaaaagaaaagatttgattcccttggctattattaatcctcatgttgtataaaaaagttgatgttgcgagtgcagaggtggtcaatagcggattggacttcttcagtacgccgccaacaaactgtgcggtgtccaactccagctatcgggagtacttgacgctgaacccgatcagctcaaggcctttccattttaaggcaaatattgggcaatgtataactcttatcagtgtttgttcagattcatccgatcaccagctacatagacctcagcaaagtgtttgtgtgcacggaattcaagctcaagaaaatcgcagaagacggagtggtagttgacgtaccagccaacgcggctgttggccttatacaaatgcccggtgcaactttcatccgcaatctgaaggtgcacatcaaccagcgtgaggtgtacgactccaaccagctgtacagctacaaggtgtacctggacaccgagctcagttaccctgcggcggcaaaggatgcctactttggcgtggcgggctattttcgagacagtgatccgacaaaagtgaacgaaaaacggaaaaaagcggtggaggagagcaagagcttccaaacgataagcaagctgagtgccgacatattcaaccaggacttgtacatgatcagcaacgtcgagattgacattgagctcgcactgcagtcggacgactttatggtccaccaggacgctgcgaataaggacaagtacacgcttgaaattgtcgactgtaggctgatcgtgaagactgtcgatttgatggacgggctgagtcttgacattgccaggaagttggacactgaacccgccagatacggtatccggaagtcgttcatgaaatcgctctttgtcactggcggtcgctatgacttctctgccaacctattcacggaggaggtgccacgaagagttgtcattggactggtgtccaatcagaattacattggccataatcagaagaatcccttctattttaatcaccacaacgtgagtggcaaatggcaactgcttgtgaatcagattattcaggtgcgggacattgagcttacggcctctggcaggacatatccccagtacccgtacaacctggactacaagaacaacaggtacgcaagggcatatcacgatgcccaagagcacctcggcatggcgtgcacaacggagagcaacggaatcagctacagcatgttcaagactgcctattgcctctatgtcttccaaatgaccaacgcgcaggaggactcgccaggatttgagctgatcaaagagggctgtactgcagtgaacatccgattcactgaagcagtacccaacgagggagttacattgattgcgtacggagaggcagacgggctcattcttattgatcgtaaccgttcgatcactagtgacctcacagtatga

SEQ ID NO: 47178 - DNA, 2552 bp, Heterodera glycines
  Genomic contig location: Contig_ID=SeqID_13989; Location=1374..3925; Strand=+
  SCN-specific regions: Sequence locations=1-198,232-265,296-612,639 -661,700-862,943-943,970-977,999-1436,1496-2108,2138-2229,2267-2552
  Gene Ontology: Mol. function=protein binding; Cellular component =centrosome; Biological process=reproduction
tttgatggacaatccggggaaacctttgcgtttcaagcggagattgcgcagttgatgtacaatatggacaacgccacgaccaaggtttgtttgacagaattggtgactaattttttacataatttttgtgaaactttttttaaaggcgcatgacatcgaaaacgacccgagcaaagccgataaaacatggaccatcattgacactggcattggcatgaccaaagccgacctcgtcaacaaccttggaaccatcgccaaatccggaacgaaggcgttcatggaggctcttcaggttttgtttttcgtttggtcaacccccccccccccaatctaaaaaacacttgttacttaagaccggcattgtcgctttaatgcccgggcattttggcgccggtttctactcggctttctctgtggccgaccgcgtcacatcaaagcacaatgacgacgattgctaccaatgggagagctcagctggtggctcgttcatcattcgcaattgtgccgatcctgaagtcacccgcgggacaaagatcgtcctccacctgaaggaagaccaaacggcatatttgcaggtttgttgtactttggttcaaaaagtgcgtttttgacgctcaaaaattttacatttttctttcgcagtaaatgcgcaattgtcaacaaattatatttttaattaaaaatcatcaaatttttattgagttcaggtgttggtgctggtgttgtgcgtgttcatctgtgaatgcggtgtggggagaaagggcggccaagcagatggtgaaaggagcagccgcggacgaccaaacaatgacggcggggggacaagcggcggagcgggacagaaacggggaggaggacgtgtcggcggtcgcggtggtggaaaaggcaatggccgcggtggtggacgaggcggcggcgggcggggagggcggtcgccgcagcccccacaggaggctgatgaggaagaggtgggggcaaggatgagaaatcaaatctcatcaatttgaattgaagaaatggtttttttacaatgtgccgtattttcccataaaaaatcgttttatgaatatggttaatttggtaatcggtgagggacggggggggggggggggttatcgagggtgctgatcccgaatctcgggttatcgagggtgctgatcacgaatctcgggttatcgagggttctgatcacgaatctcgggttatcgagggttctgatcccgaatctggggttatcgagggtgctgatcccgaatcttgggttatcgagggtgctgatcacgaatctcgggttatcgagggttctgatcccgaatctggggttatcgaggtgctgatcacgaatctgacatctcatttgcaatattttaattgtatctattattttcgcagtacctaacatgctaattctgtaggtatgataacaatgatatgttaaagttaacatggtaaatgaatgaggaacaaaaagagaaacgactttcccatgtgcccttttatatgagacgggagcgtggccatctgtgtagcgaaggtccgacgcttcggtgaccgatgcgaacggggtcagattaaataacaaagggatgtgcggcatttctgcatcggcacaaaagagaaactaatgcatcatgctgctaaccggcgatgcgctttcacatttacgggtatattcaaacaccaaaggggattaaagaaatttaaagcacacgaattaatattttattagaacaatatgaaatggtgattaaatgcaatatttagcaaaatgattagtctgttataaaataagtaatcaattcatccatccggcattgttgttatgtaccatttgtccactttcattaccattgttgtatgggttgttttggttagtcccagcgctggaggagcacaagtcaaagtgcgtgcgattgtttccgaaattgccaaaagttgagctattattagtaaagctgcttctaaagccattgttgttgtaatcgttgtttttatttgcacaattcatgtcgctcaacctcatattaagcgaaacacacccactgcacatatcaaattgcacttttacccctcataaggagtcgaactcaaaagcataattaccgccgctgttgttgttattgttttttgttgaattgaacaattattgtgagtagcaatgacaaagattgaaagttagaatatacttttttcgtaaaagtttccataactgagcattagcattgacgctgttattgttgctggtggtgttgttgttgtttttgttctgttctgctggcgcgttttgttgattattaaaagtattcatttttatattgcaaaaaaaaatttcttgtgattaaaatgaaattttgcgtcatatttgcgtgcttttatatagcggaaatgtacagtgcgcgcttagagaaggattaagttacggtgctcttacgaacatactaaagcgcttaaaatgagcacaaaatctcacttgcgcgcaatgcatttgcttatcgcattctctcgcattttgggctgtccccctggtgaagtgggtgcgcgaatttgctgta

SEQ ID NO: 47179 - DNA, 2232 bp, Heterodera glycines
  Genomic contig location: Contig_ID=SeqID_14022; Location=150..2381; Strand=-
  SCN-specific regions: Sequence locations=1-343,365-406,428-1010,1032 -1341,1369-1516,1539-1928,1950-2073,2095-2232
  Gene Ontology: Mol. function=protein binding; Cellular component =ubiquitin ligase complex; Biological process=apoptosis
atgaataatcatccggtcagattcgacacgatttggagggatctttcgcccggccttgagtccatcttcaagacgcaggagagaatggcaccgcagcgctacatggagtattacacgtgagtttgagcagaggtgtaactgttatgtaagacttcccttccctctgttttcagattggtcttcaaccactgcacgacgagtcagcagagcagcaacttcacgcacgaaacaacgaacaatcgggcgcgtcggggcaaccgcgggacgccggcagcggcggctggtgcagagtttgtcggcgaggagctctacacgcgactgcgccacttcgtcgaagagtacgcaaggaaattgctgcaggtagttaatggggggaggggcggaattttgtccaggaaaccgaactcaaattttgcttttgtttcaggaatgccagcgtctgtccggtgaccagctgctggactactacaccgagcagtggaccaaattccagttctcctccaccgtggcgaacggcattttctcctacttgaaccgtcattggatcaaacggaacatcgacgaggcgacgcgtcccggcattttggaagtgtacaatgtgagtttgtggggacggtcgtacacgaagggggatgagtttcatttttaaattttccccgaatttcagctggctgtctccatctggaaatcggtgatctttgacgaactgcaccacaacatcacgtccgctgcgctggcgctggtggagaaggaccgcaacggggaacgcatcaccacgcgactgatcagcggcgtggtcgcctcatacagtcagacttttgcttcgtcaccccaaaaatttgttgatttttgtcgtttccagttgaacttggcatcaacgagctcgacccggcgccggcggtgggccagcagcagaattcggtggtgcatcgtccgagcgtcaaataccaagtgtaccgcaacaactttgagcagcgcttccttgaggtcggttggatgggtttttgtgcatttcaaaatttttacatttcccacacaaacaggacactcgcaacttctacacaacggagtcgaacaattttctgcagtcgaacagtgccaatgtgcaggactatatgaaaaaggtgggtggtgaacaggggggagtctcgtttacgagcgcaactttcttcatgtttttctctttttttcaggttgaacaacggcttagcgaagagcgggaccggtgccaaatttacctggacaacacaacaatggactcgctgatggaggcatgtgacacggcgttgatcaagcagcacctcgagctcttccacgacaaatttgaggtagcagaaagagaattgtccattttattatattacacttttttcagtcattgctcactcgtcaacagaatgaccatcttggacggatggtgagatttgcagaatgtcaccacttttctcacaatttttgcataaattcgtttttttttcagtacacactttgttcgcgtgtgcccaacgggttggccaagctcaaggagatcctgaaggcgtacatcgaacaggagggcaaggcggccattcagcaaattgcgcgtgaagcgtccaacaatccgaagcagtacatcgactgtatcctcaaaaagtgagtagcgggtgggtttttggaaatactgaaccattttaaaggcacaaactctacaatcgcttggtggtggactccttcaaaactgaccatggctttgtgcaatcaatggactgcgccttccgcaagttcatcaacaacaacgaaattacggcgatggctcggaatgcgtccaaatcgtcgcagctgttggtcctctactgtgatcagcttttgcgcaaaagtgcacgcaacacggaggacgagaagatggatgagtacctggaccaagtggtgggtttgtttggttctttaaagtttgaaattttccataatttctgttttcttaaaaatgagaatataatatccccattgtcacagatgaccgtcttcaaatacatcgacgacaaggacatgttccacgcgtttttccacaagtttttgtgcaagcgcctcgtctacgacacgtcggccagcgaggagcaggagcggtgcatgatcgcaaagctgaagcacatgtgcgggttcgagtacacctcaaagttggagcgtctgctgactgatgtcgcgctgagcagggaccattccgagcagtacaagcaggtggctaacgaaatttaa

SEQ ID NO: 47180 - DNA, 1371 bp, Heterodera glycines
  Genomic contig location: Contig_ID=SeqID_217; Location=918..2288; Strand=+
  SCN-specific regions: Sequence locations=1-908,930-1371
atgagcgtaatcaaaaaaattgacaaagacagtgttgaaggcttggagggtagtctgtcactgttttcgcttccgccaacaaatgtagccataaacaaaaccagcgttcgagagttgctgccactgtccgcgttgaatcagaccgggccatatttgttccgattgttctcggacagtcaatactgtgacttgagcaaaacatacatgtacctgctcagttcaattgagcgcaagaatgccgcgggcgaatgggtaccgatcagtgacgctgaaccggatgataagcgtgtgagtgtagtgcagaactatggcagcagttttgtccgcgcgttgaaggtcaacatctcgggcattgaggtgtttgacagctccatctattatcattacagggactacataatgaatgagctgggctactcccatgaaattcgcaaagctttccacgaggcggcctgttactatgccgatgaggatgatggtcaagacagtgccactaacgagggcttcatcgcccgggcatcccgattttcaaacggaaagcagtgtgagacgatggtgaagctgaactttgaccttgctcatcagagtgcactgatgctgaacaaccaagacgtagtgttcacgattcaccgcaacaacgatgccttcctcctgctcacgccccattggaagaaagcggacggtacaatgcaggaaaatacgaaggaatatcgtgttcgtgtgcacgatatgcggctctatgttcgcacggtggacgttacgccaagccttaacctggcaataagtcgtcagttggagtccgcctcggccaaataccctctgcgcaagattgagatgagctccatttttttgggaaaaggaagaactgagctggcccataacgtgttcacttcaacactgccgcgtcgtctgatttgctgttttgtttcaactgacgcttattcaggcaaccgaaaactgtcacccttcaaatttgagcatgcaaatgtgcgagcaattagtgccgaggcgaacggtcaatcttttcccagcaccccgtacctgctgtcgtttgatgctgcgcagcaacgttttatgcgcgcgtttgtggacatgtatgccggtcttgggttggatgactcggacacaaaaacggtgtccattggactccaacgtttcctaaacggatgggctttcttcgtcatcccaatgacctcaacgctggatgatacagatgggtttgagctgatccgacagggtacgtgcacgcttaaagtccaatttgagaagcctataaaagatgacggttacgaaatgttgatcctcggcgagtttgattccgtcctttccattaacgctgaccgtgtgttgagcacagacggaagtgtttaa

SEQ ID NO: 47181 - DNA, 979 bp, Heterodera glycines
  Genomic contig location: Contig_ID=SeqID_14023; Location=1..979; Strand=-
  SCN-specific regions: Sequence locations=1-979
  Gene Ontology: Mol. function=fructose-bisphosphate aldolase activity; Biological process=fructose metabolism
caaacgatgggaatgactttcgaattgagtgagaaaaatgagtgcgaactgcgcgatatcgtggcgagaatgcttcagccgggcaaaggcattttggcagcggacgacccggcaggtcgaatgaatgggggcggagaggaggggggggggggggtaattagctaattatggcaaattcggacggtaatgagtaatacaccacacacacctttgattacttgccttttcagttgctctcgactcgcgattgaccctttttggcatggaaaattccgcagagaatcgccgtcgctttcgacaattgttgttcaccactcccaatattcacaagcacattagcgcagtcattgttcaggatgaggtgtcgccctccttttaatctgtttcagcaatttcaaagttttcggattggcagaaccaattattggagattaatttcaaattattctaattccctgcctaattgttagacttatcggcaaatgactgatcaaggcgatcagctggtggaccttctcagacggacgggcatcgctgtgggggttaaagttgacgaggacacaattccgctgttcccaatgccaacggaagacattgagaagagcaacaaaagttggaaaggggagacaatcacgcaaggtggggaaaagggagggattatgaattattaccctaaatgatcattaataattacaattattaggcctcgacggattggccgcgcgttgcgctgagtacaaaaaggggggctgctcttttgcgaagtttcgttgtgcttatcgcatttcgcaacgaacaccttccaaatgggcacttgagcaaaatgcgatggtttcgcagattgcttttaaaccattcgaaaaacatttaaaggtaatggcccgttttgcggtgacctgccggacgttttgggctggtgcccattgtggagccggacttaaacggtgaaggcactcacggcatgagaaatgccaacagg

SEQ ID NO: 47182 - DNA, 633 bp, Heterodera glycines
  Genomic contig location: Contig_ID=SeqID_14116; Location=2306..2938; Strand=+
  SCN-specific regions: Sequence locations=1-62,84-173,195-595,617-633
cacattttctcttgtgacgatgcctcatacactctcagtccggtggactccttcccgacgttggagaaggcaatcaacgaccatgtcagacaggccaagaacattgtgctggttaattgcatcggctcgcggtctgtcagcgaattgagcattgcccgactgacggacgaagtcacaaaaaatatgaaatttttaataaaatgatccatctttaggtgacattttgggtgttggagtcgcggagaccgctcaatttggaggacatttacaacgcgaactctgtgcgcgtgttggccccagcagcggaagttgcggaatggacactgcccgaagcgagtgccatttttgaaacaatggtggagcaggaggacgaagacgacgacgacgaagcgagcgacggggacgaggaaaaccgaccgccgtcggtgggcgacggggaaaaaagtccatttaagaaacaaatagctgagctaaaaaaaaaatagcaaaattcggtgatttttcaaaatcttaccgaggaaaaattggggccttatttgaatagtggtggtgtttatgacttatgaaggcgtaaatttaggacgaccgcgaagaagcggaggacggagaagcggcgatggcgggcgattccga

SEQ ID NO: 47183 - DNA, 2427 bp, Heterodera glycines
  Genomic contig location: Contig_ID=SeqID_2159; Location=8217..10643; Strand=-
  SCN-specific regions: Sequence locations=1-707,730-773,797-1150,1179 -1185,1207-1477,1499-1786,1808-1823,1845-2427
  Gene Ontology: Mol. function=protein binding; Cellular component=SCF ubiquitin ligase complex; Biological process=apoptosis
atggacagcatttcgcgcggggagcactgcgagaagttgctgggcgacttcaagaagaagacggcgacagaattgacccgtttattgctctcaataaacccaaaaaggttggtgccgaaacggattttttatcggggatggttacgtttctgaaaaaattgtcctccctgatttacacaagttgttataataccaattgttttgtcttggtttttaggtctcacagtcagtccttacctaaatctttttttcaaaaaaacaacaaaggacgtttttgtttttgcataagtaaacgatcaaattgtggcatttggtgccttcaaaccaatagcaatggtttagtgcgttttgttagtttattctacgtgacatttgcaaaaaacaaaaaaacaccgcaatttttaaatgtttttttcgtcttttacgtcatctcccgcatgacttacaaaaataaaaaaaatttctatttttttctgggaggacgacacgagccccaccccctccataattacgaatttaaccatttggttgatgaaccgctgaactccttgccaaggtccgcaatttaaaacaacccctactcaccctcccttaattttttggcttcaggcttgccctagcggcgattgaggccggaatgaatttaatggtgctgccgttgccataagcaggtggcttatgccgcggtgaagtggtgacgacgagcaacactttcccgttcaaatactcatttttggtaagcaattccgacattaaaagttgggtttcctcgtaaaaataaatgtttttcttttccagtgcaacacgcaacaaattgtcatcctcatgcagtacaacgaacgcaacacgtacacacttggcgagctgcacgtcactcttggcaccgactttcccgctgatcagctgtgcgccgttgttcaatccttggtcaagacgaatctgctgaagctcaccagcgccgatgggacagctttgaccgagacgaaactcaatgacaacgagcagaaattcacctttaactcggaattccagaggtgaatttgaaaatgaacgggggtaattaaattttaaaaatgaatgtaaaataccgttagttctaaattatttttcaatttcccgtcttttcagccgcaagctcaaagtcgacttggtccgtgccatgtcctctgccagggagacaaacaaggagagtgaggacgtgcagaagacggtggacgaggacaggaagttggtcatccaggtgagaaaattgacaaatcaattttaatgacccctttcttctccctcattaaggctgccattgtccgtattatgaaaatgcgcaaatcgttgaagcatcagctgttggtggccgaggtgctcaaccaattgacaacgcgtttccagccaaaggtgggggagaatgattttgggtgcaaatgaatgcctttcctttccttttaaggtgccgatcatcaagaagtgcatcgactcgctgattgagaaagaatatttgaagcgctcggaggaggatcgcgatttgtatgaatatttggcatgaggacaccattatatgtgtattgtattggatgtttgtccgcgttataattgtattattgtatttctctgaataaatgctaaataccaaaattgggagatcagaattgcaagcggctgattgcatcacttttgcaggctaattagaggatacttagggagactgaaggcattggtcgattttaatacatttataaagagagaaagagtaaagatttaagcatttgcttctacgttttcattttcgtttttcgtgactataaaaatgtttgttttttcgattggtttctcattgtgtaaaaatatttctaacataattattattgtgcccctttgtgacgttcttcgtaattgtgctaatttccaacaaaatgaaccgccggtaaaataatatttagacaaagttttccattgccctgatttgattttccacaatttcagttggctttacaccgacgtgtggatggacatgttcccattttttgaccgtcttcaactcggactcaaattggcacttctttcgccacgtttcgaatttttggtcgacaaacatttcgatggcacaagcgaattgccaattttgaaaaatatcgtattgcgcaagaacaaagtgacagcggtgccagaattgcgcgtgtttattgacaatgccaattatgtgccctttccggtgcccgaccattcgctgcccaagaaaattcgttttaagcatcttcggatttggtaattcaaattccgacatggattaacggatacaatgttcctattttcagctacatcgaccattctttcatcgcatttatccgtgccaatcagcaaatgttcgacaaaggaacaaacttggagttctctgtgtcatggaacgaaaccttttttgctcagccaatttaa

SEQ ID NO: 47184 - DNA, 1170 bp, Heterodera glycines
  misc_feature (115)..(115): n is a, c, g, or t
  Genomic contig location: Contig_ID=SeqID_220; Location=861..2030; Strand=+
  SCN-specific regions: Sequence locations=1-170,199-237,259-289,311 -754,781-1170
atcacaaatgagctcatccgctttggtaaagataaagttggatcaggaagtgtgtgctgatgctgagaaattagtgcgcctttacactgaattggcagatgttcaccggaccagnaatttgtatcttttaaaattcctttttttccctacaatcctaaggaattgtgtccttaatttaatttttttattattattaaacctgatcattcattttcaatgaaactgcacaaaaataccaaaaaaaaaaaattaaaataagagaactggatccgcaaatttgatttttgtgcgggatccggcctgatccgctttaggtaaaacaaaaaaggtttaaattaggggatcacaccccccgccccgctcattctttacaattgtcatttccatttaagcaaaattatattcggcgcatgatcctcaaatcgtatggaacggaaatccttacaaagggatgccagaaattgaaacattttggcggaatttacccgaaacttcgcatgagtaagcaatatttgcctttgttagttaatcaaaaacgagtagcaagtttaagcgtcgcttgtttggatgctcatcgaattgacccaaccagcgatgacatgtcattggtcgtgttggcgatgggcacagtcataatcgggtttggtgttttcctaatatgtctgcataaactttcccgcactttttcttagcgatttatttttggaattatgcacttttattgattaaactcttccatttgtgcctacgcctcaaaatttaaaaaaggcaacaaaggtgctcgttcctttggcgcaaggactgcaagagacgcaatcttcacccatttgttggagttttagcgtcgattgtcgtcttaacgagttaccggcacatttttttggtaccaaaaaatttcctgatgaatcattaggtatattcaaaaaaaatacatttggcaaaaacagtgaaggaagtgcgggaatttttatcgcgctctgtattgctaacaatatcacgttttttaaccaatttcagcggattgagccacgcctacaatcagtcccttttgctagttcttgaaggaagtacttacaaaatcaaaagtgacaattacagggtgatcgactgaatttaccacattgataatttgttcaaatctctatcaaagcgagtaaagcaaagaatgca

SEQ ID NO: 47185 - DNA, 2594 bp, Heterodera glycines
  misc_feature (1752)..(1752): n is a, c, g, or t
  Genomic contig location: Contig_ID=SeqID_220; Location=133..2726; Strand=-
  SCN-specific regions: Sequence locations=1-1086,1113-1556,1578 -1608,1630-1668,1697-1911,1933-2230,2261-2594
  Gene Ontology: Mol. function=dUTP pyrophosphatase activity; Biological process=nucleotide metabolism
atgatttagaggcttcaaaaatcgagctccgcgagcgatcaaagaagtgaaaaagttcgctgagcagcagatgggcacacccgacgtacgcgttgacacgcgtctgaataaatttctctggtctcgaggcgttcggtatgtatttataattaactctacaaatacaagttgtagaaaatgacatacaaaattgcaaaagcactgttttatgcttttttctacctatgcctgtagtaatgttccattccgcgttcgcgtccgactttcacgcagacgcaatgacgacgaagactctccgcacaaattatacactttggtgactaatggaagaacaattacactagttaaatctgttttgtttaggtgacgcatgtgcctgttacttcgttcaaaaggttgacaacggtcaatgtggagagtgaggagtgatagatggagaaaggatccggactgagtaaatggctgttttttgttgcgttatattgttgcggattttttgaaataaaagaatcgttgacaacccatgttcgattttatatcattaataatattcgttgtcgtgaaagaagggaatcatagacccatatttgaaaaataggtttttggtgcgttcccacttccccggacattagctgtcaagtgtgtattgttttatgttaatccggaaaatctcaatgaaatacaaagtaaaatgaatgcattctttgctttactcgctttgatagagatttgaacaaattatcaatgtggtaaattcagtcgatcaccctgtaattgtcacttttgattttgtaagtacttccttcaagaactagcaaaagggactgattgtaggcgtggctcaatccgctgaaattggttaaaaaacgtgatattgttagcaatacagagcgcgataaaaattcccgcacttccttcactgtttttgccaaatgtattttttttgaatatacctaatgattcatcaggaaattttttggtaccaaaaaaatgtgccggtaactcgttaagacgacaatcgacgctaaaactccaacaaatgggtgaagattgcgtctcttgcagtccttgcgccaaaggaacgagcacctttgttgccttttttaaattttgaggcgtaggcacaaatggaagagtttaatcaataaaagtgcataattccaaaaataaatcgctaagaaaaagtgcgggaaagtttatgcagacatattaggaaaacaccaaacccgattatgactgtgcccatcgccaacacgaccaatgacatgtcatcgctggttgggtcaattcgatgagcatccaaacaagcgacgcttaaacttgctactcgtttttgattaactaacaaaggcaaatattgcttactcatgcgaagtttcgggtaaattccgccaaaatgtttcaatttctggcatccctttgtaaggatttccgttccatacgatttgaggatcatgcgccgaatataattttgcttaaatggaaatgacaattgtaaagaatgagcggggcggggggtgtgatcccctaatttaaaccttttttgttttacctaaagcggatcaggccggatcccgcacaaaaatcaaatttgcggatccagttctcttattttaattttttttttttggtatttttgtgcagtttcattgaaaatgaatgatcaggtttaataataataaaaaaattaaattaaggacacaattccttaggattgtagggaaaaaaaggaattttaaaagatacaaattnctggtccggtgaacatctgccaattcagtgtaaaggcgcactaatttctcagcatcagcacacacttcctgatccaactttatctttaccaaagcggatgagctcatttgtgattttggcgataaaatgaattataatctgtaaaaaaaatacaaccagaaatatataaattacaatttttcacattcgttagtcgcagatagaggcctggacggggtcgggaataagggacccagacaaagcgcggtacggaattgacaatagaaaattgacatgtgtggcatattttaaatattttgaagcgggaaattacaaatacaaatataaagcgaaaaaataagatattgaactttccattgctaccttttctaatttcgccaatatttttcattcttcgtttaaatttgctagggttttgacgatggcccaggaaacggtcttacgctttgttagaatttccgataaggccagtccaaacaaaatattagataaattaaaaatttttaatgtttttgagtttaggctcatccgccaactttcgggtctgaaaattctgctggagctgacctctatagtgccgaaagttatgtggtgccagcaaaaggtactaaattttataattgtatgacacatgaccaaactacctaattaaggccaagtgctaatctcaaccggactcagtgtggccattccggaggggcactacggacgagtggcacctcgttcgggattggcagttaaacattcaatcgatgttggcgccggtgtcattgactcggattatcgcggagaattgagggtgaacttatattgctttgtgggaaataactgagaaatttggt

SEQ ID NO: 47186 - DNA, 15461 bp, Heterodera glycines
  Genomic contig location: Contig_ID=SeqID_220; Location=3559..19019; Strand=+
  SCN-specific regions: Sequence locations=1-202,224-334,356-492,514 -671,693-1462,1484-1874,1897-2696,2718-2940,2962-3085,3107-3272,3294 -3311,3333-4331,4360-4383,4405-4460,4482-5469,5491-5772,5796 -6128,6152-6283,6305-6336,...
  SCN-specific regions: Sequence locations=...6358-7355,7378-8009,8031 -8075,8097-8759,8781-9417,9439-10055,10077-10214,10237-10635,10658 -11131,11154-11802,11824-11985,12007-12794,12818-13339,13362 -13907,13929-15461
  Gene Ontology: Mol. function=dynein ATPase activity; Cellular component=fusome; Biological process=oocyte cell fate determination (sensu Insecta)
tatattcagaatgaattaacgcaatggcttgacgaattacggcgaatcaaaaaacccggcgaaagggatggacgaaaactcggcccacttgagaagtctctaggtaaatgatttgcagggtgcagtacgacatttgaagcagaacattgaaataccagaagttgtgcttgaattcgattccaatattcaacagattgtggatgtggcaagaaaggaaaacagaaaaccatttcctcaacaatctgcagaatcatatcaatatttggattaaagcaattcaaaaaatgacgaaattagaccgagacccgacgtcaggcacagcacttcaagaagtgacattttgggtcaatttggagcgtgcgttgttgcaaattcaagagatttgcgaatctgacgaatttattgtcacaatggaagcgttgaaactcggaaagcgttttcatgcaactgttgcattcgaatcaaacacaggtttttttgtgtaattttacagttttttaaatttgattatttaaagggctgaaagagatgctggttactgcccaggattacaaccaaatgatgaaggatgttcaaatcaatgaccttctgtgtgctttcgatttggctgcagttaaaacggccgtttcaacaattttgggaagtatcaaaaaaatgcgaagcaccaaatacccattgaaacgtgcttatggctttattacgacaatttcaacggacctttgcgaaaggcttgttcaggttattcgtggaggagcaaaaaaaaaccacgcttattttatacttttagcttttgaagccacgtcttttgatgcatgcgcctatgtccgaattggaggaaataatggatcagtgcaaaaaaatttttactgcttgggacgaagaagcggacaaagtgatgatgatgtttcgtgaccttgccaagaaacagcggccagcagatgcgaagccaatgttgcgaatgatatatcgacacaaattactggaacttcggctcgaacaactctaccgatttcgaacgcaacatgaacagctcagcaatatgatatcccgcgttttgcgctttgctggtccaacttcgcttgaaagttttggtgtcatcgattcagacccggagaaggaggttgaagataatggaataaattgttcttttaaaatattttgcagattggaaaagcctatgatgcagtgaaagagctggattatttggacatgggtcagcagggccagcaagcgtgggaaagtgccatgcaatactacagggaccacatcagtcgagtggaggcggaactcgcgtcccgactgcgtgaccagctcggaggtgccaaaaacgcagatgaaatgttcaccatattctcgcgatacaacgcccttttggtccggccgcacattcactcagcaattcgagaatatcaaaccgcactgattgacggagtgaaggcggacattgtcgagttgcaagagaccattttggacacaaagaagagagagctggcgatcagatgtgctgaccggtatgagaagaattaagcaattcacagttttaaatcgaatcagatatgacattcctgctttctcggcttcaatgatgtgggtcagacagattgagtctcaactgaacatgaacatcaaacggattgaaaatgttcttggagagggatgggccaatcatttggaaggtaataccgacaacagtccattcaagcattcaattattagaaaaacgacggacaaattggagttttttaggcaaagaattgagcaaagagtgtgaactgcttcgacaaaaattggacacatcgcatttgcacaaggaatggaccgataaaatgttggcaaaatgtgaagtccaaaacgacagactgttcattgttgacaaacttcaacgtgatgggaaaataatacatcgaattcgcgttaattactcgccggactcaattcgcatcactaaggaggtaaaaatggataaataatagctgtcatgcgacttcgaacataaaatgaaattatgtttttaatccactttgtgtcccttttaggtccgtaacttgaaaaacttgggttatcggatcccattcaaaattatgagccactctcatacgattagcacatactacccaaatgcgatttccctcatcgagtcaatgcgtatttacgagtcgacaaatgaaattgttttgaatcgccagtcgatcgatcaactcattgcaagctatcgaaacatcattcataatctgttgaatgaggtgacgaattctcaaaatacaaaaagtaatttcgtcaccaataaattccagggtgtcaaaactgaatggacaaactttaaattggaatcatttgttgtcaaattggccgatgctgtcggaaattatcaagagaaagtctcagatctgattgaatggctggacaaaattgagctggaaatgtcatcaatggacaagtgtcaattcaagcaagaaatcatcgcccaaattctcggctccattcaaaagattgttgaccaaatggccttgaacaattattcaaacttgaaaaaatggattgaaaatttggataaaacggtcaacctttgatttcactaatttttaagccaatcgttttctcatttcagctggaaaacaaaatggctcgtcgtcttgaagaagcaattcgtgtttggattaagctgcttaaacaaagtcgggatgagctggaggatgaaagggaagtcagcattgtgcccgaaattcacccaattccactggaaatccgaatcatatcgcaatgcattgtggttgtccctacactggaaaaggcgcgccttagcctgttcaaccagttttcgtcgtggcatggaattgtgacaaaccagacaagaatttcatgcaatcgtttccaggtttttttcctcgtactatggttcactatcacttcgggttggtttaaggtccttcaaaacaacgccgacacacaaacatacaaaagtgttttgttgaaaatgccacacagtcagcagataatacaagaaactcactttgcaatcgaagacatcatgatgaaattaggcgactatgtcagccaatggacgcgttaccaggcactttgggactttcaacaggaaatgttttttgagcgacttggaacggacttgtgcaattggatgaaggtgcttttggacatcaaaaaagctcgaacaatggtcgactctccggaaacgcgccacaatatttttccgtttgtggtcgacttcactcgggtccaatcaaaagtgtccataaaatacgacttctggcaacgtgaagttctcaataaatttggaagcgcattgggtattgtatttcttttcatacattttcaaaatttaacccctcacttgtcaggctcatcaatgcagcagtttttttccgacatctcaaaagacagacatgagttggagtcgcaaagcattgattcgaccaacaccagttccaccgtggctttgattatgcacgtgcaatcattgaaaaagcgaataaaagcctctcaagaacaggtaatagcttgtttagttggcctatattttaatattttgacaatttgaatgggtgcaacagattttcttaaaaacaggttgacactttcttgtccggacaaaagcttctgactgtgcatcgttatccgtttcctcaatcatggctatatgctgaaaatgtcgagggtgaatggtctgcacttttggacgtcttaaatcgaaaggatgtcgcgattcaatctcaagtaatcaattacttatttttatcccgttttaaaatgcattttaaggttgccaatcttcaaacgcgcattttggaggaagacaagttgctggagaagcacatcaacgatttagttgctgaatggaacaaatcaaaaccggttcatggcgctcagagaccaaaagaggcgttgattttgctgagtggcttcgaagacaaatttaagcgcctcagagatgaacgatctaatgttttgaatgcaaaaaacacattggaaatcagcgattcgctgattcacatttccaaccaaacaacaaacaaattggaaattgccattgaagagctgaacgacttgactggttttatttattttttgttttctttgcatttatttaatcaaaaggtgtttgggattctcttttgcccgtgtacaacaacatcgacgaattgaaggagatcccctggctttcggtccagtcgagaaaattgcgtcaaaaccttgaagagcttttggcaaaactgaagagtcttccctcacagtaccggtcttacgagtcatacgattacgctaagcgattgctgcagaactatttgaaggcaattgtttatgatcctgtttcatattatcttatgtttttaagatgaacagtttgatcattgagttgaagtcggattcattgaaggagagacattggagaagtgactttttattcatttttaacgtattacgtttaattcactcaagatttgactcgggaaatgcatgttaattgggtgctcagcgaactcactttgggccaagtgtgggacatcgatttgtcacgacatgaagagaccatcaagaaaattatgattgtggcacatggcgaaagagtgctggaagattatttgcgccaagtcaaagaatactggacggattatgcagttgacttagtcaactaccaacaaaaagcaaagctgatcagaggatgggacgacctttttaacaaactcaaggagcacatgagcagtttgggtcagatgaagctgtcactctattacaagcaattcgaggaggacgcgctttcgtgggaagagaagctcaacaaaatgaacacgatttttgactcttggattgatgtgcagcgaagatgggtctacttggagggattgttcaccggttctgctgacatcgcccatttattaccatccgagtcaaaccgtttcaacatggtctccaacgagttcttgggattgatgagaaaggtgcttatattacttaatttcgattaatctttagtaaatttactttccctttgttgttaaggtttccacttcaccccgaattcttgatgtcatccacattcaaggcgtccagaaaatccttgagcgtcttgcagacatgctgtcgaagatacaaaaggcacttggggagtacttggagcgtgaacgcaattccttcccgcggttttactttgtcggtgatgaagacctgcttgagattctggggaactcaaaggatttgatgcgtgttcaaaaacatctcaagaaaatgttcgccggaattatggccgttgagttcaatgaacaaagccgcacaatttctgcgattatttcacgagagggcgaatccgtcacattgaaatgtccggtggacctaaagcaactaccaaaaattgatgaatggctgcgtgggctcgagcgcgaaatgcaatcaaccttggccactctcttgggcgagtcactctcgtctttctccaaattggtcatcgaaaacattcaacatgaagaacttatggagttgatggatctttatccggtattaatcaaactattttatttttgattttttgttaatttaggctcaaatcatcgggatttgtgttgatgtgtggtggagcagtgcagttgaatcttgtctgtcaaagcatggaagtgcggaaaatgtgctgcagactgttgaaaaatggttgtccatgctttgtgaaagtgttctgcgtgaccaaacggcaattagacgcaaaaaaatatcgaatttggtgattccagactaaatagtttttttattgcgttttctttttagataactgaatttgtgcacaaaaagaatgtctgccgacaacttgtcaaaaacaatgtgaaaaacagtcaagacttttggtggcttcaggtttaccgaacacatttgctcctaacaattctgatttatttttagaatttgcgcatttacttcaattccaacgagaaagatccacgcaaatcctgcttcatcaaaatggccaatgccgaatttttttacggtttcgaatatttggggattcaagagaagcttgtccaaacccctctcaccgatcgttgttatctcaccatgacgcacgcattgcactgtcgtcttggagggagtccttttggcccagctggaacaggaaaaacggaatcggtgaaggcacttggccaccaacttggtcgttttgttttggtgttcaattgcgacgagactttcgattttcaagtgctccaaattttttttcgtttataaaattcatgacttaacaggctgttggacggattcttgccggtctctgccaagttggagcttggggatgttttgatgagttcaatcgtctcgaggaacgcatgttgtctgctgtttctcagcaaatccaaatgatccaggaaacagtgcgtgcagactctgacatgaaggtggaccttgtcggcaaaagcctcactgttaatccgaacatggccatcttcatcacaatgaatccggggtattctggacggtccaacttaccggacaatctcaagcaactgttccgttctcttgcgatgacatctcctgatcgtgggctaatcgctgaagtcatgcttttttctcaaggatttcaatctgccgagatactcgcaaacaaaattgtcccattatttacgtaatattcatttttcaacttaaattgcatggttgctttagtctctgcaaggaacagctttcgaaccaatgtcattacgactttggcttacgtgctttgaaatatgtgcttgtttcggccgggaatatcaaacgcgatgcgattcaacgttcttacgatgaaccaagccaaagcggggatggagctggagaacaggcagtggcaagccaaatgtctgaacaacaaatgctcatccaatccgtgtgcgagactttgacaccgaagcttgtctctgaggatatcactcttcttcaatcacttttgcatgacgttttccctgacatcagttacagcccaaaacaagtggaaaggtgcaaatttctgggttttttaagaaaaaaattgtttgttttattttcagcctcaagaacgaagttttgaacatttgcaaaaccgaacacttctcatgttcacctatcactggggagaagggaaatctttggctggagaaagttcttcaggtttaccaaatcaccaatctcaatcatggcctgatgcttgtcggcgcgagtggatcgggcaaaaccactgcgtggaagacacttttgaaggcgttggaaaatcatgagctcgttgaaggcgtgtctcatgttattgatgccaaatctatcagcaaagacacgctctacggcactctcgacccgaacacacgtgaatggactgatggattatttacgcatattattcgaaagtcaatttattattaatttttaataggttgacacaattgtttagaatcattgacaatgttcgtggagaattggataagcggcaatggatcatctttgatggagatgttgatccggaatgggttgaaaatctgaattccgtacttgatgacaacaaattgcttactctgcctaacggggaacggctttctattccaccaaatgtgaggcaatattaatttcaaacttatttcttttatattaggttcggatcattttcgaagttgctgatctcaaatttgctacgatggcaacagtttcgcgttgtggcatggtctggttcagcgaggatgttgtcacccccgaaatgcttttcgaaagctttttgctccgaattaaaaatgagccgcttatctccgggaatgcgaatcgactgctgaatattcaaatcatttgtgaaaacacgctttccatgcacatggacgcaaatgggctcgttccgctctgtttggaattcgctgttgagcaattggaacacattatggagccaacccgacaacgccttctgctgacctttttctcaatgcttaatttctctgtcaaacaattgctgcaatacgattcagatcaccctgattttccaccatctgtaagttattatgttgtgaatcaactatgaaaaaatttcaaggaggaacaaattgccaatttcatcagccgttcattgcttgtcaatttgatttgggcttttgctggtgatgggagttggaagaaccgaaaaagcttgagcgattttgtccgcgcttccactacaattcagctaccgccggaccaatcggtattttgatttatattttaaaaattgccttctttgtcctagctcccaattactgattactttgtgaccacggatggcgattgggaatcttggctgacaaaagtgccacaaattgaaattgaaccgcaacggatcactgatacacttaccgtaattcccactctcgacacagtccgccacgagatgctgctgaacacttggctcaacgaacggaagccacttgtgctgtgtgggcctccgggatcaggaaaaacaatgacattgttggcggcattgcggttgatttacttttctatttgttttcatatgatgaattttttttatttgttaggtcactgcctgacatggacgtcattaatgtcaatttttcttcatctactacccccgaattactgatgaagaacttcgaccattactgcgaataccggaaaacaccgaccggcgtcgtacttgccccagtacagatcacgcgatggcttgtgattttctgtgacgaaataaatttgccacagccggacaaatacggaacacagagggtcatttcctttatgcgacagttggttgaacaggttcaacgccgacgttgtgcaatgcttttactcttgttttttagaacggcttctaccgcacgaccgaccgcacttgggtgacacttgagcgtatccaattcgtcggggcatgcaatccgccaactgatccgggcagaaacccattgtctgcacgttttcttcgccatgtgccagtcatttacgttgactaccctggacgtacatcgctcaaccaaatttacggcacttttgctcgagcaatgcttcgtcaaacaatgcaaatacgaggaatggctgaaccgctcactgaagcgatgactgatttttacctgcagagccaggcattacatatttcatctatttgtaaattacagtaaatatttaggagcattttactcaagatgatcaaccccattacgtgtactcacctcgagaattgactagatgggtgcgagggataagcgaggcgattatgcccctggattccgtttctcatgaagagcttgttcggctttgggctcatgaagcacttcgtctgttccatgacaggcttgtgcgggacgacgaacgagtttggaccaatgaactggtggatcaagtcgcgcacaaatattttgctgcttcctgtaatttggacgcggcactcgaaagaccattgttgtattcatgctggttgaagaaggtttagtccgtctttttcagcattaaaaattgtttggtttagcattattcgccagtgtccagtaaagaattggaggactatgtcatgcacagaatgcgacagtttgctgaagaggaattggatgtgaagctcgttcttttcgaccaaatattggaccatgtgttgcgcattgatcgcgtattccgacagccacagggccatcttctgttaatcggagtgtccgggtcgggcaaaacaactctgtctcgtttcgtcgcttggttgaatggattcacgacaatgcaggtagtttttttttggtttactgttcgttttcaattttactttatattattatttttcagcttaaagtgcattccaaatacaaagctgccgactttgatgaggacattcgacacgttcttcgccgagctggctgcagaaatgaaaagatatgctttatcatggacgaatcgaatatgatggagactggctttttggagcggttaaacacgttattggcaaatggaaaagtgcccgggcttttcgaaggcgacgatttcaatacacttctcagtcaaatcaaagaaggagcacagcgccaagggtttatgcttgactcacacgaggagctatacaaatggttcacggcacaggttttaaatttaaaactttgctgtatatatatcaaatataaaaagatcgttcaaaacctgcacgtcgttttcacgatgaatccctctggagatggactccgtgaacgggcttcaacatcgcccgcactgttcaacagatgcgtccttgactggttcggcgactggtccaactcggcactcttccaggttggccatgaactgaccagcatgtgcgagatcgacaagtccgactacactccgcctgccgcgctggagcattgttgcgatcgtttgcccactgaaattgcctatcgcgacgcggtggtgaattcattcgtgcacattcataacattgtccggaagacaaatgttaccgagtcgcgcaaaggtcaccgcgtgatggccattactccccgtcatttcctcgacttgatcaaacattatgtgacaatgagcaaggagaagcgtgatgtgattctgcatttagtttaatttgtatcataacaaatatttaggaacttgcggatgaacaaatccatctgaacaacggattgagaaaaattaacgagacggagcagcaagtcaaggagttgcagaagtcgctgaatgagaaagaagtcgacctcaggaagaaacaaggggaagccaatgcgaagttgcaactaatgctgggggaccaacgcgaggcggaaaacgagaaacgcacctccgaaacgttgcagaagcaaatccgagaggaaaaacaatgcattgatcgaaaaaaggacgaagtgaaacgggaattggccgaggtttgttcagttaacaataaaaaaacttattcattgaatggacacgaggggagggtgaaaaaccttcctaaaaattccaggttaaacctgccgttgaggaagcgaagagcgcggtttcgggaatcaaaaaagctcaattggtagaagtgcgctcaatggcatcgcctccaaatgcggtgaaaattgccatggaagccatctgtttgttgttgggcgaaaaacaaacggaatggaagtcaatccgcgcaatattggttaaagacgacttcatcccgcacattcttcaattcaacacggattcaataacaccggaaataacggagaaaatgaagcagtatgaaggcaaccctgactgggaatttgagaaggtccgttattacaatatattaataaaataagaaatccaacaattcaaggtcaatcgggcatctgtcgcttgtggaccaatggttaaatgggcaagggctcaactttcctacgcaaaaatgctgaacaaaatcgaaccgttgaacaatgaattgaagcgtctggagaaagatgcggaagaaaaaacagtgaaaggcgaagaattgaagcacaaaatagaagcgctcgagaaccgaattcaggaactgaaggtaactgccaactgaattacaggtacaaaatattttcttaattgcaggatgaatacgcacaactcatcggagaagcggaacacatcaaacaggacctgcaagttgtgcaggaaaaagtcaacaggagcatccatctgttgaaatctttgcgggtggaatgcgatcgttgggagacaggcagagaacgatttgctcagcaaaatgagacattggtgggcgatgttcttctttctgccgcctttctttcctactctggctactatgatcaactgctgcgcgacacaattttccaaaaatggatgggaatattggattcctcacaaattatgttccgtcatgagcttgctcgcattgagtatctgtcaactgcggacgagcgcttacaatggaacaataatggaatgccgaaggacgaattatgcacggagaatgccattatgctcaggcggttcaaccgtttcccattgatcatcgaccccagcggacaatccatcgaattcatttgcaaagaattttccacagcatctggcaaggaacatcaaaagggaggctcggtggcaacaacggttcaactgactagttttaatgataattcgttcaggtataaagtgagaaaaataccaaattctttattttaaattttagaaagaatcttgagtcagcgcttcggtttggcacaactttgcttgtgcaagatgttgagtcctatgatccgatcctcaatcctgtgttgaataaggaggttaagcgaactggcggacgtgtactgatcacaattggtgaccaagacattgacttgtctccagctttcaaaatatttctctttacgcgcgattcttcggtaatttaaaatttcgttaaaacaattgaatttttcacctaaaccccaaaggttgaattcccggcggatgtgtgctcacgtgtaacttttgtgaactttacgataactcgtgctagtcttgagacgcaatgccttcaccaagtgctgcgcagtgaacggccggacatcgacaagaaacgaaatgatcttctgaaattgcaaggagaatttgcagttcgactgcgacatcttgaaaaggctttgctaaacgcactgaacgagtccaagggtaaaatactggacgatgactccgtgatcgcgacgctggaaaaactgaagaatgaagcacaggaagtagcaaagaaatctgccgaaactgaccaagtcatgaaagaggtatagacgttttttaatgatcgtttcgaatcgattcttctaaattctaccgccaattcccataggtcgaaattgtctcacaaaaatactacaagttggctaatgcgtgttcgctcatctatctcatgttgcatcgtttggacgagattcatttgctctacaattattctctggactttttgctggacattttcacaactgttctcaagtcaccacaacttgggaatgtgaaagactacgatgctcgcctgtcaatcattcttcaaaatctcttttcggtcttttttctttactttactgctacaatagttcctcttgcttaaggtgatgtactctcgtgtttccataggaatgcttcacaatgatcaaattctgctcgcttctcttttgctccggatctattctcgctgttgcggtgcagagaatgcctacgagcaggaattggagcagctcacagcccttcctcctgagcaggtgctttcctcggcacacatgcttatgacgaaggcgtttggttcggaattcatgcaacaggacaaagtggttaacctccgtgaaataattttgaatgaggtcagacaaaatgtaagataccacttgcttataaaacatctcttattaaaggttcaatgtaaagtgcccgttttgttgtgttcagcgacaggctatgacgtctctaatcgcgtggaggaccttgcatttgagctgaaaatggacattttgtcaattgcacttgggtcagccgaaggatttgaacaagcggacaaagcgttgcaatcgacaagccgatcaggaagatggattctgctgaaaaatgtgcatttggcaaccgaatggttgactcaacttgagaagaaatttcgccttcacaatccacacccacattttcgtctgattttgacagctgaaattggctccgctctgccaatttctatgatccaggtgtataatttaaaaatttacttttttcaagttccaactattttttcaggcttcacgtgtacttattttcgaaccatccacagggctgaaggcgaatctgttgcgttctctttcctccatttccccggcacgaattgcgaaggcaccagcggagcgagctcgtctgtacttcattatttgctggttccatgccattgtgcaagaacggctccgctatcagccactcgggtgggccaattcgtacgagttcaccgacgcagacttccgagtcgcgtgcgatactctcgattccactgttgacatggtcgcacaggtcattctttgtttttcgtgatgatggttttctttttctatttagaacagggcgaatgttaagccggataaattaccatggctggctctccggactctgctctctcagtgcatttacggaggaaaaatcgacaatgattttgatcaggcaagtatacagtgggtttataagggaaagaaataatataaattttcatagtattataaatgtttgggtttgaaaatcttttcgccattttctcacctatctcgctagatgcattatttcacatttaatataatttaggtgcttctcgatactcttctcgacaaactgttcacatcaaattcatttgacgctgactttattctcattgaaaacatcggagtgaacgccttgaacatgccagacgaaactaactcaaaggatggtttgatcaactgggttattaacatcaaagccttacaaaagcctaattggattggacttccaaacaacgcagaaaaagtgcttatcgccgaaagaggtactgctttcacaaaccgaaatgccatcatgaagaaatcatttatttatcaattatagggcaagaatttatacggaagatgatcaaaatgtcggacgatgaacttgcatacgaagcggatgatttggaacgtaacaagcaagcccctacctggatggttcaattttctggacagtgcaaatcttggctcgatgctttgccacaagtataccttctttccctctgaaaagaattgacattcatttaattgttttcgtttattgtttcctattctatttttttagcaactacagcgtcttcgacggactaaagaaaatgtgcgcgatccgttgttccgattctttgaacgtgaaatcaacttgggcgccagacttttgtccgatattcgacgtgacctcaacgaattgttgtccatttgtcatggggatcagaagcagaacaatcacagccgtgaattaatagctgcattggtcaagagaaaacgtgtgccagacaattggctccaattttccgtgccaaaagacgtaacagcacttgaatggatgcgagactttgtgcaaaggatggaacaactaaagcgcttgtcactttcggaaaatctgagatatgaggaagtctggctgggtgggatgttctttcctgaagcgtatataacggctacgcgtcagctgatagcccaaacgaatggctggtcgctcgaacagatgtacatgcatatcacaaaaacggaggaaggacaattaaaatcaacagcattcacattgacaggtggttgatgatgatgaacttcgttttcatcgcacatttatttatagaccttcgcgcaattggcgttctttgtgaggccgacgaaattaagctgacagatgaagtgcatgttggagtgccacggcttcagttcacgtggaccttggaaggacattctccagcgagtgttgtggtgcctgtttatctgtactccaacagggccaaatttttgttcggacttaatttgttaccaattggatttgatcattctatgctaagccagcgaggggtcgcctttgtctccaattgttcgctttga

SEQ ID NO: 47187 - DNA, 971 bp, Heterodera glycines
  Genomic contig location: Contig_ID=SeqID_14221; Location=1644..2614; Strand=-
  SCN-specific regions: Sequence locations=1-383,405-443,465-539,572 -679,701-971
atgaacattggcagtgtggtgggctcggcgatgggccctcggacagccgaaatgcaccgtcgaatgctgcaaaggatgcgcatggacgcgtcgaatgtgccggaaaatcgagcatttaatacactggcacggggacttttccaagcctggtaagtgcaaaagagagcacagaaaagtgtcacttttatagaaatttcttagaattttcattaaaatcgatacaattttttcttcgttggtgccaatcttccgacccatcaaatattcagaaacttacttaaaatccaaagattcaaatcaatcatgcatgatggaaaaaataatcctaattaacacaagctgaacgtaactgcatttcatcacagacaatccctgatcacggacaaccaaaaacgttgtgattcgcttgatccgtgatcatgtccactccgcccagaaattaattattttcacttgatttttctaagtttaaaaccctatttaattgacccctttgctaagagaaaagtccagggcgatttttttttctcttataatttattacacagatttaaaaagcatttatttttaaggctccgattcggcgatccgaatgccgtggtcgtttttgccgttttccaagggtcaatgcaccgtttcgatgagcgcgccgtcgaatatgagctgcagcgaatttctgattggcaagtgaaagttgtgcgcttatcgtcgaaagaggcctattcaaagtgagttggtttcgatctacgataaatccggcgcctttgacagttggcatttaacggtgatcccggtaacatccaggggaagtggccggcgccgggtttttacccatattaaaaaattcacagccctttttcttgaaaaataaattcaatttcggaaaatttatcagccattttcgaagatacatccacatgatttctaacgcaattggccctgaaagttctcaacaccaattcgctttttag

SEQ ID NO: 47188 - DNA, 801 bp, Heterodera glycines
  Genomic contig location: Contig_ID=SeqID_2174; Location=891..1691; Strand=+
  SCN-specific regions: Sequence locations=1-801
atgagggcgtcgttgttacggcccggcacagcgctggcgaagggaatgtcggaagaggacgcgaaattgagacaacggatgctggaagtggccaagaccaaactcaaaaacttgacgatgttcgtctcaccaaatcgacttgtggtcagccaaaaggggcaaatcagcggagaaacgtttaaagtttttactgctttctcagatacacaacattcccttctcgtggaaggacgaccaactgaaaagcgtttgttcggaagcggccggcgattgtcccgcgacggccatctcagagtgccggataatgcggcaactgaagggccaaaacgaaaagggacgcgccattttgggaaaatccagcggattcggctttgtcaccttcaccgaacacactttggcgctgaactgcctgaggaagttgaacaacaatccgacgacattctctgacgaaagggttggtgaacgattggaatgccaacttggagaaaacatttttaattaaagaggccaatcgtcgaattttcaattgaaaatttgaatgcgttgagagtgaaggaaagacggcagcaaaaagaaacgaaaagcgaagaaaatgaggaggaaaaacaacaaacaaagaatagagtcggaaatgccgaggcattggagaaaacgaagcgcgaaatgatggccggcgggaagaaatggctgccgaaaaaattagggacgaaaattcggcacaaaaagccgcagaatggactcagcacgacgcctggcaaacgccgaggacagttcgtcgaacaaagggcggggatggtttaa

SEQ ID NO: 47189 - DNA, 2551 bp, Heterodera glycines
  Genomic contig location: Contig_ID=SeqID_14302; Location=1..2551; Strand=-
  SCN-specific regions: Sequence locations=1-47,69-120,176-188,237 -322,345-380,402-433,459-603,625-676,707-926,958-1037,1059-1292,1314 -1333,1373-1992,2014-2100,2122-2290,2312-2318,2341-2551
  Gene Ontology: Mol. function=drug binding; Cellular component =mitochondrion; Biological process=positive regulation of growth rate
tggacctggacctggattccatgttggacctggaccttgatttcctggacaaaaatccaggaaaatccaggtccaggaaaaatccaggctcctcgagacctggatccaggcctggactggatttttttaaatttattttaaaaatcaaaaaaatgtttgaaaaaattaattatttgcttagaagcatctaaaaatatctaattaataataataatgtgtttttaaatttatttaatctgttttcgaaaacttgaaaaaacatcggtcacttgaaaaaataaattctaaaattttgtccaggaaaatccaggttttttcctgttttgcctggacctggacctggattttttttcacatttgacctggaccttgatttcctggacaaaaatccaggaaaatccaggtccaggaaaaatccaggatgccgaaaaatggcctggacctggacctggatccaggaaaaatccaggcctggattcaggtccaggtcgatctctaaaaattatccaatttataaattaacgaacgggactgaaataaaaccaaatttaatacacaaaaaattaaaattcaaaaaatatcctattcaatttggtctttccttaatgtctttgaatttcaaattccttaatatcgtacaattttcaataatcgctcaagagtacgaaaagtcgacaatgaggtctaaaattttaaagttgaaaaattaacacaacatcggcctaccttaatttttaaaaacataaaagtgagtaaaaagccaatagaaaacttttttaatgtgacgggaaaattagcaaaatgcattctttaggaacattgactaacaccattcgacagcatttgcaaagacatattttcggaacattgttgaacggaagcctcttccagcaagccatggttttaaaaaattcaaaaaaaaaattccaaattttcatttttccccctttttcaaggttaggcccatcatcatttctggtccttccggttgtgggaagagcacaattttggcccgcgcaatgaaagaatatcccgaagcatttgcttttagcatttctcgtacgctttttcgtggcaattttttttcatatttttgacagagcaagaaatgcgtttaatttaggctcgtaaccagcaataattcgggtttgaaatggaaatttattttagaccgttaattatctggcaaaaatgctaaattttagataatttttaggcaagttttggaaaaaaattatttattgtggaaaataatgaaaatttagcgattttgacaaggaagttaataggacttttcctggttactggcctaaatttctccatttatttgtggaaaattaactttaaaaaattttaaaatcaaaattttaaagcaattttttgtgtcaattaaaaaaaaattgttttggttttttagataccacgcgaaagccgcgggatggcgaattggaccagcaggttgttgaaaatatcaaatgttggacttacattgttgatgccgagtattttctggcacttttacgcttttaacgggccgattttcataaaaaccgaaatgaggagaggaccctttaatttgctttttttttttgaaaaaatggtcccaaattcttgcaaaattctcaaatttctgttacaataagggtaaaattcggtggccctcccaaccgaaaaaactcaaaaattgtgtgtgtccccacaattccatttataattttccagcactattattttgtggaccgacgcgaaatggaacaaatgattgatgccggacaattccttgaacacgccgaatttggcggcaatttgtacgggacgagcaaaaaggcggtggacgacgtgcaaagcagcggcaaaatttgcgttttggacgtggagctgaacggcgtgcgcaacttcaaagcgctgcaatttgacgccaaatttgtgctcgtccgacccccgtccatcgaagtgttggtccgttactcaaaaaagggagaaaaaaaacagcaacttttagaaaaaagtgaacggcgcctctgactttaggatctatgggaccaagccaagggggggggggaggaattccaacccccatgccccacccctaaaaaatattttgttttcctagaaaaatagggaaatttaaacaatttcttatccaggagtgggttacttgctccccaaatttttttaaagagaaattaaattccaaaatttacccctccggcacacatttaatcatcgtggactcacatttaccatattttgaaactgaccacacaacattttgtttttggcgaaaagggctaaaaaatatattttttcctcggcgctagaaaacgtttaaatatttttcccaggtaaaatctggcctcatttttagggaagtttaccaaaatattcggggaaaaaattgggtttataataagcgggccataagaaaccgtactggattttcaaacagaatcgaaaattcaggaacaacgacttcgtcagcgcggaagcgaaactgaagagacaattgcgaagcggctgaagcacgccaaggaggacatggaagccggtg

SEQ ID NO: 47190 - DNA, 3895 bp, Heterodera glycines
  misc_feature (1345)..(1345): n is a, c, g, or t
  Genomic contig location: Contig_ID=SeqID_2185; Location=1562..5456; Strand=-
  SCN-specific regions: Sequence locations=1-20,44-55,87-124,146 -156,179-187,211-304,345-345,367-463,485-703,732-985,1007-1052,1074 -1375,1400-1427,1449-1492,1517-1528,1554-2074,2096-2103,2125 -2128,2150-2250,2274-2420,...
  SCN-specific regions: Sequence locations=...2442-2528,2560-2579,2601 -3331,3353-3378,3400-3748,3770-3779,3807-3840,3862-3895
  Gene Ontology: Cellular component=membrane
aaaccaggagatgtttatttgctggcgtacaatgccatccaatttttggggtttgtttttatttaaatttaaaaaattaatattttggtcaaaacattcagtctggaagaaattttttttgccttttccaattcttttttcccatcctttgcctgtgatttctgttttggttttcttgccttttgtttaaaagttttatcattaaaaattggcaatcctaaatttgaagtaattaatcccttttcaagatggggttccattcttgtgaagactgtgctttggttggccagcggacactcctttcccgaactgtaccaaaacgtggagatggaattgaaaatcttccaaacggctgccattttggaagtgagttttctcagtgaaaatgtgagggttggcatttaccgcttttgggggttctgtcggctttttgcattgactttggcaccaattatttcttctgtttgtttttcagattgttcacagtgtcgtcggtttggtccgttcgccggtgttcaccacaattgtccaggtaagcttacaattaccagcatttggcttccaatgccaagaaatgctgggaattaattcgtttattgttttgttgtcggcacttttttttttgcttaaggccccagaaacaaatttatagcacaaatagtggaattgagcctaaaaaagtaataatttgcaatttcgtaagaattttttaatcatttaaaaaaaattttgtccaaatattctccatcaaaatttttcaaagaactgttccctgttgtcattggttttcaatcttttcattgtacagctaagtgactgtcgataatttttcggaataatttttcgaaaaattttagaaatttttcgataaaaatgatcttttttaaatttcggcaatttatgattttctctttttgttcaaacccctccgttctcccaaattcctccttcgttatttctgtgtcggtcatacatcaaagcaattgctactttctgctcataaatcaatccttttttgtccaggttttctcccgtgtcactgttgtttggatgattttgcacaaagttgcctcggtatgatttattacaattgcatttaaagaattagtgaccgatggagggggggggaaagcaaatttttgatttaattttcggctcttcacccccaccacatgtttataatgccaatttttgggttttcatggccactgatcacgaattaggcatccatctttgaccattttcgaatgcgcgaaattcgtaacgaatgaggagaataacagaaaaaaacacgaatcttgagaaaaaagtggtcaagatgaatgtcggattcgtgggcagcggnccatgaaacccccaaaaaattggcgtttttaattttgaaaaaagtggggaaaaattgtggggatgaaactgcataagagcccttttggtttttcaatttatttcccattttaggcccgtctcagttttggtgtgccaatgcttttgctcgcctggtccatcactgaagttgtccgctattcgttctatgcgctcaatttgctgaacgctgtgccctacgcattgacgtggatgaggtgtgaattaaaaagcaaaaaaaaaaaaaaaatgccgtaatttcgtggaccattcacatggggggggcaaaaggtacgccattttgcgaactccttagaatgtttctgtttttccaagaatgcctaactatggttgattttgctcacatttggccatttaaaaaaaaaattgaataaattccataaaattctgccttcttaagttttatatttatccgaattacatcccatctgtcctttcaggtacacttttttcattgcgctttatccgatgggtgccggcggagaagtgctgacaatggtcgccgcattgggcgaaattgcacgacgcaaacattttacaattgaaatggtcagcaaacgcttttgaaaaaagcatggacccggattccctgttggaactggatttcccggacaaaattcaaattgttgaaaaatggactggaaaagcccaggcgtgggtccgcaggtcgggctctagaaattatttattgtcctcaaaataagaattctttgcttttatatttgtttatttattaattcacattatcttttttggctttagcccaattcgtggaacatgagcttcaacttttactacattatcatcgctctgtgtctcatttatttgccgggttttccaaaactttacgggtaatttaattgtgaatttaatctttttaaaaaatgtgaattctgctttttcaggtacatgttcatccagcggaagaaggtgctcggcggaggagggaaaagttcgaaaacgacgacggaaggggccaaaaaattggaatgaagcgaaagaaaagaaaactaaaagggcgaagaagccaaccttaattttgtttgttataaattagacaatttcttatttattgaaagaaaaatctctgaatgcttggagatacctaattaatttttgattttaccttaatcctcaaaaattagttaagaaagtccaaaccttaaaatttattttatgagatcccaataaaaatggctaaatgaatggtaaaatgataaatatagtacaatagaagataacataaaaaagagaaatgactagaatttaaaattacaatttgctggttgtcagcagtcgatcacttcgtttatgcttttcttccatgtcggcgaccgtttgtccaacaattgttcatgggatggatgccgtctgttgagcaactgtaattgagaaagcacttttgtaaaagcgtcggatatttcaatagcagtgataatcttatttatgttcttatagcatggtaacgaaaaccaaatggggaattatttttccaaaaactaatttttcgaattttgttttaattgtccaaaaccaatttatgcaattacccaaaaccacaacataaatgggggtcagtcaaatttgactaattgtaaaaatatcaaattagttgtgaaagcttttttggagggttttctatcggcttggctgaagataaatacgggcacctattttgaccaatgtaaaaccccgaaagcaaatttgaataaatgttgaaaaagggagacaaccatattaccagtctaaaataagtttggaaatataaaagtgagttcctcttttgattttaatgctcctaaacccgaataatttcctcatttgtctcactaaaatttaaatgggtgtaagaaactaacgccagtcgaacggcgattcaaaattccaccaattgtcacttcgggtctgtcgtcacttccacaaaaacctgtatcattttcgtcgtctgacgactgatcactgcccaccagcgcaagggtaagaagcaaaaccaaaataatactgaaaattggggaagttagactagaaaaaataaggtttgaaaaccctatcaaagtgaaaaagaacggttggttgaagccgaacacagacaaagcaaaagtcatcggaaaaggaggcaatttgtaaaagtaatcaaaattaggagtaaatacctaaaaattagggtgtaagttacagtcaacaatctaatgataattatgatggtaatggttacttttactggtccctaaaaaaaagaaaaaaaggcgtttttatgatattttgttctactcgggggttatcggggacgctgatcacgaatatgacatcatctaatacagggctgccatcgtccatcctccgtttccaaggacgggtatgccgattttcaaggacatagtggggaaaattcatgaaatccaaggacatttaaaatttttattatatgcaatgaaaaatggttaatattagtagttaccccccaagattttggcccttaattttcagccccgccatttcagtcccaatggaa

SEQ ID NO: 47191 - DNA, 1703 bp, Heterodera glycines
  Genomic contig location: Contig_ID=SeqID_14360; Location=167..1869; Strand=+
  SCN-specific regions: Sequence locations=1-143,165-613,636-971,993 -1374,1397-1450,1473-1703
  Gene Ontology: Biological process=embryogenesis and morphogenesis
atgcatacccatccgttatctgttgatcatggccgaccaacgacacaacgacttccaacacatcagacctgtgcttttgcgttatgttgtgttgagcatgccccatcttttgccggaacaagaccatttcgacgcgttcagaaggtcgacaaaaagggcaagtggggatcactggatgttgatggtctcgtattttatttttgtctcatttttctcgatttttcatccattgttgttacccttccccttctttttcgtgcgggtctttttgttttttgcaatttgtgctttttgtccttttctttcatctcccattcattgtcagtgcccaccaaaagggtgcctttgcttcttcgccccgtcgtcctctgctcatttccatcgacgaatgctccgtcgctttggaggaggccagcatttcgcacaatttcagtcgcctttccaagtcactcgacattctcttgggccgtgcaactgtggagcagcaattctgctactacgagctgatcctcaaggcgatgagtctctctttggacggaaaatggccacgggcactcgtcgacaaattgcaattggcctgggaacgttttgacaggtgggccaaggcagtgtcgaggattttgtacaatttgcttcggcagcgttattccccgtcgtcttcacgaggattctgtccgtctttggttgtcctccgctaatgccgccaaaatcagtgggctcgaccagcgcgacaactcctttctcattgcccacacgccgttggttctgttccgcgttgactcacgcattttccgcagtcccccgcacttgcgttgcttttgtcgttcgttgtctttttatttggccgcttcacgcgacatgaacacgctgcagttggtccgttcttctctgaacagctccaaaaggtccctccctttcatttttcattttaaagtcatttttaaacagcgaaattgaggagaaagaagctctgctccgttcttttggtggcactcaacgattggccgttgttcaaacatacattgaactttgtgacgacgaggacggcaccgaaattgatgacattgaggagattcggcagattttatgctcacaaatccaccaattgtttattgcggacacccatcttccaaagctcgtccatttcaatgttcttttatcatcgcccgattgatttggcattttcctattttcagatgtatcccctcaggcttgtccctgtcattgtgcaacgtgtaccctcagcgcatgtgctgatcaattccatcaacgagctgatcactggcagcaatttggagaggcgtatttttgcgattgtgctaatcactgaactgcttgaacttgtcagttcccacagctttgtgtcaactttaaccttttatgttttcatttttcagtataaaattccgagcgccttcgctgctctgtcgctgatttctgacatgttagatgccatgttggtcagcttggtcaccgacgaatttattgtcctgatgctaaacgtcgtcccgtctttggctcgcctcgttctcctgtcaccattccatgccgaacagtttttgaccattttggaacgcacgcggaaactcgcattcagtcggatggccatttatagcagtttaagccaggcaagaaaatcgccagaacggaaactgtttgaaatggtcaacaggacaatggaagatctcccaaaattgacataa

SEQ ID NO: 47192 - DNA, 1673 bp, Heterodera glycines
  Genomic contig location: Contig_ID=SeqID_14362; Location=1..1673; Strand=-
  SCN-specific regions: Sequence locations=1-365,387-935,957-1213,1236 -1448,1470-1479,1501-1616,1638-1673
  Gene Ontology: Mol. function=nucleic acid binding; Cellular component= mitochondrion; Biological process=embryogenesis and morphogenesis
cccttaatcagaccaaattcgtccattcatttggtttttctcttcagaagccctccctcaacgccacaaattcggccggaattcgtccgagtgccgtaaaaggcgccatcgaatttaaagacgttcactttgcctatccctcgcgcccccaactcaaagtgctgaagagcgtttcattgcgcatcgatgcgggcgaatcggtggcattaatcggacacagtggaagtggaaagtcaacgatagtggcactgctgatgcgattctacgaagccacaaaggtaatctgctgctgatgctgcagggtacggtagacacagtaacggtccgaacgatacggtagaaagctaaaaggttctctttgttcttttagggctgcgtttcgctcgacggcgttcctttgagcgatttgaatgtgccgtggctgcgccaaaccattggccttgtgcagcaggaacccgttctgttcgcggcaacggtggaggacaatttgcgcatgggaagagaagaagcgaccaaggtggaggacgaaaagcggggaaaacatttcataaaagggaaatgaaggaggaaatggagacggcgtgtcggatggcaaatgccatcggatttatcaacaaattgccccaaggcttcaaaacgctggtgggccaaggcggcattcaattgtccggaggacaaaagcaacggtcagcgaagagcacaaatggattgcccatcccattttgtaaatgttttacaattagcttggccattgcgcgtgttttgctgcgcaacccgcgcattttgttgttggacgaggccacttccgcgttggatgccgaaagtgaacaaattgtgcaggaagccattggtcggttggcattttgccatttccgaattgtgccaatgtgcacctgataaatgcgaatggcaccactcaaattggcattttttcccttcttcagacaatgcttcctcgggacggacgaccattaccattgcccatcgcctttcgacagtgcgaaatgcggacagaatagtcgtttttgagcatggccgaattgtagaaatgggcaaccacgagaaactgatgggaaggcccaactccgtttacaagcaaatggtgccgaataaaaatgaaaaagggttaaagtgggggggggggggacaaaagaacagagaaagagcgaaattcaattgggccaattaaatggcattttaggtaatggcccaacaaattgaaaaagaaaagccaaagggagccgaggcgggagaagccgcttttggtaataattggaagattatgaaatttggccatgactttgacagacgtcgaaactcagtgcaaaatcagcgaaaacgcatcggaacgcaaaatggcgcggatgtcggagagaatgcgccgttcgattagttcagtgaaatccgttgggctgacgagcaccgccggaggggacgaagaagcgaaattggaggagtaatgaccaaacatagcacagcacagaacactttgttcttgtttgacagattggacgacgaactgcacgagatgggagctcgacctgcgtctccgctggacattttgcgatatgctgggcccgaaatgccctttgtattcttcggtgtggtcagtcggccatttggccagccaacaaaacgtcgccggacgagaaaaatagccaaaaaataagact

SEQ ID NO: 47193 - DNA, 572 bp, Heterodera glycines
  Genomic contig location: Contig_ID=SeqID_14363; Location=138..709; Strand=+
  SCN-specific regions: Sequence locations=1-521,543-572
  Gene Ontology: Mol. function=protein serine/threonine kinase activity; Biological process=protein amino acid phosphorylation
agcggttctcgtcatgccgtggccatcaaaatggagccgccgtccaatgggccgttgttcaccgaaatgcacgtgtacatgcgcgtgctgaagcctgaacacttggacaaatggaagaaggacaaaggtggggttggccgcagatttttgaggaaaattaaggtatttttagatttgtggaattttttggtttcttaactaaaactttgacttgtctataatttttggacttgtatttgttaggcataggcttacggatccgtttgacgccttgcggaacttttgtatttaaaaagtgcggaatttggaaagaaatctcccaattttgggtagcattttacccccccccccatttttagggcttaaattcctcggcttgccccacttcatcagcaacggctccttcacttacgaaggccaacaaattcgctacttggtcatcccaaagttcgccctttccttggaatccgtccgcgcggcgcgcactccgtcggcggtgctcagttggaccgaagtgtccgccgtggccaaaacggtggtgcacgcgttggcgtacctccacgaccagggga

SEQ ID NO: 47194 - DNA, 2797 bp, Heterodera glycines
  Genomic contig location: Contig_ID=SeqID_14364; Location=415..3211; Strand=+
  SCN-specific regions: Sequence locations=1-162,184-282,314-423,448 -851,887-944,967-1089,1116-1217,1239-1253,1275-1340,1380-1384,1407 -1561,1583-1697,1727-2099,2121-2208,2231-2605,2627-2742,2766-2797
  Gene Ontology: Mol. function=casein kinase activity; Cellular component=nucleus; Biological process=protein amino acid phosphorylation
ggctcaaattcctcggcttgccctacttcatcagcaacggctccttcacttacgaaggccaacaaattcgctacttggtcatcccaaagttcgccctttcattggagtccgtccgcgcggcgcgcactccgtcggcggtgctcagttggaccgaagtgtccgccgtggccaaaacggtggtgcactcgttggcgtacctccacgaccaggggagttgggctctgttgtaaaatggaaaaacaatttttttaatgctatctctttgggcgcttttgcattttctttttaatttttttattatcattttttaaatgtctcatttcctcctccattttgaatttcatttcttcagaattatgtgcacggcgatgtgaaggcggccaatctgatgatggagtccaaaagtgatttttcccgggtcgtgctcatcgacttcggcctggccaggcgattgcccgacgcactggtggagaaagagaacaaaaagcaaggcgaggagagcagttgccattgtgaatttccaattcgcctgaattggaaattcacaatggcattttatgccatttaaatgccggcattttcattttcgattttggcatttatttgtttcttttggctgttcagctcacaacggcactccgctgttcacttcctgcgacgcccaccgcggctgtctgccctctttccgtggcgatttggagattttggtgcacaacatgttctactggacgaccggcacattgccgtgggaagtgagcacaaaacgggcacaatttgaattttcctaaaaatattttgagtctttatacctcctttaaaaactttttaaactttttttgccggagaattcgattttaaattatgaaaattaaaaatttcaaattttgaaagaatttccgcggcggtggggcgggggaaggggaggcaaaatagaaagagcactaaaaatttaaaaaatcttaaattcttcattccaaattcacaatttaatctccattttccgcagtctgtcgagcaaaatttggacgccgtgtacgaggcgaagaagtcgctggtggcgaacgcgcgccgggaggtgccgcgactgatggccagcagcagcggcagcaccgagcagagccaaacgcagcaaaagcgacgggcgaccgccgccacggccattgcggcactgtacgcacactgtgccggcatggaattcggcgagaagatggagctggacacggtgctgcacgcgctggacggacgatgatttttgatggcatttttatggctggcagcggcggtcgacgggaaaaaccaatcattgaattttgatgattgattgcattgaaaaataccacaatttttattttatttattgtttaatttgttttatttatgtatgactctcttttttggtgtatctcaacatggaaggaaaggggcgacgctttctttcctcccctaacaatttgagcattgtttttttttcatttcctttatttttctttttgtttatctctgttgtgtatgataaatgacgtcatatcccctaaatttcaactaaatacagttaaaatacttaattttaatatctccaaaagattttgggggctaattatcatctttatagtgtttttattgttttggcattagtttttgatatatgtttataatttgccttcaattcattctcatttacaaccaacccaattttgccttttgcccttcccaacaaatccctcccccggggggtcaacttccttccgcccccccccaagggctgaaatttatgcgggagaaatggggcggcaatgaatggattggatgtgtggtgccggtgattaatggcatttatctttttgccgggagggcgcccttcccggcaaaatgtcggaagagtccggcacaaatatttgtgtgtttggtgcccgtttccctcccaccgcaggcggccgattatttggccctattcgaatttatgcggcggcggtggcccaaagacgccgccaaataaactgtgaaaatgacctcaagaagggcatcatcggaaaagccaattcgaagtcgaagggggtggtcaatttgggggacggcataattcggaaattatagaaatttgacagtctttggactacatacctaattgagctaataacggaatcctaaatcctgttcatggttgaattggatcaacggattgccgagatcagtccgagactctcggtcctggcacttttccataaaaaagtgccggaagttcgggtaaattcacagtcattggactgtttacctaattgagctaataatggactcataattctgctcctgcttgactggatcaacggaatgccgggaccagttcgagactctcgaccttggcacttttccattaaaaaaatgccggaagttccggcaaaatgccattgtgagtgtctgtatgccttctcctttgcccgggtccaccgttctctccgaattatataattacaatttatttctcatccaatttcaacatcaaaaatggtgttaaatttgctttttattccccccccctcaattggtccccattttcaattgttcttcaaaatgttcctctgtcgtcgtcgtcgtcaaatcaaattcctttcccctcaattaatttttcacttcccatttctcctgatcacattccgtccaatttgatttgattaaaaaaagttgtgtgaaactcaattttattccgtccgaacaaatcacagagcccaaagcccgcaaaaaaagagagagaagggaagtgaggagatagcgatatgaaccccaaaatgaaattcaaaat

SEQ ID NO: 47195 - DNA, 1173 bp, Heterodera glycines
  Genomic contig location: Contig_ID=SeqID_14373; Location=1..1173; Strand=-
  SCN-specific regions: Sequence locations=1-265,287-454,476-1173
  Gene Ontology: Mol. function=protein kinase activity; Cellular component=cytoplasm; Biological process=signal transduction
atgccctcaaacacaaaattgaaaccagcaaatttaaagcatcccgaggtcgccgaattattctcattgaaggaccccgagcagcgttatgaagacctccgcgaaattgggcatggcgcattcggatcagtgttttatgtgtgtgttcgcaattaagtacgttaccgaaacaaatttcttcgatttttaggcacttgacaaagacacgcaagaaacggtggcgataaaagtaacaacaaattcttgggatttgggacgttttctgaatgaattcagaaaatgaatttctctgggaaacaatcggtcgagaaatggaacgatatcatcagagaagtgcgctttctgaagtcggttcggcacccgaacattgtctgttacaaggcctcctttctcaaggagcactcttgctggtatttgcctgcgaaaattcctttggctcgtcactcactaaatattattttcaggttggtcatggaatattgtgtcgggtcgactgccgatattttaaaggtttttggtgattctctcccccttaaatccaatttaataatttttccattaaatttgaggtgtacaaaaaggctttcctggaagtggaaattgcagcgatttgcgagcaaactttgaacgccattgcacatttgcacagtttgaagaggatacaccgcgacataaaggcaagcgaacaccaaacaattgagaatgagcaccgtttgttttcgaatggacacggacttataaattaggctcattttgggtgacaaaattgcccattattcgcaatatttgttcggtttaaaaaatgatctgtccaatagaacccattgaacatgtattatatcttcaaaatgctcaaataaactgatttaggctggtaatattctgctcaccgagtcgggtgttgtcaaattggccgacttgggcagtgcgtctctcagttcgccagcccaaacatttgttggaagtccatattggtaggcatttaaaaagcaaaacccacttaaattctcggaaattgggtttaggatggcaccggaagtgataatcgcacaagacactggcggtgtttacgatgaacgtgccgacatttggtcctttggcatcacctgcattgaacttggtccaactttaataataattggtttttaaaataccgacaaaaattacatttca

SEQ ID NO: 47196 - DNA, 1827 bp, Heterodera glycines
  Genomic contig location: Contig_ID=SeqID_14378; Location=904..2730; Strand=-
  SCN-specific regions: Sequence locations=1-538,560-816,854-1107,1143 -1202,1234-1419,1441-1531,1553-1631,1658-1704,1727-1748,1770-1827
  Gene Ontology: Mol. function=ubiquitin-protein ligase activity; Biological process=G1 phase of mitotic cell cycle
atgttggtcagcatttacgggagtaaggacctgttcgtcaaggagtatcagcacttgctggcggagcgactcgtgcacaacggatgggaccgctatttgcagtcggagttcaattatttggagacaatgaaacggcgcttcaccgacggagagctgaaccattgcgaggtcagtctctttgcacacctcgggatgactgcggttggtggaatttctgttcattttggtaggttatgctgcgtgacattcgcgagtcgtgtaaaatggcaagtcatgcgaatgcatctttgccattttccgtttgtccacggatcatttcattcaattattggcctgaaattgttgccaatgatggccagcagagcgagacgccatttcggcccgtctttaaggaagcagttagtcgttacactgaaatttttatccaacacaaaccggcaaggtccataaattggcacacaaacaatgcccaagtaaacggaacgtaaatactaacaaaagtaaatgtttaattgaggtggaattggagcttgaacttgatgggagaaatgttcaaattgttgcaccattaacccaagcccaaattatccttcttttcacggaaaagggtaagtggacttgttttgaatttgtgaagcaacttaatgctagtggggtgcattaagttctcacggagaagaacaaaacttcgccgggacaaaacattagcaaagaaaatcaatttcagttgaaaaaaatctggattccagcgaattttgcgatttggacagatgatcttgataggggtacctacaagaaatatcgaaaattttcatcttttttaagaattttttattttaatttttaaaatattcttttccaaatagctctttaaatagttgtagtaataactgtctaactcattttcagagatttgggacgtcgcatcacttgccgaggcaaccgaactggaaatattggacctaaggaagcggttggactggtggacatccaaaggacttctctcccaagggcccagtgacccgataactctcgaggacacattctatttagtctcgacaacggaagccattgaaaactatttgaagcaggtattaaggggtggtataaattcaattatattatttttagagcaatttgcatagaatctaatctttctcagagcgctgtccatcagagcggcactttttacgaatacatgtacagtgacgaggaggaggaggagaagccgttggttgaggatgtggccgaggaattggagcagtattggaactacacaaagggtttggtaagcggttgcctcgttgtttcttctgcaagctcaatatttgccttttctttcagcttatgcacagggcaacttgtgaacctctgactgcccaatttttgcatcggatgttcaaaaacttcacaagtcccggaaaaatggcaccctcgttggaagctgtccaaatatttatgcagagaaaaatcaaacagaatttggttgtttttgaaaacggagtttacaaggcgaccaaagagctcaaatcacaaagcaataacaccaaatgatgttttttgataaaagtttgaatcttttatgaactcatttcatttcgttaataagtaatgctatctttactattttcatttgtttaacttaaaaaattttcaaacttcgaattagttttttagagcctggaattttgaaatccgggtcgggattagggaaacggtcccattttacaagggtccaaacgaagggcaaaatttttaaaaatattataggtttgttaagaacgatatataatttttagtctatttttaagggagaaacgaaataaa

SEQ ID NO: 47197 - DNA, 1403 bp, Heterodera glycines
  Genomic contig location: Contig_ID=SeqID_2195; Location=737..2139; Strand=-
  SCN-specific regions: Sequence locations=1-710,740-770,792-1403
atgagttgtccaaaaaagatcagcgagcagagtgcgcttgcgttcaacagtgcgctgaacgtgttcaccgttccgcccacaaatgtgtcggtgtcgcgttccttcttccgagaactgttgccattgtccactatcagccaggaggggccctacctgttccgcttgttcaatgacaacctgtgggcggacatgtcgcgcgtctacctgttcctcgagctgtccatccaaaaggaggatggcggcggacgttgggtgcccattgaagctgcagtggccgccgatcaactcgtcgcgcccgcccaatgcgtaggacagacatttgtacaacaactcaaggttgatgtcccatagtcctcatgattgcaataaccagcaccaaatttaatcaggttgaggttcaaaacacggagttatacgacagcggaaccctctacccctacaaggcgtacttgaccaacgaactgtcctttccgaacagtgcaaagggacactttatggccagcgcgggctaccacccatcaaggaagcacgacgacgcgacggacgccggttttctggcacgctgtgcgcgcttcgcgggcggtcgtaaagcacgcttcctttcccggctggacttcgacctgggcaaccaggagctgtatctgttgaacaacatggacgtcctgttcaccatctatcgggcaaaagatgcgttcctgttacaaagtctagcggcggcggcagcagcagcagcggcggcccaacattacgcgctgtacctacacgacataaagctgtacgtgaagatggttgaggtgcaaccgtcgctgaacctgtccatctacaagacgctggaaaagcagccggccacctacgcggtacggaagacggaggtgaagtccgtgtttctgaccgccggccgtaccgagatggaccacaacatattttccgccgccatcccgcgccggctgacaattgcattggtggcgaacggagcgttcaacggccagctggcattgtcaccgttcaacttcaagccttacgcgatccgtgagatcagcgtgcacgctgccggtcatgtgtatccagcagtgccacaccgcatggacttctccggctgtgcctacattcgaccatttgttgacatgtacgaggcgttgggcatggccaactcggagcgctctatggacatcacgctggagcagttccacgacggatggaccatcttcgtggtgccaatgacatcgacgctggacgatagttgcggctttgaactgctccgctccggcaccaccagcattcggctcgcgttcaacgaagcgataccggcaggcggcgttgagatggtcgtgctcggggaattcgatcagttgatcatgatcgactacaaccgccatattgtatccgactcaaaaattgcataa

SEQ ID NO: 47198 - DNA, 1595 bp, Heterodera glycines
  Genomic contig location: Contig_ID=SeqID_14392; Location=1291..2885; Strand=-
  SCN-specific regions: Sequence locations=52-59,83-262,295-385,418 -478,502-672,702-762,784-847,880-980,1013-1082,1127-1235,1272 -1406,1472-1500,1534-1595
  Gene Ontology: Mol. function=MHC class I protein binding; Cellular component=tubulin; Biological process=embryogenesis and morphogenesis
atgcgtgaaattgtccatattcaagctggtcaatgtggaaatcagatcggttcgaaggttagtttattgttttggaaattgcttttcacacaaccaaatttcagttctgggaagtgatttctgatgagcatggaattcaaccggacgggacttacaaaggcgaaacggacctccaacttgaacggattaatgtctactataacgaggcccatggttactaattataatgttattttgtaatgcatacttttcttcgaatttaggtggcaagtacgtgccccgcgctgtgcttgtggacctcgagccgggcacaatggactcaatccgggccggaccttacggtcagcttttccgtcccgacaacttcgtgttcggacaaagcggagcgggcaacaactgggccaagggccattacaccgagggagccgaattggtggacaatgtgttggacgttgtgcggaaggaggcggaggggtgcgactgtctgcaaggctttcagctcactcattcgctcgggggaggcaccggttcaggaatgggaactctgttgatctcaaagattcgggaagaatacccggaccgtattatgtcttcgttttctgtcgtcccttcgccaaaagtattacaatagtttttcaaatttctttcgacctttacgaattccaggtttctgacactgtggtcgagccttacaacgccactctttccgtccaccaactcgtcgagaacactgatgagactttttgcattgacaatgaagcgctttacgacatctgtttccgcactttgaagcttcaaaaccccacatacggggatctcaatcatctcggtttttggattttcatctacatttgtctttgttttaattcattgcttttttagtttccgtgacaatgtccggagtgacgacttgtcttcgttttcctggacaactcaatgccgaccttcgcaaacttgccgttaacatggtccccttcccgcgtctgcacttcttcatgcccggctttgcgccgctttctgcgaagggagcggctgcatatcaagcgtgttccgtggcagaactgaccaaacaaatgttcgacgcaaagaacatgatggcggcgtgtgacccgcgccacggccgttatttgacagttgcggcaatgttccgtggtcgaatgtcgatgagggaagtggatgaccaaatgatgtcggtgcagaacaagaactcctcgtacttcgtcgaatggattccgaacaacgtgaagaccgctgtctgtgacattccgccccgtggcctcaaaatgtcggcaactttcgtcggaaactccacagccattcaagaacttttcaaacgcatttcggaacagttcactggttagtaaaaacgaactattagttatcgtccttcaaaacgttttttagctatgttccgtcgcaaggctttcctccattggtacaccggtgagggcatggacgagatggaattcacggaagccgagtccaacatgaacgatttgatctccgagtatcagcagtaccaagatgccaccgttgacgatgagggcgaatacgaggctgaggacaccacccaacccaccgctgaagtcgaatga

SEQ ID NO: 47199 - DNA, 1061 bp, Heterodera glycines
  Genomic contig location: Contig_ID=SeqID_14398; Location=461..1521; Strand=-
  SCN-specific regions: Sequence locations=1-44,66-73,116-391,421 -436,458-508,538-1061
  Gene Ontology: Mol. function=RNA-3'-phosphate cyclase activity; Cellular component=nucleolus; Biological process=35S primary transcript processing
atgcttcacggaaacatttctgacatttacattacgattgaccagaggaagggcccccagggcggactgtccgtttttatttattttaattttacaaatatatatttgttttaaagatctcccggctttggaatcttcttgacggctgaaaccaccgaaggcgtatttttccatggagaagcgatgtcgcgccctaagggccaaaacgaagaccaaacagtgccggaagaaattggggaacaggcggcaagacgtttgctggatgaaattcatatggtaagtgctttctcttatcatgggttcgaactgttcatttttacacatatatcttgtttttttctaatcattccaaagaggtcaacaaaaacctacaccgctaccttttccagggattttttaaatatttttaaaattatttttctctcgattttctgattttaaatatttatttactaatcaggacgggaccgctcctttcttctctaccgttttccgcgcccctggaaagttattttttaaatttttatgaaaatttttgagtcaaaaaagtcgactaggtttttttgttttcatctggtcagaatccgaatttcaaaaattatgttatattcgtgaaaggagaggccctgacaagctactgacatatggaatctagattatgcccataaacggaaaaatattgtattatagtgtgataagaaagaaagctttagggaggctgtgcagattcgtcctgtcaatctttggccgccactttcatgactctctgcgacagagatgtttcgaaatttctccttggtccactcacaattaacaggtgcatttttcaattctttgtctttttattactcgtttttagcgtacacacccttcggaatttgcaaatgtttttcgagcaaatgtttaaattggaggaatggtggaaggttatgaaagaaatcgtcggaaaaggcggaaatgcgatgaaaaacggaagtgaggacaaatgtttgatgacctgtgttggggttgggtttcttcaacatcaacaaagaccaactttaattgttcttttttgttaa

SEQ ID NO: 47200 - DNA, 1934 bp, Heterodera glycines
  Genomic contig location: Contig_ID=SeqID_2197; Location=1..1934; Strand=+
  SCN-specific regions: Sequence locations=1-481,503-777,799-895,917 -1694,1716-1934
  Gene Ontology: Biological process=gametogenesis
ttgagacgcaggctgcgacaacaactgcgcgtgaacattacccggcaacagtttcctatgaaggaccgctgagcgcaacaacacggaaatgggagctggaaggcgctccgctgaactcacatgtgactgtgtaccatcatggccgctctgatttggcagcacctgagcaacaacaaccagtcgctgagaaagtcacaacgaagataagctcattgttcaagaggaagccacaccatgaggacttcccagtctcggagcccttcactggccaattggatgagacggcaagggtttcggagctgttccacgaaccaatcgacgcaagtgtcagcgtctactcggccggaagatctgatgagcatgtcgttgtccagccaacaacaattgctgaggcggagcccgtaccgctcgttgagtacccgcgcacgacagcatatgatggtccactgcaaagcacatcgaaaggagcagaaatggaggggcagccgttggatgcacatgtttccgcctatcaccatgggcgctccgacatggcacccccagcagcaccgaaggagacaatcacaacaaagctcacttcaattttcaagaagacaaccgctcaagaagacgagtacccgcccaagactgagcctttcctgggaccggtggcacaaacgaatcgccaacgggagttggaagccgttccggtggtggacaggattgaacggatacccaaagggttggtgaagtgcgaaaatagtcataataaaaaaagaaaacctttttttggtttatccatgttggggtggggtggtctcgacaactaacacgggaaaaagccggccagcttttatgttaaaaatgcaaatgttctggcaaaatagacttcgactaatggggaatgttagagccatagaattttgaaaaattttttgatcacgacaatcaatttccagcttctacgaggaaggcgaactgcatccagtggtggtccatgaggagaaggaattgactccgtctgaggcggagaaaaggccaggaacattggagcgaattacgcacttgttcaagcggacagccacagagggagagtggccaatggtcaccgagccgttcactggaccgcatgctgagacatcccgaaagggggagcttgaagcacgcccgcttggcgaactcgtggctgcctatgcttccggccgttctgacgaagtcggtccaatgcaaacgattgagacgcaggctgcgacaacaactgcgcgtgaacattacccggcaacagtttcctatgaaggaccgctgagcgcaacaacacggaaatgggagctggaaggcgctccgctgaactcacatgtgactgtgtaccatcatggccgctctgatttggcagcacttgagcaacaacaaccagtcgctgagaaagtcacaacgaagataagctcattgttcaagaggaagccacaccatgaggacttcccagtctcggagcccttcactggccaattggatgagacggcaagggtttcggagctgttccacgaaccaatcgacgcaagtgtcagcgtctactcggccggaagatctgatgagcatgtcgttgtccagccaacaacaattgctgaggcggagcccgtaccgctcgttgagtacccgcgcacgacagcatatgatggtccactgcaaagcacatcgaaaggagcagaaatggaggggcagccgttggatgcacatgtttccgcctatcaccatgggcgctccgacatggcacccccagcagcaccgaaggagacaatcacaacaaagctcacttcaattttcaagaagacaaccgctcatgaagacgagtacccgcccaagactgagcctttcctgggaccggtggcacaaacgaatcgccaacgggagttggaagccgttccggtggtggacaggattgaacggatacccaaagg

SEQ ID NO: 47201 - DNA, 950 bp, Heterodera glycines
  Genomic contig location: Contig_ID=SeqID_14418; Location=1..950; Strand=+
  SCN-specific regions: Sequence locations=1-238,261-715,738-950
  Gene Ontology: Mol. function=chaperone activity; Cellular component =mitochondrion; Biological process=cell organization and biogenesis
cgactcgatacatcgaactctgtttgtctcttccagccaacataagttgtgtttttaagcattgaaggaactgttcgtttggcgcttcatgcaggtcgtaactccgttgggttcggtttgttagctcaaaattcagactgatccgaattggtccaactttctttttgctccaaacccctccatggaccgttaccaattggttctgcttgatttcggctcgactcgtagtttcagcaaaactttcattgacaaatacatgcgcatcctcaaagcggcttatgccgctgatcgtgaagaggtaccatttcatttccgtcagcttgacgggagcagcccctttcccccggcctggattagtggtttcagttcccccactcttcgaccctcccgaaaactttttaattttcaaaaaacatagaattttttttcaggttttcttatagaaaattttcggggccaacctatacgagggaactgatacggggagagggggggggggggtggggaaatgtagtgcactcctgtttgacgcccctcccccttctccgcagatgctaaaatggtcgcgtgagattggctttctcaccggttatgagaccaaaacgatggaacaagcccattgcgaagccatcgccatcatcggcgagacactgacctgtaccgatgcttatgacttttcagaacaggcacctcacatacgatttgataaattaattggttctatttaagagtgtgaccccacgcatcaataaactcgtccccgtgatgttggagcatcgtctgacggcgccgcctgacgaaatttattcgcttcatcggaagttggccggttcatttctgacggctgctaaactcaaagcatcggtcgcatgtggtcggttattaatttggcttgaattacttcgctaattagcatctattttacctgatcctttattttatttgtcgat

SEQ ID NO: 47202 - DNA, 1081 bp, Heterodera glycines
  Genomic contig location: Contig_ID=SeqID_14430; Location=482..1562; Strand=-
  SCN-specific regions: Sequence locations=1-402,424-1019,1043 -1048,1070-1081
  Gene Ontology: Cellular component=cytosolic ribosome (sensu Eukarya); Biological process=protein biosynthesis
atgggttcggctaagcgtcatggtactcgcaatgcgcgtatgccagagaaagtgatctggatgcgtcgaatgcgtgtgcttcgtcatctatcgaagcgttatcgtgatgctaaaaaaatcgacaaacacctttaccatgagctctacctcaaagcaaaaggaaatgcgttcaagaacaagcgcaacctcatggaatacatctttaagaaaaaaaccgaaaaccaacgttctaaacagcttgcgtatggtttttgggtccaactgaattcggctcaacccgttatattgtgtttcagagaacaggccgaggcacgtcgcaacaagaacaaggaaacccgcaaacgtcgcgaggagcgtttggttcagaagcgaaaggaacttttgcacaaaatttcggagagcgagaaagagaagacacctcagcccctagtgacaaagccagccgagaaagagcaaccgaagccacaacctgtcgctgcacggaccgctgataaggaacagcccaagacacaacctgccgcggtaaaaactgcagagaaggagcagccgaagtcaaaaacggaaactgtgggcaaaagggtattagtcggtgtaagcttaattgaggtctaatgggtttaattgcttaaaggaaactgttggtcccaagaaaaagaaaggaggcaagtaaatgacaacaagcggacgatcggatttgagacaatcgatcgcattcattgttttgccacatcatatttgttgaagaattgttattattcaaattggttttttgatttaaatgttttgctgcttttttattttgttacattttatgtttcaacgtcttttaattaggcggttcttaaggtatacaacagttttcactcggatcggaccgctttggcgtcttcctccatcgtttgtcgtaaacagtgtggactttgacggacctggtctttattttgagaaaggtatcgtggtaggatgtgttagtggaataatatgcactatgtagtctgggttccgaaattggttgggttaaatcttaaaaatattaatgactaacagcaaactaatttaacttatatttgcgacaaataaa

SEQ ID NO: 47203 - DNA, 888 bp, Heterodera glycines
  Genomic contig location: Contig_ID=SeqID_14457; Location=1..888; Strand=+
  SCN-specific regions: Sequence locations=1-672,694-705,727-777,800 -827,857-888
cttggacctttattatttttgatttatattaacgatcttcctgatgctttgccatcaggagtaagaattaaattatatgctgatgatgttaaattgtatatttgttataaagcaagaaccgaaacagaaattatgcataaagcattgcataatttatcagaatgggaaaataaatggcagatcagaatctcaattaaaaaaacttttgtattcatttggggaataaaaaccccaaagaaatatataaaattgatggaaatataataaatgttgtggatacaattagggatttaggcataaatattgataataaattgcaattttccaatcatgtcacacaagtaataaagaatgcatatttacgtatgcgttctttatttcgggttattaaatcaaaatcttctaggatttggattattttgtacaaaacttatgttagaccgttattggaatatgctcctgaggtttggaatccatctcttctaaaaaatatttaaaaaattgaaaaatgtcaaaaatatttcaccaaaagagttcttttcaaatgcagccttccacccattccataccaacaaagattagaataccttcaactgccaacacttgaaagcaggccgaaagctttctgatctgttcatggctcataaaataatttatggccgaacagatctgaatccctttgaaatacttaaaccttctaaacgctttaacattcccttttatagacttaactcgaaagataaattaggcaaaaaaattataccttttgcggggcgggtaacaaaaatttggaaccaactcgataaaaagcttattgaaataaactcattaaatcaatttaaaaataaaattaaaactttcatttctgtaagattgaccggaaaaata

SEQ ID NO: 47204 - DNA, 1210 bp, Heterodera glycines
  Genomic contig location: Contig_ID=SeqID_2214; Location=899..2108; Strand=-
  SCN-specific regions: Sequence locations=1-284,306-874,896-1151,1194 -1210
atgtctcgtgtctacctgtttctggagttgtccatccaaaaggaggacgctggcggacgatgggtaccaattgaagcggcagaccaacttgtcggacctatccaatgcattggacaaacgtttgttcaacaactcaaggtcacacatacaacatccgaacactcttcacttgcagaaaattaccaatatttaggttgaagtgcaaaacactgagttgtatgacagcggcacattgtacccctacaaggcgtatctgaccaatgagctgtccttcccaaacagtgcaaagggtcatttcatggccagcgcgggctaccatccctcactgaagcatgacagcgcgacggatgccggcttcatggcacgctgtgctcgctttgagggaggacgaaaggctcgcttcctgtcccgcctggactttgacctgggcaaccaggagctgtacctattaaacaacatggacgtcctgttcaccatctaccgtgcaaagaacacttttctgttgcaaaacctggcgccagcgccggcggcaggagcagcggccaggcagcagtatgccttgtatctgcacgacataaagctgtacatgaaggtggtggaggtgcaaccctcgctgaacctgtccatctacaaaacgctggagaagcagccggccacctacgcggtacggaagacggaggtgaagtccgtgttcctgaccgccggccgtaccgagatggaccacaacatattttccgccgccatcccccgtcggttgaccattgcgctggtggcaaacggggcgttcaacggacagctggcgcagtcaccgttcaacttcaagccatactccatccgtgagatcagcgtgcacgccggcggtcaaatgtacccggcagtgccgcatcgcatggacttttccggcgccgcctacattcgaccctttgttgacatgtacgaggcgctgggcatggccaactctgaacgctccatggacatcacgctggaccagttccgcgacggatggacaatttttgtggtgcccatgacctcgacgctggatgacagctgcggctttgaactgctccgctccggcactaccagcattcggctcgctttcaacgaagagattccggccggcggcgttgagatggttgtgctcggggaatttgatcagttgataatgatagactacaaccgtcacattgtgtctgactcaaaaattgcataa

SEQ ID NO: 47205 - DNA, 2705 bp, Heterodera glycines
  Genomic contig location: Contig_ID=SeqID_14460; Location=260..2964; Strand=+
  SCN-specific regions: Sequence locations=1-68,93-347,385-608,630 -1034,1069-1858,1898-1917,1940-2220,2242-2705
  Gene Ontology: Mol. function=glutathione synthase activity; Cellular component=intracellular; Biological process=neurogenesis
atgcaattgctttacttccgcgtcggctgcgatttcgactttttgttcgaagcgtacaaagacgtggtgaaaacagacaaacaaataaaacagatggtgcacattttgcgagaagtgcaaaagcagggcataaaacagccgcagacattgctgataatgagatcggcaagcaaattaattattgttgattaattaattattagctaatttgggatgaaaatggtcaattaaatataatagcaatttcattttttgtttttgtataggattatatgctgaacaaagtggggagcaacacagagaatggaaatgatcactacgagattaaacaggcaaaaaatattgagttaaaattaaaaaaaaattaaatttgaaatttattttcggatcgaagcgaacaccggcgccatcggcggattgggaaatgatcggcggacaagcgaattgcaccagagactgttaaaacgcattggcatggacccgacaaatgcaccacaaaatgagggcgacgcacatctgatcaactcactgtttatggcatggtaaagggggcgaaacagctgaaaatgctcggaaaggatttaaaaattattatttgtaatggcacattttcaggaaattgtataaatcgggaaattttttgaaatttaaggaaggcttttgacaattgcgacgctcttttggtcattttgacgcatgtcaaattctcctacaaatacgaactgcgcaaaattgaagatgaattggaccgattgtctggtggacaattgcgtgttgcttacgtttcgctgaatgacggatattatgagtaaaagcatttaaatattagtaaattaatattttcaaaggtttatttggtaatagtaccgatggtagtccgtcccgtccgtccccctttttcggaaaatgaaattttagaatttttttttcgagaaaagaccgtataagggggtttaagggtcgaagaatccgaatctgacagaaatttcgacctatatctaaccccgaacccggattcgaacaaaagtcgaattcaaattttaaaatttctctttgttcctttaaaaatggtttaaatgatctttttttaaaggaatgttgacttttagtttgtctcccttccaaatccaacattgttggtatcattcgaaagcttaatctatttagaagtttttccaagatattgcgttgcgattagacaattgttaaaaaaagttatacatgaaaactgcgaaaaagtcgaaatttttgaagttttttcttaataatttttttccaggctttaaaatcttttcgctttttgtaaggctaatagagcctgatgagcttccgaatgataccaagattgtcggatttgttcgacaaagaaaaaaatcctagtggaaaaacatgctggggccctaacatgccggctcaaccgtgccgaccaactgagctactccgctccctatatgtcagccattttaagatcaaaaatgaaaattcgaaaattttcattttcgactttttgttaaaacccggcttcggggttcgaaataggtcgaaaattatgtcagattcggattctccgacccttaaaaccccttagacggtcttttctcgcgaaaaaaattcattttctgaaaaagggggacttacccccttcggtactattaccgtttattttacacatttactcactttcactatgaccgaattaaagacaaaatttttagttttaaattggccgctgattcttcgcttttgttaaatggcaaagttgttggcgttgtgtattccttgatttccgcacttggctataaagcaaatgaagaagcaatggaagcacggaaaatgattgaattgtcgacagcaattgtaaaaataaataaataaaataaatcaattaaaataaaatggaaaaactcagtgaatttttatagtctcactgacaacaacaaacttaatctaaacaatgtcatttgaaagtgctcaatttgctttaatttttagaaggcgccgtcgttggcaattgcaattagcagttcgaagaaaatccaacaggtgacagcaataaaagtccattaaaataacaattaatttaattgttcagcttctcgcctcgcctggcggtgttgagagatttttccccgaccccgcagaagcggacaaagtgaaggcaatccgcgaaattttcaccggcttatggggcctcgaagggcatgacgagaaaaccgaacggatcattgcggtagaggtgaacggcaataaacaataattaattaattgtttaggatgccatcgaaaatccgtcaaattacgtgctgaagccaaacggcgaatgcggcggaaataattactacgacgaccaattggttgaaaaactgcgcacaatgaccaacaatcaggaagaacgagctgctcacattttgatgcaaaagttacacccaatgatcacaaaggtgagagacacaaaacggtggtgtactgtaagagtgaatcgttgaaaatctaatacggtaccggaaaactgaagtacagttgctattctttttgaatgttttgttgaaatttagaactattttcttcgtccaaccattttgccacggttgggcgtcgttgtcagcgaattgggcgtgtacggtactctgatgggaaatatgctcgaccgtaccgtatcgtacaatgcgcagagtgggcatttgctgcgtacaaaattggccggg

SEQ ID NO: 47206 - DNA, 530 bp, Heterodera glycines
  misc_feature (509)..(509): n is a, c, g, or t
  Genomic contig location: Contig_ID=SeqID_14477; Location=1989..2518; Strand=+
  SCN-specific regions: Sequence locations=1-530
  Gene Ontology: Mol. function=ubiquitin conjugating enzyme activity; Cellular component=proteasome complex (sensu Eukarya); Biological process=chromosome organization and biogenesis (sensu Eukarya)
atggcacttcgacgcatcaaacaggtggcgaaatgacaactctctgatcagccaatgctttaaatgttttgatccatttgcaggaactggcggagctgaagcaggaaccgatcacgggttgcaccgcggcaccgatggatgacggcaaagacatgttccactggaaggccaccatcaaaggaccgcccgagtcgccgtacgagggaggcaccttcaacatggacatcgttttccgtcgcgactacccattcactccgccaattgtcaaattcgaaacgcccgtttaccatccgaacgtcaacaagcagggtggcatttgtctggacgtcctgaagacgacgcattgggcgccgtcgttgaccatttcgaaaggtgaaagcgacgcgggaaagagcagacaaaacgccgacaaaatattgagacgacaaaacgatccaattcaaaacgaccaccaaaaccggactttttggaaaagtgtcgatattttgtcgtgtgaatgggatttttcnaattcggaaatgccgttttaa

SEQ ID NO: 47207 - DNA, 601 bp, Heterodera glycines
  Genomic contig location: Contig_ID=SeqID_14483; Location=180..780; Strand=-
  SCN-specific regions: Sequence locations=1-38,61-601
  Gene Ontology: Mol. function=3'-5' exoribonuclease activity; Cellular component=mitochondrion; Biological process=35S primary transcript processing
atgcgactgatgttagcaggaggggacgaagcgatggaggaaaatggacgaatggaggaaagcacggggaaagggatggcgagggaatggccgagcgatgcgcaagcggacgaaggcggacggatgtcgctgggcaatggggcgactgcggaagacgaagcggtggaggagcatccgtacgctgaggaattggcacaattcgaaccgaccgaacacagtcaaatgatggcactgcccgaaactgtcaaagtcagtgtttttcacttgtatacatttatgcaattgttttttctctttaagaaaccgactccattggagagttctccgccaatttgggtccgtcagttaaaggacttggaggcattgatcgacacactaaacgaagttcacgagttttcctttgatgtcgaggtttgaataatccccccttcctctgaaattgccaattttgtttcagcaccattcgttccgctcttttctcggcctctcctgtctcctgcaaatctccactcgttccgccgattacctcgtcgatcccttccctttatggccgcacttgcatttgctcaacgaaccattcacaaacccaaacattgtcaaa

SEQ ID NO: 47208 - DNA, 5367 bp, Heterodera glycines
  Genomic contig location: Contig_ID=SeqID_2219; Location=1..5367; Strand=+
  SCN-specific regions: Sequence locations=1-106,128-485,507-576,599 -637,659-742,764-860,882-1113,1135-1513,1535-1574,1597-2292,2367 -2412,2434-2493,2573-2591,2630-2970,2992-3145,3168-3597,3644 -3867,3890-3981,4006-4067,...
  SCN-specific regions: Sequence locations=...4118-4162,4184-4239,4261 -4387,4424-4478,4500-4500,4522-4608,4630-4981,5045-5204,5226-5367
  Gene Ontology: Mol. function=hedgehog receptor activity; Cellular component=integral to plasma membrane; Biological process=regulation of smoothened by patched
tttttcaatttttccatttgtcagaccgccattctgttgaccaccaacttgttcggcattttcttcatttacccggcattcattgcgttggatttgaagcggcgcaaggcgggccgacgcgacttggaatttctgtgctattactgcctttgtgtggacgacgacgacaacgtcgacgcggaaacggcgcacaaaattcggcgttccgacgtaataaaaaaacagatcgggaaattgttgtgccatcttaccataattaggcattttgaaaaagcctgggcttggacttgggttccatgttgcgcatgaatttcttggacaaaaatataggaaaatccatgcttggttcattgcccacgtggatttattcaaacagagactgtttttgatacagtacttgtggtccatgacagtaatcaggacaagaacatgtccaaaatggacatgaaaatggccaaaaatgatgataaaaacccactctaaactttaatatagttgtttattgtgtgcagcatttatggccaaaaattacgaggaataacactttccatggagtgcccgtcaatgcacctttccatggtcttacagttccaacaaaatattaatttaaatacaattgaaaaccaaatataaattattttcttcaatttcgccgacgaattaaaaaaaaaatttcaaacttagaaaaaatttcttcggcgaaattttgtttcggcaaaacttttcataaaaaatacatatccctttgttttccccaagtgccaaaaaggggtggtgcacaaattgatggcggagacggcggacgacgaccacaagccggacaaaaagcgtgtgcccgcggagccacggtttggcacaacggcggaggaggaggacggcacggagccggaggatgagcaccacccgcaccatggccagcagaagccgtactttgcccgctgctcgttcaagccgatggtcattggacggacggcgccgagtgccgtcaaatatgtgcagcagccgaacggaaatcccaccggcgacggcactgtcattgtgcaaatgccaggggttagtacaaacggatggaaaatgtggcaaaattagtggtgtaacgatgcccgaaacaaaaaatttgggaatttgttaaaagatatatcaaattgattagtcgccactgttggtcaaacaaccaattaattagttttgccataaatgatttaaaatttatccattgttggcaaatatttaaatttaagcttgtcggtacatcccaaaaacgtcaccgcaaaaaaaaaaacaaacaaactttttaaaaattgttttaaaagttattttcaaaaatctaggtgttatttaaagaaacttgctatatttcaagggagaaaaacgaaaattggttcatttccgattaataatcgaccatgaacagcctttaaatatattttttaccaaaataactattttctattatttacaattgcttcaaaaatttcagtctcacaaaacgcgacgccgacgcccagcgcagaaacagtacaaaatttacactttgcacggttttttgcacattgtgtacattccgttgctgaggcgaagggctgtcaaagtgagtttggatgtcataaatttttttttaacaaattcatccttttggaatttgaaaattcagatttttaaattacaatttaaaaaaaaacgaaaatgacttttatctaagaaaattcaaaaaacaaaataaacaaatttcagcgatctgttgaaaattttttgaaaacagtaactcattcattatacagtaaaaacttgaaaaaatagttggaaacatttttttttaatttatggccctttccatccaattttaaaaattttctaattatttcttcggttttttttactaattacccccctcccaaaattgtgcccagtttgccattctcgtcacgatggtggcactgttcgctctcggcatttacggcctcagccgttcgaccatcggtctcgagctcagcgacgtgttgccggacaacacggcgccggccgccttcctgaaaacgcgcgacaaattattctccttctacccaatggcggtggtcattcgcggggcaaacgtcgattttgcagcgcaacagcaccaaattgacctgctgagacgggacattggtggggaaacggacggacggaataaattacaaaaatttgaattttggcatagaaaaacatttttaaaaacctaaaaacaaaaaggtttaactattgagtgcattctaaaatatcgtcgcccgaatgccgagaagaaatctcgccaccaatttaaaaaaaaaattatatttttgaatttttttctggaaaatttttttttgaaaatttttcaaaaaaaaattcagtgacgagatttttttcccgtatacgaaataatgcaatttttctaatttaaaataagaaattaatttggcattttcaggcttgtcaccatttgtggtcaaactgccggacggcgagccgagtgagtttttttttttaatttttacatattaaaatgttttttaattaatttcattcaaaaataataaaaaaatgaaataaaaatgggggatggcactttcgcccttcattcctttccctgaaatttaaaaagatttccaaaaattcgattaaaatttgtgcattttgccgtgccgttcaggtgaacgctattggctccagttgttccgcgattggctgcgcggtatgcaacagcggctggacgtggcgaagcgggacggactgttggacaattttgacggggatggcacaacgccaatgacggcgacaacaaatgcaagcagtacatccgcagcagcaacgacaccgaaggcgaaacatcattcgcccgacctgcaaattgcctattcgttggcctgctcctacgggcagaactacgactgtgctagggtgagtttttcaaaaaaaaaaaaccttgggatttttagtaaattttttgcctacaaaaaaaaattttaaaaaattgcggctaatgattcgaaaccatgttttttaatgacttttcgtccatgcttttgaaaaaatgaaatttccatgtagagctgctatcttctgttaaattggttgcatttggaaaaaatttacgaatttttcattgttaccgaaataaaaaaaaaaattccagaatcaaaattgcctccttttttttcctgtaaggccggcacagtgcgtctgattgatgagagcggcacaatcaacacggaaggcttctacaactatttgtatggatggcacgaatacgaacaaatggtatggggttgccctcctaattttactgtttttttctcgaatttttttatgaaaattttgaaaattaatcaaaaaatgtagaaaatttcccttcctttcagttctattccgtctctcaggccagcttctacccccgtcttcgcaagttgcgccagggaccgcctgggcctatgaaatatgtgcgttttagcagtttcaatcttaaaaaggactatttcgtgattttaattacgaaaattagtgctccgactttaaaaatttaagaaaattgccagaaaattcttccaaaaattaccattaaaaaactcattgtcgggcctcaattaatattttacactttataataatttatttttaaattttttttcccaatttgtccctcccatttcagcgctattttcattccgccggcgccgaagccgttgttcagccgaattccgttttactgtgacgggttgcgcgacacgccgaccatcatgcgcatgatccgcgagatcagggcaatcagcgaaaattacagccgcgcgggcctgccaaattacccggaaggtgtttttttggaaatttgggaaatttttaggggaaaacaccaaattttattaatttttcaaggcgtcgcttttaccttttgggagcagtatttgcacttggactactacttggtgttggctattggtgtaagtttttctttcttttttgatgaacaattattataagaaaaataaaatattcgactaaaagttaaaggagtttttcataacttttgcttgattatttcttaattaaaaagcaaaaaaaaaaatttttttatttaattttttaaaaatttttacaatttaatcacgtaaaaaatgaaaacaataagtcgctgaatacttcaaaagtttcttattgaaatatattaattgatgcatttattttagatcatttccgtgtccgtcttctgcgttatctccaccatcattttcaacccgtgggcgccgctttggtttgttacaaaaaaaaaaaaaagttttttttttgtctggccgaggccccaaccccattctcctgtatacaatttgttaaattttttggtcattcaaattctccaaacctttctaaatgtgtttctgacaaataaatcatattttgtttattttgacatggtcgatcttttgttcgctaattacttttccgcttttccgatcacttcttctgatcacatcatttcatgtccactttttaacttatttctgattatttctctcgtctctaatcactttccccattccaccatccgatcacatcactgacatcaaatcatacaatttcctttttctgatcgttcccgctcattcagagcacttcctaatcatttgtttctttgctttgctttttcctttttctgatcacttaccatttatccccaaacaacacaggtcacctgcgttgtggccagcatgaccgtggagttggccggcttcatgggccttgcgggcgtcaagctgaacccgatttcgtccgtcactctgatcaccgctgtcggcatcggtgtcgagttcactgcacatgttgcgctcgcatttctcacctcgttgggcacccgggaggagcggatggtcaatgcttgcagcacatgttcgtgccggtcatccacggcggcatgtccaccctgctggtcagtcagtcattcaatcagcaggctgaaagtgggaaatgccagaaaattaaaaatttcaataaaaatgaaaaaattttctctatttttaaaaattttagaaaaaaacctgccagaaaatttttttaaagtcgctgaaaatattttccattttttttgaaaattctttgaaaattcgggcgcctttgattttgaacacattcatttgcttgtattgaatttaccaaatatggtttaaaacagagtgaccaattacggttttaattaatctcttctttttcttccagggcatcatcatgttggcgttttccgactttgattttgtcgtccaatacttctttgttgtgctgactgcgctcgtcatcattggcctgttcaacggacttgctgttctgcctgtactgcttgcctatgtgggcccgccttgcgag

SEQ ID NO: 47209 - DNA, 1707 bp, Heterodera glycines
  Genomic contig location: Contig_ID=SeqID_14534; Location=402..2108; Strand=+
  SCN-specific regions: Sequence locations=1-140,180-940,962-1007,1030 -1096,1118-1182,1205-1520,1542-1707
  Gene Ontology: Cellular component=nucleus; Biological process=rRNA processing
atggacgaggacatggaagaagtcgaaattgtttttgctcaacgattggccagcggtgaaccaacggcacgacaaagggccatgaaacacttgcgaacgcacataagagaaaggacgaaaactgatgcaaagggtgcactttcttccacttccaacactttttgttgacattcccttttcttttcttaggcttttcctctgtttcgttagcgcgactttgcaaagggttgcattatgcgctttggatgcaggacaaaatgactttgcaggaggaacttgcggatgaaatctgcgctctttgcaactattttcgcaccgacgagcaactgcttgaatttgtcgttgttctgttcactacgctttctaaggaatggccgcacatcgaccggtggcgaatggacaaatttctcatggttatcgcaatttcttatggctgatctgtcacttattccgctggtttatattcagttggtccgtcgtttggttcgcactttgttccgtcaattgtcctcccaccgctgggacccgccattgtgtgaccaatttttgcaaatgtttcgctcttcgctgctcagtgccaattcgcctttatgcgagtctttgaaattccattgcgcgtccgtttggttggacgaattggacacagcggcaacagcgaaagtgacgccgagcgaagggaacgccggcaaaaattgcgaagcctttccattggatgaacagcgctcgttggactttgtttggccttatgttcaactgttgcaggagcaaatttcgtgggaaataaacaaattggtgttaaatggaaatattgccaattaattcagtgactcttttttccgcacaatttgttccgacattttcgatgcgatactttgcgattttgagcaacgaaaagcggagaaaatggacgaacattgcgacgagaaacagcaaaatgtaacagtggaagaagaagaaaaggtggacaaagcatttggggctgaagtttccgaaattaatgccaaacattggaaaatttacagaagaaaactgaagaaaaatcgtcgtcttttgaatttgactacaagcgaattggggaattactttttgaggttggaaaacaacagaaagtgccaagtcggaggaggaagcgaatttacgcattgtgtaagaagtaagtgaacgaagcaaaagaggggaagggacaaaaccgggaaaatttgaaattgattgcaatatcttttttttctggaattcaacaaatttttgttttcaataacacataggttttcaaaaaaacaagctaacaataaaacaattttttaattcatgaaatttttgaaaaacaaaaattttttttttgctaagacgttttttccggccacgttttgggttgtgcccgggggggggggggtatgtaccccgggtagccttccccctgggaccgtccttgctgtggtgtaagtggtcgcctcttcgttaaatctttatttcttctgaatgaaataaattagattatgttcctataataaatttttgggttgcaaattaagtgcgaattcatgttttttgtcactttatcccatgaaactcaaaatgtatttacagattcgaatgtgcggcccaaggcgatgaccctttcccggtgccaaatttggagggcgtgaaaatacgtaagaaaaagcgacgccgaaaaaacagcagctcttgacaagtcgccattgttat

SEQ ID NO: 47210 - DNA, 888 bp, Heterodera glycines
  Genomic contig location: Contig_ID=SeqID_14541; Location=647..1534; Strand=-
  SCN-specific regions: Sequence locations=1-13,66-71,93-103,129 -366,388-646,669-888
  Gene Ontology: Biological process=reproduction
atggtgaccggagagtacggatggtctgccaacatggaacggatcatgaaggcccaggcattgcgtgactcctccacaatgggatacatggcgtccaaaaagaacctggagattaaccctgaccattcaatcatcaagtgagcgcattcaagatgaaattgagatcatgatgtaattttttgacagtttttcgtttttaggtctttgcgcgaccgtgttgagaaggagcaggacgacaaaactgcaaaggacctcgttgtgctgctgtacgaaacttctctgctcacctccggcttttcattggaggacccgcaacagcatgcgtcgcgaatttaccgaatggtgaaacttggacttgacatccccgacgaggaggagccggccgagcaacagccgagcacttcgggcgagccgacaattgcggagaaaattgctggtgccgaagaggaggcctcgagaatggaggaagttgactgaatggtgacatcgtctatccattcttggatctcggctattcaatattttgattcattgtttttttgttttcttgtttgacataaatttgaattaaattttccgtttcgaaaccaaattatatatggaaattgggcagtaagtagcttcctgggcatgctttgcttgttaattggatacaaattaacaattttcgtcttacaaattagtctaccgccttataaatagagatgggatttttaggtttttacctattttttgtggcttagctatgatgagagaagcctaaaaatagcattttctccgaacaattttcgatttagagcgactttttagcacctaaaattacctaaaactggattttcggtcaatagcacctattttggcattttcccatagcaaaaatgcaataaa

SEQ ID NO: 47211 - DNA, 940 bp, Heterodera glycines
  Genomic contig location: Contig_ID=SeqID_14543; Location=5..944; Strand=-
  SCN-specific regions: Sequence locations=1-147,169-322,346-737,766-940
  Gene Ontology: Cellular component=cytoplasm; Biological process =neurogenesis
tcccttttgctctgcgaaatccatctcgcctttctgcgcctgttttttcgcgaggaggacagcgaacacacaattttcgcggccacagagaccaccgtttccgtcaacattctcatccaactgatggactcgatgagttttgccgaggttatttttacatttgaattgcttttttttgctaaatgtgatttttaaatctatttttttgtgataaaaaccataatgatggagtctaaattggacatattttaggcgtctaggcactcaaaaatgtgatttaaggacttaaaaaactttttgcttccgcaaactttaattgtactccaaaatgcagaaaagtaacgaaacatgaacaaacgaactccttttcccttaaggtgttgcgccattacgtggaaagtgacgcccatttccccgtcgatgtgttgcacattttgcagcacagcaactacccatttgtggagctggacaagcggttacgtgtgctgaaatggatgtgcgaacgcttcttccaattcgatttgatcaaacgcattgtgggcggaacgcacaaaaccgtggtttgtttatttaatatttaatcctttggcaattcctcaaaatacaaatttaattgtccatttttaagcatgacgagcagtgccgcagctgtggcaaagcgggcggtggcttcggcaaactgttggcatgcgccgagtgcgaggcggtctaccacgtgcactgtgacgcggacttggtgcccggaccgacaccgccaccccaaccacaagcaccaccaccaaatccacaaacggtgccgtcctccgcctctgatccgacgacggcaacatcgaacggcggaggtggtgctggaggcggtgttgccgtaacaacagcaccagcaactcccgtggcggcagaggacgacccgaactggcgctgtccgttgtgccgaatttat

SEQ ID NO: 47212 - DNA, 1400 bp, Heterodera glycines
  Genomic contig location: Contig_ID=SeqID_227; Location=1082..2481; Strand=+
  SCN-specific regions: Sequence locations=1-1324,1350-1400
atgacatttcacaaaattgacgcgagtagcatcgattcgattaccaacgccgtggattttttcagtataccccctacaaatgttacagtatcatcgtcaaaggttttcgagattttgccgagtaatcccctcaccgacacaccttaccattttaaaatacactcgagccaaaactacattgacctgtcaaagtgttaccttttgaccgaatttcgaatgcgaaaattgacagcaccaaatggtgaatggggatatttggatgccactgatcaggttgtaccgatacaactaatcggacacactttcatacgagacatgaaaattgcaattaatggtcgcgaaattttcaactctaattctctgatggcatacaaaacttatctctctcatgaactttcacaatcacttgaagctaaagtttcgcatttaactgctgctggatacgaccgtgaagatgctagtaatctacaaaacgcaaattctgaagggttcaaaagtagaagacaacggtatttgggaggtcgaacagcacaatacattgcaaaaatcgatgctgatcttttcaatgtaccccaatatttgattaatcattgtgaaattgacataacgatacaaccccatgacgacaattttttgttaattgacaccttagacccacccggtcagccatataatattgagcttgttggattgaaactctactgcaaaaaagtcagtcttatggatggcttggctcttgagttggcgaaaaaattggaaatgaaaccagcacggtatgctgtacgaaagacaatgatgaaagcactgttcataagcccgggacgctatgaatttaatgcaaacttgttcatggaccaagttccacgccgcgtaacaatgggacttgtcgcaaattcagattatgtggggaacaccaaaaggagcccattcaactttcaacattttaatgtacgggaattgagtgttgtggccaatggtcgctcttatccccaagccccgtatgatattgactatgaaaattggaaatttgtccgtccctacaatgacacgcaggaggcgcttggttttgccaactctacatatggaaatggaattgattacttttcttttttgcacactcactgtatttatgtgtttaacatgactaatagtggagatgatcatggcggtttatttgacctgattaagaagggatgtacagcagtgaacataaaattcaaaaagccagtgcccgatgggggaattacattgattgttatgggagaagcagactccatctactttttggataaaaacagaacgatcgcgaccgatacaaccatttgattataaaaatgtttaatttattctttattgtcttattttttcaaccaattgtttcattgattgttgaagaagga

SEQ ID NO: 47213 - DNA, 1917 bp, Heterodera glycines
  Genomic contig location: Contig_ID=SeqID_2232; Location=162..2078; Strand=+
  SCN-specific regions: Sequence locations=1-13,35-35,58-325,347 -807,829-983,1007-1177,1200-1215,1237-1270,1292-1325,1351-1352,1381 -1381,1403-1917
atgacggacactgcaaatcgacagcgacgcggccgaggcgagagacgcacacgagtggtaagacagttggatggtgaacacgattctgacttctatttggaacccctgacccggattcgaaccaaaactcgaaatttcaattttcgacaaaattaaaattatgcaacaaaatgcacgaaataaaacggaaaatacgattctgaaggcaagacagtgtatttcaggcatatttgaactgtttttgttgcatgacttgaattttgccgaaaactgaattttcgagtttgtttgagtccgggttagggattcgaaatggacttcatacagcgcccccgaaaacccccctaaagcatcacaaagccgctcattccttttttactcttttatgggaccacaaacggattttgacattaattttagtcaattttcagcttctacgcgacagtgccaagaaaatcaccaaagcgtccattcttcgtctggcccgacgtgccggtgtcgcccgaatcaacgcagaagtctacgacgaggtccgtgccgcgctgcgctcgtacttggaaaccatcattcgagacgcggtaagttttcaaaaaatgattaatcccgatatatcacatcacccaatgctttcaggccatctactgtcagcatgagaggcgcaagaccatgaagagccgggacgtggtacacgcactgaagcgccagggcaatttgatgtacggcttcgaacaataagcgcaaggaagaggaggacggatatatttggaaccggcaccatatgacattttcatggataatatattatcattgtacatatgtgtgtatatgcctatattgtattgtatattgttttgtcatttatcagtgcaattcagggttgttccgggtcgagaaaaatatcgggtcgggtttcgggtcggccgaaaaatcatcgggtcgggtttcgggtcgagaaaaaggccgggtttcgggtcaattgacaaatttttaatttgtttaaaaatcaaatggcactgcaatatttgcagcgaattgcgccatttataggacgatggaaataaaaccaaatggaatcaggtttttcagccatctgctttgcttaaattcaagaaattcatacaaaatatctttagaaaaaggataataattagggacgtgaattttagtgaagaaaaatcccgaaatagttaactaaaatagtgagtaaaaatgccaaaatagtgaagaaatagtgacgaatagtgacataattttcagccaaaaattgagcaaaactaatttttattcactatttgcagttgcaaatgagttggactgggatttttaagaccaaaaaacccaaaatagttacctaaaaaattttttaaattaaaaatttttgccaagaaagtaaatttttgagaaaatttttttttgatttcttaggagtattttttgaaatttttttagctcgattcttaggggtgtattttttgattttattgcatttttgttaacaaattttccaaaaaatgtagaaatagtgaaaaatagtgacaaaacgccaaaaaagtgaattttcatttaagtgacgaaacgccaaaatagtgatttctagtgacgaaaaatgacgtccaaatgaaaaaattttaatgcataaatgcgttttttgagcacctttcttcaaatcaatcgagcaaaaaaaagtttttccactagaaatcgcgtccctagtaataaattgataattaattaatttgcagacaaggattagggttcatatcttttggcccggaccaggccgttttcgcgtgggcccagtttttgaactataattttttttttattgtcaactaaacccacgaacttgatacattcgaaagccctaagtgccctctattagccatcatttcaaaaaatttcgtttggttttaaaaa

SEQ ID NO: 47214 - DNA, 1196 bp, Heterodera glycines
  Genomic contig location: Contig_ID=SeqID_14564; Location=75..1270; Strand=+
  SCN-specific regions: Sequence locations=1-1196
  Gene Ontology: Mol. function=cell adhesion receptor activity; Cellular component=integral to plasma membrane; Biological process =cell-matrix adhesion
gcaaaaaccaccaaatgcttggctttgtgatcagaagcagcggacggcgcgagaaggccgaaagtcgagcgatggtcagtaagaaacgcttttttcgttaattgattgatttgactaccttctttatactctccctcctctttttaaggcttgtgccccgcttcttcgatggactcccaatgcttacactaatggtgagttgtaaaatgatggtttaattgatacattagtgaatgaaaaactaaagaaaattgcttcccaatgcaggagtgtgctatttgctcaattccgaacttaacaacaccgttgtgatcaacccgtgcgattcgttgccgaaaaaagatagggtcggcacttaatacaaatgttctgctgatcagtcacgctctagaaattgcctaattagtctctatttagcataatgactacggtgcgtgtgaacaaggcttttccggtttcgttgacaatgtgatgaatgctcatactttctcctcattctcttacatcgcatttcaataattttccatcattttcagcacatcattttgactggtctcccgggggcacggaaatggacaggcggagttttcggtaatttttatcagtccatatttctatccatgcctgtttgtaccattgggaataattgtgtgacattttcatcagctcgatacgaattcactgattccgatggttttactgatttggtggaccggcggacgatggacgtgagcaaagaacagcgggggatcatcaacgttttgacttcgcacgactatttgggatactccgtccgttatgggcgcttcggcttttggtatgagcacaccgaggcgggcgaggaggccgccaatttcacggtggtcagtggcgcgactcggtacaatcagacgggtcagtcgacgatcaaatgttgcgattttcttggcattttcattttgcctttttcgcaggtgccgtcgtctttttgccattctggcgacatgttcaggcggagaatcagcgacagttgggcctttccgacgacttctttctgttagccggccatcagcttggctccgggttcggctccgctttggaagtgctcgatttgaatgccgacggcttcgacgaccttttggtcggcgctccctttgaatttcacctccgctccgatggcgcgtcgggtggtgccgtttacgtattttattccgcgg

SEQ ID NO: 47215 - DNA, 1260 bp, Heterodera glycines
  Genomic contig location: Contig_ID=SeqID_14566; Location=1736..2995; Strand=+
  SCN-specific regions: Sequence locations=1-495,529-637,676-712,734 -778,803-1260
  Gene Ontology: Mol. function=transmembrane receptor protein tyrosine phosphatase activity; Cellular component=integral to plasma membrane; Biological process=protein amino acid dephosphorylation
ctataaaaggcgttgaattttgcaaaaactttcattgccttaccctaattaattaactattataattctctctatatcgtcgtcgccgtcaacctcaatttgaggtgttttcactccattcataattttttaatctccgtttttcttacagcagtcatcacgatgtccgggagaagtggccgcagtgggaaacgccgacaggacggaccgggccgcccctcacgttcacgtcagcagcagcacacccagcgcggcgttcagtctgcatatcaaggtccacgagagccgccggagcaaccaacagtccgaggctgggaggacacgcacgacttcagctcagccctgaaaatcttcgtcaacgagacaacgcgacgcaacgtgaaggagctggtcaacgaatacacggagctgaacgccatgccacggccggagacttcgccggaattcacacggtcagtttggctgtttcgattttcaaacacaaataaaataggtaatttctttacagccacatggactgcaaccgctaccgggacgtcatctgcgccgagcagggccgcgtgcgactcgacaacggacgatacatccacgccaactggatcacggcccttggcgaacagcgcttcatctgcacacaaggcccgctcgagacgacctgcgccgacttctggacaatgatcgtgcaggagaacatcgaaagcattgtgatgctctgcgacaccgtcgaacaaaacaagaccaagtgccaccagtactggccgacaccggacaaaaaggtgggtttttccattttttccccttgcagcaattgcacttcgccaacaagacgatcaccgtgcacttcatcgaagagactgcgctggagccggacctctacaggacaaagctggcggtgctctttcccaacggctccatgcgcgtccatcacttccactggcgccggtggcccgaccgcggtgtgccccagaacgacttggcgcctcttcgtttgctgttccacgtgcagcagtttcggcgctcggtggtccaccgttcagcgggtgagtttgtgccaagttggaaagtaaaaattcaataaatttcccatttttaggaatcggacggaccggaacactcggtggcgctgcacatcgcctacgatactctgcagcgtggacatcgactcaacatcctctcgttggcgcgcaacctccgtcagcatcgggcccagagtgtgcagacgccggaccaatacctctacatatacttcgtgatgttgcg

SEQ ID NO: 47216 - DNA, 359 bp, Heterodera glycines
  Genomic contig location: Contig_ID=SeqID_14583; Location=11..369; Strand=-
  SCN-specific regions: Sequence locations=1-251,273-359
  Gene Ontology: Mol. function=endopeptidase activity; Cellular component=proteasome core complex (sensu Eukarya); Biological process=sporulation (sensu Saccharomyces)
atggcagacaatttgcgctcggaggacatgtggcgcgtcaatgcaatcatcggcggctttgattcaacggacaagaaagcgtatctcaccatgattgattatcttgcgacaaatattcctccccaagtagaaacccctttcaaactacggagttttttgtggtagaaaatttcacatttttagaatttcatcttctacggctttcctggtgcatttgcttactccatcatggacagtttctaccgtacaggtttattttttaaatttatattgatggcgttattttatttgatttttagacctaactgaacaggaaggattgggattggtgcagcgcatgattgaccaggtgaagcgtc

SEQ ID NO: 47217 - DNA, 673 bp, Heterodera glycines
  Genomic contig location: Contig_ID=SeqID_14584; Location=31..703; Strand=-
  SCN-specific regions: Sequence locations=1-423,448-451,473-673
  Gene Ontology: Biological process=locomotory behavior
atggaccgtgacaaccgatgggagcgaattaaggcactcattttcgaaaaaaacatcgtttttggacttgcatttttccttaaggttgcctacgaggcattggttgccggagagggcgaaaagtgcgaaccggcgaatgctgtacaattggtgaacgagcgctacgcaaaccaacagactgacgaattcctgacgcccatcgtgttttcggacgaagcgcgtgtgaaaggtatgaaaaattgctgtttttatccatttggaattttggggggggggtagatttttttcaagcaaaaaataatatggagaattatttgtttgaaaaaacgaacatattcatgatcaacgaccatgaaaatatgtaattgtactattttcaaaaataaataggaaataaataaataaacccaaaagggtataccaattttttagaaaataaatattgctccctccacccaaaaaagcaaaacgccgaaaaaaaaatttttttttgtgctcagcctttttgctgtaccggctctaaagatgcttattgttagtcattcattttcaatcacaatttacaatttcagacaatgacacattggtctttttcaattatcgtgctgatcggatgcgtgagattaccagtgcatgggtggtctgcaaaacttgcaggatttgggcaccaatg

SEQ ID NO: 47218 - DNA, 830 bp, Heterodera glycines
  Genomic contig location: Contig_ID=SeqID_14592; Location=577..1406; Strand=+
  SCN-specific regions: Sequence locations=1-656,678-778,808-830
tgccatcacgagtgaaaataaaattatatgctgatgatgttaaattgtatatatgttataaagcaagagcagatacagaaattatgcataaagcattgcataatttatcagaatgggcaaataaatggcaaatcagagtctcaattaaaaaaacttttgtacttcatttggggaataaaaaccccaaagaaatatataaaattgatggaaatataataaatgttgtggatacaattagggatttaggcataaatattgataataaattgcaattttccaatcatgtcacgcaaataataaagaatgcatatttacgtatgcgttctttatttcgggttattaaatcaaaatcttctaggatttggattattttgtataaaacttatgttagaccgttattggaatatgctcctgaggtttggaatccatctctgctaaaaaatattaaaaaaattgaaaaatgtcaaaaatatttcaccaaaagagttctttttaaatgcagccttccacccattccataccaacaaagattagaataccttcaactgccgacacttgaaagcaggcgaaagctgtctgatctgttcatggctcataaaataatttatggccgaacagatcttaatccctttgaaatattcaaaccttctgaacgctttaacattcccttttatagacttaactcgaaatataaattaggcaaaaaatttataccttttgcggggcgggtaactaaaatttggaaccaactcgataaaaggctcattgaaataaactcattaaatcaatttaaaaataaaattaaaactatctctattcccgtaaaatag

SEQ ID NO: 47219 - DNA, 1480 bp, Heterodera glycines
  Genomic contig location: Contig_ID=SeqID_14593; Location=16..1495; Strand=-
  SCN-specific regions: Sequence locations=1-140,162-262,284-688,712 -909,931-1125,1147-1480
  Gene Ontology: Mol. function=protein serine/threonine kinase activity; Cellular component=nucleus; Biological process=regulation of mitosis
atggaatacgtccccggaggcgatatgatgcaacttctggttggtccacccaaactgccctctctacacacagatcattttcagattaacatgggcattttccccgaaagtctcgccaggcaattcagactaaattcacttctttgaatgtttaacgccaaacattacagattttacattgccgagttgactttggccgtggaatatgtccattcccttggctttattcatcgtgacataaaagtgcaaattatttgatttcaaagtttcaaatgcatttaaatcgtttagccggataacattctgatcgaccggagtggccatattaaactgactgattttggactttgcaccggactcagatggacccatgacaaaaggcattacgtagtctacgacgaacaatcaaacggagcacccattggccatgtccgggacgactccttctcgttgccccctgggttggaccagcgcgtcaaagtgttggagatgcggcaccaccggaagagggacagagcgcattcggtggtcggcacgggcaattacatggcacccgaagtggtgcagaaaattggtgagaaaaacggaaaaaatgtcaaaaaaggggggaatggacattcagcggatgcttttgatgtttaagtaggatggtccatcatgacaaagttgttcagggcatacccaattgtgcgactggtggagtgtcggcgttattctctacgaaatggtctacggacgaccgccgtttttgtcgcagcgcgacgacccggcggaaacgcaatttatgatagtgcattggagacgctttttggacttgcgaaacgcgatgggtgtgcgtttgtccaaacagtgcgtggattgtgtggccaaattgtgctgtgaccaggagaaccgactgggacatcgcaacggggccaaggacatcaaagcacacccgtggttcaaggtgggcattgcaaattgcgaattagcagtgccaaaatggaaagagcattcactcccttcccgcagggcatcgattttgccaatttgcgcaacactttccccgaatatgtgccacgagtgcagaatcccgaggacacgtcaaactttgacacctttgaagtggagaacgaggaattgatcagaacaaatggaaatggaaacgaccgattaaaatgcgcggcgtacggcggcggaaagccattgggaccgaatttcatcgatttcacttttcggcacttctttagcgagggaatgtgccctccggcacggggccggtctccgcaagtcaggccaagtttggccccgcttatggagagttcgactgaagggggaaacgcagcaaaatcgccggcgggcgaagtcttcgccaaaccgaaacaaattgtgacgattacgggtaaagcaaaagtggtgccattcacatcatcaaaacgtgtgccggcaccttcgattccttctgattcgtctaaagcaacaacagttcaaatcggaggaa

SEQ ID NO: 47220 - DNA, 1512 bp, Heterodera glycines
  Genomic contig location: Contig_ID=SeqID_14641; Location=217..1728; Strand=+
  SCN-specific regions: Sequence locations=1-321,343-481,503-504,527 -816,838-946,970-1212,1234-1313,1335-1512
tggcaaaagagttgctgatttgccattcttcctctcccactgcatcgcctcaaccgagcggatgtttcttaacgtccgccaatgtcgtagcggaattggacagaattcgaagggaacagaacagaagcggggccggagaagcggacggacaaagcaccgccgcaacgacaccgaacgcatcgcgaaggccgagcaattcatccgctgccgcggtgattagctaataaatcattattagtgaatgactcatttaaatttcaattttgtaggtcagtggaagcgttgaagacgaattggccaaaatcaaagtggtcttacgacagcacgagaggaggatccgattgcttgaggtgaatggcatttatacggaaaaactaaaaaaacaattcaggaccaattggcggatgccaacatggccaatgcttatggattatgaaaattaatacggacagaaatattgtgattgaagaaatgacgaaaggaaaatatttgaaaatttatagcaaacaaatgcaatttgttcatcacaaaaaatggaatatccgccagctttttgtaaatgagcttcaaatgtttggtggttgtatttataaaagtcgctaataaactcatctaaaaatgaagggcaaatattgccaattgtgcagaatggtggtcccttttccttttttttattttgggataaaaattctggagttaaaagcctgctgcttattgttatgtaacgaccggggcgggaattcccggtcccggcttctcaggtcccggttttgcccaaaattcccggtaacgaccaactctagttataggatttaccaaaattaccaattttgcaatttcgggtcaatttttttaagaaaaataggaattattggggtccggcggcgctgataggcgccgtattgtttcaaacgaaaaatatgacagttaactgactttgttcgcaattttatgatgttttaaaaatgaggatttctcatgccaaatgaggatttttttgaggtattttagtggcaaatgaggattttttatggctgaaatgaggattttcaaaattttgagatagaagtcctggcataatgtcaacaagaatttcgcatcgtattttcgaaaatttatgaattctaagattcggacttattaagccaattcattctaccccgattcgtactaaattttcccaaacatgtaaaatgtgttgagtgttcatccaaatttttcaaccaaaattccccatttctcgcttctttacaattttatttctataccattattcgacttcaaacagagtttattaacgacatggtaattttaaacaaaataaaagacaaaattctccgcttttagccaggcaatgaaacaattcgaggccatttggaaaaacggaaggattggatccgacggacgagggaccatcaggaaaagtcggcggatatcaaaaagttgaagagaagcgcacgggaacggaaccccgacgaattccattttcatatgttgcggagtcaaatcgga

SEQ ID NO: 47221 - DNA, 462 bp, Heterodera glycines
  Genomic contig location: Contig_ID=SeqID_14646; Location=1..462; Strand=-
  SCN-specific regions: Sequence locations=1-462
acatatttgttttcacagcattccttgatggttcgtcatgtgactgcctcctgctttcgtgcgccatggccttttgaaaaaaagggctcaactggatggcggaagaatgggccggttgttattgaatcgcacaaatggcccggtcaacaaaaggaattccccgagctctcgccaaaatttctaggagcaaactttaaacagctatggagtaagcgaaccggaattggaagctaacctatgagtggagattatctttaggatacaccggagtggcgcccacaggatttaatgaccccaaaactgacgattttgttcatgttcccgaaatggtgcccgaattggtcgtgccggacctagcaaatttcgagctgaagccatacgtctcttacaaaacagatgcaaaaattgaagaaaggtaaaaaaaatttaagacaacaaatatttctattgcattaggctacg

SEQ ID NO: 47222 - DNA, 1061 bp, Heterodera glycines
  Genomic contig location: Contig_ID=SeqID_14679; Location=2138..3198; Strand=-
  SCN-specific regions: Sequence locations=1-44,66-70,95-970,1011-1061
  Gene Ontology: Mol. function=serine-tRNA ligase activity; Cellular component=cytoplasm; Biological process=tRNA processing
atgtccacctgttttcggcaggaggtttgtatattctgccaatatttgtttctttaatcccatggcatcgttaccttttattttcacttttttaaggtcggaagccatgggagagacacccgcgggattttccgtgtgcaccaattcgagaagatcgaacaatttgtcatctgttccccatttgacaacgaatcgtggaagcacatggacgaagttagtggacttttggaaatatagtccagtaaatttaattctttttaaaattcagatgattgacaatgctgaagagttttgcaaagtgctcggccttccctaccgaattgtggccattgtttcggccgaactgaacaacgcggcggcaaagaaattggacctcgaggcgtggttcccgggcagcggtgcatttcgggagctggtttcatgctccaactgtacagattaccagtcgagtcggttacgaatacggtacggacagacgaagaaaatggacggagaggtaaaaagtgatttgaaacgaaaggatcagccggcaatcaattaataaaacggataatgcccttcatccttgaccatttgtcctgttcttgggttcagcttttctgcggtttcttatttgcatttcttctcttttaggtctttattaatgtcaattccaggtcaattatgtgctcatgctgaacgcaacaatgtgtgacaccacgcgagtgatctgtgccattctggagaacaatcagacggaggatggcattgtcgtgccggaacccctgcggccgtttatgccatcgcaatattcgcaacgaattccctttgtaaagccggcgccaattgagcaggaaaaagtgcagaaaaagaagaaatagtctttcgcagacgctgatattcggaggcattctttgctttggcatttgttgacccatttttatttataagtgaatttgttaattgatggcaatggctttacaactttcgctgtttgttttttgttggtttattcattcattcgtttgtttcgaaaatggcatcagtttcattttgattgggtttagtgttagtcaaataaa

SEQ ID NO: 47223 - DNA, 2240 bp, Heterodera glycines
  Genomic contig location: Contig_ID=SeqID_14686; Location=153..2392; Strand=+
  SCN-specific regions: Sequence locations=1-171,200-685,708-1037,1059 -1074,1098-1465,1487-1543,1566-2080,2103-2240
  Gene Ontology: Mol. function=protein binding; Cellular component =cytosol; Biological process=anti-apoptosis
atgtatcaactgttccgggcattggggtacatttttttcttcatctttattttaatttcatcatcccccttcaattttttagttacattcacagcattggcatttgtcatcgggacataaaaccgcagaatttgttgctcaatccgcaaacatcagtattgaaagtggggcatttaaaaaaaaattatttttaatttttcaccactttttagctttgtgatttcgggtccgcaaaaacgttggtccagggtgagccgaacgtcgcctacatttgttcacggtcagttaacattttggcgttataagggtttttgcgtaacaaaaaaaatcaaaatagttagctatttttctgccaaatttcaggtattatcgcgcgccagaactgatttttggcgccaccgattatacgaccaaaattggtacaagcaaaccaaatattattgtagttttagcatatattttttaccaacacataaaaagggtgcaattttttcagatgtttggtccgcgggcacaggtaaaaactaaaaattaaaaaaaagtttttgtttctacggttttattaaattttcagtgcttgctgaacttttgcttggtcagcccttcttccccggcgactcgggtgtgtttgtactactactatttgaattgtttattagttttgtaaaagcattttgggttttatgggaaaaccccatattttttaatttccgagattggtctgggtcaatttcgtcccgacaaaccccgtaccagtcaagattagggcgcgacatgatcttttgctttattggaaaaccaaatccagcaaaaacctggtgtcatttgaaatttttgcatgtttgggagccaaccattaagctattatttacaattagcactagacattttaaaaagtagcttacagcatgacaaccataaaatgcagcttttgcatttgtattttttagagagtatcaaaaaacaacaaatttctatttgatttttggtattactatattatctatataaagtcttttacactaagcgctttcgacttttatatttatgttttatatattttgagcaggtgttgatcagctggtggagatcatcaaagtgttgggcacaccgtcgcgcgatgaaatccaacacatgaaccccaactacaccgaatttcgcttcccgatgattcgaccgcatccctggcaccgggttagttcaaccttcattcattttcgtgataagagaactacaaaaatatacactaaaactcgagaaaaaattacgcatcatttccagttatcaaaaaattagttttcaagaatttatccattttcccgcaactaatttttattttggagatttgtgttgtggtacagtgagcaaaaaattatttgtactgtggactggtacaaaaaaaaacaatccgatactcttcattagtctaaccaaaaaaaatatattctggtatgggtcgatccgaagattttttgcttgacatctcattggcataagttttccagaccaattttcaaaaaaaaaaatcgttggcacgaaaataataatgaatgtgtttggttctgctgtttcagccaggaaaaaaatttttactttcgagagttatggggacactcattcatttttggatttttttttaggtgttccgtgctcgtacgccccaggaagccatcgatttggtttcccatctgctcaagtacacgccgagcgttcgtccttctccgttcgaggcgttggcacacgacttctttgacgagttgcgctcgccgacctgcaaaatgccgtcaaccggtggcccgttgccgccactgttcgacttcacggagcacgagctccagattgagccccgtctgaacgaaaaattggtgccaaagtgtcagtctgcttccgcctcctcctcattgtcggcgacgatgccaaagacgtcgacggcgccggacggtggtggtgccaaacagcaggagggggtcggtggtggagtggtgaaaacggacgaatcagacagcaaacagcaggtgagcacattgggggagcatttgtggtattactaaccatatttaataataaatccccccgagagttcaatttttcaggggctttattagaggggggcgggtcactaaaacattttttattagtcattaaaaagtgacttaggtttttggttgtttttctatttataaggtatagggtccaatgaaaattgaaatatacaaaaaaaatgttttaatactaaagaa

SEQ ID NO: 47224 - DNA, 3195 bp, Heterodera glycines
  misc_feature (69)..(69): n is a, c, g, or t
  misc_feature (3075)..(3075): n is a, c, g, or t
  Genomic contig location: Contig_ID=SeqID_2268; Location=1..3195; Strand=-
  SCN-specific regions: Sequence locations=1-92,136-164,202-351,373 -2067,2094-2205,2245-2545,2578-2625,2647-2745,2786-2791,2814 -2846,2869-2967,2989-3114,3136-3195
  Gene Ontology: Mol. function=metallopeptidase activity; Cellular component=extracellular matrix; Biological process=proteolysis and peptidolysis
agcgaaatttttcgacccgaaaacgtaaaactttcgcctccacaggcctctccattcttagtgtttggnccgtccatcctctgagagggcaaggaaaatttgaaaaaaccctttcatttaaaaccctttaaatttgagtcacaatttctggctcttggaattatttttaatcatttccacacatttttccaccaggattgttcgctacgaagtgtaccagactcagccggttagtgcctttcttcagttttcattattggcacatttagaattatcccaatcttttcagagtgccatcgcctcatatttgcacgaaaatgtgagactgctcgctcgctgatcagtgatcaatttttctcttttttctgatcagggcaatgcccaacgctacctggacctgttttgtcgccatcagcgcaatttgggtgcccgagagtgggaccatgcgctgatgttgaccggttttgacatccaccggggctacggtgccacatcaatttccggcattgccaggcttggtaagtagttcaggatgttgcgaaattataaaaactttaaattttccacccaaatttaacagtcgtcagagtaagtggttttcgcctttctgatgacttttttatttttacgaataaacaatatttttgccctcttccatatggttcatctaaaaattatttggtgccgaattttcggtacccaattttctcgtctaattacccccctccgtcccccgctctcggggctgagtattccaccgaataattaaattatggcactcatatgtatattggcaccattctccctttagatggaatgtgcgattcatggaattcttggtaaattaaaacacggccaaatgagtcccacgagggcacaaatttaaaattcagtacgcttgccgaaggcctggacttcacatcggctttcatcggcacacatgagcttggccacgcggtcggcatgcgccatgatgagccctactgtcccggcacgcacataatgagcgcatcacttggccccggcaaagtgacatggtcaagctgttcaacacgtgattatcagatgttcatccaacgcctcgagtgggttgccctgctgggtggaattcattgatcaccaagaaatcggacaggatttagggctgatcacaaagagaaataatcgccataaaaaatagggacagggcctgggattgatcaccatgaaaaattggacaacgtttgggactggttaccaagaaaaataggggaagagtttgggactgatcagtaatcaccatgaaaaatagggacaaagtttgggactgatcagtaagcacgaagaaaatcggggccggtcttgggactgatcaccacgaaaaagggcagtttaaatttcaaaaatggcattaggtcacccctcaaattcaagggcgtagccagacccttggcttcggagggagctgaagctcgattttaaaatttcaaaaaaatttactgaaaatttttactttttgggtttcgggggggggccttagccccctcagccggaacgggccaactccgtctggccaactccgtctgagccaactttgagtcaatataactcttgaagttattgaccgaatcaaacaatcttgatatcattggaaagctcttcacaggctctattagcctactaaaaattacagaaaatttcgaactataaaaaaagatagaaataaaaaactttgaaaattctgccttttttgcggttttaaactgacaacttttttgagagctgattaatcactgagaaatagcttataaatatcttctaaacatctagggctttcgaatgataccatgattgtgaagtttggccaacaaagaaaaaagttatagctttttgaacattgctgagacggagttgacccctaccgccctcagccccccccccccgccctgcctacgcccttgctcaaattgccatttctccccatgtttacagtgcacgtcaaaacaactgcatgcgaagctcactgctgcgtgaacagcttccaatcaccgaatcgctgaagcctggccaagtttacgatgcccacggtcaaaattttaagaatattttatatttaaggactccaaagcgggctcataatcccttttttctggattttacaaaatttttgatcgctttttctgattaaacactgatcaaacattgaattttgttggcaattcgtacaataaatttttaaatttaatttttttttattattaaaatgtacaaattgtcagataaccaaatttaagtgtttcttctttcagagcagtgccggctgatgcatggaccatcgtatgtgcaagtgtcgccacggcatgaccattacggtaaagcagaatgccaaaaaagaattttccttacgccgaatttaaattacccaaattttacccaagatggcgtctgtcacatgatgtggtgcggtcagagcaactacggacgcatcatcacttctcatcccgctttggagggcactgtttgtggcacaaatcaatggtccgtttttggcattttgcataagtcgattttaaatttttttttttttgaattttaaatgggattttttaccagaaaaaaaatcgttccgatattttcaaaaggcgtaaaaatatggcaaatacaaaaatatgagttttgaaaaaatggcaccgactctaaaaatatggcaaataccgtacagatatagtattactgtcaccatgacgaaattattttttagcaatgaaaaaataaataaagaaattttcaaatgttttaatattttgcaaacaaaattacaaaattctcaaaaagcataaaattttcatatcagaaaaaattcttggaaaatttatttaaaaaataattcatgctaggggggaaggaatgtaagaaatgccgttgttttgttgccctttcggcactcagtccgcgcttttccccctgcgcaggtgttcgcttggccgttgcatgccatggggcagcagcggtggctctggcgtcgccgttggcaccgcgaccgccactccaaccgcaaccggtggccaccgtgccaatgctgacaacagtcatgcncagcaacgacggtcagttctaatgcggcatggaacgcgcggcaggaggaaatccgtgccaaatacatgcgtacgctggccgagtggcgagcgcggacggagcgcgagcgggccgactatg

SEQ ID NO: 47225 - DNA, 1344 bp, Heterodera glycines
  Genomic contig location: Contig_ID=SeqID_232; Location=1753..3096; Strand=+
  SCN-specific regions: Sequence locations=1-737,759-830,853-1344
atgacatttcacaaaatcgacaacgactcagtgaactcaatcaccaatgctcttgactttttccgtatacccccgacaaatgtgagcgtctcatcttcaaaggtattcgagcttctgcccagcaatccgcttaccgacacaccctaccacttcaaacttcactccagtcaaaattacattgacctctccaaatgctatttgctcaccgagtttcgaatccgcaaggaaaacgttaatggtcaactcattaacctaggcattgatgacataaatattgcaccaattcaaatgatcggacaaaccttcatccgtaacatcaaaatgagcatcaatgggcgcgaaatttttaatgcaaacgccctgatggcctacaaatcatatttctcacatgaactctcctattcaacgaccgcaaaagactcccatctgaatgcagctgggtactaccgggacacgggcgatacattggagatgggaggcggatgcacagcgcgacgcgatttatttgcgggtagcaacgtagctcaattcattgcaaaaattgacacagacctattcaatcagccgttgtatctgatcaatttttgtgaattggacattgaaattttgcccaacgacaacgactttgtgctaatttcaccagtcgtaggtgcacccaaataccattttgaggtcatgggtttgaaaatgtatgtgaagaaagtgtctttgatggacggattggcgctggacattgcgcgaaagttggagttgaaacctgcgcgttatgcagtgaggaagacaatgatgaaatcgatgttcatcagtcaaggacgatatgagtttacagccaatttgttcatggatcaaatcccccgccgtatcacaatgggtttggtggctaatactgactatgttggcacaattaggcgcagcccattcaactttcaaccatttaatgtgcgcgaaatttcgattattgccaatgggcgctcttacccacaagcaccctacgacttgaattacccaaacggtaaatttgttcgtccattcaatgacatgaatgaagcggtggggttttcgaattcatcagagagtaatgggattacttttgcccaatatggaagaactcattgcatttacgttttcaatatgaccaacagcggggacgatcaggcggcattgtttgatctgataaagaatgggaccaccgcggtgagcatcaaatttaaccacccagtacccgatggaggaataatgttggtggtaatgggagagtgtgactctctggtgatgttagacaaaaaccgatcaataagcactgacaccactatttaaaccaccccgcattgtcatttcattaaa

SEQ ID NO: 47226 - DNA, 1635 bp, Heterodera glycines
  Genomic contig location: Contig_ID=SeqID_14718; Location=424..2058; Strand=+
  SCN-specific regions: Sequence locations=1-336,358-539,562-728,750 -1071,1101-1635
  Gene Ontology: Mol. function=structural constituent of bone; Cellular component=collagen type I; Biological process=histogenesis and organogenesis
atgaatcagcaaaaggaagaaaagaaggcgtccaagggggagagggaggaggacgtcaaagtgttgttggccgaagcggaacgcttcaaaaggctggccttcctcggggtgatggtgtgcaccggtgggtgacccgtggaccattcattggcacttcgaatttgccgttgtctctttcagtggcaactttgaccgcctcaatgtgcgtgccgatgctctattcctacacgcagtacatccaattgtcgcttcgggatgaaatcggcttttgtgtgcatagaacacaaaatttgtacagcgaattcgcaaaagtccgttcccccccgttgcccatggcatttcctttcaattttcagtatgaaattgttcgacggcctaaacggtccccaatggtcagtcagtttctcatctccaaccacggcagtctctccgcggcacagttcactccaaacacagcccaacgccgcaaatcgcgacagggaggctatgagcaagtgatcgccggctacgccgccgccgggtcccaagtggcgccccctccggcgccgccggcacccgccaacgcttacccagggaacaattcgcctcctccgcctgcccaagaagtaccgcaagctccgccttcttcgcccgctccatccgctgctaattacgcggcaggggcacaagcgccttcggccggtgctcagcaggtgccattagtcagtgcccattagaaaatgatcaaaacacagcaggaacaggcggtggaggagcaatgttgctcatgcgcggttggcgccgccggaatgccggggccgccaggcgaagatggaacggatgggaaggacggacttcctggccagtccgggctggacggggcggacgcgccggagcaaggggcgaccggagggtacgacgagttctgcttcgactgcccgggtttcgaaacattttctcggttgggtttctgtaccatttgcttattcagctgcttaccccggaccgcccggcgggatgggccccaaagggccacccggacagccaggactgccaggccaacccggaattccgggagcgcccgggcctcaaggccccccgggcccacccggccccggcggagcgaatggaccgcccggacagccgggaccaagaggtaaaagagaagggagcggagcaaatgcaagcatacacttcagggttggacggacagctttcggatgtgcccggcgttcaagggcctccgggccccgttggcccaccggggcccccgggagtgccgggagagccaggccaacaggggcaaagccaagtaatgagggggagggctgaaaataatcatgctaatggccattaagccgggcccgcctgggcctcctggcgatgcggggctgccaggactgccgggacagccaggcgcacccgggcaaagcgcggcggacggcgaacccggaggaaagggcggctgcgaccattgccccgccccacggaccgccccgggctattagtcggattttggctccattcctcaaagcattgtccttttctttttctgtctgctcaatctcagtttctttccttatttacaatttcttcctcttgaaagcatttattttgtgcataaaatgcagaattgtcaaatttgttgttaaggaa

SEQ ID NO: 47227 - DNA, 2076 bp, Heterodera glycines
  Genomic contig location: Contig_ID=SeqID_14728; Location=21..2096; Strand=+
  SCN-specific regions: Sequence locations=1-213,236-594,625-1082,1111 -1408,1431-1432,1459-1573,1596-1627,1650-1740,1763-1963,1985-2076
  Gene Ontology: Mol. function=oxoglutarate dehydrogenase (lipoamide) activity; Cellular component=mitochondrial matrix; Biological process=embryogenesis and morphogenesis
gaatatgtggacgaagaattgaagaagtacggcgccattctggagaatgcgcacgagagtgccaagcaggtgaccgagctgcgcaaccgggactggctggactcgccgtgggacgactttttccgtggcaaaaacccatcccaattgttgcccaccggcattgagcgcgactcgctggagcacattgtgaacaaaatctcgcaagtgcccgacgggttcaacctgcaccggggactgcttcgactgctcaaaggtgagctggccagtggaatataaaaagtgaagaatttgtttctttatgggttcgttcttggaattttttttgcatcagaattccattggtcttacaattaatcagtactaatccatttttactaatttgttaacatttttttttgtaggacgaaaagaaatgctgagcgaaaacaatttggactggtccattggcgagtcgttggcgtacgggtcgttgctgatggaaggtatgtgggtttcctgttttttttggatttggttggagtaaattccgtcttaaattgtgccaggaattcacgtgcggttgtctggtgaggatgtggagcgtggcaccttctcccatcgtcaccatgtgctccatgatcagaaaattgaccaaaaaacgtacaatccgctcaacgacctttctgaggttggaattttttattttttgagcatttttatcattaaacttttttctatgccagacccaagcggagtacacggtgtgcaattcgtcgttgagtgagtacgctgtgctcggcttcgagttgggctactccgtggtcaaccccaactcattggtcagtcagtcctgtatcggggttgtcatgggactagaaaaaagacgtgggacgatacgacctaaagcctggatcgaaatccgggacgaccgaatttgaaatcgggtcaggatggtcaaaatttcggcattggaatttgggacgataaaaaatgtttgaattcagtggtaaccctggtcaatctgtaaaacgtcattatattaatcaaaaaaaaaatttgctaaggtcatttgggaggcccaatttggcgactttgccaacaccgcgcagtgcatcattgaccagttcatctccagcggacaagccaagtggattcggcagaccaatttgacactgttgttgccgcacggttctgagggcatgggaccggagcacagcagcgcacggccgggtgagtacagcttacttgtatttgtgcatcggatggaggttgaacggcgggttccgaactaaggaaatcccagacatttcaaggttcggaattccacattttttgggcgaggggcttaaaatggacatgatttggatgggttaatccacacaattacactatgtttaaggacaacaaaaattttgtccacaaatttcccaaaattaaaaaatatatattttcagagcgtttcctgcaaatgtgcaacgaagatgatggcatcgacttgaaggtgtgaaaaatggaatttaataaaaatttaaagaaaattcagagtgtcgctttggacgaggcatttgtggcccgtcagctgaacgagaccaattggattgtggccaactgtacaacaccggccaacttcttccatctgttgcgtcggcaaatttatttgccattccgcaagccgttgattgtgttcacgcccaaagtacgtgcatgaaaaaatgaataactaaaaaatttggaatttttttatgcctagtaatcctacgattttttctaaataaaataatcaaattaagttgaaatttgattaattaaaatttccagtctctgctccgccatccgttggccaaatcgccggtggacgactttttgcccggcacatcgtttcgccgtgccatccccgaggagggcagtgccaccaacaacccggcggccgtggagcgactcgtcttctgttccggtaagaaagcgttgattgatcaatcaagagtaaagttgttttactataaaactttgtggcgtgttattacggaaatgtttttttcaggaaaagtttactacgaaattttgaccgagcgcagaaaccaaggcctggatgataag

SEQ ID NO: 47228 - DNA, 403 bp, Heterodera glycines
  Genomic contig location: Contig_ID=SeqID_14730; Location=20..422; Strand=-
  SCN-specific regions: Sequence locations=1-224,247-403
atggcaccgctggccaagacatttttgggccccgaattggcacggggactgaaggagggactgccgtacccgctaaaggtgagcaaaccggacggaacggaagaagaagcaactgatcgaatggggaaagggtcgatcaatcgtaagacaaccgcaaagtgaatcgagcgaataactgtccgatcagccattgatcaatgggcaattaattaaaaggcatttaatttgtttgttttttaaggatacaattcgcttcatccgtcctaagctgacccttcatgaaggctacatccgtttggccactgatttcgaactcagcgagcagcacatgcgccagagagttgcagaagcatttgagaggatcaaaaacgaacatgaaccaccgggccaatttagaaattaa

SEQ ID NO: 47229 - DNA, 616 bp, Heterodera glycines
  Genomic contig location: Contig_ID=SeqID_14732; Location=3038..3653; Strand=-
  SCN-specific regions: Sequence locations=1-385,408-507,529-587,609-616
atggaatccactcgcataagtgaagcggagattaagcgcagggaggcgcagatgatggagggggcgcgtcctttcaatgtgttcgacccgttcacctggtcatttccgggcaaaatagccgctacgagcaccggaattttgacttgctcggtgggttttgcctatgaaattgagaatgagtacctaattgcttaaggtgacttattacatgttgtggtaccgaaagccttggtacgccggtaagtcatcgatatttttttttggcctttttaacgtaactgaatattgtccgtttttaattcctgtcaaattttttttttcagcgcttaacatgaaaattctaatttttgcggccgggatcagcggtgcttatttcattgcaaagtctcgcgcccgagtgatggccgatcgcgacgccgtcgtctcgcattacgttcagacgcaccccgaagactttgagcatttgaccttgaacaattgtgagccattcaacctttgatcttttttgttattttgaaaattcttttcagtctatggtcgtccctacagagaccttctcctcccatgggtgccaattcgtgctcagtacaacaaacttgaaaaggaagcgaattga

SEQ ID NO: 47230 - DNA, 1508 bp, Heterodera glycines
  Genomic contig location: Contig_ID=SeqID_14734; Location=1335..2842; Strand=+
  SCN-specific regions: Sequence locations=1-178,200-295,317-393,423 -653,675-795,839-1097,1119-1441,1465-1508
  Gene Ontology: Mol. function=succinate dehydrogenase (ubiquinone) activity; Cellular component=mitochondrial inner membrane; Biological process=tricarboxylic acid cycle
tttatttgttatttcaggcgaatgctccggaaacttaagcatagtgctagttttccgctaatttctgcttttacacgcagatttagtaaaaatgtttccggctacaaaattgttgaccacactttcgatgccattgtggtgggcgcaggtaatcaacaacccctcaagttattcaaccttttatttatatattatttaaggcggcgctggtcttcgagctgcgatgggtctttcggaggggggaatgaaaacaggtcaatttgggtgtggggttcgcgtaatgtatttttttgtggttcagctgttattaccaaactgttcccgactcgttcacacactgtggcggcccaaggcgggataaatgccgcattgggaaacatgaacccggatgattggcgatggcacttttatgacactgtcaaaggcattcgatttgagggtctcccatgtcagtaattttcttttaggaagcgattggcttggtgatcaggacgctatccattatatgaccagggaagcgccccgggcggtcatcgaattggaaaactacggaatgcctttttcgcgcacggaggagggaaagatttaccaacgcgcatttggaggacaaagcaatgattttggacgcggtggtcaggcgcacaggcaagaaaaaaggacactttgggaagaatggacggggggtttcacttttgagtttaaagggtaggagattcccttcgggcactggggagccttcgccccccccaaccctcgcatttcctctcgcatcgtttccctgaaattttttaaaggtttttttaattaataattaagtttttttaaaagaatttattttccttttccggtgattttcaaagatttttttcagaaacccaagttttccaaaaagattttttattttctcctagaaaaaatcagtaaaaaatttccgtccaaattttctgtccgtatttcgtcccctcctcctcaggacgtgttgtgtcgcggatcggaccggtcattctctgctgcacactctttacggcgcttccctccaatataattgcaattacttcgtcgaatattttgcgctggaccttttgatgtcgcgagaagggcactgtgtgggggtggtggccataaatttggaggatgggtccatccaccgttttcgggctgccaacactgtcctcgcgacgggcggctacggcagggcgtacttcagctgcacttcggcccacacctgcacaggggacggaacggcgcttgtcgcccgggccgggctttgcaattcggacatggaatttgtgcaatttcaccccacgggaatttatggcgcgggatgtctgataaccgaaggatgccgaggtgagctttgagttgtccaaattctaaaaatcttggtacaggcgagggcggttttctgatcaataacgaaggggaacgcttcatggaacgctacgccccggtggcgaaggacctcgcctctcgggacgtcgtctcccggtcgatgaccatcgaaataa

SEQ ID NO: 47231 - DNA, 3053 bp, Heterodera glycines
  Genomic contig location: Contig_ID=SeqID_2277; Location=941..3993; Strand=-
  SCN-specific regions: Sequence locations=1-1,44-135,157-342,365 -417,440-480,503-701,723-859,881-1335,1358-1677,1748-1786,1809 -2525,2548-3053
  Gene Ontology: Mol. function=protein serine/threonine kinase activity; Cellular component=cytoplasm
ggaagaaaaagaaggacaaaaagcattcgtcctcctcgggccaccatcggtcgccgagccgaaaggacgtcaaaacggagagacggagcagcgaacgagaaaaggtgaaaagagtcaagcagtcagtcgtgggacttttgtttggtggcattggggtccacacttttttcaataaaaaacaattcattacccctaataaatgtctataaaaggctttttctgggacaaaactcgagtccaacttcactttgatttattctgaccaatcagcaaattcttagaccggcgcaatattttaggattctttggagaaggagcaacgccgtcgctcgccaaatcgacgggacaaagaaatgctcagaacgatgaaaactgaacggagaacgccggaaaaagactgagggaaaaaagcgaaatgttttttgtttctataaataatagttttttattgatgcataaattattttattggaaagggtgaaattttaattaaaaaatatttgaaacttgtcaatttgatattaaaaaaagcatttcttgcatatatttatttttattagaccaaaatgaaagggaaggcaaataagcgacatggacgacaacgaatggtcgaggaaatgaggcaattgtcgaccgacgacgacggcgagcagttcgaggggagcagcaaagggacggaaaaagcacagcggggggacagcgacgaagaaaagcgaagcgaacggacgacggaagaaatggggggagaaagttgcgaagagatggaggagcaccaaaaggtgggcaaagggagggagagtttaaggatgggtgaacgagactgacgtaatcgcaattgccgggattctcagtcctgatatttttcgaaaagccaacccgaaactggcaaatttcagctcgagtccatatgtctgaaagggggtagccagggccaaggcgcctacttttccgttttttcgtcagttgctttgcgttgtttatttcttggtctttcttcaccctcagtctctgcccgcccttttcccccgtcggttggccatgttcgactttggccaatgcgaccccaagcgctgttcgggccgcaagctgtgccgcgttgggctcgtctccgtgcaacggttcagccatcgttttcccggccttttgctcactccagccgcatccgtcaccatttcacccgtcgaccgaccattggtcatggccaaaggcctcgccgtggtcgactgttcgtggaatcgcctggacacaacgccaatgcacaaggcgaaggtgctttgttagtccacacggttttggccaagtttctgttttcaggggtctgaacatcgtttactgccctttttgttggctgccaacccggtcaactacgccatgccgttcaagttgagttgtgtggaagcattcgccgctgcccttttcattgtcggcttggaagaagcggccaaatgcgtgttggcacccttcaaatggggcccaaactttttggctctgaatgccgaagtgttatccgcttacgcaaagttaatgttttgggacctcttaagttttatcggaaaaacaatttcagtgctcatcgggcgacgaagtgattcgatgtcaacgccaattcatggaaaaaattgaggcggaagccaaacggagcaaagaaaggacagtcaaatatcccacttcgtcatcagaagaagacgaagaagccgaagatgaggaaaacggagaagggacggaaaatgaaaaagtggggaaagaaagtacggaccgaccgaatcgtaaatagggcaaaattaaaatatttatttggttttaagggttggataatttggggtttattgcatttttcttcggctgggcgatatccctgaaattcacacaaaacccattttaggcattgaggctgaagtctcttccgactccgaaggtgcttccgttgcgctacagaagacagaaacggtggatgccattgtgtcccaaactgattgtgagctttacgaatgggaaacgacgcccttttgccagggggccgaggcgcgactgttcgcgtgcactttcctccgtcgtcgggcagtgatgaaagagcggtttgtgaagcggtacagacacgcggaattggacgcgcggctggcgaaggagaggacgcgggccgaactgaaggccatcctcaaatgccaagaggtgccttggcgggggggggggggactgcttgaacttttccactttgttcgctttgtcataactttgccgctgcttttctctcagattggcattcgcgtgccatccgttttcttcgtggacccgctcaaaaatcggataattttcgaactaatttgctcgtctggcagcagcgacagagcaccgaccgcaaaacattttctggacaaattgcagcgggacgaatcggcgtcgaacaatgccgaacaatttgcagtgagtagtgaaagaagaagcactaatgccatgacaaaaggacggggctatgttaacaaacattttgttatttggatttacgcagctgtcaaactttagtccgatttttctttttaattttgggaagggttattcccacgttcctatgattataataattacataaaaatctgtgtgttggtgccattcattttctccctccctaaggctcaattggcggaatttggacatgaatttggaagaattctgaggacaatgcacgacgccaatctcatccacggggacctgaccacgtccaatgtgctcgtcctgactcaacggggaccagtcgaattggcactgattgactttgggttggcccaattctcgtcaaagccggaggacaaagcggtggatttgtatgtgctggagagggcaattcggaggtgagtattacaaacaatgttggtgagcaaatggacaaagaaaacaatcgcagtgcgcacattggcatgggcaaaatgatggatgccattttggacgcatacaaaacagaagggggcggaggggacgaggacggaacgaatgccaaaccggtgctgctcaaattggacgaagttcggcgcagggggcgcaagagagacatgatcggg

SEQ ID NO: 47232 - DNA, 1517 bp, Heterodera glycines
  misc_feature (1441)..(1441): n is a, c, g, or t
  Genomic contig location: Contig_ID=SeqID_2278; Location=29..1545; Strand=-
  SCN-specific regions: Sequence locations=1-1139,1161-1517
  Gene Ontology: Mol. function=hydroxymethylglutaryl-CoA synthase activity; Cellular component=endoplasmic reticulum; Biological process=cell organization and biogenesis
atggacttggagggcgccgacgagaaaaacgcgtgtttcggtgggacccaggcgttgtttcatgccgtcgattggatgtacgctaattacgcaacagaaagtgagcaattggtcctaaaaccttcttttcaaagagttgtggaaacatttaattgcgcaatcgttaggttatcagttcagtcattctcacttcgctttttcatttggcatgtttttaattttcagaacgccttgccatcgttgtctgtgctgatgtggcagtttattcggctgggcccgcccgatgtacgggcggtgccggtgcagtggcctttctgattggttggattttgttgcgccaatttaggcatttattctttcattttctatttcaggaccaaatgcaccgattgcacttgaacgtggccttagggcatgccattctcaaaatgtttacgacttttacaagccaattggaggcgttagcacgcaattcccacgagtggacgggccaaacagtgtggagacctatttgaacgccgttgacatgtgttacgggcgattttgtgagaaatggaacaagaaattctgcacagggcgtaagtcattcatcgtattttgttctatcaactaaaaaagggattgcgaaatattggttataaattaatttgaaataaactttttctgttattttcgatttgcgtgactaatgcaactgttttacaaacgattggacactcaatcatctcacttaatgatttattacatttcaattagttatttcagccccttgctctctttcggattttgtcgctgtcattttccactcgccgtacgctcgtctcacccaaaaagccttttcttggctgtccttcgtcgactttaaacggggaatgatggacgatggtgtcacagctgatgatgatgatgtgtctgattgggatcaactcagcgcatacaaatcgaaatcactccatgagatttttgcggtggaacgcacaaaaactcgctcggacggcgatcgatttactgacaaaattttgcggatgagttcgcggacagcggatgccaaactgaatccatttttggagtttagtcgacgcattgggaacatgtacacgccgtcggtatatgctcagctgatcaacgtctttctgaagtgagtggggggaggaggaggaacagcaagcaaaggtcattagcgaactaatttttctatccgttttagcactgaactttccgataaatcgaacgggaaacggatcctcatattttcttatggcagcggttgtatcgccgcaatgtactcacttcgtttcaatttgtacacggaaaaactgatggctgcctacggcgcaattaaacaaagcgcgaaaaaggcacacgcgcgattggaccagcggatccgacacagccccaagcagtttacagccgcattggagagaacggagcaaatgtcgcntgaagggggtcagtttggtgacgagccgcccaacgaaccatttatgtacagatacttacatcgaaactcccgatga

SEQ ID NO: 47233 - DNA, 611 bp, Heterodera glycines
  Genomic contig location: Contig_ID=SeqID_2278; Location=3705..4315; Strand=-
  SCN-specific regions: Sequence locations=1-407,429-464,500-578,600-611
  Gene Ontology: Mol. function=sodium:phosphate symporter activity; Cellular component=integral to plasma membrane; Biological process =hermaphrodite genital morphogenesis
ccccccccccccccctcccttaagcaatgccattgctccgctcgtgtcactgtacaccatttacgatgaaggcagtgtccatcagaagggcgagacttccgtatatttgctgctttacggtgctgccggaatgtgcgttgggctttggctgctcggccaccgagtgatctacacggtcggcgaaaatctgaccaggataactcctcccagcggcttttccatcgaatttggcgccgctctcacagttcttttcgccagcaaattgggtctaccgataagttccactcagtgcaaggtgacgatttgatgagagaagatgatcgctttgttttgtctaggttgggagtgtggtggccgtcggactggtccaagcacatccggtggtccattggactgtgttcaggaatatctctctctcttggctggtgaggcgttagaaaattactattgaagaagcacagagcataaattaaaaatttcaaaattcattttaattaaaggttaccctgccaatcgccggtgttatgagtgccattgtgatgtttctgctgagaatgctcattttgtgagggtcgtctgagcatcatcagagaaaagggcggctgttcatg

SEQ ID NO: 47234 - DNA, 435 bp, Heterodera glycines
  Genomic contig location: Contig_ID=SeqID_14754; Location=264..698; Strand=+
  SCN-specific regions: Sequence locations=1-24,46-435
  Gene Ontology: Mol. function=tryptophan-tRNA ligase activity; Cellular component=cytoplasm; Biological process=tryptophanyl-tRNA aminoacylation
atcaacaaatatgcgttcagtggcgggagggacacaaaggaagaacaccgccaatttgggggcgactgtaccgtggacacttccttccaattcctgcgctttttcctcgacgacgacgaaagattagaagaaataagagaggtttaaccacaattcattatcatagacttttgcttatggcacccaaaataaggcccttttagttaattatttaaatagaaatagcaatccatcacaattacacaattatttgtacgcaataaattttgttttaagcaatacgcaagtggtgctatgttttccggcgaactcaaggcgattgctattggaattgtgcaaggcattgtgtcagaattgcaaactcgaaggaagacgatcaccaacgacgtggtgcgcgagttcaccacgccaaggaagttggcatatgacttttag

SEQ ID NO: 47235 - DNA, 2069 bp, Heterodera glycines
  misc_feature (8)..(9): n is a, c, g, or t
  Genomic contig location: Contig_ID=SeqID_14788; Location=128..2196; Strand=-
  SCN-specific regions: Sequence locations=1-216,242-688,717-754,778 -809,843-934,960-1105,1308-1315,1425-1539,1562-1814,1868-1889,1974 -2069
  Gene Ontology: Mol. function=voltage-gated calcium channel activity; Cellular component=voltage-gated calcium channel complex; Biological process=transport
aattacanngttccgggaaattaccgaaatgttatcatactttctactgtagtcgacgattgaattgtgccaaaatgcgcattaattctcgactcgagcatatcatcccttgcttcggattggctttttctcagccccaatttttgcctctcaggtctccaagttgttctgaatgccattcttcgtgccatgattccgttgctgcacatcgcactgctcgtcctcttcgtcatcctcatctatgccatcatcgggttggagctgttctgtggcaagctgcactccacatggttgacgggcatttgagaaaatttggaaaatttaagacgaaaatttagtgaaattgaatttatgattttcggaaaagttttcattttttatttaatagggaaaagttttttttttttaattttatcccaaaaaactcattaacaattcttttgaagcatcgattcggtgaccctcgaattggcgcaattagatccatccgtaagttcccattttttaatttggcatccataattggcattttgccccctttttttttgttagacttgtggcttcgcctccagtgcctaccattgtgagccttcctccgcttcggccattcattcggtgcggcacaaatggctttgctcgcacaacacaacatggatggtcagtcagtgagaagcacattaaaagtgccaatttaaatttttaagaattttaaaaaacgcggcaattttaattcttatgaattttaaaaaatgccaaaatataattattttatttaaaccctgggggcactcaaaaaaactcaatttaggaaaaattaatttaattaattattttaaaattttggaaacaattctcaattaatttcattttgtttaaaattattttttctattttcattggcactttatttgaatttccgcgcagggccccaacaatggcatcaccaactttgacaacattggcctcgcaatgcttacggtgttccaatgcgtttcgctggaggggtggacagaagtgatgtattgggtgagagaagaagcgattaatcttaggcttaggctaaagcctaggcttatgttaggtttatgttaatcttaggctaggcttaattaatttaatattaatactaaataattaattattccataaaaatgcctaaaaacaaataataattcaattttatattttaaaccatttttgtaaatgaaataaaattataaaaaaaaatattattattattattataaaaacgtaattttatttttttatacttaaaataaataaatatatttaattaattaataattgacagaggattaaaaataaatttgaactttaaaaataaaaataaataattttatatttttaaattaatttttctattttttctatttatttattattttaatttccatttcccttttccggttaatgatgcggtgggccgggaatggccttggatttacttcgtgactttggtcatcctcggctcctttttcgtgctcaatttggtgttgggtgttctgtccggagagttctccaaggagcgggagaaggccaacgcgcgcggactttttcaggcattttcaaaacaaatttctgagcaattgtaatggaattgatcaatttttggtgatcgaaatgaattatggactaatttttgattagtcggatttgaacaatgatcaatcggaaagaaagtgatcattttggtcatcctcttcgatcgatcaaaccatgccattttgatcaatcaatgcattgaatttgttactaaagtgatcaataagcttaatttgatacagaaatttcgcgagaagcagcagctggaggaggacctcaagggctacctggactggatcacgcaggcggaggacatcgagcagttgggcgacgacgaacacgcggacgaacatggcgagtcgggcgccggcgacggtgacgaggacggcgagcacagcgacggcgagacgcagcgaccgtccgcgctgctgacgcagtggcgactgttgcagcggatgaaccgccggtgtcgccgcgggtgccgtcgcatggtcaagtcgcagacg

SEQ ID NO: 47236 - DNA, 567 bp, Heterodera glycines
  Genomic contig location: Contig_ID=SeqID_2290; Location=2545..3111; Strand=-
  SCN-specific regions: Sequence locations=1-567
  Gene Ontology: Mol. function=DNA binding; Cellular component =nucleosome; Biological process=embryogenesis and morphogenesis
atggcaagaaccaagcaaattgcgaagaagagaatgagtgaaaagaaagcgactgaacaggatgctttggtttctaagcaaaatttgcccacccaagcagtcaaaaaagcgggatctgacatgggccatcgtgctaagcgacaattggcaacgaaaagtgccccgaatcgccgcccacggtaccaagcatcgcatttgctaccaccacccgaagaaccattacaacaaaaacgctttaaaaagcgtggagcgctcgctctccaggagatccgcaaattccaagaaagcgtcaatctgcttataccgcgcagcacgttctttcgtgttgtccgcgaggtgaccatgaagttcgccgatggaatgcgctggcagggcaaggccctattggcactgcagaccatgaccgagtgccatctcgttaatatgttcgaggatgtcaatatgtgcgccctgcatgccgggcgagtcacgataatgccaaaagacatcgccttggttcgaaaaatacgcggcgaaaccacactcgctccgtcgtccggtttgcgccagactaaccgtcgtcgttga

SEQ ID NO: 47237 - DNA, 2374 bp, Heterodera glycines
  Genomic contig location: Contig_ID=SeqID_14793; Location=870..3243; Strand=-
  SCN-specific regions: Sequence locations=1-6,30-196,218-311,333 -1583,1605-1676,1698-1764,1788-1844,1868-1872,1894-2059,2081 -2090,2112-2374
  Gene Ontology: Mol. function=pre-mRNA splicing factor activity; Cellular component=spliceosome complex; Biological process=mRNA splicing
gagtgcggttatgccattcggtttgaggactgcacatccgagaaaacgataattaaagtaacttcgatttcccattttttgtatttcatttttgcatttcactttaatttttttcagtatatgacggatggtattctgctgagagaatgtttgaggtgccatcccaaacgcattctttttttagattttataattcattttcagtgaccccgacttggactcctacgccgccatcattatggacgaggcgcacgagcgttcactgaacaccgacgttctgtttggactgctgagagatgtggtggcaagacggtaaaagaaatgaaattaaaattgcatagataaacaggctcataaccagaaaaaaattcggtggggggaggcaaccgaagagcttccagcgccgtagaaaaaaaaacctagatgctgccgaggaaacgaaaatttggccatcttttaagaaattcagttaatttaaaattcccatttttcggatagtttttcatttcgggcgtttggcaattccccacacaccccctggttacggatctgtggcggaattaagtagggacatctaattttcaacattatttgagtgcttttccactttcgctgttcatttttttcggttaatcattccctgtcgttttcctttccaaattttctcttactttttcctttttagttccgacttgaaactgattgtcacttctgcgacaatggatgcggataaattcgccaatttcttcggcggacatacgccaattttccaaattcctggccgaacatttcccgtcgagatttaccacgcccgtgttcccgtggaagaccacgtcgacgcggcggtcaaacaggcggtcaaaattcacttgggcggcatggagggcgacattttgattttcatgccgggccaagaggacatcgaagtcagtcccagcattcacgttggctttatcaattcatttctcattggtttccttggggttccctcccctccccatttttcgcaaaagctccgtttgttattttatattgaaaaaaattaccaaccggattgacccttccaggattatgctaaattttgcccctttttaaggtgacttgtgcgctgatcaaagaaaaattgggcgagttggacgaggcgcctccgctcgccgtgctgcccatttactcgcagttgcccagcgaccttcaggccaaaattttccaaaaagcgccaggagggatgcgcaaatgcattgtggccacaaacattgccgaaacctcattgactgttgacggcattttctttgtggtggatccgggctactgcaagctgaaggtattcaccgaaaaaatcggcatggacacgctgcaggtcagcaaaattaagcatttgcaatttaatccaaaccgccatttgctgaacagatattccccgtttcgcaagcgtccgccaatcaacggtcgggccgtgccgggcgtacggggcctggccactgctaccgactgtacaccgagcgacagttcaaggacgaaatgttggtcagcactgtgccggaaattcaacggacaaaccttgccaatgtcgtccttttgctgtcagtttttctccttaattttttgcttgcaattagagttcgtcgctttcggtcctttctaatttaatgtttttcattttccgggaacattcatggtttattaaaataattatttttctcatttagcaagtccctcaatgtcgacgatttgctgctgttccatttcatggactcaccgccgatggacaacatgctgaactccatgtaccagctttggacattgggtgcactggacaacattggccaactgacggatttgggacgcaaaatggtggaatgtaagcaaattcatcccactttccccccaaaaaatgctatttttcgtttttctcagttccgctggacccaacactgtccaaaatgctgctgatgtccgtggacatgggctgcagcagcgaaattttgaccattgtgtcgatgctttccattccttcgctgttttttcggcccaaagggcgcgaggacgaggcggacgcacgacgggagaaattccaggcactcacatttcaatttctaaagaatggaaataatccgacaattgcctttaggtccccgaaagtgaccatctgacctacctgaacacgtacatccaatggcagaagcacaagtacagctccaagtggtgcaccgacaattttgtgcacgcaaaagcgatgcgcaaagttcgcgaggtgcgcgcgcaattggccgaaattatggagagtcagcgcttggaaatgctctcttccgggacggattgggacgtggtgcgcaagtgcgtctgctcggcatacttttacaacgcggcacggtaa

SEQ ID NO: 47238 - DNA, 1004 bp, Heterodera glycines
  Genomic contig location: Contig_ID=SeqID_14827; Location=609..1612; Strand=-
  SCN-specific regions: Sequence locations=1-153,176-211,233-293,315 -474,496-1004
  Gene Ontology: Biological process=embryogenesis and morphogenesis
atgacagacaaaggcggcgattcagacgacgaagcggccgaagaatttgttccgacgggcacttttaagccgattgttccgttgccctcaaaagtcgatgtgaaaagcggcgaagaaaatgaggaggtgcttttgctttttgcttgttccatcttttttatttattttttttttaggtccttttcagtgctcgttgtaaattgtttcgctacgacccaatggacaaaaagaacaaagaacggggaattggggagcttaaagtgagttgtccccccccccgccccaaatggcctaaaattgggaccttttaaaaaagagttggagaaggtttcatgagggaggaaatgaaataaatttattctcttcgtcgcctgtgggccatgtaaacaaaaaactcgtcaaattccatgtcttacaattacggcttgtgtaggtcccacttggggagagggttgggccggtaaaacaaattttccactgtattatcccattccattcgtgctgaaatcgtttgcccttttcagctgttgcacaacaaagagacgggccgttatcgctgcgtcattcgcagtgatgaccaactttgcaaattgttcgctaattttcccgtcttggccacaatgataagccgtatcactggtcagaagccgaacgttcgaactttgcagtgccgagtaggaattggcactatcataattaattaactaattatctttgtttatttgttcttttaggacttcagcgaaagctccgagggaattgacgaagtgtttttgcttaaatttcgtgaccaaacgaccgctgaagaatttgctaacaaattggaggagacaggcaaaagattaggagagacgccgaaggaaaaggaagcggccgagaaagagccaagacaatgaacggagttgaaaagaaacggaaatgaaattcaatttttttccccttgttgcttaagctatcaccggaacagctgttgttgctaaggctatgtttttcttgagaataaa

SEQ ID NO: 47239 - DNA, 1155 bp, Heterodera glycines
  Genomic contig location: Contig_ID=SeqID_14838; Location=2287..3441; Strand=+
  SCN-specific regions: Sequence locations=1-433,455-492,514-648,686 -877,899-1084,1106-1155
  Gene Ontology: Cellular component=endoplasmic reticulum membrane
atgaaccaattccgtgtgggtggtcagcgtgaattgttgggcgttgctgaggattatgcggacgatgtgagtgggggaggggacaatcgctgacaagggctggtggaatatgaattgttttttatttttgtgctacaattttgctgctgttttttgtcgaaccattaattctcctgtttttcagattttgcgtcatacaaaaaagattctgccgcatttggcccgacttttcctcgtttccacattcattgaggatggttgtcgcatgtgggtgcagtgggacgaccaacgcgagttcatgcaggtgacagaaaatagatgggacggatgggcgaacctttcagcgtccatttttgacttttaccacatttaaaatgttataaaacctttacaattttaggagtcttggtcatgcggttggtttcttgccatgctttttgtggttttcaatttcttcggccaaatccttcccgttgtgatggtgatgatccgaaaatatattgggattgcttgtgccattcttgcgggaggtttgtttggctttttgttactttattttattggacttttcagttgttgtgcttcaaacgtttgcttatcatattatttgggacctcaagtttcttgccaggtttggcaatatgctcgaattctttctttattattattttcctagaaatgtggccattttcggtgctctcgtcctcctctatgctgaaactgtagaggaacgaaagtcactcttcgctggtgtgcctcaaatggacgaccaaaacaaacccaaatcgtacatgattcttctcgggcgtattctcctcgtctttatgtttttgttggttttttgttttttatattcaaaaactgatacgcttaattgtaggtctctcattcattttgatcatttgtccttcttcaaagtggtaattaatgacataatgctgaataccttttcttaatttttataacccaacaattttaccataagtgatttggcttctgttttagcttgaactctcagttggcattgtgctaatgattcttgtaacaattggtttcaaaacaaaggtaaggctgaactaaactgttcatattttgtttaattttagtgttaatttggcttttttattgatgcctgacattttaattgtgctttag

SEQ ID NO: 47240 - DNA, 1450 bp, Heterodera glycines; identical to SEQ ID NO: 14855
  Genomic contig location: Contig_ID=SeqID_14855; Location=1..1450; Strand=+
  SCN-specific regions: Sequence locations=1-1055,1080-1238,1260-1450
  Gene Ontology: Mol. function=inositol-145-triphosphate receptor activity; Cellular component=endoplasmic reticulum membrane; Biological process=calcium ion transport

SEQ ID NO: 47241 - DNA, 198 bp, Heterodera glycines
  Genomic contig location: Contig_ID=SeqID_14868; Location=627..824; Strand=-
  SCN-specific regions: Sequence locations=1-123,147-198
  Gene Ontology: Mol. function=CTP synthase activity; Cellular component=cytosol; Biological process=pyrimidine base metabolism
atggcagaggaaccagtgaaactgattcttgtcaccggcggagtgatgagcggcgttggcaaaggcattgtgtcgtcgagcatcggtgtcctattgaagggttgcggttaccgagtgactgtgatcaaaatcgacccgtacatcaatgtcgatgctggcactttctctccattcgaacatggcaagttgactttgccc

SEQ ID NO: 47242 - DNA, 618 bp, Heterodera glycines
  Genomic contig location: Contig_ID=SeqID_14874; Location=55..672; Strand=+
  SCN-specific regions: Sequence locations=1-123,163-165,335-468,490-618
gaacattgtccctgcggacgttgtgaaaattgcgccatttactcttttcccgtcgcccttcccacgcgaactttttgtccaagcgcagaaagtgcacaaagtgaggaagtgaataaagacaacaaaataaaaagatttagttattttatttataaaataaaaggcaattaattaattatttttcattaattaggccactcaattaattcatttttcattaatgaggccatccaattaatgtattttctcattaattaggccatcctttaatgatttttcattaattaggccactcaattaattcatttttcattaatgaggccattcaattaatgtattttctcattaattaggccatcctttaatgatttttcattaattaggccatccaattaattcatttttctattaattaggccatccaattaattcatttttctattaattaggccatccaattaatgtattttcgcgccgcgtcgaactttgaatttttgaaagatgtgcacaagggactgctgaaaacagaccaaaatttcatagaaacttttaaaagcattgaaagcagacacttggaaggcattaagcaaccgctgactttgttctgcaacagagcag

SEQ ID NO: 47243 - DNA, 442 bp, Heterodera glycines
  Genomic contig location: Contig_ID=SeqID_2311; Location=183..624; Strand=+
  SCN-specific regions: Sequence locations=1-107,162-187,209-265,289 -322,344-411,433-442
  Gene Ontology: Mol. function=vitamin D3 receptor activity; Biological process=signal transduction
ctgcgagtcgtgcaaggcattcttccgccggaacgcgttgcgcccaaaggagttcaaatgcccgtactcaaatgagtgcgagatcaccgcgctcagccggcggtgtgtttttttgttttttctatatttaaaaaattaatttaaaaaaataaatttttaaagtttttgtcaaaaatgtcgtctccgcaaatgctttgaagtcggcatgaaaaaggagtggattctgagtgatgagcagctgaaacggcgcaaaaatgcccgcattaagtgccaacaacagcagcagcacccaaacggtggcggaattgccagggagcaccagcacaaccgccacaacaaccaacatcagcatcatcaacaggtagagagagagagtacagtaagaaatggtacatataacgatggggggaaatggcaaaaatttggcaccactggcgagtaa

SEQ ID NO: 47244 - DNA, 809 bp, Heterodera glycines
  Genomic contig location: Contig_ID=SeqID_14887; Location=18..826; Strand=-
  SCN-specific regions: Sequence locations=1-26,48-166,220-294,316 -463,485-509,538-606,628-809
atggcagttgctgtcgctgacaatgccaacagcaacaacaacaatgccgtgttggcaatattttttgggcaatttggtaaaaaaaatgacacgaaaaaaccggaaattttgtaatttttaggcattggactgatgcacacaacttttatgttttattatgtcaaggttttttattttattcttaaaaaatatgaaatttaagaatttcttatttttaatgggtctataaaaggtgttttaccccaattttcaggtgtttctcaacattttccaagtcaacgagtattggttcaactggtcccagctgttgtttctgatttggaatgccatcaatgacccactttttggctatttgcaggtagcgagcgaatctcccgcttttaacaaaaactcttaaaaaccaaattcatgaaattttaaatcgcaaaaatttttaagtgtgctttttttacctagactcactcaatttttgagtctaatttttgaaaatttagcgaagaaatacaaccattttttgtttgtcttggtgtgatttttaacgaaatttttgtaaattcaaatataaatttggctaacaaaatccgacatggtttagccatcgctggggaatttatgggaaatttctttcagaattatcttaaggcctagctttacaacaaaaaaaaaaatgcgcatttttttattccaaattttcccatatttttttaggacgtcggtggcacttggatgaaagaccgtggcaaaattttcacctattttggcccctttctcgtcctctcctttcctgatcatttggttcccgtggcgaa

SEQ ID NO: 47245 - DNA, 815 bp, Heterodera glycines
  Genomic contig location: Contig_ID=SeqID_14901; Location=657..1471; Strand=-
  SCN-specific regions: Sequence locations=1-401,442-579,602-815
  Gene Ontology: Mol. function=protein binding; Biological process =purine nucleotide biosynthesis
aaaacgtggcaccattcaacccggcagcattggtccctatccgttcgtcacttcgtccaattctaccgtcggcggttgcatcaccggccttggcattccgccgacagccgtccgtcgcgtcatcggcgtggtcaaagcctaccaaacgcgtgtcggctccggtccgttcccgactgaactgcttgacgccgatgtatgtacttgccccaaaaattatgttaatttgatcgcattgtttgtctttccatagggacagcccagcgaagagggcaaacgtttgcaagaagttggtgctgagattggcgtgaccactcgcagaaaacggcgctgtggttggcttgacttggttctgttgcgttattctgcaatgatcaacggattcacttcgtacgtttcacccaattattattttatatgttcatatttatagtttttcataattttagtttggctgtaacaaaggtggacatcctggaccaatttcatgaaattaaaattgccattggttacgaattgaatggacggcaaattgagtaccctccaggtgagctgaacaaaattaacgactgtttttatgccatttcaagtgtttatcttttttcagcgaccgtcgatgattgggcaaatttgtgcgtccattacaaaacctttgagggttggcagtcgccaacgaccagtgcccgtcagtgggaacagttgccggacaaatgccgtgcctatttggagttcatacaaaatcaactgggcgtacccgtcgaatacatcggagttgggaagggacgggagcagctgattgtgcgcacgaataacggagg

SEQ ID NO: 47246 - DNA, 796 bp, Heterodera glycines
  Genomic contig location: Contig_ID=SeqID_14903; Location=129..924; Strand=+
  SCN-specific regions: Sequence locations=1-296,318-796
  Gene Ontology: Mol. function=transcription cofactor activity; Cellular component=transcription factor complex; Biological process =regulation of cell cycle
atgcgcactttccaaattcgtcatcgttcaacggataaaacgcgcgggttgcgtcattttgctcacaaagtttgtgagaaagtgaagcaaaaagttcaaactaattacaacgaagttgcggaagaattggtcaatgaatattttgacaatattgttgaagtcccatcggacccggttaattgatattattcgtaatgaaataatgcatttaaatttcaggaaaaattacaatatgatacaagaaacattcgccgtcgtgtttatgatgcgcttaatgttttaatggcgatgaacataattgaaaaagaaaagaaagagattcgttgggtgggcttgcccacttcgtcgttggccgagtgccgacggctcgaagaagaaaaggtatgacgccacagcaaattcaacgattgaattgttaaatttcatggctttaggcacaacgtcaggaacgaatccgtcaaaaaaccgaacaacttcaggaactgatagttcaggtgattgaacaaacatagttatttcacttaaattgatctttttagttagtttcttacaaatctttggtccagcgcaatagagaaagtgaacgagtgaatggcaggcctttggtgccatgtaatcccgacactgggtaatttcgacactgagtaatttcgacactgaactattttcaaaactttcactgttttacttcattttcgacactgagtatttttgacactgagtaatttcgacactaaagagttttttgaaaaaaattcatgccaaaatttgaagattggtcaaaaactaaatataa

SEQ ID NO: 47247 - DNA, 1265 bp, Heterodera glycines
  Genomic contig location: Contig_ID=SeqID_2316; Location=2387..3651; Strand=-
  SCN-specific regions: Sequence locations=1-45,67-123,145-283,312 -836,875-1140,1166-1218,1260-1265
  Gene Ontology: Mol. function=protein serine/threonine phosphatase activity; Cellular component=cytoplasm; Biological process=cell cycle
atgcagccgacgctcgtcagaatccacccgccggccgtcatcgtgggcgacatccatggacaattcgcggacctgaagaagattttctcaacgcatggcctgccgccggagcagcagtacgtcttcctgggcgactacgtcgacagagggccccaatcgatggagacgatcatcctcctcttctgctacaaggtgtggtttttgggggatggggggagggaacccccaaaaaatgaaattcatttcccccatttttcaggtgaagtacccgtccaacttcatgctgctgcgcgggaaccacgagtgcgccaacatcaacagagtgtaagtgaaaaagttttttgtgtgtttttttgtgattaatcattccccccccccattttcaggtatggcttctacgatgagatcgaccgccgttacccgcgaccgggcgctcgtcgactcttcgacctcttcaatcaagtcttcgcctggatgccattcgtcggactggtcggcgagaagatcctctgtaagttttgggggagggcaatttttggggttcaataactgtttccaactgattttcaggcatgcacggtggcatctccaatcagatccgcagcctggaccagctcagcaacttgcttcgcccgcagaccgagccactgcttcgttcgctggaaattgacctcctctgggccgacccgtcgacgagcatcacaggcgtcgccccgaacaacagaggagccggcgtcatgttcggcgcggacgtggtcgagagcgtgcgcaacctgctcggcatcgactacatcgttcgagcgcatcaagtgagttttttttggcttttcatttcacttttgctttaataattttccccttcccttctttttcagctcgtcatggacggcgtggaatacttcgcgaatcgccacctgatcaccctgttctcggccccccgctacaccggcaagaacaacacgggcgccacgctgctgatcgcgccggacctgagccacacaatcacgcgcttcccgcctgcctgaggacgacgagacggacggacagaacgcgcacacacactaactgcacacagaagaatggtggaactgcccggagagcgatgcgtgtggagaaatcggatcatctgaccccccattgttgtattgtattgtattgtattgtaaacccccatttcacatgatgaactcccccaaaaactgttgtcatttcaatatttgcgtgtgtgaatgtatgtatgtatatgctatgtgtgtgtgaataaa

SEQ ID NO: 47248 - DNA, 1719 bp, Heterodera glycines
  Genomic contig location: Contig_ID=SeqID_2317; Location=190..1908; Strand=-
  SCN-specific regions: Sequence locations=1-16,39-70,99-1005,1047 -1132,1154-1186,1209-1251,1277-1278,1307-1317,1339-1352,1375 -1512,1552-1719
  Gene Ontology: Mol. function=protein phosphatase type 1 intrinsic catalyst activity; Cellular component=cytoplasm; Biological process =cell cycle
ggatgggggagggaacccccaaaattcatttccccccatttttcaggtgaagtacccgtccaacttcatgctgctgcgcgggaaccacgagtgcgccaacatcaacagagtgtaagtgaaaaagttttttgtgtgtttttttgtgattaatcattccccccccccccccattttcaggtatggcttctacgatgagatcgaccgccgttacccgcgaccgggcgctcgtcgactcttcgacctcttcaatcaagtcttcgcctggatgccattcgtcggactggtcggtgagaagatcctctgtaagttttgggggagggcaatttttggggttcaataactgttttccaactgattttcaggcatgcacggtggcatctccaatcagatccgcagcctggaccagctcagcaacttgcttcgcccgcagaccgagccactgcttcgttcgctggaaattgacctcctctgggccgacccgtcgacgagcatcacaggcgtcgccccgaacaacagaggagccggcgtcatgttcggcgcggacgtggtcgagagcgtgcgcaacctgctcggcatcgactacatcgttcgagcgcatcaagtgagtttattttttttttggcttttcatttcacttttgctttaataattttccccttcccttctttttcagctcgtcatggacggcgtggaatacttcgcgaatcgccacctgatcaccctgttctcggccccccgctacaccggcaagaacaacacgggcgccacgctgctgatcgcgccggacctgagccacacaatcacgcgcttcccgcctgcctgaggacgacgagacggacggacagaacgcgcacacacactaactgcacacagaaggatggtggaactgcccgaagaacgatgcgtgtggagaaatcggatcatctgaccccccccccccccatttattgtaaacccccatttcacatgatcaaccccccaaaacactgttgtcatttcaatatttgcgtgtgtgaatgtatgtatgtatatgctatgtgtgtgtgaataaacattgtaagcaaaaaaaaaaaaataggcaaaattcgttttttcaaaaaatagttaacataaatagtgagtaaaaatgccaaaatagtgaagaaatagtgacaaaaagtccgaaatagtgacataattttcagccaaaaattgagcaaaaataattttattcactgattgcagttgcaaatgagtaggacagggatttttaagaccaaaaaacccaaaatagttacctaaaaaatttttaaaattaaaaatttttgccaagaaagtaaattttttagaaaattttttcatttcataggagtatattttgaaaaattttagctcgattcttaggggtgtatttgcatttttgacatagtgaaaaaatagtgacaaaacgccaaaatagtgaaaactccaaaatagtgatttctagtgaccgataatgacatcaaaatcgaaaatttttaatgcagaaatgcgttttttttaattttaataatattttttcatttttttaaaccgataaaatattttaaaagcataaatggaaaaacattaaaaatgaatatattctaattttaaaaaatggtaaagcacttaactaatttgtaagcatccaaaaaaacctaaatttaagcatgaattaagcactaaaatagcaaattaagcataaaaaccgaaaataat

SEQ ID NO: 47249 - DNA, 2551 bp, Heterodera glycines
  Genomic contig location: Contig_ID=SeqID_2318; Location=2810..5360; Strand=-
  SCN-specific regions: Sequence locations=1-603,625-1254,1276 -1693,1715-1766,1808-2082,2104-2104,2140-2173,2207-2420,2442-2551
  Gene Ontology: Mol. function=snoRNA binding; Cellular component =cytoplasm; Biological process=signal transduction
atggtcgccccgaaacagacacagctcaacgcattgtgcgcggacaaagcgggcgatttggtgatagcgtcgagcaaagacaacttcgacatttacgtttgggtgggtaacgtaacgaacgaatgaccggctcaaagagagggacgaggatattacaatctgttgctttttcaaggcattggccaccggccatttgttggaggtgctcaacggacacactaatcttgtgacgggtttggcactgtccgaaaacacgcttttctctgcttcttctgacggcacgctgaaactgtggaatattatcgaagggaattgcctggaaagtgtccaattgaccagtgagggattggatgtgaagcacaggtaacagagtgactgctatgcctccattttttcaattgtccgcgaccaacattttcttattccacgcccccaaagctcacaaatctcaaaatgactttgccatttcagtccttccgccatgcttttggccgtgctttgttacgactcgtcaattgctttgttcgacactgtgaacacccaacaattgggtacaattgacaccaaactcgacattgacgcggcccgacaaaaggcggacaaagtgaagaaagcgtcttcagagcggaataagtacgttttttcagtgtcctttaatcgtttgtccataattcccccccccctttttaaggactttcacttgcatcgctttctcccccgacggttctttgcttttggccggtggtcagtccaacactttttgtctgtatagcgtcgcgggtcgtattcgattgcgtacattcaaattgagtttcaacgcgagtttggaaggggttaaggtatttgagaccaattaatttggtaaatatttccaatgtttaatttgtctaaggatgacatcaattcacgaagacaaacagaatttggcaacattgacttgtttgacatcagtgactcggaagacgaacggcacaatccaagaaaagccatcaaactcccgggcacacggcacacagacatggccgaacggtccatccaccaacccgtcactgttaccaagatgggcttttgtccaactggtacttaatgtgctctaaacacagcgtccggaaaattaactcctgtaccaaaaaagaattcatgtgtggcgaagtggttttgtaaggggttcgagtccgtcgcgcggcatgaatagttttatttaagttttgtccaaaaattgaaaaagtccatttttgaaaattatttttaaagcctttgccaaccaaatttggtgtcattcgaaagcttttgattaaaaaaaactttttctaagcaaatgataagcgatttaattgagagatgttttttctctgcactttctattttttgtacatctctcatttttcagacgctgcgtaaataaacataaatattgaactggttgagccgtttgctttccattttaggtggttctttcgccgtcgtttcaacggaaggcgttgcactttactctctgttccaaatgcgaagattcgaccccttccaattggaaattgacgtggtccccaactccatcgtccaattttctctttccggcgaacacgcgaaagccatttcgttggcacttcggctcaacgatgccaaactgacgaggagagtggtcgaatccgttcccattttacaacgtaaaataacaataaataatccgtacttttcccatgtttttctttctttagtttctgctgtcgttcgggggattgagctgatttacatcgaacgtctgattgtttggcttttgttttttgctgacaaaggccaccaaaagcatgtccatttttaccaattattggtccgagaaattcttattgcaaatgcatccaaactgaagcaatcagttgatcaaagccggcaatttgtcactggacttcagcaaatgattgccaaccaccaaattttgttgatggaaatgttcgttttcagaacaaaaagtcaaccaaattcgtcttattttgcatggtttcaggtgttcacaaaatacacaatcacttgcttatttgctgatgacgagaagaatgaaaaacgctatcatatattaacagaaacaaaaaccaattttcaattgttattattttcaaaattaaaaataacagaaaaggcctaaaaaatacattagattggctggatcacgaatgggggcgggggcgaacaaaaaatggaaatgggacgagaggggggggggggatcaaaagtgtgatcggaacgcggttggtccactctcatctcctcttcgtccttctctgtgtgtcggctgttttgtcggattctgtgtcactgcccttcacaatagccattttttgatggcatctgaatttcgtttttgtataattcagccaccaaactggcggatttcttacaaagtgcggcagaacaaagcgctgctgcccccaaaactacagcaaatccaattgctgtgtcatcgctcccgaaagtggcacttgcactgctggttatcggtggaggcgaagtcggacacggtgtccagaatgtaggggccgtcttaagagagtga

SEQ ID NO: 47250 - DNA, 1038 bp, Heterodera glycines
  Genomic contig location: Contig_ID=SeqID_14928; Location=1..1038; Strand=-
  SCN-specific regions: Sequence locations=1-445,500-692,719-1038
  Gene Ontology: Mol. function=receptor activity; Cellular component =integral to plasma membrane; Biological process=locomotory behavior
acgtgctgcgtttgctgtgccttcacaattgtcacatttctcattgacatcgaacggtttttccttcgtttcaattggccaatgactctgtttcctttggtttagcttcgaattccccgaaaaggccatcttttacatggccatttgctatttgctggtcagtgccacttatatggtcggcctggtggaggaggacagtctctcctgcgctgtttcctccgcaaccaaacaacagttggtcactcaggtcagtctaccccaaaattgtgtccattttttgtttcaactttcgttttcccgcagggcaatgagaatattctctgttctgcggtggcagtcgtccattactttttcaacttcgccggcactctttggtggttggtgctgtgcttctcctggtttctggtcaccaccctcaaatggggagaagcgccggttggccaggtctgtccttccctttttgtctttctctctctccctctatctctctcattttctcaatttgtccacttccattttgggttttctcctcctatttcaacatcctcgcctggtccttacctgccattggctccgttctgctcgtcgccatgggtgccgttgatggcgatatgttcaccggcatttgctcccttggcaatcttcgccccgagttttactttcgactcgcgttggtccctcaaagcattgccattggtttgtttttactttttgcattgttttcaattttccttgaatttgccaattattttccctcttttatgtgtcggattggtgcttttcgccagtgggttcgtttccatccttcgcattcgctcgtacatcaaaggccaccgtttcgtgaccgacaaattcgagcagacagacgccagtgacaaactgagcaagttgatgttccgcatcggctgcttctctttggtttacgttcttccgatggccgtcggcattttctgcgcgttttatcagactgaaaacattggccattggctgaccaattggttcgtcaaatgaatgttttcttgcaacaaaccttccttt

SEQ ID NO: 47251 - DNA, 646 bp, Heterodera glycines
  Genomic contig location: Contig_ID=SeqID_14943; Location=2340..2985; Strand=-
  SCN-specific regions: Sequence locations=1-214,236-412,434-646
  Gene Ontology: Mol. function=ubiquitin conjugating enzyme activity; Cellular component=proteasome complex (sensu Eukarya); Biological process=mitosis
cgtttttgttgttgtttgtgcctgtgtgatttcaagaagaaggccgagtttgcgaaacgaattgttgcgattgatcgaccttggacaccaaattcaagttgttgatgaaaatgtacgttcttcaccttttcctcttatttaaattgcatttttcagatctatcgttggaaggtgaaaataccgggaccgccaacatcgctttagtgaggatgcattttcttttgttctgaaaaaatgtttcagttttcccggagtctatacggtcaatattgaaattccgtgtgtctatcccaatcaggctccaaaagtacaattcgaaacaagaatactccaccccaacagtaagttggacctttcgttaacgatcaatcctgtttgcttttcagttaagaatggtgatttctgtgttaatctgctgacactttggaatgctagcaacaatatgacagatgtgctccaagcaatctcacatgttcttcttgagccaaattatgaaagtccatacaacactgaggcagcggtaagtacttctgctgtttagtctgtcaattttttttcctattttcagtttgcatatcaccacaaccaagtcgcgtacgaaaattctgttcgacggatggttcaactatacgctgtgggtggataa

SEQ ID NO: 47252 - DNA, 860 bp, Heterodera glycines
  Genomic contig location: Contig_ID=SeqID_14957; Location=1135..1994; Strand=-
  SCN-specific regions: Sequence locations=1-95,118-537,559-582,604-860
  Gene Ontology: Mol. function=methylenetetrahydrofolate reductase (NADPH) activity; Cellular component=cell; Biological process =methionine metabolism
gatcagttcaatgttagcctctgtgatcaacgaccgcttcaaccggcacagccaatgcgctcctttcttttctttggaattttaccctccgctgaaagaacaccccaaaaatttggcggacttcttcgaaatgttggatcatctgaagcaggcgcagcctctgtttgtggacatcacttggtcaagacgaaatgacccgggtgagaggagggtaattacaaggattgatcaattagtatggtcaaaaaagctacaaacgcttacaattagtctgatttattcttcacaggaaatttggccaaattgaattcttcgtcggccattgccattgccaccgcggccattttcggcaaagaacgcacaatgctgcatatctgctgcaatgatcacacgaggactgagtcgattagtcatgtgaagcaaacattgagccatggcattgcgaatattatggcactgaggggggacgacatgccaacggagcaaacggtgggggggcaaaaaagaaaacaatctcgatactatgagattagcagcttctcaccaaaaacacaaaacacttcgccatcgatttggtcaaatggactcgagaattggaagagaccggcggatattttggcaatgatcggctaacggtggccgttgcgggacacatttatccgccgatgaaaaatatttcttacagacaatgcatggaacatttgaggtggtcgaactcaattaaaatggagtttaatgaggcagcataatcaatttaactttgtcaaatgcatttcaaatttcgcttttgacagggccaaagtcaatgccggcgccgacttcgtcgtcactcaattctttttggatgccaatttgtttga

SEQ ID NO: 47253 - DNA, 220 bp, Heterodera glycines
  misc_feature (206)..(206): n is a, c, g, or t
  Genomic contig location: Contig_ID=SeqID_14958; Location=1396..1615; Strand=+
  SCN-specific regions: Sequence locations=1-220
  Gene Ontology: Mol. function=protein transporter activity; Cellular component=Golgi transport complex; Biological process=intra-Golgi transport
atgcctgattatgatgaaaccactgatcttcaactttgcttcaataaaactcattttcaacgttcggattttaacgtcgaacgatttgtgaatttggcaaggaaacgcgtgactttggatcagctgcaaaatgacctgcgaatttacttgcggcatctccaaaatttcatggttgaactgatcaatgatgattatgccgactttgntaacctttcttctg

SEQ ID NO: 47254 - DNA, 1823 bp, Heterodera glycines
  Genomic contig location: Contig_ID=SeqID_14968; Location=669..2491; Strand=+
  SCN-specific regions: Sequence locations=1-544,566-1823
atgcatgttgattttgatcctctacaagtggattggtccacattctcgtccgagtatgtgcaatttggtggatacaacatttatcgggggttgccctatcagcgtggagcgggagttggcgcagtgttcagaagtcttatgagatacttgctgccgattggaaagcaaattggctacgcaattggatgtcagggaatggaaagcggaaatcgagtattcaccaacgtgctagagggaaaagacctcaaagagtctctcgtaagtgagagtaaggcaggactaaagaatcttctcgaaaaagcagccaacaacataaacatcagaagggtcaaggttttgattttaagcgatacaaaaaagactcggctcccaaaattggaaaaataaaacgaaaaaatataataaacttcaatcgttaatcgggccaccaatggttgatgagaccaaaaataaacgtctgcgtgttgactcattaggatcctattaaaaaatgacttgcccacaaaaaatcagcatcagcagtcccctagcaattaacagtggtctgaacattttctcagttcccccgaccaaagtgtctgttgtacgttctttctttcgttaggtgcttccgctagcaacaatcacgcaagaatcgccttacctatttcggctttacagtgacaatttgtggaccgatttatcgcgggtctatctttatctcgaactgtccattgaaaaaccgggagcaaacgataaatggattgctatagaggacgcggatactagtgtctctgccattcaagggattggtcaaacatttgtccagcaactaaaagttacggttggcaatacggaagtatacgatagcggaaacctatacccattcaaggcctatatcaccaatgagttaagctttccaataaatgccaagaaaaattttcttggttcaacagggtattattacaccgtaaaccaagatgactcaacagacgaggggttcaaagaacgttgtaagatctttaagggtggaaaaaatgcgcaattcctctcccgtctcgactttgatttgggaaaccaggagctttatctcttaaacaatttggacttgctgttcacaatttacaaagccaaagatgtctttctcttgcaaactttaaaagccaacgattcaaccaaatatcgtttgacagttcacgatgtcaagatttatgccaaaatggttgaggtacaaccttcactaaacatgagcctttacaaaacacttgagaaacaacccgccacgtacgcagtacgcaagaccgaaatcaaatcgtcattcatcagcgtcggtcgatacgaatttgagtataatgtcttcagcgcgaccattcctcggcgcgtgacaatcgcgttagttggaaattcagcatttcacggcgactacaaactgagtccattcatgtttgagccgtttgatttgcgtgaaatttcggtacatgccggtggggtggtctacccagctgttccttataaactaaatttttcaaaggatcactttgtcagtgcctttgttgacatgtatgaggcactcggaatggccaattcagaacgttcatttgacatttcaatgacccagttcaagaaaggatggaccttttttctgatcccattgacatccacgcttgacgacagctgtggatttgagctgttgagaagcggtacgacaaacgtacgagcaacattcaattcaccaattccacttggtggcgtggagatgattgtcttgggtgaattcgaccaaatgattatggttgattataatcggcacattgtgaccgactcaaagcttggataaaatataa

SEQ ID NO: 47255 - DNA, 1090 bp, Heterodera glycines
  Genomic contig location: Contig_ID=SeqID_14970; Location=207..1296; Strand=+
  SCN-specific regions: Sequence locations=1-136,159-271,300-351,373 -438,465-1090
  Gene Ontology: Mol. function=chromatin binding; Cellular component =nucleosome; Biological process=establishment and/or maintenance of chromatin architecture
gtcggccttcttctttttctcgaatgagaagcgtcaggaagtgtccggagagcatcccgaatggaaagtcgggcaaattgcgcaggaactcggcgttcgttggaaggcactttcggacgaagagcgcgcgatttacgaaaagaaagcccaggaggacaaagagcgatacgctgaggtgagagagaaaggagaacacaacggacgcaccccaaattaaaggacaaatttcaaatatttttttagtctttgacagattttggctaaaaaaccattcagattttttggcatattttggaaaattataaggccattggtggtccagaggctattcttattattagccatttaagaaaaaacaagtgatcagaaaaattaaatttaaatgcgcacggaaatgttgcacttaaattcttctttcaaattttgtcacttatttctctctaaaatggttaattttaacaaaaagtaaaatgttttcagtcggatggatttgaaattgacttttcctagggaaatggggaacgattgtcaactgttccgggttttcacgactttttaatcgctaaagcatcttttccattactttttgctgcaggaaatgcgtgcctatcgcaacgattctgctctgtcgtccggcacttgtcagaagccctcttacctggagggagggccgtccatggtcaaaacacccaatccgagaggattaaacaaaacaaaatgtccagttgattcagaccactgctgagcatgtgctgcagtcgcagggcggtgctcacgtggtgagcacatcggcgggcggacagccgcaaatggtcattctgcaacagcaaccgcagcagggacagccagggacgcagttgccaatgcaaatcttggtaatacaatccaatctagtgcattcattggccattttcagcattacaataagcagagtaaacgggagggattccccctccccccttggagtcagttcccccgcttggttaaaaaacatgtcttgggattggtccgtttattcgtcgttgttaaggaagagcacgtcagctcggcgtcagcggcacagcaatgcgcgacacagcagcacgcgtga

SEQ ID NO: 47256 - DNA, 916 bp, Heterodera glycines
  Genomic contig location: Contig_ID=SeqID_15003; Location=1171..2086; Strand=+
  SCN-specific regions: Sequence locations=1-195,220-780,802-916
  Gene Ontology: Mol. function=actin binding; Cellular component =cytoplasm; Biological process=actin cytoskeleton organization and biogenesis
gtaacttttgtgaaggatggctgtgagcattttttgataaaattgatgacaattgaaaactgtctcgggttgcgagaactctctgatcagcacagttgcgaacaacttcttgccgcaattgaggcatttatgcttgaacattttatggtaaaaaaaacattatatgagttgaatttttttcattcaaaggaaatttgccacaaagaagaatttatggcattggattcggtgacaacattagagcgactggcgaaaagtgacgatctaaacataacagacgaacggtttttgttcgaattcctcgtcaaatgggttgagatggacaaaaccgggttacaaaccgccggactaacaataaagaatatttgataattggcatgttcaggttgaggttaaattcgctgactcgcctccttcgatttgtccgtttttttcaacttcccttcgactattttgtgaacatcaagcaactcccgttgatttcccaatcgtctgaagcattggcatttgttcagtctcaatccgaagcttttttggaggcaatttctgcttctggtatttattttgtaaatttttttgcggctaacttatccgggagacgggaataaggcccctgttcatgagtccggcctcccataaacgttagaccttgtcaaacagaattttccaaatcgttgggccgtttgcttgcctcggcctctaattaaagggctctttagttttctgcttttagtttgttcggcttctcattcgttggccgaccaatgtctccaacagcgttttgttggcggccacaaaagcacgctttctggctccgacttgcacatttccagccgttcatttccgaacaaaaatcaaccttccaacagagagtcgtcactcacagcttcaagctgtttgggccagcatcaattaa

SEQ ID NO: 47257 - DNA, 1309 bp, Heterodera glycines
  Genomic contig location: Contig_ID=SeqID_15006; Location=509..1817; Strand=-
  SCN-specific regions: Sequence locations=1-114,137-353,386-756,779 -890,912-1225,1247-1309
  Gene Ontology: Mol. function=protein phosphatase type 1 intrinsic catalyst activity; Cellular component=cytoplasm; Biological process =cellular morphogenesis during vegetative growth
atgacgaccatttggcaactgtgcgaggacgcgaccaatgtgctgcgggaccaggcgtcacttgtcgagacgaaaccaccgctggtcatgtgcggcgacatccatggccaatttgtggacctgaagaggattttcaacaagatgggctacccgccgttcaccaaatacatgttcctgggtgacattgtcgaccgtggcaatcaaagtgtggagacgattgtcctgctgctgctctacaaggtgggtggaaatgtcgtgccgcgggagggagaatttgatcattttgcagggccaatttccctcccccccccaattttaaggtgcgctacccgaccgaattctatatactgcgcggcaaccacgaatgtgccagcatcaacagaatgtgagtgctgtggtgccgtcccatgtgtcacattttaactcaatttcagcaaaaaaaaaatccccccccccattttcagatatgggttctatgacgaaataaacgagcgttatggacaacataatgtgcggcctctgtgggagcggttcaacatgacattcgcctggcttccgttcgtcggattggtcagcgactgtattctgtgtgagttttttgccgttgatcggctgtctgatcgatcggacgaactctaatccccccgccctttttttaaggcatgcatggtggaatcgcgccggagatgaccaacattcagcaactccgcatgctgcgccgtccgtccatcgacccgccagttccgtccctggagctcgacctgctgtgggctgatccatcaaccgctgtggaaggcacggcacccaacccgcgtggagtgagcatcctgttcggtgccgatgtcgtcgccgaagtttgcagaaagctcaacatcgaattggtcgtccgcgctcatcaggtggggctggataatcggcacggcacatggacgactgactgtttatcgaagcgatttttttggtcattttcaaagcgttaaaacgttatttgaaaatgaataacaaaatttttcggtccgcgtttggtctcccctgtttttagagggccgaattagtgggatttgtgtgatccgaaaatgtgtaatttatttcattctccccactttttcagtgtgtcccgtttggtgtctcattctttgccaactcctacatgctgacgctgttctccgcaccgatgtacgtgactgaaaagaatgtgggagcggtgctggtgattgacgcgaagctgcagctgtccttcagattcttcaaaggcacccaaattacccccagcattggtccagcatctcgacgcgaatgttctcaatag

SEQ ID NO: 47258 - DNA, 1187 bp, Heterodera glycines
  Genomic contig location: Contig_ID=SeqID_2336; Location=774..1960; Strand=+
  SCN-specific regions: Sequence locations=1-112,137-1187
  Gene Ontology: Mol. function=pre-mRNA splicing factor activity; Cellular component=nuclear matrix; Biological process=mRNA splicing
atggatgccggcttttacagagggacctcttcagagcaggacatccgtttcactgacaaggaacgcaaattgttaaggcaaatgaagttcgaaaatgtgcttgaaacaaaggttgttgtcttcatttttgttgtttgactgcagttgactaaggtcgacttggcaaagataaatcttgatgttatcaagccgtggataacgcttaaactgaacgaaattctcgggatggaagacgacgtggtggtggaatatgtgttcacgcagcttgaggagaaggagctgaacccgaagaaaatgcaaatcaacctcaccgggtttctgaatgcgcgcagagctcgcgaatttatggtattttttcatctcttggatcaccttttgtcattttaggcagaaatgtggcaaatgtttgtcgaagcccaagacagccccgaagggattccaacgagtttagtggagaagaaagtgcaggaacttaaggtaggctgaataattgatttgagaaaacggcccataaaatttgcaaattcttttgcttaaacgtttttaaacactgccaaagtttaaattcgagaaaacagcataaataatcatattgcgttaaggcatcaaattcgaacaaacagccaatgcagacgtaccacaaagcgacggaagtggactggaaccagcggtaccaaacactgacgggcggacgctatgggaaaatggacccaaaagcccaagtgagcaaatcgcatatgtctgatacttttatgaaaggtggaggaagacgacccccagcgaaggcggcgcgatccggaagatgacagagatgaaagagcggagagacggatgaagtacgaagaggggcgattcaaagagaggaaggcaagtgggcacaaatacatcggttagtacccaccttaccaataagttaaatttaaggatttgttacgtgagaaacaacggcacgaagaaaaacaccgagaacgcacttcttcgcccgagtcaccaccgtcgatccgccgtttcgagcgagagcggaaaaagtggagaagaaaaaaaggcaacggtaggaggcggaccgaccagtaaatctcaattaaagtaaggtggggaaaaagcacttgaggaagagattaacgaattaaggggcagacaaaacggcgacgatgaaaaagaaaagtaccgcttaaatttgtttatta

SEQ ID NO: 47259 - DNA, 2446 bp, Heterodera glycines
  Genomic contig location: Contig_ID=SeqID_15032; Location=134..2579; Strand=-
  SCN-specific regions: Sequence locations=1-139,174-301,323-409,431 -533,555-618,640-655,677-764,786-1127,1149-1225,1255-1265,1287 -1556,1578-1717,1745-1783,1805-1827,1850-2218,2240-2298,2403-2446
atggcgatgcgacttccgagtcctcacaatcagcggaatgagtggctacggcatcagcacacttttgctgttggtctgcgctatcatcagcaaaagggtcctttaaacattctttgttggcataccaagcctattcatgaaaaaatattttgatttttttttaataaatataagttgactttgatattgaacatgtccaataatctcttcctcagtccgtcaacttgttgaagtgcaaaacgtgctgtattcggacggaaagtccacgcatggtcaatgagaaaaacactaaactcttttttgattttctttaacaattttaagtgaatgacttttccgggtcgtccattttcaattcgctcatagctttgacttgcgatgaaattgtttcattcggttcgctttcttcgatgataacctcaaaatattttcctgcatcgaaaatctaaaaatatttgttttttttatttaggtatttgagttcaaattgcctgattggatatctttttgtataaggatttccagaacagttcaggcaaaccagaagccaacaattggggctcatgaacttggagaaattgatcaaaatttaaatggtgagtcattgtccagaaaacaattcaacatttgcttgcccaagctgaaactgatttataagtagggatgatatttttaggcaaaagcctatttttttcctgagctccctatggtctgaaatgcacgaaaaacatgtttttttcggcggttgttaagctacttttcaagttattaatgcctattttctaggcttttatttttagcgcctataaagcctaaaaaaatttgaaagagcctatttttgcctattttggcgttttgcccaaaatttgttagcaaaaattcaataaaaacgaaaatatttacatagaataaaggaatcttggaaaatgaaacgggagttgcacatttatgcttatttgtttagtagtattttgtttttaaatactatttttagatttttactattaaaaatgccaaaagaaatttcatcccgcgcatttcttttcaaaaaatggatttttggcgttttgtccaaaatttgttaacaaaaatgcaataaaaacgaaaaatacacccctaagaatcgattttttgggaattttaaaaatacacccctaagaatcgacccaaaaatttctaaaaataaaccccctcagaaatgaaaaattttccaaaaattcatctccaaaatgtatttatttattttcttgacaagaatttatgctttaaaaaattatttatctcaatactgacttggcctaatttttttacttttttgaataattttttgtcattttacacccctaaaaatgagtttttttagtgcctattttccattttttagtgcctattttgggggttttttagagcctagagcctacctattttggcggtttttagtgcctataaatatcatccctatttataagagaataaattattcgtaaattaaatttggcatttcgaaattaaattaaaatttcactggcggcttaaacaaaaaagaatttaatcccattttttaaattaattttttagatggcagcaacacaaacaatggaaaatgagaaaactttgcaaggtgaaggaattttcgcagaaccggttcttccgcagaaaaatttgccactgaaaccggcaaaatcggaagagagcgacgaagggacagcgacggaacaaactcagcagcagcaacagcagccaaccatcagtgatttgcgatatcagcagccattttgggctttagtccctgctgaagacaaacaggaatactttcttgaagtgaaatgatcattttggaaagtaaatttgttttttcactctctttttcagattataaaagagggcactgtcattgggactgtccgtctccacgacagcgcccaccaaaaatcattttggtccattggccgttttgagccgtgtgacatcaaattggagcatccgtccgtttctcgtttccacgccattttacaatacggagaatgtataaaggggagaccgggatggtaaaagatggaggataaaaggggttttaccaatcaaatgttttctctttccaggttcatcttcgacatgaacagcacccacggggtgaggctgaacaagcagccgctcaaaaaacgcacttacgtcccattgcacaacggatttgtgttccaaatagcgggtcggaattaaatattttaaattgaatgaacaacttttggcaatgtttttcaggcagttcacgtcttttcactgtttgcggtggtcccaaaagagaacagaaagaagaagaaaacaaagaaaaggcacaaccaatgggaaaaacggagaacaaaaaggacgcagaagaggaaggagaggacgaagaagaacaacagctccgatactacgagaaggacccgttgggatggctgcaaaa

SEQ ID NO: 47260 - DNA, 1047 bp, Heterodera glycines
  Genomic contig location: Contig_ID=SeqID_15038; Location=180..1226; Strand=+
  SCN-specific regions: Sequence locations=1-22,45-527,549-1047
atgagcataaatggacgtgaagttttcaactccaattcactaatggcctacaaaacatacttctcacatgagctgtcctattccaatacggcaaaggactcgcatttgaatgcggcgggctattaccgtgacattggcggctcgcttgagacaggggacggatgcattgcgcgacgcaacctgtttgcgagaagcagaacagcgcaattcattgccaaaattgacgccgatttgttcaaccaacctctctacttgatcaacttctgtgagctggacattgaaattttacccaacgacaacgactttgtcctaatcactacgcccgctgttgcccagggtgctgcagctgctcctcgttaccgcttcgaggttgtcagtttgaaaatgtatgtgaaaaaagtctcattgatggatggactggcattggacattgcgcgaaaacttgaagtgaaaccggcacgatatgctgtgaggaaaacgctgatgaaatcaatgttcattagtcatggacgtttcgagtttacagccaatttgttcatggatcaaattccccgccgtatcacaatggggttagtggctaattctgactatattggaacaatttcgcgcagtccgttcaattttcaaccgtttaatgtgcgcgaaatctcaattattgctaatggccgctcctttccccaagcgccatacgacttggactacccaaattggaaatatgttcgccctttcaatgacatgaacgaagcagtgggattcgccaactcattggaaagcaatggaattagctatgaacagttcggaaaaacccactgcatttatgtgttcaatttgaccagcagtggagatgatcaagctgcgctgtttgacctgataaagaacgggacaacagcggtgagcatcaaattcaaccaggcagtgcccaccggggggataatgctggtggtgatgggcgaatgcgactctcttgtgatgttagacaaaaatcgatcaattagcacagacattactatttaaggctgtcattttttgtatgccactatcatttga

SEQ ID NO: 47261 - DNA, 237 bp, Heterodera glycines
  Genomic contig location: Contig_ID=SeqID_15043; Location=660..896; Strand=+
  SCN-specific regions: Sequence locations=32-78,101-237
atttattgaattcacttttttatttggtttcgtccgacaacaagaaatggtaagttgtaacggaatagcattcctgataactcaattaattcatattcaattgcttaggcaaagcgcacaaaaaaggtcggcattgtcgggaagtacggcactcggtacggcgcctcgttgcggaagacagtcaaaaagatggaggtgtctcaacatgccaaatacacatgtgcattctgcggcaag

SEQ ID NO: 47262 - DNA, 521 bp, Heterodera glycines
  Genomic contig location: Contig_ID=SeqID_15047; Location=312..832; Strand=-
  SCN-specific regions: Sequence locations=1-36,63-357,380-476,503-521
  Gene Ontology: Mol. function=structural constituent of ribosome; Cellular component=cytosolic small ribosomal subunit (sensu Eukarya); Biological process=reproduction
gtgatcatccgaccgtcttcaaaggtgatcatccgtttcctcacggtcatgatgaaacacggctacattggcgaattcgaaattgttgatgaccatcgtgccggcaaaattgtggtgaatctcactggacggatcaacaaatgccaagtgatcaggttctgttacatgaaaagaaagagtggccatactcccacccaaatatttttttactggtatgggatttattaaacaaattctgtagatttgtttcccattccaaatgccttcatctcgttaattttctgaatttttcacaatattgcaaaatacaatagacatttgattgaaatcaaatgacttcgtttaatcataggcggaaagactttattattttatttttcgatttcagtcctcgtttcgacattcgaatggccgacttggagaaatggaccagcaatttacttccatcgcgtcagttcggttttttggtgctcaccacttcggctggcattatggaccacgaggaggcacgtagaaaacac

SEQ ID NO: 47263 - DNA, 711 bp, Heterodera glycines
  Genomic contig location: Contig_ID=SeqID_15052; Location=421..1131; Strand=-
  SCN-specific regions: Sequence locations=1-201,224-711
atgccattaaatgatgtgtcgaataatgaaggcattgctcaaaatggcaccaccgattcgcttgccgacgccgacaacggcacagaagtgatgccaccgcagcatttgttcagcgactacgtggagatcgcttatctgggcctggtgatctgtgccggcttggcactgaacatttccgtgcttaaacgactgatggttgagcgaaggcgagcccggaggagcaacaaagtgatggtgggaaaaaggagcagacaaatgaacattttgcaaaaatcatgggcctaatttcaagactaaaagccgggaaaagcgaagcccaaacagaaaaaagagttttgaccggacttagtgcagaaacaattttattacggatttttaaattctgaaatgggcctaattattgctaattaattggttggctacaaaaaaaagtctgcggttctttagagcggttttctgctgctgaagctgaacctgaacgtgtccgacatcctgatcctgctcatccacgccagcggcaagctcggctggctgatcacttacgattggcggggcggcgacgcgctgtgccgcctgttcaatttgttgtccatgttcacgctgtacctctcctccaacattgtgatttgcatcgcgctcgaccgcctcttcactgtgctgaccgcgcagcggatggacttgggacagcaaaaagtgagaacaaaaaaataa

SEQ ID NO: 47264 - DNA, 228 bp, Heterodera glycines
  Genomic contig location: Contig_ID=SeqID_2342; Location=571..798; Strand=+
  SCN-specific regions: Sequence locations=1-228
atgtaccaacaattggtcaatttaagccctccctcgcaacaacctccacaatcgtcctccgcgacccatcaaggaggtcatcatcgccacacatcttcaggccatcaccgttcgtctggaatgactgcttcttcttcgcgtgctccgaataggacacgtaccggagatgacctgcacattggcaagtacaaactgctgaaaacaattggaaaaggcaacttcgcaaag

SEQ ID NO: 47265 - DNA, 3217 bp, Heterodera glycines
  Genomic contig location: Contig_ID=SeqID_2343; Location=4471..7687; Strand=+
  SCN-specific regions: Sequence locations=1-897,919-1485,1507 -1782,1812-1875,1897-2168,2191-2796,2820-2852,2874-2992,3015-3217
  Gene Ontology: Biological process=cell growth
atggcccacctcatccaggacggttttgtcgtcaatgacgcaacatggaaactaggcattttcatcaccgatatgaacatatcgcgagagttattcgttcgcggtgacatgaccatcggtagtctgatgatgcagttggtggggcaaattggtatcagaggcaaaagcagctccgctaatcagttcactgttcttaggcgagactcaggactggagtgaccattacatgtggtggcctgaccgccgtaagtggctgaaacacacgcgaagcacgttggaccaaattggaatcactgcagcgacttacttggaatttacaccgatgcataaacatgccaagtaaagggattaattattgcgtaattgtcttgttgattatttcatattttctgtaacatctttcagggtccaactccccgatttgcaggtgttcacatttaatttactttgttcaggcttttgattatttctctatatcttcttgacttttgtagattatcgatgcccgactcgatttttccgtgcccattttgaaggtcacccaaaaaatctgccaagaacttgccatccgtcacccggaagaactgtcgctgaagcgtgatattccgccagatattttgcgaaaaggcgcatctgtcgaatcggaggctcagattcagccatacatgaagccgggcgaggagtccattggacccggcactctccgaacggccaaacccatccgcgcttcaactgtcaacctcactagcgggcgaggctcacctgcactttcgcaggcatctgcaatgggccccggtcacttgtttaacgcttctgaaattggcacactgccgaagatgggaacgattccgcgcggaatgagccccggtccagccgcagtattcctttcagtttccaacatttttaaaatttaaatttgctccattagtatcgcgaagtgcttggacgaacaccggagcccggttactctgaaggaggcggtctcgaatgtgaccagttcgacgaaaatttgataaactcaccgaaaataactccgggtcgtgaaacattcagaccccaaaattatttggagaaagccgcgttgaaccggggatggttggactcatcgaggtgggccttcgctttaatcaaattatgtgccaattattaaacaggtcgctgatggaacaaggcatttgcgaaggcgatgttgtgcttcttcgttttaaattcatgcagtttttcgacatgaatctgagatatgaccccgtccgtatcaatcaattgtatgaacaggccaaatggtccgtccttttggaggaggtcgaacacacggaggaggagtcatcattatttgcagcgctgcaggcaggcacttgactaatacatttgaattatattattgcttcagttgcaagccgcgcttcagcgaaactctccggaccgcgaatctccggaacgtgacgaggtcgatgtactgcttgatgagttggtagggaccagaattttttctcaatgattaaatttttcttgaatttgaatcaaataatagtttttataaaattttcctgattataggaacagactttggacaccactgcctcactaagtcgccgtgatttaacatacgtgcctgagttgacagaatatctcaaatatttgaagtttttttccaataatgtttttgtatatttgtttttactttagacctaaaaaattgggttttaacaacttcaagagagcttactttacatttcgagacctttacttgagttattacaacacagctcaagatgcaaatggttataaatgtatttttaaaaaattaaattcattgtttaagggcctccacttggtcactattatctcaaaggtttatcattcggtgtccgcatatttcttgacttcaaacaattctaaaggttgcgaggtcagccaggatttgagcgtctcgcaaggaaagttcaacataaaattgcaagtgccgagcagtgaagggatgtcggaactgatattgaagtgtgacacggagcaacagtttgccaaatggatggttagttaccaaaatgagtattgacaaatttcccgctttctaaggccgcttgtcgtttggcatctcgtggaaagacaatggccgattcttcgtacaattcggaggttgaatccattaagaaagtgctgcagatgcaagcaggaagtgagcatttggttgcgaaaattttttggtggtaaaaatttgtggcgtctaaaaccattaggcggatttacaatttctattttacagtgctcaaaaatgtaatcttcttatttttgcctgattacctgataaactaattaaataagccctaacaaataagacacgcttaaaggggcagcggcagcgcaaaacggtgcacaaaacaagaagaaatcgcaaccggtgcagctgcccacggatttcaattcggaagagttcgtttgtcagcgatattggaagagatcggggaacaaaagcgtaagtcaaacagaggaccggggtaggggaggaaagaaagtgttaaaaagttttattcaaaagatgcaacagcgcatttcggatgcccattcaaacgtgaaaacattgagttgcaccgaagcgaagcttcagtacattcgcaattgggaggctctgcccgagcacggccttcactatttcatcgtcaaattcaggcattttcttttccattatacaatttgcgttttttttcaaatttaagtggtactatttatacttcaaaaatgccaattaaatgtactcatattacaaaacttattacccaaaactttatttacaaatggtttttgcaaaagtatgtaaaaaatatcccctaaactctaaaagtatcctgcttatgcctttttgattttacagaaatgggaagaaagctgaactcattgcggtggctcacaataggatgatgaaagtgaacagcgacaacggagaatcatcaaagacatggagattctctgggatgaaaaaatggcacgtgaactgggagataaggcacttaaagatacaattcgacaacgaggatgtcgaattcaaacctttgtcagcggactgcaaggttataccgaattgtaaaaaagaaagctaataaagatcaaacaggttgttcatgagttcataggcggctacatttttctctcaatgcggagtaaagaccaaaaccaaacactggacgaggaagggttccatcgcctgactggaggatgggga

SEQ ID NO: 47266 - DNA, 509 bp, Heterodera glycines
  Genomic contig location: Contig_ID=SeqID_15068; Location=2345..2853; Strand=+
  SCN-specific regions: Sequence locations=1-75,97-153,175-416,438 -486,508-509
  Gene Ontology: Cellular component=cytoplasm; Biological process =ribosomal large subunit biogenesis
atggtcgcactccgtgcacaatttgaggcgagcaatgatgtcggagttttctgtaaactcaccaatgcttattgtctggtgggcattgcttcttccgaaaatttttacaggtgtttgctaagaatagaacagccgtttttggcgatatattctttgaaaattgctgtttttaaaccgaaatgggcgtgtaaatccagaattattgcaacaaaatcggtgatgggatttggttacccattttattccggtggattgaaaatgaaaatttccttgtttttttagtattgtggaggctgagttggccgacgtcatcccggtcatccattgcacagttgcgggctgtcggattgttggccgtgtgacggccggtaatcggcacggactgttggtgccgaacgcgaccacggaccaggaattgcagcacatccgcaacagcttgcctgactcggtccaaattcggagggttgacgaacggttgtcagcgctgggcaatgtaattgcatggtctg

SEQ ID NO: 47267 - DNA, 1698 bp, Heterodera glycines
  Genomic contig location: Contig_ID=SeqID_2347; Location=581..2278; Strand=-
  SCN-specific regions: Sequence locations=1-112,139-258,284-669,692 -1250,1272-1464,1489-1698
  Gene Ontology: Mol. function=pyruvate dehydrogenase (lipoamide) activity; Cellular component=pyruvate dehydrogenase complex; Biological process=coenzymes and prosthetic group metabolism
gcaatggacgaggaattggagcgggacgagcgcgtgtttctgcttggtgaagaggtggcaatgtacgacggcgcatacaaagtcggcacagacaatttgcactaatttttgccaaatttttcattttcaattttgaaaacaatggcatgaaatggttgtttttctaaatttatgttgtttttttagatcagcaaaggcttgtggaagaagtacggcgatgagcgcattgtggacacaccaatcactgaaatgggtgcgtccaaatttgattttttaaaacaaatttttcgactcgtactgggaccgtaccgattgggtatttttcaaaaataccccatcgacctgggataactggccacaaaaaattgaaaaaacaacgaaaattaccgatcgggccctaaatttgggcgggtgcctgtcgggtcggagctgttccttccgggcaaaaattgtccgagcattcactaccaatttatcgggacttattcaactgtgaacggtccaatgtttttggcaaaatatttgcattatttccgacttgcccaagacataagcaaaaatgaattatacgtttttatctgagtgaaattgcaatgtttgttttgcattgaattttgatgggtttaggctttgccggccttgctgttggcgctgcgtttgccggcctgcggcccatctgcgagttcatgacgttcaacttcgccatgcaggcaattgatcagctggtgaacagcgcgggcaaaacctattacatgtcggcgggaagggtcagtgaaagctacgaattttacattatcatggttctctattcatggacattatttagacctgatttttgggggaaaaaaattcgaaaaatcaccaattaatagggtttcttccccctgtggttttaggaatttttccaattattggtttttgacgcttaaaagtttaacaaaaaatttttgcaggtgaccgtcccaattgttttccgtggccccaatggtttcgctgccggcgtcgctgcacaacgttggcttttttgtttgggataacgcgtccattttctcgttcagacagtcaggactatgcggcatggtacgcccatgtgccgggactgaaagtggtcgcgccgtacagcgccgaggatgccaagggtaagtaaccatggagaggagggcattggccatgggatgaaccaaaaagggggcaccagagggttgtttcatccaaattttgttgctatgaaaattccaaaatggcccgatatttgtttgccctaccgaaaggaattgtaacgacaaaaaagggatgacattttggtctcggtaaaatgccaaaatattttatcgccatatttttgccagaaaataaccggacgaggattttggatgcatcaaatatgtaataatttatttgtctctgtttaggtttgctaaaggctgccgttcgtgacgaaaatcctggtaacaaaaatttgcgactttttcccccaaattttcactccgtttagtgattttcctcgagaatgaactgttgtacggcgtgccgttccccgtctcggacgaggtactcaatgccgattttgtgctgcccattggccagtccaaaattgaacgggtcggcgctcacgtgacgctggtctcctactccaaggcggtccaaaactgtttggaggccgctgatcagctcaaagcggagggcgtggaggccgag

SEQ ID NO: 47268 - DNA, 1475 bp, Heterodera glycines
  Genomic contig location: Contig_ID=SeqID_15079; Location=135..1609; Strand=-
  SCN-specific regions: Sequence locations=1-159,181-278,300-1220,1242 -1475
  Gene Ontology: Mol. function=protein binding; Cellular component =chromatin; Biological process=DNA replication
agattatcgtgaacagcctgaattggatgcgctgtctcagtcgggaattgatgacacatctgacatcactgaactctcaatcgatgctcgccgccgcgcagagttggacatggcaagacgcgaccaaatgaccgttgatgacgcggtttgatgcattcgaaaattaatataaaatggaaattttatcagatttattgggaggatggcgatgatgaggcaattcacttaatgcgacggaggaagcaacgcggtttatcctctgccgacgaacattcattagctggagagccggcagaagaggacattcgcattgatatcattgagaacccgcgcgggagaccaactcgagagcacataaaagacgaagttatagcgaaggagattgagaagaggcattttgacaaatttaagctacaaaaaatgtttgcttttttagattctgcaaatttttgcgcgttttcaaagatacggtgaacaaacaaaacttttacatacagtcaatcaaacacatggtggctgagaatcgcgaatcacttgaagtggattacaatgacctggcacacgaatcgggagaaccggacattacttatttcttacccgaggccccaacagaagtttgatttaacgtatgacataatattttgagaattaaaggtactcgaatgtttgaatcgcgcagccacgactgtggtagtgtcaatctttccgtggtatcatcgcatcactacggaggtgaaagtcaggatcaaaaaccttccgatggaggaagacattcgcatgttgcgtcaagtgcatttgaacatgctcataaagacagccggtgtggtgaccattaccaccggaattcttccacaacttgggatcgtcaaatacgactgcaagtcctgctcttatgttctcggcccgtttgttcagcgtcaggacgaagagacaaagccgagcacttgtccctcttgtcaaagtcgaggcccattcgaattgaacacagaagagacaatttaccacaattatcaacgcgtgagcatccaagaaagtccgaatttggttgcggccgggcgactcccccgttcaaaggaagtgattctgctgggcgacttgtgcgactcgtgtaaacctggcgatgaaattgtgattttggtcatcgctttatctctcatctgcttctgtttaggaattgactggtgtttattccaatggttatgatggttccttaaattcgcgccagggttttcccgttttcaacacagtgatcatagccaatcacataacgagaaaggatcggatcgagtcggattcactgactgacgaggacatcaaagcaatccacgaattggcaaaacatccgcaaatagctcaacaaatattctgcagtgtcgcgcccaacatttatggccatgcagaagtgaagcaggcaattgctttagctttgttcggcggagaagcaaaaaatccccaaggaaagcacaacatcagag

SEQ ID NO: 47269 - DNA, 3043 bp, Heterodera glycines
  Genomic contig location: Contig_ID=SeqID_15085; Location=1..3043; Strand=-
  SCN-specific regions: Sequence locations=1-194,216-575,597-716,750 -941,968-1258,1280-1296,1318-1321,1343-1443,1466-2095,2117-2301,2324 -2398,2420-2654,2676-2932,2954-2983,3005-3043
  Gene Ontology: Mol. function=RNA binding; Cellular component=DNA -directed RNA polymerase II, holoenzyme; Biological process=signal transduction
ccgccacagctcatgctgatagcaccgaatatttgaaatgaaatgaaagctgagtcgtccgccggtgtgagtaacggaacttcagtttgtacccaacacaccgcagatgatggcagaagttactattacaataaggcaacaaaagtgtcttcctggaccaagccggacgatttaaagaccaaggaagaggtcatttgatgggaggaaattcataaggatactttggattgtttagaaagagctttctgtatggaaggagtacaaaacaccggaaggaaagccttattattacaacacccaaacaaaggtcacaacatggtcaaagcccgaagcgctgaacaaagttaagtccattctcttttttttttgctctggagcacaaaacctattctaagggttcttatcatgaaatcatcaatttgatcagagtatggttaataagttcaaacaaattcctttgtgcgaatgttctaataagcacaacaacttttagcttagagatccaaacatctactccattatggaatgctttatctgaccaagaattaatcaattgttgatttgttcgatctttagtgcttttttgcaaaaataaacctttataaaatcatattcttaatgattgtcatagatgtaatcccagaacattcaatttaagtgtcgttaaaatttagctcggttatagtcattttattcctttcagaacgatattatcttttttcagaaacaaaaacaaagaaagaagaaagcgatgcagcgaacgaatcaaagcccgatttggttcatctttcatcgaattccgaaattgaaaaggcaatggaagcgactttaaagaccttagttgtgaagaagagcgacgaacccatcgaagcgaaagaaattacacaaaaaaaggaggaggaggacgattctgaatacaatctgaagaaaagacaagtggaaaaattcagggaaatgctgcaggacaaggcaaagccatagcaatggaaggggacaaacattcatttaacaagcatttaagtgcaacgagaagcgaatcaacacgaatatgaattgggaacaggcgtcaaaatacattcagaatgatccgcgctacaaaatactggccaaagtaagcgagaagaagcaagtgttcaacgcatggaagacacagcggtacaaagaagagagggtaattaatggccaatggattaatactttaattggccattcccaaaggacgagcgaagatttgctatcaaaatggcaaaggaaggcttggaaaaatggtaaataaaggagtgcttttggcggttgttttgatttgtgcaattatttaggctgatggctcatcagagaatgaaacccactctgagataccataaagccgaggggattttcgccatggaattgcaatggaaagctgtcactgaaccagagaggagagaaatctttgaagacgtgaaaatcgcattggcaaaaaaggacacagagcaaaaaaaggcgttgaaagagagaaacataaaagtgacgaagggggggggggggtaaaacatatttaaaggaaaggcattcgggggacaggcactgagcgacattctggacggaattgacaaaatcgactacagaacgacgtgggccgaagcacagcgaattctgatcgaaaatccaagctttgctaaggacacgacgctacagggtaaaaagagtgaagaaattgacacttacaattagtcaacgtctccttttaagggatggacaaggaagatgctctggttgtatttcaaaagcacatcaaactttctgaggagcaatacgtaaaggaaaagcaactcgaagctaagcgaattaagcggcaggaaaggaagacgagagaagcattcatccaactgctgcacggattgcacgacagagcattggtatacggataacttattgtgattatgtgtaagagcgcaagtcattttatgcgaaaaacggctattaaaattcctgtaaaacatactcccgaattcggatttccaaaaaagaaaaacaccccctaaaaatcgaattttgggttcaacccccccccccgaagccaagggtctggctacgcccttgattgtaggccgataaaggcatttaaatgaaaaaatgagacggagtgatactttttcaccataaaaacttattttgttactaaaaggtgactcccgccagtagctgggctcaactctacccaatgatatctgcggatcagcgattcgaaaatatggtacttttttctttaagtttaaatgtaaatgaaacgattggggagggaataatgaaaaatcgccgaagaaatgttttaaaatataattttgtatttaagcttcttacgaatggttcaacagcactggaccttttcaaattttatgttgatgagttgaggacgaaataccacgaggacagaaaaacgatcaaggagttcctcgaatttaagaaaattacaattgacgagtcaacgacttttgatgcattccgacaatgggttaaagaggggccgaattccgatcagttggaccctgtgaatgtgaagctctgttttaatggtagattttggttaaatctttttttatttacataaacaatcgaaatttgaagatttgtgtgacagaattctgatgaagaaaaaggaggctgaacgtgacgaattaaaaaaggttttatttgaggaaatattcaccaccgggccaataaatttcagcaaaaaagggcggaattggccttttgggatttgctgcggtcgctttctccggcggtagggccaaattccgattgggagcagataaaggaacaactgaaagaaagcggacaactcgagacgacggcggaggaagagcaattgaaacggccattcttcgattcatttgtcaaatcactgcaggacatttgtggacactatcacagtgcagtgagtagcagcagcaaaaagaggaaaaaggagaagcggaaaaagtacgaacaggtaaggaaatgggggacgggaagacggaaaagcaaagaaattcaggaaaatgcatccgactcggaagagacg

SEQ ID NO: 47270 - DNA, 301 bp, Heterodera glycines
  Genomic contig location: Contig_ID=SeqID_15098; Location=825..1125; Strand=-
  SCN-specific regions: Sequence locations=1-301
  Gene Ontology: Mol. function=iron-sulfur electron transfer carrier; Cellular component=mitochondrion; Biological process=synaptic transmission
agcccacgaataggcacttatgtgatcaataaacaaactccgaacaaacaaatttggctttcatcgccagtttctggtccaaaaaggtatcactcactattcattaaacgctaatcccataaaatttatttgaggtacgacctcagcgacaaaggccggtgggtgtataagcatgatggagttacgctacacgaattgctcgagaaagaatttagacacattttcaaaaacgatcaaatttcgttacatcagagttaaagatttatcgttttttataccgatataaattttatttggtgaa

SEQ ID NO: 47271 - DNA, 1336 bp, Heterodera glycines
  Genomic contig location: Contig_ID=SeqID_15113; Location=291..1626; Strand=-
  SCN-specific regions: Sequence locations=1-239,270-402,430-536,638 -644,667-691,772-878,921-958,1010-1336
  Gene Ontology: Biological process=regulation of protein activity, epigenetic
atgaataacaaatcacaagtatttatacattttagtggtacaattgatgaatcaaactcaatgaaaaaagagcgaaaatgggtgactatttcggagcttggccagagagatttagaagaagaacttgaaaaagtcagggaaatatcccttgatttagaaggagaagtcagtaaagtcagggaagagattaaaacgatgctaaagcatattatgaaaccgctgatggaatttcacaaaagtaattaattaactcattaattaattaattatgatgaaagcttcatttaacaattaaattgagaaattgtgatgattaattagactctttaaaccaataaaactaatttttgtttttagttgggattcatttgaattttaagccgaagaatttaattgtatttgaaaaaacagaagaagaagaagaattgccaaagctggaagaaaaaaaagcagaaaacgaaaaatcaaagcaaaacatatttccattgtttaaaatgtttaacagaaaaaacgaagccgagaaaaaagccaaggaggaaaaagagaggaaagaaagagagagggaagagaaagagaggaaagaaagagagagggaagagaaagagaggaaagaaagagagagggaagagaaagagagggccaagacaattaaatgggaggaaaaagttatcaaattgaccgattttgatggtaatttattaattatttaattttatttttatattcaacagttttgttaatcaaatgttattatttttaaattcttttttaagcgtctgttctttatttgaaagaagaaaaaaagggaataattgtaaacaaaaaattttcgagttacaataacggatttaccgcgcccgaactgcttgaagtcagagattaataaatattataaaaagtttaaatttattttatttttagctattatatgacaaagagggcgatgttgaggtgaatcaaattttaaaatttaaatcattctattaattaaatcattttattaaataaaggtcactccaaaaatggacatttggtcagctgggcttaccattttacaattgaccctcaaaaaacgtttggctataaagaaaaggtggatgagaaaattggcgaattgtttcgaagcgcaaaattgaaatttgaaggaggcgaatttaagcctgatcgtacaaaattaacacgattagcactgccaatagacaattatgaatgtatggaaaacttaaaatatgatgaatattggccatcgggaaattggtggtacaattatttgacagtgatccatgatattcttacgttatgggacaaaatgccagagattgtcttcctatcagtg

SEQ ID NO: 47272 - DNA, 3231 bp, Heterodera glycines; identical to SEQ ID NO: 15133
  Genomic contig location: Contig_ID=SeqID_15133; Location=1..3231; Strand=+
  SCN-specific regions: Sequence locations=1-1,189-572,596-1237,1259 -1705,1727-2989,3011-3024,3046-3231
  Gene Ontology: Mol. function=ATP binding; Cellular component =extracellular space; Biological process=growth

SEQ ID NO: 47273 - DNA, 518 bp, Heterodera glycines
  Genomic contig location: Contig_ID=SeqID_15173; Location=2443..2960; Strand=+
  SCN-specific regions: Sequence locations=1-148,170-353,377-518
  Gene Ontology: Mol. function=transcription factor activity; Cellular component=nucleus; Biological process=G2/M transition of mitotic cell cycle
atgcgacgggcggtgcgtcgtctgcgattcgtacgtgcgcccgtgcactctcgtccgcatttgcgacgagtgcaactacggaagctatcaggttatgcgcattgaactattgtatttaagcaacaatttaccgacttaccctcacattttttgtattagcattttaaaatgatagaaataggcaatttttggacgaaaaatataaaacttattgttaatccagaaatgtgggcatggattactgtggtcccaatttttagggtcgctgcgtaatttgcggtgggccaggcacaagcgacgcgtactattgcaaagagtgcaccattatggagaaggacagggacgggtgtccgaagattgtgaacctgggcagtgcgaagacggaccttttctacgaacggaagaaatacgcgttcaaaaagacgtgatcatagccgggggttggactgtcagggtttttgtctgttttttccgaccgttcgacctccgtttaatttaccatcgtttctttttataaa

SEQ ID NO: 47274 - DNA, 2570 bp, Heterodera glycines
  Genomic contig location: Contig_ID=SeqID_2370; Location=13..2582; Strand=+
  SCN-specific regions: Sequence locations=1-873,895-973,995-1177,1201 -2051,2073-2433,2456-2505,2527-2547
  Gene Ontology: Mol. function=aminopeptidase activity; Cellular component=cytosol; Biological process=proteolysis and peptidolysis
gggaagtcgaaaacaggcgccaaccttcgcatttacagtgtgccgggcaagaaagaacagggaaattacgcattggaactggtcaccaaatcaattgacttttactctgaatggttcgacttcaaaatgccgttgccaaagtgtgatgtcctcgctatgcctgactttgcaatgggtgaacagcagaaacgaattgcaaaataaaccgaattttaggtgctatggaaaattggggacttatcactgcccgcgagaactgctctctttatgacccaacaaaaagcccttcgacacacaaacagcttctgactttgttattgtcgcacgaagtctcacacttttggttcggaaatctcgtcacaatggtgtttttacatttttatttataaatagcaaaaacatttagaaatggtggtccgatctttggctcaaggagggttttgcttcattcacgcaatatttgttcaccgacaaaaactaccctgaatttaaaatttggtccgatttcgtcgacgcggaagtggtcagagcgatggctttggactctctgcgcagtacgcatccaatcgaggcaatttctgaatattgatatgatattgtaaacacaatattttttaggttcctattgataacccaaatgaacttgaagaaatttacgattcgatcacttacgcaaaatcaaattcaatcattcggatgctcttcaatcatttgggcgaagcgactttccaaaaggccattcgcgattacttgaaaaagcaccaatacgcaaatgcagagaccaacgacctgtggaagagtttgtccgacgcttctgggattgtgagtttaaacaataaattcaatgtcgaagcaaagaatttccgcacattaaatatatttgcaactttatttcaaagaaacaaaaacactaggaaaggaaaatggttttacattttggtttaggatgtcaaagcactgatgtcttcctggacccaacagatgggcttccctttggttactgtcgaggaaaaaattttggatggagaccgtattgaattgcacttaaaacaatctcgctttttggccgatggaggtcatgacgaagcgaaccccgtttggcaagtgccgttcggagtcaccaccgcggcggacctgactcatccaaaggccaaatttttactgatgaaagccgaagacaaattcatcgtggatggagtcaaatcaaatgaatgggtcaaggtgaataatcagatggaagagacaaagattacaaatacaaaccaatttttatgttgaaattactcattacaataattttaggtcaactccaacttctcttcgttttttcgcgtccaatactcaccgaacatgctgcagtctttgctggatggtgtgaaaaaccgcgaactcggagtgttggaccgttaccaactcgccagtgacctctacgccgtgagttgtggcctgttttggatttaacccatgagtatattttgtttggttccttgattcttcatttttagcttgtaaaatcttctcgcgtatccgtttcacactttctcgcgttgctcactgtttgccaggaggaggaggattactttgtgtggtctgcaattgactcgggcattggcagcatcgctcattcactgaaacatttggacgacgaacgcaagctgttggaccgtttcgagcgttttgtgtgcaaaatgattgaacccgtcgctgccaaattgggctgggaacccaaagagggagaaagtctgaattatttctttgaaactcattttgtttttttcataactttctttcctttttagctatacacgttggacgtcttcgtgccctgctcctcagccgtttgtcacattttcgccatcaaccgactattcaaatggcactttccaaattcaatgccctcatcgagaaaggcgtcgatgttgtcccggacttgcgaaagctcattttccgtgccgtaggctctacaaatgatgaaaaaatcattgctgcattgaaaaatttgatggagacatcgggctacgcacaagtggagttgtcatgtgtattaggtatgagatattaggcaaatgtgaggtggtcccttatgacaaaccttttaaggacttggccagtgttcggacttgaaaatgctcgaggacattttcaattatggtgttattcaaggcaaaatccgcgaccaggacctttatcttttgttcgcggcaacggaaatggcaccgatggcgtgctgtggacatttcgcatgggactttttcaaaaacaatttcgcacttttgatcgagaagtacggcagcgtcaacagcaacgtgttcttgcattgttttaactgcgtgacttcgggtttctgttcgaatgccatggccgaagacattatggtgggttaattcacaatcagtggcaaaagcggagattttagacccatttaaatttaggagttttttaaaaaagaattggacgaacattctctgaaaacattggagcggcctcttcgtcaagccgtcgaatccattaaagtcaaagagagtttgctgaagaataacgtgcccgatttggacaaatatttgcagaac

SEQ ID NO: 47275 - DNA, 935 bp, Heterodera glycines
  Genomic contig location: Contig_ID=SeqID_15189; Location=1..935; Strand=-
  SCN-specific regions: Sequence locations=1-493,515-517,539-558,581-935
cctaaaaaacaataaaatttcggaataccaatttggttttgttagaaataggtctacgacaagtcaactaataacagttgtggaagattggtacgaggcaattataaatggaaaaaatgttgactgtatttatattgattttcaaaaagcatttgactcagtgccccataatttacttttatacaaattggaaaaaattggtataaagggcaaacttttaatgtggataaagggctttttgagtaataggacttttcgagttaaaattggggattctttatcctcaagtaaaaaagttacctctggcgtcccccagggctctgtcctgggccctttattatttttgatttatattaacgatcttcctgatgctttgccatcaggagtgaaaataaaattatatgctgatgatgttaaattgtatatttgttataaagcaagaaccgaaacagaaattatgcataaagcattgcataatttattcgaatgggcaaataaatggcaaataaaagtttcaatgcaaaaaacttttatattatatttgggttcaaaaaacccaaaagaaacatataaatttgatggaaatacaataaatgctgtggatacaattagggatttaggagtaaacattgataacaaattacaattttccgatcatgttaatcatataacaaggaatgcatatttacgtatgcgttccttgttccgaataattaaatccaaatcatctaagatttggattacgttatataaaacttatattaggcctttattggaatacgctccggaggtttggaatccgtctcttcaaaaaaatattaaaaaaatcgaaaagtgtcaaaaatatttcaccaaaagagtattttttaaatgtagccttccgccaattccataccaaaatcgattagaatacctacaactgccaacactgagaa

SEQ ID NO: 47276 - DNA, 2852 bp, Heterodera glycines; identical to SEQ ID NO: 15192
  Genomic contig location: Contig_ID=SeqID_15192; Location=1..2852; Strand=+
  SCN-specific regions: Sequence locations=1-6,30-313,336-711,734 -908,930-953,983-1174,1198-1232,1268-1348,1371-2408,2431-2484,2521 -2562,2585-2655,2677-2852
  Gene Ontology: Mol. function=phosphatidylinositol 3-kinase activity; Cellular component=plasma membrane; Biological process =phosphatidylinositol biosynthesis

SEQ ID NO: 47277 - DNA, 1730 bp, Heterodera glycines
  Genomic contig location: Contig_ID=SeqID_15208; Location=700..2429; Strand=+
  SCN-specific regions: Sequence locations=1-506,528-811,833-909,936 -1501,1527-1730
  Gene Ontology: Mol. function=protein binding; Cellular component =ubiquitin ligase complex; Biological process=signal transduction
atgggaggacccgaggactcaagggtcagagtgattagcgcaattatatttatgattacatggattactgtctttaggttaacggatgctccgctgccggaaggctgggaaatgcgtatcacagagcaaggtgtgccattctttatcgaccacaacaacaagacgaccacctacaaccacccgcggactggtcggcctgttggtgtgttctttttgttcctacccaaagtgattgttcaatttcagggcctcttggtggtcccggcttacacatggctgccgacaaaacattcaaaaacaaagttgctcagttccgttatttgtgctattcaaacagcgtgcctaaccatgtgaaaatttctgtgacaagaaacaatttgttcgaggattccttccaagaaataatgagaaaaaaccccttcgacttgcgtcgtcgtttgtacattcagtttaaggcggaagatggactggattacggtggaattgctaggtattttgggttattatttgtttttattaattgactaaataataataataactttcagggaatggtttttcttgctctctcacgaagtacttaatccgatgtattgtctgtttatgtatgccaattcgagcaactacagtctgcagattaatcccgcttcttttgtaaatcctgaccacttgaaatattttgagttcatcggtcgcttcattgctatggtgtgttgttgtgacccaatttactatcgtaactaactattagttttacaggcacttttccatggaaaatttatctacagtggtttcacgctcccattctacaagaaaatgcttaacagaaagatcactctcaaagacttggaatcggtcgacactgaattttacaattccattgtttggagtaagttaacagaaaacgtcataattataaattattaaaaataaaagttcgcgacaatgacattgatgaatgcgacatggaattgtactttgtggttgattatgacctacttggtgaggtcaaaacgcatgagctgaaggagaatgggactgaaattgctgtaactgaggccaacaagaacgaatatattgaactgctggtggaatggcgtttcaaccgcggaattgagcaacaaacagtggcatttttcaacgggttcacttcggttttccccctccaatggcttcaggtatgaacttttgtatttagcccttaatttatattgttttttagtatttcgatgaacgtgagttggaactgctgttgtgcggaatgcaggagattgatgtcgatgattggcagcgacacactgcctatcgccattacgctgttcaaagcaaacaagtgatttggttttggcaattcgttcgctctttggaccaggaaaagcgttcaaaactgctccaatttgttactgggtaacttacaattagtttttaaatttactgactgaatcgttatttcacttttcagtacatgtcgggtcccggtcggtggtttttcggaacttatcggttcaaatggtcctcagctgttttgcattgaacgcgttggcaaagaaaattggttgcctcgttctcatacttgtttcaaccggtaaacaaccgatgcttatcaattagcttcttattgtcttcatactgatttaatttaggcttgatttaccgccctatcggtcgtacgaacagttagccgagaagttgacagcagcaatagaaatgacagaaggctttggcaacga

SEQ ID NO: 47278 - DNA, 1013 bp, Heterodera glycines
  misc_feature (970)..(970): n is a, c, g, or t
  Genomic contig location: Contig_ID=SeqID_15208; Location=2894..3906; Strand=+
  SCN-specific regions: Sequence locations=1-250,290-1013
  Gene Ontology: Mol. function=TATA-binding protein binding; Cellular component=nascent polypeptide-associated complex; Biological process= nuclear positioning
atggtaactgcggaagataccgttaaaacaaaggaagaagaccccaaaaaaacgacaacggacgacggatcgagttcagaggaagaagtgcccgagctcgaagagggcgacgttactgaagagcagaaaaaagttgctgaggcggccggactcagtgagcaggtggctgattgattggtggtgtcatgacaactcgtacaaatgcttacaatttgactaggcactttcgaaacacaaattggacaaaaagttcaaacaaattaacattttttgtcttaaaattttttaatgtaggagttgccattaacctgattggtttgggcagggagcccatcgaggcattgatgtgctaaatcaaataaatcggaacattttaaaggttgccgaaaagggctccaaacaatcgcgttctgaaaagaaggctcgtaaactattcagcaaacttggtatgcctttcaaagttgttcattttcttttgtttataaggcctcaagcaagtgcacggcgtttcgcgcgtatgcatccgtaaatcgaagagcattttgttcgtcatcaacaagccggacgtgtacaaaagtccgggctccgacacatacgtcgtttttggcgaggcaaaaattgaagtgaggcatttgccatcgttcgtttttcagcttggtatttttatttggaggatttggcacaacacgctcaaatcactgacgtggagaatttgaaaccgccctcaatcattcgcgatgttcgcaaccgaatcacaccggcggaggaggaaagcgatggcgaagaggtcgaaagagtactaaaaaaattgataggaacatggagcctggacattgcgacaatcttattctctctcacatctaaatactaactaaaattgtgcttttcaggctgatgctactggaattgaagaaaaggatattgagttggtgatgtcgcaagcaaatgtttctcgaaacaaagctatcanagcattgaaaaaggctgacaatgatttggtgaacgctattatg

SEQ ID NO: 47279 - DNA, 1241 bp, Heterodera glycines
  Genomic contig location: Contig_ID=SeqID_15224; Location=137..1377; Strand=+
  SCN-specific regions: Sequence locations=1-505,527-611,633-1241
atgaacgtcaaaaaaagcttcctcgcttcaactggtcactatgcgacacgcacacacgacagcgtcgctgatgagggctttaaagctcggtgtaaaatttttgagggtgggaagcgagcccaatttctttcacgtctggactttgacctgggaaaccaagaactttatttgttgaacaatttggatcttttatttacaatttacaaagctcgtgacactttcatcatgcagacattgaaagcagacgatactaccagataccgtgttagagtccatgacgtaaaactgtatgctaaaatgattgatgttcagtcatctttgaatttaagtatctacaaaacgcttgaaaaacaaccagccacatatgcagtgcgaaaaactgaaatcaaatcatgctttataagtgaaggtaggtttgaaattgactacaatgtattcagtgcaacaattcctcgacgtatgacaatcgcacttgtcgcaaacggggcatttaacggaaattatgctctctctccatttaattttaaaccgtttgacattcgagacattgcagtgtatgctggaggcatgatttacccaattgttccatacaagcttgactttgccaaagatatttttgtccgtccttttgttgacatgtatgaggcacttggcatggctaattcagagcgttctttcgacatcacaaaagagcaattcaaatctggttggaccttttttgtaattccactcacatcgacgctcgacgatagcacagggtatgaactcttaagaagcgggacaactagcattcgcgcaacatttaatagtgcaattcctgagggcggagttgaaatgatagtgctgggtgaatttgaccaaatgataatgatagactacaaccgtcacattgtttccgattcaaagcttagttaattaactgtataaataagatgcataatgcgaaaaatgccaccataaaaatggccttcttaaacactacagtcaacgccagtttaaagccagagatacaagtactaacatttgaaaacaaaagcgttcatcctaacctcctcgtgcaacttctattgcttgcccattatctcattgcttttcccgttttcattttatgctggtattctttgataaattttcttaagagaagaggacatatttctcagcgtgatgccaatgagatgatggatgatttgcgaaattaccaattaccaaaaaattcatcaattatttttccaagtttatca

SEQ ID NO: 47280 - DNA, 2449 bp, Heterodera glycines
  Genomic contig location: Contig_ID=SeqID_15244; Location=1..2449; Strand=-
  SCN-specific regions: Sequence locations=1-15,38-55,77-749,771 -1533,1557-1733,1856-2049,2071-2449
  Gene Ontology: Mol. function=ATPase activity; Cellular component =cytoplasm; Biological process=synaptic vesicle priming
catttttactgcatttttgttaagaacttctgaaaattgtatttaaaaatggcagaaatgtgccattttcttgcttccggtatgaataaaaatttgcttttttaatgaaaatttaagaaaatatggaatcgttttgctgcgtttgtaaagcaatttatggaggaagtcacagctgttccgtctgcaaattgccgtgccacaccttctgtggcgattctggcggagttgaaaacgaaggcttcggcggaaaggtcgtgtgcaacaactgcgcaaacgaggaaggcaatgcaccgatagcagaaggctcagaaaccaatttgctggaaaattggtgatcaattttgctggctcggtgtggatgaatgatgacacaactgaggactatttgcacaaaatcatcggcgcaaagctgttcgttggcgaacgcctcttggtttgggatgcgtttggcagccacaagagcgagagaacaacgaaggtcgtgaaggaattgggagtgcaaacggtttttatccctggcggctgcaccaaattcatccaggtgctaagtcatctttctcaatgaaattctttgtcttccctaggctcccgatgtctcgtggaacaagccgttcaaggagcgaattcgacacttctacaacatttggatgtccaacggggcggaaaaggtgttcacatcggcgggcaaccctaaggcacctgcacttcaagtgctacttgattggatctaccgatcatggcaggaaatctccaaagaagttattatcaaatcatttgagggtcagttaaaaatggatacaggaaaaaggcttaaatatttaagtttgtgggctgacaacgccattggacggaacaggagaagaaaaaattgcttgcttcaagccggtaggagcaattggaccgattgggaccaaatttttgcgcgagtttagggcaaatgaaacggcgaaagatggacggaaacgatcacgaagaagccggcttatctgatgatgatgatgtagggatggatggagtcggagatgacgacgaattgttcatttattagccccttttactgttgaattgttttttattttttttgaaaaatgtgccaaaaaattttatgaaaaattctatttatcccccctggcacataaatggagactgggagattatttttcaacctagttcgaaaggggtatataattggagacggcagattaatggagactggcatataaaaagagcaaatacggtagaccacattgaaggtttgtcggcgaatctgaggcgaacatgcgcaaattgttcgccgacgccgaggaggaatggcgccgatgcgggcccaactcgtggctgcacataatcatttttgacgaaattgacgccaactgcaaacaaagaggatccatggtaaaaacagtcacaccatttcgacagtaaagccattttatccgcttaaactaggattttgtgcaaatttcttagggcggctcttctactggcgtccatgatacggtggtgaaccaactgctgaccaaaatggacggggtggagcagctgaacaacatccttgtcattggcatgacaaaccgcaaggatattatcgacgaggcgttgctgagaccgggacggatggaagtgcaactggaaatatcactgccggataagcagggccgcatccaaatcctgaacattcacacggcaccgatgaggtgtgaaaaaaaaagaaaaataagagactgatttgtgagagagagaaagagtgagagatggagggagagagaaagggaggaatgactgagagagagggagagagaaagagagtgagagagagagagagtgagagaagagagagtgagagagagagagaagaaattccaacctcctttcccaccaagagaacacaacaaattggacagcgacgtaaacattgagcagatcgcaaaaaggaccaagaatttttcgggtgccgagttggaagggttagtccgtgccgcccaatcgtccgcaatgaaccgattggtcaaaccgggaggcaaagttcagcaggtaaaggacacaaatggacgaaagaaggaaaagccgaagggccaattcaggtggacgacgaagcaattgacgctgaatcggctgctgtacggcggtctttgcctgtggggcgactgcgtctcgcgagtgttggaggggggacgccttctgatcaaagagaccgctgcgcccgacacgcgcgggttcgtccgagctttgctagcgggtaaaaggcagtcaatcatcatcaccagcagatttattaatccgcttaatttaaacaattgaggtcctccaaacactggcaaatcctttttggctgcgcaaattgccaaggattcggagtttccgttcatcaaagtttgcactcccgaagagatggttgggtacagtgaagcggaaaaatgtgccaaaattcggaaggtttaaatttgag

SEQ ID NO: 47281 - DNA, 1652 bp, Heterodera glycines
  misc_feature (581)..(581): n is a, c, g, or t
  Genomic contig location: Contig_ID=SeqID_15280; Location=323..1974; Strand=-
  SCN-specific regions: Sequence locations=1-2,39-39,71-86,112-185,213 -331,361-437,465-466,539-686,715-1652
gtaactcttcgcgatggtcgcacccaaacattggataacgtgtttatacgaggctcacagatccgtttttcggtccttccggatacgcttaagaacgctccgatgtttaaagtaagtaaattagtgaccgggtatttggctatttattgttagtgtgtacaaagattgtcttttttgattattcgatttaaaatttatttttttatatttatggtctgctctaactaacaaattttttcaaaaattccacgaacttatttattcataaaaaggaaaatgtgactgatgtatatttatgatcatttattagtttctgcgtctcgaatattccccgaatattaaaattaatatttcattatcccctctctcattcttcgcctgtagaacatcggtcgtgcgcaacgtggtgcccaaggcatgggacagggcggtgcgcctcgcggacgcggcagtgcttttcgtgggtggtggtcggggcggcggacgaggccgtggcggatttggacgcggtggtagggaagggcggtggtggcggcggaatgcaattccaaggctgaaagcggacaaatccattgaatcgntgggagtgtttgtgctgtccgtttcgatcatttttatttgttttgcacacactttttgttgtttggtctcactgcgattgaatttttttataattaagtgctgacattttttaatatattttctttattttgatccgtcaggcagaaaacttttttatttttttaaaaactttaattccaattttttctaattgcttctgcacgaaatgagtaaggtcagtttctacaaaatggatgcgcttctttttattttgccctttttacaggtcgctaaattacagcaacggctgagtgcggctttaacttctaagcagttttatgaagcgcatcaaattttgcggacggtccacgcgcgactcagcgcggaacggaggtttaccgaactgctcgagcaaatccagtccaccgttctaatattgtgtgaaggtaagtcctcaaaaaagtaaaggatggcttattagcaattgtaccattctttgttaagcaaaagaatacacaagcgcaattgacttggccgagctttacgcggagacactcaaacaaagtgaggccacactgaacacagaaaatctccaaattttgctgacggtttgcgcttcaaattgacaaaattcctcaaacaaaaaaatccttcagatgttttccaatttgccttcaacatttaactctgatagtccatcgtcggaccgtcgcattccatttttgaacaaaacgctcgactgggccctcaaatcggcgaagggaaagcccgaaatgttgagggcatgcgcacttctgcagaggaaatttggcgatgttttcttcagcgaaggacaggaagaacaagcggaacgtaaatacgaccaattggcatttttaagtcaatttcactttttaggttatgctcgctctgctgaatatttgcttgacgaagtaattcttatgctaatcgggcaattattaattgttgtttaggccgaccgaatcgaagggattccaattggtggagaagggagcagtggcgaaaaccgcgaaacggacaatgccgacgacgcggcgcagaaaatcgactccgaactcgaattggactaa

SEQ ID NO: 47282 - DNA, 717 bp, Heterodera glycines
  Genomic contig location: Contig_ID=SeqID_15283; Location=1148..1864; Strand=+
  SCN-specific regions: Sequence locations=1-4,27-322,345-517,545 -588,613-717
  Gene Ontology: Cellular component=AP-2 adaptor complex; Biological process=intracellular protein transport
atgatcggaggtctttttgtttataaccacaagggtgaggtgcttatttcaagaatttatcgcgacgacgtgaatcggaatgccgttgacgcctttagagtttcagttatacatgcaaggcaacaggtaatttcatacttcaaaatattttttggttttgctttcagattcgttcaccagtgacaaatattgcaaggacttccttttttcacatcaaaaggggaaacgtttggatgtgcgctgttagcagacgaaacattaatgcatcgatggtcttcgaatttctcaatcgttttgcagacacaatgcaatcttattttggaaaactgaatgaggaaaatgtgaaaaacaatttcgtcctcatctacgaaattcttgatggtaaatttaaaaatatttaatctgttcaatgtagttttttttgcttttagagatccttgattttggttacccccagaataccgacccaggagtattgaaaacatttataacacaacaaggcgtccgaacagcggtaagaaaattatttaaattttatctcttactttgttattacagagtaaagaagaacaggcacaaatcacttctcaagtaacaggacaaattggttggcgccgagaaggcataaaatacagacgcaatgaactctttttggatgtcattgaatatgttaacctcctcatgtcgcagcagggtcctatcaattaattcgctaaa

SEQ ID NO: 47283 - DNA, 1358 bp, Heterodera glycines
  Genomic contig location: Contig_ID=SeqID_15296; Location=1..1358; Strand=-
  SCN-specific regions: Sequence locations=1-154,176-565,587-590,612 -804,826-1035,1057-1251,1273-1358
tactcgccgcggtggacatcggtcgctttctgtccgacgtggtgctcatttcgtacgacaaatttctggtgtttggacaattttactttactcattttataatagggttgcattggccatatcgaagaagaaaggacggcaaaagcacagagacgaagacggaggaggaaacgacggcggagtggacaaaatgcaaaaagaaaaaggcaaaacggagccgaagggtcagtttttcagtgtttaatgagggtaatttgtgtggcttttatgagcaattagtgccacttccctcagggaaacgtcgtttgcccctttccgtagatgccgccattctgttgcttttctgtatgctcggcggcgtcgtttacattgcagcggcgggcagtgaccacaatttcatcgaaggcttcttcgtcactttcaatttggtggccaatcttacgatgagcggtgaatgaatgatctcgcaaaataaaatgatttacctttttggcactttaccattttaagaaatgccaaccgatatttctcggcttatgacactgatctacatttttgtgttcgttacttttggtaatacatttttacgtttcagtaaaataatttaatttaattctttcatttttttaggcctcgccgttttgtcaatgtgtgccgaccttgcggccagcgaactcaaatggtgcaaaattattttcgttctggatggctttttcaataaaaatttgttttttttcgtgaagggtgttcctgaaaattcattactttggctgcaaaatcaattgggccaagcgacggtccctcaaaaagcaacaacagcaacaaattgaggtcaaagctggcaaagaacaatgctttcggtgtaaatggcagcaacttctgttttgatatccgaaaaatgggggcaattatcagtcaaaatgccagatgggcgaatagggaaaaggacctcggtgatgggggggggggcggggggaattcgagaatttttcggaccaggccgttttcgtacgagcacaagtttttggctgcaacttttttctttgccaaccaaatcaaacattgttggtatcattcgatagccctaggtgtcctcttagcatgtaaaatttcaaaaaatttctttaagattcgaaaaaagttaaagccagcagaatgtcaaaaaaccatgttttcaaacaatattgacaataacttttttgaaccttaacgaaatttttacaagatttgggatttgtttgtggggaagggatagagaaaaacaaatcaacagcttaacatgtttagaagcttttttcaagctattgcttagcgattagacaattagccaaaaagttctattatgaaaatcgcaaaaa

SEQ ID NO: 47284 - DNA, 2428 bp, Heterodera glycines
  misc_feature (2382)..(2382): n is a, c, g, or t
  misc_feature (2389)..(2389): n is a, c, g, or t
  misc_feature (2395)..(2395): n is a, c, g, or t
  misc_feature (2399)..(2399): n is a, c, g, or t
  misc_feature (2402)..(2402): n is a, c, g, or t
  misc_feature (2405)..(2405): n is a, c, g, or t
  misc_feature (2410)..(2410): n is a, c, g, or t
  misc_feature (2417)..(2417): n is a, c, g, or t
  Genomic contig location: Contig_ID=SeqID_15299; Location=81..2508; Strand=-
  SCN-specific regions: Sequence locations=1-711,767-951,975-1226,1263 -1353,1376-1471,1493-2428
  Gene Ontology: Cellular component=cytosol; Biological process=sulfur amino acid metabolism
atgcgtcgtttgtcacagctgtttttgcggtgccattggacgccctcggagattgcggcgagttgtcgtcatgccagcagtgccgccaccgcccgtcccttgtacatggacgtgcaggcgaccacaccgatggtgaggcggacgggggaggagtcaatgtgacaactattaataacttttcgggactgtggtcctgccgaaatttaaaaaatggccagcatctctatctacgccttcggttttattttttcgacagtttttcctgtaatccgaggggatgccgttcaagcgccctattaaaaacaaacgtttttgtataattgcttgaaccaaaaattgttttgtctctttctttgaaaggggttcgatggcaaacgtaggaaaattgcttcattttttgcttccttgatttaaaaaaaatcggaccctgggtgaggaaggcgatttgatggaattggtcactaattttttggacaatttgtcctcgaggtttaaaaactatataaatgattggccgtcgtgttgttgttgacaagcaatttctggctatctatcaccgaattatgccctgattttttcgccaggacccacgggtggtggacgccatgttgccctatcagttgaacgactttggcaacccgcacagtcggacagtgagtgaatttttattatttgagagcagttcgtcgctctccccgaatttttctttccattatttttcaaaaaaaaaattcatttttgaaaaaattttcaaaatttaaaaaatcggttcggggagacgtattgcacgctttttattatgccgtacaacatatcagcctttaattgtaccaccccccccccccccattagcatgcctacggttgggagacggaaaaggcggtggaacacgcgcgacaacaggtggccgaactgatcggggcggacccgcgcgaaattgtgttcacttcgggcgccaccgagtccaacaacattgcggtgaagggcgtggcacgcttctacaaagtggccaacaaaaaccatgtgatcaccgcacagacggtcagtggggggagggaagggggaggacaataaatcggagcaggtcatccgccagaaaaaaatttttagatttccagacccttgaaatttttcgataaattttgaaatttttctaagaaattctctggcgatttttgaaaatttttataatcaattactaacaaactgttttaccaagaaatcgctaaaaagcatttttgaaattttcttaaaaactttctaagatttttttttttgaaaaatttctaacataagtggtttaaaaaaactcaggggccgtgaaaatgaagtacacaccaagaaatacgcatttgttgaatattttattcattttattaataagtttgaataagttaatgcaagtcggcaccgctggactctaaaatttcttgatatatttttttaattcgatccaaaaaatgcgcagaattggtcatttttgggcaaaaaatccgttcaaaatcctatttgttcgtgcactgcgcctaataatattagaaaatgaggtttttgccaattgatagaaaaaatgagtgaaaaaatggcaaaaaatttgccgattgatcacttggtattttgcaggagcacaagtgcgtgttggactcgtgccgtttccttgagcacgagggcgacttccacgttacgtacattccggtgcagaacaacggactgatcagtttggaggtgctcgagcaggccattcgccccgaaacatcgctcgtctccatcatggcggtgaacaacgaaattggcgtgcggcaaccgctcaaggaaattggtaaagctttttaatttgaaaatttttcagcgttttttagaattttatgcacgaattactgttttttccaaaaaaaagtttaaacattttctccgcttccccttccctactttttaattcgaaaatgccctatagttttatagatctttaaaatgctttcttctgataaaaaaagcttaaaaggatgtttattttatttttttatgggaaaagcaattttcagttggtctatgttaaatttgattcatttttattgaaaatttttttacaacttttggggaaatgttgaacaaaaacaaaaataggtacttaactccgacagtatacaaatgcttcgtattgtctgaattgggccacacttaaagaggagctgaaaaacgctggtcatccctggactcgaattcaggggatacagtcaaaaattggtcccatttttaaaaatttttttagcgttcctaatttaaaaaagcattggtcttttaatgcctttttcttccaaacccaggcgaattgtgccgcaaaaagaatgtgcatttccacacggacgcggcccaagcagttgncaaagtnccattnaatnttnacnaactnaagattnatcttataaag

SEQ ID NO: 47285 - DNA, 1862 bp, Heterodera glycines
  Genomic contig location: Contig_ID=SeqID_15309; Location=1..1862; Strand=-
  SCN-specific regions: Sequence locations=1-330,352-484,507-743,766 -808,830-1037,1063-1083,1105-1177,1199-1266,1319-1472,1495-1713,1735 -1862
  Gene Ontology: Mol. function=glycogen phosphorylase activity; Biological process=glycogen metabolism
caactgatccgcgacggatggcaggtgaaaatgcggcttctgggggacaaggctctagtgcagttcacacgaccataacctcgactaaaataatatgacaactttaaagcaccataactttttctagaagcaccgaaagtaaacatttttttgtatcattcgatagccccaagagtcctctattagtctacgaaggtttaaaaaatttcactcaaaattcaaaagtttatgttcaaaaaaatttttttttatgttgctcataaattttttgaaacatgcgaaattctttgaaattgcaggctaatacagatcttaaggggctatcaaatgactaagatttttaattttgatgcttctaaaaaaagttatgttgcattaaagctgtattattatagagccgagaaacattccaaaaaagcaaactttgtattatttgcatttatttttacgcctcttaaaattctctactcgaagatgcaaaatcctttcaatcagatcgaagagccggacgattggctccgtttcggcaatccgtgggaaaaggcgcggcccgagtatatgcttccggtgaacctttacggccgcgtggaaaaggacgtcaatgggaaggtgtttggagggtcaccgggaaacgcgggacattaaaaaaaacattcagagccattggagggacacccatttgatttttgcgatgccttacgacacgccggtgcccgggttccgcaacaacgtggtgaacacactgcgcctgtggtcggccaaggcggagaaccatttccccctgaaattttgtgagcccaaattggaaatttaataattttggaacatttaaatctctaaaatatacaattttatagttctcaaattttatcccatttgccccccccccctctctctattaaagtgctcttttgtttatgcctttttgtccgtttagtcaatgacggcgattacatccaagcggtgatggaccgcaacctttcggagaatatcactcgcgttttgtaccccaatgacaacgttttcgtcggcaaagaattgcgtctgaagcaggaatactttttggtggccgcaactctccaggatatcatccgccgtttcaaatccagcaattacggaagccgggacccagttcgggtcgactttgacaccttcccggacaaagtaagcaaatgcatggaggaagaggaaaaggggaggcaatagggaatttcatattggacggacagacgcccaaaagtgtgttttatcatggcctgtatcttgttttttttaaatttgttttaaaaagcaaactaataataattttttaataattggcagtaaaacatgggtattcgaaatgacaaactctaaaatattatcaaggaaatccagtttttcgtgactagcctggacatggacttttttcttatttgacatggacatgagtttcccctggacaaaaaaaaggtccagaataatccagacctggatccagttcaactctaattacaactttttcctgatcatttaccattctttccctgctctcaggtggccatccaattgaacgacactcatccgtctatcggaatccccgaactgctccgtctgctcgtcgatgtcgaaggactgagtttcgacaaggcatgggaaatttgcgtgcgcactttcgcctacactaatcacacacttttgcccggtgggcaaatttagccaaatcatttggcttttttgcctttgttctccctctgaaaaatgtccgttctttcagaagcattggagcgatggcccgtcgcaatgctcgaacaccttttgccgcgtcatttggaaataatttatctgatcaatcagcgatttattggacgtagtgctgtttg

SEQ ID NO: 47286 - DNA, 529 bp, Heterodera glycines
  Genomic contig location: Contig_ID=SeqID_2408; Location=71..599; Strand=-
  SCN-specific regions: Sequence locations=1-529
  Gene Ontology: Mol. function=RNA polymerase II transcription factor activity; Cellular component=transcription factor TFIID complex
atgccaatggatgaaggggacgatgccgtcgttgaacagccccaacagcttggtgccggggcgccggaccaatccaccggtgcggagacggtgcagcaacaatcatccgcttccgtgcaatatgcgcgtccgttggtcgcacgtccggtgaccgaacagcaaatccaagcactgcgaaacggtccgagttggcccgatcatacagttttcctctttttggtttggtcacttaaaattacccctttttcggcaaaacggaaaattgtgcctgaattgtgttcataaaggcctataaaaacgccctaaatttgcagggagtgatgtgcgtccgggcagttcgttggccgacttctacagggacttggagaattatcggccgaccatcccggactcggtggcactgtattacatgcgcaagaatggcattgcaaatccggacgtgcgcgtggtacgcctgttttcgctggctgctcaaaaattcatttccgacatctgtttggacgcaatgcaacaggcaagacacaaataa

SEQ ID NO: 47287 - DNA, 1789 bp, Heterodera glycines
  Genomic contig location: Contig_ID=SeqID_15329; Location=109..1897; Strand=+
  SCN-specific regions: Sequence locations=1-109,132-186,208-218,244 -314,357-432,464-759,784-1041,1063-1290,1312-1595,1617-1789
  Gene Ontology: Mol. function=14-alpha-glucan branching enzyme activity; Biological process=embryogenesis and morphogenesis
gaattttacaccccaacggaaaaatacgcgctgaaaacggcccacaagcgtccgcgtcggcccaaatcgttgcgcatttacgagacgcatgtgggcatttccagccaggagcccaaagtgaacacttaccgcgattttgccgacacagtgctgccccggatcaagggacaaggttcgggaaagcggaaaaattttaaaaatcaaaattttttgagtccaaattttattattttttaaatttttccaaacaaaattttttttattgttagtaatttctgacgggtagggttggatgattgaaatgtggcattttgttttttaaattgaaattattaaaaaaatttatttctaaaaatccgttatggcgatagacattctgaatttcgattttaaaattaacagtttgatggtatttgacagtgttgccacacgaaaatttctttaaaaaataataataaattttgaatttggttgaagtacatcaccttttttttcacttacacattttaaaatgtcccaacttttcagggtacaacgccattcaagtaagtgggccggccattttcatccaattttaagggtttttgatcaattttcattttatccaccattttagctgatggcaattatggaacatgcttattacgcctcatttggttaccaggtcaccagcttttttgccgcttcaaggttttgcaattaggaaataaatatatacaaaattgggatttacgaaaaaaagaaataaaatgtttgtcgaatttaaatgattcactaaaaatggcacattgacgactttatgacaaaaatacaaaagcttggaccaaaaggaaatttcgagtttactttttttgcttgacatctgattaggaattcgaatttttttttttttgcaaaaaaactcataaattaggttttatagactttaaagtctaactagcaaattttggcggtttttcatacaaaaaataaaacaaaaagttgaaataaatgagccctaaagctcgtccctttttgtaatttattcctcttttttaatataaattgccattttttccacagtcgttttggcccgcccgacgacctcaaatatttggtggaccgtgcccatcagttgggcatcactgtgctgctcgatgttgtccattcgcatgcgtccaaaaacgttgcggatggactgaaccaatgggacggcacaaatgccgggtcagttttttttttttgtacaaattcaagcccttggggtctcgtaaatttgtaaaaaaaaatttttttcaaatcctttcgttttcattttcagaccattttcccgatttcctttccacgccatcgtttcaccaaaccaaattttgagtgtctaaaattaccaatttttttcaaaaatttagtcgagccttgtaaaaattaagcattttttctttgcattttgtctatatttttgccaaatcttctatttttctccacttttcagctacttccatgacaatgtgcgcggctatcacacccaatgggactcgcgattgttcaactacaacgagtaaattatttgttattccttgtaaaattttttttctttattccgtgtaaaaaatttacatttaatcctttaagaaccgaaactttgcgctttttgctctccaatttgtgctggtggattgatgagtacggctttgatggtttgtctgcccattttttcgtttttttaaattttttttttgaaggtttccgcttcgacggcgtctcatcaatgctctaccattcccacctgatcagtatgttgtctaaatga

SEQ ID NO: 47288 - DNA, 469 bp, Heterodera glycines
  Genomic contig location: Contig_ID=SeqID_15345; Location=1085..1553; Strand=-
  SCN-specific regions: Sequence locations=1-66,90-469
  Gene Ontology: Mol. function=snoRNA binding; Cellular component=small nuclear ribonucleoprotein complex; Biological process=35S primary transcript processing
atgcaatatgtgctgtccgtcttgtggtcttccgacaacaaatttgtgttgtccggcagtgatgacatgaacattcgcctgtggaaggcaaacgcagccgaaaaacttggcccggttagtcattttgatggcttcaaccagaatagataataaaaagagcattttttttagctctgtccacgcgagaaagcggcgatcgaatacagccagaaattgcgcgacactttccaaggccatccggaagtgcggcgtatcgtcaaacatcggcatgtgccgaaagctatttacaggttgtttttttcgatttaaaaaaaattcaattgttatgccaaattcacagtgccacgcgggagcacagaatcatacgtgaatcacagagaagaaaggacaaaaacaggcggaaaaacacgaaaagtgccgcaacagaaccatttacgtcggagagggcgaaagccattgtcagcgaagg

SEQ ID NO: 47289 - DNA, 2261 bp, Heterodera glycines
  Genomic contig location: Contig_ID=SeqID_15346; Location=165..2425; Strand=-
  SCN-specific regions: Sequence locations=1-151,176-1453,1476 -1586,1609-1625,1647-1674,1699-1731,1753-1849,1873-2261
  Gene Ontology: Mol. function=snoRNA binding; Cellular component=small nuclear ribonucleoprotein complex; Biological process=35S primary transcript processing
atgaaagtcaaagtgatctccagacatccggatgaataccaacgcgagacaaaacatgacatattcaagggttagcagctttatgaagatatttttggtgatttttcgcatccaaaattagtgcctcggaattacgccgccccgcccgacccatttcagcagcaggtggagtacacgcgagcactgaacgcggcaaagttggagcgcatgttcgcgaagccatttctggctgcctttgatgggcacaatgaggcggtcagttggtgttggcatttcattttttattggcatttcggtatccccatttacctacatttcttcgtatattttcaaattgtttaatccatacgttcgcaggtcaatttgttggtcaaacatcccacccgtctgtccaccgttctgtccggtgcgcgtgatggccaagtccgagtgtggcatttggccactcgccgctgtttgcacgtcctccaggcacattccggccccatcaacggtctctctgttgatgcatctgacggtttgcactttgtcacggttggccaagacgcgcagctcaaagtgtggccgttgccaattgaatttgatggaaatgctcagccaacgcagcccgtccattcggtcggtggccaatgaattggccttttcttttgtgtaacgttctgtccctttccttggccattcgcagttgtcccttgacggggtccctcacggctgttcccacgtggcgatgtccagcgatttcgtcacctgtggtgagggcatttcggtgtggcggttgcacaggtgcggtgtccagacgtggtgtcctcccaatcggtgtcatccttttcagatcttcgcccattcgccattacgctgttgggcccaacactgtgcagcatattaactgcaaccccatagaggaaggcattatggccggatgtgccgcagatcgctccatttttctgttcgacacacgccagaaagtgccgctgagccgcgtagtgctcaaactgaggacgaacaggtgcaaaaatgccgtttaataaaccaaatgattttaagcattgcctggcatccgcttgagccgttcacttttgttgctgcaaatgaagactacaagtcagtctgacgaacctatcattccgttgtttattgggtatatttttgactttccccgctttttgtcagtttgtacaccttcgacatgcgcaggttggactccgctcgccacgtccaccaagggcacacctccgctgtgatggacgtcgactttgcgccatctggtcacgaatttgtcagtgggagttttgacagatccttgcgcattttccctgttgaacaatggcgaagtcggtgagaaacatttcccccatggacgtcccaggattatcagttaagggggggggcaccattcatgggcgatgagactttctgctttcacacctctttttgcggcggggcgcaaaaatattttttgcaaaaatttaaaaagtgcaagcaacaatgagaaaatgtaaaaaaaaaatacaactcgttaggctttgagcctattaattggcactaaaaaaaaattttttgtttttgtaaataggcaaaaattattatatgtgggtcctttttatttatcgatgataaaattgggcgaagccgcaaatgtctggacaccaaagtttacattgtctagccccttaaaactttttaatattttatttttgcgtcgatgtttgtggatgcatctcccctatttcctgtttataaatttccctcctaatttgtaagggaagtgtaccacaccccgcggatgcaatatgtgctgtccgtcttgtggtcttccgacaacaaatttgtgttgtccggcagtgatgacatgaacattcgcctgtggaaggcaaacgcagccgaaaaacttggcccggttagtcattttgatggcttcaacccgaatagataataaaaagagcatttttttagctctgtccacgcgagaaagcggcgatcgaatacagccagaaattgcgcgaaactttccaaggccatccggaagtgcggcgtatcgtcaaacatcggcatgtgccgaaagctatttacaggttgtttttttcgatttaaaaaaaaattcctaattgttatgccaaattcacagtgccacgcgggagcacagaatcatacgtgaatcacagagaagaaaggacaaaaacaggcggaaaaacacgaaaagtgccgcaacagaaccatttacgtcggagagggcgaaagccattgtcagcgaagggttggaa

SEQ ID NO: 47290 - DNA, 2008 bp, Heterodera glycines
  Genomic contig location: Contig_ID=SeqID_2416; Location=436..2443; Strand=-
  SCN-specific regions: Sequence locations=1-93,118-292,316-344,395 -839,874-2008
  Gene Ontology: Mol. function=chaperone activity; Cellular component =mitochondrial matrix; Biological process=mitochondrial translocation
ctttcatgggaagaaatttttctttcatatcttcttgacgacgaatgatgctgatgatgttggtaatggtggcgatgggaatgcgtcgtcgtctgctgctgttgcgcgtggtggtgccgacctttgctggacgacgaatacctccgtccagcacttttcgatgactttttggccctaaaactaataatttgtctctgtttctggcccattcagtgttgcgctttggctgacttttcttcgctgcccggtgaaccttcgtcgtatgtgtcggtagatgcacttgactcggaactggatgaagatgaggaagaagagcttcgctgccgtttcctctcccttctttttgtcctttcgcttgaccctttcaaatccatatttgctaaaatgaataaatgattaatatttttagcggataaagaattattttgaggatttagaacaaaaaaaatatttcaataattaatggccacaataggaaaacattgtaatttttcattcatccccggactcatcatgacgaatttagatacaaaagatccctagttcttgcctcttcctacctaatttaagtataaaaaactttccactcaaataggtatgcgttaaaaaaaaatttactgtgcgaattctgctttttccagataaagaataggagtatgccaaaatgagagtgtatttttctctgctctctctaattattatgcgttatgccaatttgaggtttcgttagattagagataataaatttggtagatcagcaaaattaaacgagagttgatttgactcaaattgtctttccctagggaagcttatgctataaatatccaaattccagaaaattttctctttgcttctctctcctctgtttttcatttccttaaaagcggcaatgaccagtcgaattttgagctgcaatttgcgaaggtacttctccaagatgaaccaacacatcgagttcggcacaacgaagagcgcttcgtccgacaaacaatcgccgccttcccctacaaacaatcagtgggtttagaatagataggagtggggagggtgaaaaaaaaagggaaagaaagggacggacgaccaatcacatggacaaaaatgcgtgatttgataagcctaccgggtcgaacaatacaaataattttggttttacaggtaagcgcaaagtggacgataaaaaatagtggaatatttctgtttctagaaggggcagggctcatctttctccgttcctattccttctcatccgacagaacgcaacacgagggaatgagtcaggaatgtcgggagcaaatcgagcagatggaaaagctgaagagcgacaacgaaatgctgaccgacaaatacaaaagaacacttgcggacatggaaaacttgcggaagagaacgcagcggcaaattgaggaggcaaaactttttgcaattcagccattttgcaaggatttgctggaggttagtgaaattcatactcagttaagaaaatatattcaacacatttgttttataaagcccgaaacgacgattgagtcctctttgatttttaaaattccaggtggctgatgtgcttgacttggcgttgaattcgttggaaaaaatgaaaacggaggacggtgccgcctccttggacagtggagtgaacaaagggatcaaaatgacgaaggaagtgttgctgaagacgttcaaaaagcatgggcttgtaccggttcaacccgaaggacagaagttcgacccgaatttgcacgaagcggtgtatgaaataccgaaggaccaggcaagaattgcaacaaaagggcatatttgcaatttataatcagcaaaattcccaaaaggtcctattatatgtgcctaggagtatttggcattctgtcattttaatggtatgaagtcaatgaatatgttcaatttgcagtcagataggcctgccggtcacattgcgcatgtgttgaacattgggtacagtttgcacgaccgtccgattcgaccagccaaagtgggcgttgtgaagatg

SEQ ID NO: 47291 - DNA, 1338 bp, Heterodera glycines
  Genomic contig location: Contig_ID=SeqID_15357; Location=247..1584; Strand=+
  SCN-specific regions: Sequence locations=1-75,113-484,507-884,908 -993,1015-1338
gtttttgctgctttgctccaattgtcggtggcatttgctgcgtaaaattgcctatgatacactgagtaacatcgcaagaaatgtttgtttgtttgttccccgctaataaaaatgcatttctatcagataaaattggtcgacaaattgtccaccgttttgctgaacaccgtccaaaagggtctccactcggacgacaaatgcaaagtgatgcgatccatggaaattgtggctggtttatgcgcaacgccaaccaacgagtcaattgtttgtgaattcttcgaagaatcggttccacgcttttaactgtgtttttagagtaattattaatttatagcaaatcataccgcggattttcgctcttttgtcactgaaggatattttgatgtgtatgtgtgccatggagtccgtgttggccatttccgagttgggacgggtcgcgtgcgaagccgtcgcccgctgtgaccgcgtcgttgaaagtcagtggcaaattaatgctttttcattttataataattagtttttaatcatttctgctgtcttttagtgctcgtcggctttttgaccaccgatgccctttcttttggcaccgtcggtttggcggggatgcacgtggttgaggtgcacggacaccaaaccaggccttatgttgcggttagtttccgtcttgaaaatcacaattaaatgatttaaaacttcgcaaaatgaatcaatttttagccaaacaaaaagaatcctcccccgccgcttaaacttcaacccgtacaaccgcccgttcaatatgcgcaacaacggcaccaaacgccggcgagcagtacaacaacaacggcaccaccatttggtgaagcgatggaatttgcaataaatgctcgcacagatactcttgaaacatgcccaggtaattgatattaattaattatccctccgaatgctttcgtctccttcagatgcctttcatcgtcgtgcaaccgatggcaatgactctgctcaatttgcctctcatcagcgtcatccaccgactcgcaaaaaagtttatctgaaatcttcgcgcctgccttttctcaaccaccgacaacaattggccaccgatgctccgcctttacaaaatggcctttcgtcaattgctgccgcggttccgtcgtccattgaatctgtggcgaatgaacgcgactttatgtgcgaatggctgatgcagtcggagggggacgacgattggtcggacgaggagggcacagcagcggggccaattgagccgtgcgcgaggtgtgccgggaattgcatttgtagttcttatacaaaaattccagactttcccggcggccgaaccccattgatttttga

SEQ ID NO: 47292 - DNA, 1445 bp, Heterodera glycines
  Genomic contig location: Contig_ID=SeqID_15368; Location=854..2298; Strand=+
  SCN-specific regions: Sequence locations=1-48,70-570,597-1122,1154 -1445
atggagaatcacctggacgagcaggtgatggtgcgaaactgttgcctctgtttgtgtcaggtattttgctgcctcgatttcatttcttatattccttaaaataccctcccgttcagttcgacatccctcaagacattatgttcggttatggacatgtcgccaaccttctcgtcaaagtgctcgaaactcacagttcggatccactcacccaaaggattgtcgtatttttactgaattcaatggcttgtcatgtggaaggcgtgcaaaagatcgaagtgggcgagttcggagcaattgaggtgcgaatcccccccccccccccgcctcctgatttagcgttttgcagataattctacaacaaattgcacgcaaacttcagtccaaccaatgcgacgatgttatggacacggcttggagttttctttggaatattacaggtcaacttttagtgtactatacaaattttggtagcagctcgtttccgcaccgtatcagctcccccccccctggcttaaagctttttcgaaaatttattttctttgaatttccttgtaagaagactttgtaagattttttcttgaaaattttttaagttagtaaaaaaaattctattttctctggggtggggaaacgatgcggggtaggaacctagtgcaccccacaaattttcacaaattttgttaaaagcttcagtttagatgagacccccgcaaattgctcccgatttctgaaagccgaggggctcactctgttctacagatgttatgtcaaatttcccagtcaaatggaattggtacggaatatgatgggacttatcggaaacattgcggaagtgttcgatttgcgtgatcagttgatgattgacgactatttgaatatattttggtaattgactatctgtgcctaatgaaaaactcactgaaccccttttcagcacactgcttgacaatttgagtgacggaatcgaaatttcgtataatagcgccggcgttttggcacatttggttagtgatggcgatgagagatggaagacaacgaaggtgaaaaactcgcgacgccacgtcagcgatttgattgtgcgggtgcgtgttggccggcagcgaaccattcattaatttatagtttagtattttttctttaattcttttgatttaaggctaccgagctgtgggatttgaatgctcgtcgcttcatcaactaccgctcctttaaaccaattctcggtcttttgtcccaatggctcgcgattggctctcaacaatgggccatttgggcattggcaaatttgactaccactgaccgtgccaaatattgccgttttgtggtggaggagggtggcgtagaattggtggaacaattggtcaacagttcgaactctacaaatgcaatccgaaatttggcacagactgtgctcaacaacatcgaagaatggtgagtttggatca

SEQ ID NO: 47293 - DNA, 1911 bp, Heterodera glycines
  Genomic contig location: Contig_ID=SeqID_2419; Location=4986..6896; Strand=+
  SCN-specific regions: Sequence locations=1-598,620-665,688-914,936 -1256,1278-1378,1414-1640,1662-1911
  Gene Ontology: Cellular component=mitochondrial inner membrane; Biological process=ubiquinone biosynthesis
atgcgatcactgcagaaatcaccatattattgcggacaatttgggctggttcagcgatttggacggcaaaaagaacatcgaagagattttggcatcgaaaggagaggcgatcaaaaaggggacggcggtgttggagatggaagtgccagcggaggaggagggggacaacgccaaatacagcaaataaaaaagggtgatgatttaatgaaatttgtgaccgaatagactcaaatttgcgtcgaccttgccctcatctccccattctttagacttctcccaacaaatgttcgaccacatcggtgccatcgatgactccccgtcggcgtcctcttcgttgctgattgccatcagcgagttgcagcgggcactgctcggcattggctcggctgtcatgtcactggtggacccaaaacggggcgacatggtcgccacaatgggcgaaacgacggtcagctcaaaaagagaggggcgagggggtcaattcgaatttgtcctttactgaatttgttgaggtgggagctgttcttgtcatttggcgtaagaatgcattttacggaatgtttagatttttgaagaattcatttttttgcttttacctaaaattgttcccaaactttctttttgtacattttcctatttcgtggaaatcccattctatttccgtgttttttcacttttcaggttccccattccttgctgaaacatctccgcgatcggctgagtcgtgacgtgagcggcgctgagcttttgcggaatcggccgcgcatcagtggcgaaaccatcgaccggcgatggttggcgacgcttcccgacggaacgatgggcagggaatatttaaggtaattttcaaaaaatcaatccaatgaaataggaaattgagcccaaaatcaatctcccccaccctcattattttattttcaaaagcagaaattcaattgtttgttatttacaaatagggcatcctttattcgccttttataccacacttccgtttttcggtttctcgattcgctcaacacttccccggacgcgcgaccgcccgttcaatttgttgcggatgaccccgaattggtatacgtaatgcaaaggtcccttttttgcgtttttattccaattttccattttctcgcttattgtcagatatcgcgaaacccacgactttacgcatgttctgttgcaaatgcgcccaaatatgctgggagaggtaaaaaatggcccattttcggtcgataatattagataaatgcacaaaagcaaaagtagcattgtttttaaaagccaattaaatggctttgtctttgcatgggaattgcgaatgcacgcgtttttcaacgttttagcgaataattataaaaacttttttgggaatcttggatggctttatttctttttaatttttgatgctccctgactaattataggatcctggaaaagtcttgtatacagaaccatatcctttccgggctcactgaatgctatcaattttttattttaaacgtaaaaattcttcaaattaccaggtgaccgtcaagtacttcgaggccgttcagcttggctttcccatgtgtgttgctgccgcgattttcggcgcacttcgacttggcccagtgtaaatgaccaattactccctctccccttctcatccttttgaaaaatggcaaataccaatattatggggtgtccatttgacttcaaattccttcactacttctccaaatttccattaaaataatcatttttagccatcgtcgtcagctgatcgaacggaacattccatgggttgtgcaacaggcggagaggggccgttttttgttggcgttggactgggaacgccgttttgagcagaaaatagccgatttgcagagggaatgctccatcgaaccattttcagcagaatgttcaaatgaatga

SEQ ID NO: 47294 - DNA, 1493 bp, Heterodera glycines
  Genomic contig location: Contig_ID=SeqID_15375; Location=121..1613; Strand=-
  SCN-specific regions: Sequence locations=1-119,169-263,328-351,374 -457,547-967,1055-1106,1211-1340,1381-1460,1486-1493
atggacaccgatgatcctattctgaaacatatttcaccaaattcacgtgcatatgttgttataattgcaggaattattctgcaattcacttacggactcgtgtacacattcggtaattcatttaaattatataatttgaaattaaataaatttttaaattgatttatagggaatttgctcccatatttggcatcatatttacgctggaaagtcgatcctgagttaaatgatggcacattaatatggtttcaaagtttgctcggtaaaattttacaaaaaatttgatttaaatattatatcggaaaataattttatttaaaaattttacttaccggtaattttgccttcaagttttttggtcttaatatggtttgaattgacaggcattaatttctaagaatgtacaaaatttgagaaatccaaatgcaatcggaaataaaattataagcgccgctagaaaatttcataaaattttctttaatatttatgacaaattttattaaaaaacttttataaacttaaaattaaataaatgttaaatatttagctggatttcctttcgcttttcttgtcggtggttatcttgagaaagtgattggcgcacgatggggagcagcatttggctcatttctgtacactttgggagtggcactttcttacttggccatacaaaaatcatatttttcattggtaattaattcctaatttatatttctaatagctaatgctttatcattcattcagttcattacactgggattttttgctgcttttggccatggcgttgcatacaattgtgtgttgacacaatgccagaaagtggatttcattttgaatttattttttcatttttatacgttcaacttaaattaagtcattatttttgtaataatgttttggttacataacaattttttgtaataaattgaggcacttaattctaatttttaaatgtataattaaggtgttatttaataatatcaaaattttttatttattcaaaatgtaaaaatttgaaaaaatggaatattattgaaatatcttttttaatattggctgcataattagatgaatagttattaattttttgagtaataagaccgtacataatttaatttaatttaaattttgtgcaatttatttaataaaaaattaatgaaaaaaataattttataaaacattaatttgatttattcattttgttttttaagtggctacctcatcgtgttggcctcgtcagcggccttattactgctggttttggcagtggtgccttcataatgtcaccaattcagaccaaatacattaaccctgacaacctaaacattgattctacagggttatttaaattaaaatgaaattttaaataaatttatttttgcagttattttacacaaccagaattgctggagagagtgccaaaaatgttccttttgttggccaccatctttggcacattgcaatttgttgcattattttttattgcagatcca

SEQ ID NO: 47295 - DNA, 2152 bp, Heterodera glycines
  Genomic contig location: Contig_ID=SeqID_2430; Location=345..2496; Strand=+
  SCN-specific regions: Sequence locations=1-246,268-459,481-732,755 -1683,1726-2152
  Gene Ontology: Mol. function=calcium channel activity; Cellular component=integral to plasma membrane; Biological process =gametogenesis
atgcccgcggatttgttggaccaacgactgcagttcaaacgacaccatgtggtcaacgggttcatccacacgtcagcctatgctcaacggtctgttcatgaaagtgcgtttattgttagtcagtccttttctaaaatttgttagaggattaaaatgttcgaattttgggttaggggttcggaaattcgtaaaaatagagttaaaattcatgatcagcggccccgaaaacccatggaaacacgtttttatcattaaaaacagaaaaaattttttgcgccgcccgcacccgcgcagctgctcgatgcgccgcccgcgcagccgctcgaagcgccgcccgcgcagccgctcgaagcgccgcctgccaactacgagctcattctacagcaaatgacaatgctgagcgacaccctgcaaaacatgaacgacaattttggaggtaaagaatgtcgtccctaacttcttttttattttgggttaaaatcagtttcctagcgtttttgagagtgatggccacgaatatgaaatcgaatttgccaaattccaaatccctgacccgaattcgaacaaaaaataggtgttaaatgaattcgaagcttttacccaagaaaatgcatctttgaaaaagaatttcactttttcgaattcaggtccggggttcggattgggcaagtccaagttcagattcgtaagcagcaagcaccctcgaaacccctaaaaattatttttgatcccaaaattaaaaaaaaaaaaatttccagatcgaatggacagaatggaagtgcgcaacaccatttccatgtgtgcctccattttggcgatcgtgatcagcggcgcagtttttttttgcaaaaagtgatctgaattttttttttttgatgacaattttgttgtaaaattattttgttttggcttatttatttgtcagttccaaaaagcgtaggatttcgcttttcaatattacaaatatttcattattttatcactgccattgatttctgatttgctaatttgtccgtcctgacgaagaggcatgaaatggtgagtcgaagcgtgaagattcttcagaatgctaaaaccaaacttaggctctttgcatgtggcaacatggagaagaggcactggccaaggcgttggtggcatgtcgcatttacaaaagtttggccaatgaggcagcggaggattacttggaagtggaagtatgtgaggaacttaagacgtatgccgaagtgagcaaaagcattcaactccttaaatcacttgcttaattaacaatttgcacgcttttcaggagtttcggcaactttcactggaattgctcgaccattgctataaagaagatgacgcacaaacgcttcagttgctgacatacgaacttagctattggggccaccagacatgcttgtcactggccgtcattgtgaacaacaagcaattcctggcacacccttggtagcagttcttagcattgattgctgctagtaattgtcatgcctttttagctgccaaattttgttggccgacctttggcacggcggtctccgtattcgaagcaactccaacatcaaagtgctcatgggcattctgtttcctccctcaatctttctgctcgaattcaaatcccgcgaagaattgctgcttcagcctcagaccgcagctgaacatcagaaggacatcaacgaatcgtcgtcgtcctcctcagattcctcctcttcgtcctcgtcttctgacagtgaaaacgacggcgacgagtcggacgcgggcgaaagaggcggtgccacagccgaagagcgccgacgcacgtcgcattcgcacggaagcatgcagtcgttgaacttcacctccgtaaaacactccatttgcttacatatggtttatcttcggttatttttcagatctttaaaagtaagcgcaaacgccgtcgtccttcccactcgcgttcttccaccacggccaaagaggacattgagatgagcaaacagaggaaccgaggttggtggttgcctccgagtggtccaatccccgttcgaccacccacaacttctgcttagattgccaatgccttttagtgacgagtcgcagttggaggctttacacgctgttcaatgtggtctactggacttattacatgttcattgccaagtcgacgacgtga

SEQ ID NO: 47296 - DNA, 1030 bp, Heterodera glycines
  Genomic contig location: Contig_ID=SeqID_15481; Location=2127..3156; Strand=+
  SCN-specific regions: Sequence locations=1-45,67-123,145-284,313-1030
  Gene Ontology: Mol. function=protein serine/threonine phosphatase activity; Cellular component=cytoplasm; Biological process=cell cycle
atgcagccgacgctcgtcagaatccacccgccggccgtcatcgtgggcgacatccatggacaattcgcggacctgaagaagatcttctcaacgcatggcctgccgccggagcagcagtacgtcttcctgggcgactacgtcgacagagggccccaatcgatggagacgatcatcctcctcttctgctacaaggtgtggtttttgggggatggggggagggaacccccaaaaaatgaaattcatttccccccatttttcaggtgaagtacccgtccaacttcatgctgctgcgcgggaaccacgagtgcgccaacatcaacagagtgtaagtgaaaaagttttttgtgtgtttttttgtgattaatcattcccccccccccattttcagttatggcttctacgatgagatcgaccgccgttacccgcgaccgggcgctcgtcgactcttcgacctcttcaatcaagtcttcgcctggatgccattcgtcggactggtcggcgagaagatcctctgtaagttttgggggagggcaatttttggggttcaataactgttttccaactgattttcaggcatgcacggtggcatctccaatcagatccgcagcctggaccagctcagcaacttgcttcgcccgcagaccgagccactgcttcgttcgctggaaattgacctcctctgggccgacccgtcgacgagcatcacaggcgtcgccccgaacaacagaggagccggcgtcatgttcggcgcggacgtggtcgagagcgtgcgcaacctgctcggcatcgactacatcgttcgagcgcatcaagtgagttttttttggcttttcatttcacttttgctttctataatttttccccttcccttctttttcagctcgtcatggacggcgtggaatacttcgcgaatcgccacctgatcaccctgttctcggccccccgctacaccggcaagaacaacacgggcgccacgctgctgatcgcgccggacctgagccacacaatcacgcgcttcccgccggcctga

SEQ ID NO: 47297 - DNA, 1506 bp, Heterodera glycines
  misc_feature (138)..(138): n is a, c, g, or t
  Genomic contig location: Contig_ID=SeqID_250; Location=8..1513; Strand=-
  SCN-specific regions: Sequence locations=1-173,195-560,584-599,621 -794,816-898,920-927,951-981,1003-1506
  Gene Ontology: Mol. function=FMN adenylyltransferase activity; Cellular component=cytoplasm; Biological process=lipid metabolism
gatttgactattttcttttatacaatacgaaatgtaatgcatgcccggtgttccacactttgtgagcaaaatttcgtcacttgaaggtaacgagcagaagaattaacgccaaatttaatccaaataaaagtgaattgntaatagataatcaaattgctgtttatttttcgcgtaatgtttcaaataagtaaattcgctttgagggatggagaaagaagccaactaaagataaaaaagacagactcggagatagaaatgagatgcaagaaatttctcgccttttaatactattttttaattttaggactacctattcccttcgtcacttttggaaatgtttacgaacaatttatacttaaaaaagagtgaaattcatttacaacaaaaactgtcgcaattggctgccaaacatcaaaacgtctcaattgggtcgtatccgaccatggaaaacaagtaaacttgaaagctttgtgtcgcagctttatttacctttccgtcagttattttaaaactcgtctaagcattgaaagcatttcgaaggaattaggcaatttggcttatgaagaattggcaaatgaattttcaggtaattttccagataaattaaaagtaatttccaattcattcaaagagtgggtggtgaattacgatcccgaaccgtgggaggattgtgtccataaattggacatttattgcgcgactcaaaccaaggaattttctgtcaagcttttcaatgccatcgcaacaattgacgaaattttggacaaatatgggtgagtgcatctcaatctaaacatcctccccctccccctcagctctttggatcaattggcgatttcattcaatggaggcaaagattgcacgcttcttttgcatcttttccgcatttgtgttactaaaaaattcgggaaagaaaagcgaatcgaagggtttttcgtagaaggcgatgagttttgcgaattaattgcatttgttcggaatatttccccaaagtacttttgctactcattattagcttacataaaaaactcatttgtcgttgtttagctactcgttggatttgctcgagctgaaaggcgctttgaagaaaggattggctgagttgaaagtcgttcgaccgaacattgaggctgttttgatgggatcgagagcgacagatccgagagggcgcttcatgaagagtaaatgcgaatggacagatcagggttggcccagtttcttgagggtcggtttctttgaaccgacgtttctgttaactcctctttccatttttaaaggtttgccctttgttggactggacttacaccgaagtttggaagttccttagggacatgtccatcccgtactgccatctctacgacatgggatacacttcgttgggggaatgctcaacaactgggaagaacccagcactgaaagtggagggcacggaggacaggtgcttattttgtgaatatttacaatagggttttttcagcggtaaaaaaagggagcggtgttattttc

SEQ ID NO: 47298 - DNA, 619 bp, Heterodera glycines
  Genomic contig location: Contig_ID=SeqID_15502; Location=418..1036; Strand=-
  SCN-specific regions: Sequence locations=1-182,204-332,354-619
  Gene Ontology: Mol. function=general RNA polymerase II transcription factor activity; Cellular component=transcription factor TFIIE complex; Biological process=transcription initiation from Pol II promoter
atgtctgcaaataatggaaaggaagataagaaggtgctaacagaaatacccgaaaatctcaaatatcttgtcatcttgctggtgaaaaatttctatgggcctgaatattacgttctctgtgaatatatacaaaagagggtcatcatcaaagaagacgaattgcgtgatctatgtaaaattgaccaaagacaattgagaaagttcctcattacattaaaagtttttttttaaaattttcttttgttttcgttttgttaatttttaggttgataaaattgtaaaagagcgactcgttccagaagaaggtatgtatatgcatataacatgtgttctttatatgtataaataaaatttagtcgatggaaagctacgaaaagtaaattaccttttcatcaactataaggccgtgattaacgtagccaagtacaaaatcgatcacattcgtcaaaaattggaggttcgcgagaaggatgatgttcataagtacgttttagcaacttttttatctacaaattacttaagagcacattatcgctgtactggagcgaattgtaaaagacaatatgatgcaatggatattggaaaaatttacgatcctttttctcaagaaatgaggtag

SEQ ID NO: 47299 - DNA, 1303 bp, Heterodera glycines
  Genomic contig location: Contig_ID=SeqID_15507; Location=522..1824; Strand=+
  SCN-specific regions: Sequence locations=1-355,377-640,662-698,720 -1303
  Gene Ontology: Mol. function=chaperone activity; Cellular component =actin filament; Biological process=cell organization and biogenesis
atggacgttgagcaccacgtggctaaattgatggttgagctgtcccaatcgcaggacgacgaaattggcgatggtaccacgggagtggtcggtaagtgacaaagtgcgtgctgtgctcattgtaagttttgccgaatccatgtagtgttggccggtgctctgctcgaacatgccgagtctctgctggacaaaggaattcacccgacgaaaatagccgacggattcgaattggcatgcaaaaaagccattgaaaagttggagtcaattgcgcaacaatttcccatcgatgacagagaggcgctggtcaaaagtgcgatgacttcgctcggctccaaagtgtgcgtttgtctccaagttttgagttaaaatatcattttagtgtgaacaaatgtttgcgccaactcggtgaaattgcggttgatgccgtcctttctgttgccgaccttggacaacatgacgtgaacttcgagctgatcaaagttatcggaaaagtcggcggacgcatggaggagacggcactgatcagaggagtagtcattgacaaaactttggtgagttttaaggattcattgaaaacaacgcctttcaaatgtgcagagtcacccgcaaatgccgcgtcgcattgaaaatgccaaaatcgcaattttgacgtgcccattcgaaccgccaaaaccgaagacaaaagtgagcagattttcaaaccaacacaagaattaaaattgatttcaagcacaaacttgacattgcttcaactgacgaattcaaacaattgcaacgttacgagaaggaaactttcgagaaaatgattaacgaggtaagcctttgttcccgagacaacccaggggtttggcatttcccacacgaagattaacgattttaactcatttcccaatcttttgcccatttaaaattttttgtttgttaggttaaatcatgcggagcaacgttggcattgtgccaatggggttttgatgacgaggccaaccatttgctgctgcacaaccaattgcccgcagttcgatgggttggcggaccggaaattgaagtattgggaagtaaataaccgcggctgaaaaatttttgttttcagttggttgccatcgcaacaaatggtcgcattgtccctcgctttgccgaattgactcccgagaaactcggctcggctgggctggtgcacgagctgaaattcggcacggacaacgagcaaatgctgtgtattgagcaatgcccgaacaatcgggcagtgactgttttgattcggggaggaaataaaatggcaatcagaggactaactgaagaatga

SEQ ID NO: 47300 - DNA, 1086 bp, Heterodera glycines
  Genomic contig location: Contig_ID=SeqID_15508; Location=1..1086; Strand=-
  SCN-specific regions: Sequence locations=1-136,160-234,256-416,449 -1086
agttttgtcgatcggcatttcagtttttttttgatcattttttcggtattttatttgataatactatcaagtcgctcgtccggctttataaatattatttgacaaattgttaattgttcaggacggcgacttcggtcaggagacggatcttttccacagcatttgcaacagtgcgttgatgcttttggtgcaggacgccgaaacgatgtgcgagccgtcattgcaggcgatgaacaaaataaagtgaccaaaaaagggacgggggattcggcgaagcgaatgaaaaacgtttttcccttttttgttggtcaaatgtcgaccaagtgggcgatgagtcaccgtatgtttcgacgatccgaaaaaatctgagggcatccgttcccctaatacgcgactacttttccgaacggtttgtcattttaattaattttttttatttctaaatttagtcgaaaatatttcgcccatttctgtctgaaattagcctcccaattggtcaatcgttttttgggcgcccttttcaaatgtcgtccaatttccatcgccggtgctgaacaacttttgctggacacgcactctctaaagacttttctgctcagtttgccctccgttgaaagtgccgtcgtcaccaaaccgccgacgcaatacacagccattctcaacaaagggatgacaaaggcggagatggttttgaaggtccatcttttttaaaaaatagatttggagcgattagttttgcaccttttcctttgatttgaggcggtgatggctgacaagtcaaatcaggaggaatttgttgcgcatttcattcgcattttgcccgattccgatgccgctgagttacagcggattttggagatgcgcccaattcgaaggaatgagcaaaatcaaatcatccaactttacaagaccaaagttgaaagtccgtccgttttcattttaaatgtgccaaagtttgaatgggctttttttgttaaggtgcaaatcccacgccaattggcactttgtccgtaagtcatcagccattgcctacccaatcggtgtactcctctctgatggcgagcattggcgactcgagcatgagaa

SEQ ID NO: 47301 - DNA, 917 bp, Heterodera glycines
  Genomic contig location: Contig_ID=SeqID_15538; Location=331..1247; Strand=-
  SCN-specific regions: Sequence locations=1-167,195-294,317-392,430 -510,535-557,580-726,748-803,826-917
  Gene Ontology: Mol. function=structural constituent of ribosome; Cellular component=cytosolic large ribosomal subunit (sensu Eukarya); Biological process=reproduction
atgccaatcaaagcatccggagaaactgtaatttttaaaatttggtctttgtggaaatcctgtcttttcagttaagaaagtacatcgttgttggacgtaaactcccaactgcaaatgactcaaatccgacactgcatgaaatggttatttttgccagcaaccacgtcgttgctaagtcccgcttctggtacttcactagcatgttgcgtcgtgttaaaaaaacacacggagaaattatttcatgtcaagaggtatgaaggaaaagggataaaaactcaattcgtttgtcaattcgtttttgttttaacttgttaatgtgtatgagatatctaacttctcgatgtaattgtaaaaaaagagagcgtccaaaacgagttgggcgtcgtccgttttaagactgaaaaatatttaaaaataactgaaaatgttgtaatgattgatccgcgcaatcacttacgtttaacataaaccaaatgcgaaaattaaggtcttcgagaaaaagcctggctccgtgaagaactttggcatttggctccgctacgattctcgtactggacaccacaacatgtaccgcgagtatcgcgatgtttgtgaagcgggtgctgttacgcagtgctatcgcgacatgggcgctcgtcaccgcgctcaagcggatcgcattcagatcatcaaagtgcaaaccatcagtgtggcggactgcaagcgtgccggggtgaagcaatttcagaactccaagatcaaatttccgcttcctcaccgtgtgaattccaagcgacgcaatgttagccaatgccattacacctattttttacttttatttctcatttagatgactcctttcacgacacagcgtccgagaactcattttgtgtagagaaagaaatgagacgacttgtatttccgatttgttgattaaa

SEQ ID NO: 47302 - DNA, 2289 bp, Heterodera glycines
  Genomic contig location: Contig_ID=SeqID_15545; Location=1050..3338; Strand=-
  SCN-specific regions: Sequence locations=1-415,439-590,661-1223,1265 -1403,1425-1883,1905-2064,2086-2289
  Gene Ontology: Biological process=protein folding
atgctccgttatgtctgcctttttccacggaggtcgtttcatttcagcacatttttgcccaaggattactacaaaatattgggcctatccaagacggccaaggagtcggatatcaaaaaagcatattacgaggtatgcatttttcgactccatgaatggctttggtcaacataaaaacaaaagaattttagatggcaaaaaaataccaccctgacgtcaacaaagcgaagggcgccagtgaaaaattccaggaactctctgaagcgtatgaggtaatcattttggaatacaatgataaatggcatcgaaatccttagtttttttgggagtcggtggtaaaataaacaacaaaaaaaatgctaggttaattgaaaaatgtttggcattgaagttgaaaaaaaatcaacaaaaatgacttgagaaattcaggttcttggggacccgaaacgacgcgctgaatatgaccgttttggggccggcggtccgcagcccggcgcggcctctggcagccccggaggtccacaaagtgcccgcgactttggctgggagttccactcgggcaaatcggcggagcaagtgtgagtgataccattatattattgtataatataaattataaaagcaaaattttaagaaaatgaatacattatataaatattagcaaaaacaaaaatttttttgttgctatatttacaaaagttggccaaaaagccgaaaattttggttttttggctaaattttattttctatacaggttccgtgacattttccgcgacttcgacccgttcggcaatgccggcgcgtttggctccggccgccgttcctttggcgaaacgcagcacggttttgacgcagcacaggaagtggtggtcaacgtcaccttcgaggaggcagcacgcggtgttcgcaaggaagtgcgcatcaacgttggtactgtgttttgttgtttatcattgtttaacggcaacagcttgttttcccactcacccccccccccccacaaaaaaaactacgatttttttttgtaaacttacaaacaccctttaccgatttttttgtgtcaccgttttaaggaaattaatgtgccgtcggtcggtgtcacaattagcagaaataaatctctctttttttaatattaaccatgatattttttagtggattcctgttggaaatgcaacggcagcggtgttcagccagggtttaagaaggttttgttatctcgccaacttttcaataaaacttttttatgtttgtattctgttcaggtgtcttgtccgtactgcaatgggacgggtatgatcacacagcacactcaaggctacttcgtacagacaacttggttcgttttgtctatgtttctatcgtgtccatgcctttgcgcttatgtccaaatttcggatttaaatttggggtttttatttattgtcataaaggtcagacattttgccatcgcttttttacgactttatactcataccctttcatttcatgcatttattttttctttttagctctcgttgcggtggccaaggtgcctacaacaaaaatccatgcttggaatgtgagggacatggccaaagtgtgcagaacaagaacttccatttggacattccggccggcattgacaatggccaagtgctgcgcacccaagtctcacgagtcagttcgtttttttcggggggggggggtggtggaaatgtcgaacaattttgcaaaaatgccgggaaatttttttctcttttaacttttcgtttcatacagtcaactgtgtatgtggtggtcaatgtggcaccttcatctcagcaccggcgtgagaaggagcacattttcactgaagtggagattagtttggcacaggtattcgaattttcatgcaaatggtaaaggagggtgggggagagagatcatagtcgatttccattgctcctatcaagaaatcaaatatgtacccacaaaattggtaatttgtacgcttaagaccccattccctgttttaaactttcggagttacagttcgggttgttcccttgcaagttaagtcctagtggggggagcacttgctcgttttttatgatgtgtaaactttctctcattgtgcaggcaacgcttggcggcacaattgacgtgccaagcatatccaccaacaacgatggcaaaacacgggtgcacataccggccggcacgtcttcccatgcgcaaatggtgctcaagggcaaaggaattaaacgcctggagcagccgggctatggtgaccaaatactcaacatcaaagtgaatgtgccgaagtga

SEQ ID NO: 47303 - DNA, 1966 bp, Heterodera glycines
  Genomic contig location: Contig_ID=SeqID_2463; Location=856..2821; Strand=+
  SCN-specific regions: Sequence locations=1-129,151-181,203-517,540 -623,646-1130,1152-1361,1391-1715,1763-1966
  Gene Ontology: Mol. function=poly(A) binding; Cellular component =cytoplasm; Biological process=muscle contraction
atggtgtcacacatggatgaggaactttcatttgaagatgaggaacaagaacctactccgaacggtgcgccggccggttcagtgtctgtcacaatgtcggaagacaatgtaaaaacattcaaaacttgggacaattcaaatcgcttaaaatgaccaagggggtaccaagttgagaggccagcatttggtctttaaagtcttggtaacaaaaaacgaattcagaaccaaccgattccatggaaaaattgcaaatttttgccattttcaattgcaaaattgtttttttaggattttgacgacatcaatgagaagctgcaacagatgagcaagaggcgcaaaaaattcgtgaaatgcaaaacgaaatggagaagcaattccagtccggcactgccgtgaccggcaccggcagtccggtgataccgaatccgatgtccctggaggagaagcaattggtggacgcacgttccatttacgttggcaatgtatgtaatgggtttgtgagtggcgccccaaaactgaacaattttcatatctttggtacattaaaatttgtcagcaaaattggggttagtccttttgaagccgcactttcaaaaatgtgccgccattaattccgaaaaatcaaattgcatttgtttttctttcatgagtcaaatttgtctaatgggttatgtttagttagacttttggtaatattttcggatgcaaatgaacaccctctaatataaaaggatcgaaaattggtaggacaatttcaaattgaattttcatcacccggaaatcgcttaggaccgacacctgcaaaatttttcatttttttttttttttgctcatttaagtgcgaggttcttttttttgaacagtttatcctattatacgaataaaagtattcttataccatctatcaatcttgtggttttgatgactaaaaaaatgtgtaaaatcttcgaaaaatattcaaaaaattataggtattgcaaaatagcaattgtcccaacaacaatttatacaggtggactacagcgcaacaccggaccaattggaggaacacttccgcggttgcggtgccatcgaacgcgtgaccattctgacagacaaattcactggccatcccaaggggtaattaattgctgttttcttggtccattcactcttaccaagaaagggagaggagattaaagttacatataaacaaaaatttttccatttttttaccgttggatttcgcatttttgcgcttttaagagtcaacaattttcattattcaaaagctcattgtgagatcgaaaattgatacaaaagagttaaaaatgagacctaagacgttcgacaaaatttatcgagttcaaaaaccgggacgcaaaaaaaattttaaaaaagttttaaatttcgggaagtgggggaaccgcgggggttggtaactgattgtgagtcttgaaacatatatcttaaaaacgaagtacatcccattttctaacacattttgctattttctggcttcattcactcttgccaagaagggtatggaagagccatgagttcgcataaaaaaacaagaattcccccacttttcaaccgtttggtttcgctttttgcgactttgaaagttgaaaaagtttcgaattttcgagacctgattatgaggcagagaattgacaccaataatcttaaacgagacatcgcccgtgaaatttctcgagtcaaaacccgaaacgaattttttttttttttgaaaaatttctgaaatttttttttaaattttcggggaagaaaagcggaagggggcgggcgggactgattataataatgagaggggtacattactaattatagcccttttgctaacacattttcatatgtttgccacatttcctccagtttcgcgtacatccaattcgcggacgtggacgcggtgaacacgtccacctcgttgaacgactcgctgttcctgggccgtcagatcaag

SEQ ID NO: 47304 - DNA, 1018 bp, Heterodera glycines
  Genomic contig location: Contig_ID=SeqID_15625; Location=954..1971; Strand=+
  SCN-specific regions: Sequence locations=1-1018
  Gene Ontology: Cellular component=cytoplasm
atggcggagaatcgacgggaggaactgccacagattgacggactgaccagcgaacaggtggggagagcaaattgcaatgcaatgaacatggattgacaggtggcagagttcaaagaggcattcgaactgttcgacaaaaacggagacggacgagtgaccgcctcagaagtaaggaaaatggcaaagtgatcggcgatcaaagcaaataaacaaaaaacatttagcttggcattgtgatgcattctcttggccattccccgaccgaagaagaattgcaggaaatggtgcgcgaaattgacgaaaatggtcagcaattaaacgatggactgatcgaatgaaaggaaaattaaccttttcaatgttaagggaatgggagcattgaattggacgaattcattaaaatgatgagccgaaaggagaaagagtcggaaaatgagaaagaattgcgggaagcctttcaggtcggactgactgatcagagctaatcaataatcaatcaatcagtaaaaagaagtgattagaactaatcagccaattgtgatagaagtgatcaaaccttctcaaattgaaattttaaaggtgttcgacaaagacaacgacggttttatttctcccgttgagcttcgctttgtcatgcaaaatttgggggaagaactgacagagagcgaagtgcacgaaatgatccgcgaggctgatttggacggggatggaaaagtgaattttaacggtacgaggaatttcttcagctttttaaactcaccaatacaaatttcagaatttgtatttatgatgaggcaaaaagtttaacggaagagagagagagaaggaagagaaagaacgactgataaaaccaacaaaacttttcaacgggtcatacaaacaaacgccggcggggctttcaggtgcagcggaatacttttggactttttggcacatctccttttggcattccatcacaaaaacaaaaaatattaacgtaaatttaatttctataaaaagcacctgaaactctggtata

SEQ ID NO: 47305 - DNA, 1029 bp, Heterodera glycines
  Genomic contig location: Contig_ID=SeqID_15636; Location=409..1437; Strand=+
  SCN-specific regions: Sequence locations=1-141,165-173,195-212,234 -417,439-1029
  Gene Ontology: Mol. function=structural constituent of ribosome; Cellular component=cytosolic ribosome (sensu Eukarya); Biological process=protein biosynthesis
atggtatgccgttttcctatttttttatctgataatttttttaggcgattagcaagggcactaaaattacgccaaaaggtggtaagggcggcaaaggaaagaagaagaagcttacgctaaagtttgtgatcgaatgcaaaaacccagtggaggatggcatcatgaagactgccacatttgtgagtttggtttttgggcgcatctgctttatgttgatagatttcaatatttatgtaatttttattttgccatagttaacggttctcgcgagcgtaggggcccattccctagtcagcctcgtcaacactttttaggaaacctttcttaacgaacggatcaaagtcggcggaaaaaccaatcaactggcggctaatggtgtcaaagttgaagccacgaagacaaaactggtcgttacatcggagcagccattctccaagcgttacttgaaatatctgacgaagaaatttctgaagcgcaatgctctccgggattggttgcgcgtggtagccagtgccaaggacacttatgaggtttggttttcttatcaccaaaaaagggtggatgtctttttcaggggtgttaaaatgcagttcggtccccctcacatttgtattaaattgaggagagggtcggagtgtggttaggctatatataacacagcaaactagactcattaatccatttttaatttttagcttcggtacttccaaatcaatcaggaagatgaagatgaaagcgacaatgaagcatgagcgatttgccatttcttttgttgggtcgtattatttgttgcactttttaccagcgataaaaacttgttaaaggaattgtttatgactaaaaaatacatgataattgggtaagctcaatgagtcttatttgatcaaaaaggattttctcagctcctgcaatcgctttcttgcgtcgagtactcgccgttcctgggctaatatgtcttgttccgtgatggttggaatctgaattagaatttgtctaacataaacagaatttaatttcattcttcccata

SEQ ID NO: 47306 - DNA, 1924 bp, Heterodera glycines
  Genomic contig location: Contig_ID=SeqID_2481; Location=7766..9689; Strand=+
  SCN-specific regions: Sequence locations=1-275,298-433,455-693,716 -890,913-959,1036-1120,1142-1276,1298-1313,1335-1358,1399-1695,1717 -1847,1906-1924
ttcaccgattcaatcaaaattgccttttcagtaataacttaaattggaacaaaggcagtgtcctcgggcctcttctttttttgatttttataaatgaccttactaattatattccgcctgaagtcggaattaaattgtatgccgatgatgttaaaatttacatttcgcatgataatgacgcgaaaagggatttactctctttagcgttggctaacttagcaaatggtctaaagacaatggcatagccattgcgcatgagaaatgcgcagcattatatttaggaaaaaataattctagactgagtataaaattggcgagaaagtaattttaagcgtagattgtgtccgtgatctgggggttttggttgatcaaaagctctcatttaacaatcatatttcaaaaattttaaaagcggcctattacaaggcatatcaaattttaaaaatattaaaaacaaggaatatcagtaccttaatcctagcatataaaagctatataagacctcacctcgaatacgcatccgaaatttggaatatctcctcaaaagaacagagtaaaagaatagaaaaggttcaaaaatatttcacaagaatcgtatacaaaaaatgtggcctcaaggcaataccatatgaaaaaagacttgagatttgcaaattggagaaattaagtactcgaaggtcgctcactgatatgaatatgactttcaaaataattaggggcttaactcatttagacccaaaaaaatatttcgaattttcttcaaggtcgcaacgaaaaacatttaggattcaaaacaaaagattcagtaataaatctcgaaataacttttttattcgtacaattaatccctggaattgtctacccaaaacggctatggaaatcggaagtttagctaaatttaaaaattttctgagagaattttatttagaaaataagtcctgagtggtaattcatcccttttttattttattttatgtattttactgtattgaccatatcatatttttttttaaattgtattcattactttgttttccgctataagtgcaattacatgttgccttgcggtttgctcaaataaataattacaactcgccttttgtctccttctccccttgctcttttggtgtttttgttgtccctccaattcaccgattcaatcaaaattgccttttcagtaataacttaaattggaacaaatcctattaatatttgacagtaattataataataatgttacggtaggtacagtaattaaccattgctcatttcccttaactatttgacagtaaaccttcgtctgcactttcacatcaatttgtgccatgacatttttctcaagcttttcttgaaatgccatctgctgaaattaacagatttttctttttgcaaaaagcaatctattttctaaaacattaaaatattagtgccaaaaattttttatttttgtgtttttgtaagtgatttataatttgaccccaccgcgtttaattttttctccattttgtccatttttcttctccatttcattgtgatcatttttcatgttgtcatcattctccttttcggcatcagcgttcgtctgtagcatcttttacggcattttagcaaaaaagaaaatcaaattcaaaatgtgctgatcaatttgcttcattttccttttttcacattttcccaccttttccatctgatcaatgcttttctgttgttctttctgctgatgatccatttcgaccaactttttctgtaattcctccaaattcttctccaattgctcctctttcttatcaaatttttcctgcattttttcaatgccatttttgagctttcgattctcagctttggccataaaaaatgaaatctttttaacaaaaattttaaacaaaaataaagaattaaaattttccctgtactactgttgata

SEQ ID NO: 47307 - DNA, 1406 bp, Heterodera glycines
  misc_feature (29)..(29): n is a, c, g, or t
  misc_feature (815)..(816): n is a, c, g, or t
  misc_feature (875)..(875): n is a, c, g, or t
  misc_feature (892)..(892): n is a, c, g, or t
  Genomic contig location: Contig_ID=SeqID_15683; Location=345..1750; Strand=-
  SCN-specific regions: Sequence locations=1-634,656-1406
  Gene Ontology: Mol. function=phosphatidylinositol 3-kinase activity; Cellular component=membrane fraction; Biological process=signal transduction
acagtgatcgctcatccgttcggcaacgnccgccggaagtccaaactgcagtttcggcaacagtcgccccggcggtgtcgtcgccgaccgcgtcgatgcttctcggcccaatagaaacaatggcaatgtttggtgcgcaagaatccatggatttggccacctttttgatccgcgcggcctgtgagaacagtctgatcgccaacttcctcttctggtatttgaaggtacgcacagtttggacgacaaatgcgaatatgtttttgacattttgcgtagttttcctttatttgtgcaatttggtttcctttaggttgaaatggaggccaacgcgacggacagtgacgagacaaatgcgccgtcatcagtctccgccatgtactgcttggtgatgggccgcttgaagcaggaactgtccaagggaaacgggtcggcacggcacacactgagcacaatcgcaacacaaaaagtgagcggacaaaaggggggttgggtagagagtgcgtttccagggcggacgtacccgggtaaaatttccgaaaaaaaaactaaattttgcaaaatgaagttttttttaccaactggggtacccccacagccctcaaaatcatgggaaagggggaaagaacagaaaagatgcattttgtccttcagaaatttgtcgacactttggtggacattgctaaagtcatttccgatttgagcggcagtcggtccaaaaagcaggaggtgctgcggaagaaactgtcggagaatgtggatttgacggaattgaaggtgattttctgtcatcgtttggtccgctttaccccctcccnncagggaagggtgatttgctagggacttgccaaaaaactaaatcatgttggttcattgcncctgataattgtctccncattttctcttaagggtctcggtcttccgctcgacccgtccatccacgtccgcgcggttcagcccgagtccgccgtgctgttctcttccaatttgatgccgatgcgtctcactttctccaccgtccgtgacgcgctcacgccgtacgaatgtgcggaggcgtacaccaccattttcaagcggggcgacgacttgcgccaggaccaattggtgctgcagatgattcgactgatggacgagctgctcaaggaggacaagttggacttgtgcctgactccgtacgccgtgttggccacgagttgttcagaagggtgggccatttcaaaacgtaccaacaaaataagtaaatgagtcgttttttcaagttttgtccaattcatccgcggcgccactcctcttgcggacatcaaaagtattcaagttggttggttttcactttttcctcatgagtttctcacttctttccaggacacactgcgcacattcagaccgtgttcatccacaccttacggtaa

SEQ ID NO: 47308 - DNA, 1242 bp, Heterodera glycines
  Genomic contig location: Contig_ID=SeqID_15699; Location=1342..2583; Strand=+
  SCN-specific regions: Sequence locations=1-663,686-692,714-747,782 -887,909-1242
  Gene Ontology: Mol. function=transporter activity; Cellular component= COPI vesicle coat; Biological process=exocytosis
atgccattgcgtttggatgtaaaacggcgattgctggcgagatccgatcgcgttaaatcggtggatttacatctcaatgagccttggatgttgatttcactttacaatggctttgtgcacatatggaattatgactcacaacagctcatcaagtcatttgaggttgtcaaaattgttctttttctacaatattttgatagagccttacaatttcaaggtttgtgatctgcccgtgcgtgctgcaaaattcattgtgcgcaaaaattggatcgccactggttctgatgacatgcagttgcgcattttcaattataacacgttggaacgtgtacatcaaatggtttggttcataaacttaggctaaataagaaaatttacaggaagcgcattccgattatctccgatcccttgccgttcacccaacccaaccatttttgctgacttcatccgacgacatgctgatcaaactatgggattgggaagacaaatggaagctgaagcaaacatttgaaggttcgaactggtttttgtcgaccatgggctataaccaaatttctaccgaattttttaacaaattttgtcaaaaactgcaactccgttcatgattatccgaattgagtgattttgctttcgacggccccgagtattctcaatttccggtgcaaaattttattaattttaaaaagattatgaacaaaaatgtttggaaaaccagtttataatacaacgaaatttttgaaatttcagtaaaataaatattttatgatatttaaattataaagccaaaaactggctcgggccccaggtgaccaagtactgcctgtaggcgccgtctgggaaaaacgaaagttactaaaaaaactatttttctccatgacatttacaattggatttttgggaaattacaattaattaaaaataccaaggcttttaataaacatttcttattttcttgcataaaggttttctcaatgctttttaaatttatcatcttaaggacacacacattacgtgatgcaattggtgataaatccaaaagacaacaatacctttgccactgcatctctggacaaaacaatcaaagtttggcagttcggaagctcagtgcccaattttacgcttgagggtcatgaaaaaggggtcagtccatggatcccactatcattcgaactttgggtaatggtttatcgaaataggtcaattgcgtcgattattatcacggaggtgagaagccctacttaa
